United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 13

SEQ ID NO: 63001 - DNA, 264 bp, Glycine max
  Peptide Sequence Number=SeqID_154686
atggatttgaggcttttagtcctcacgttagtttcacaccttgcggggcaggatcaccttgggctaccttctggagtgaagacaaaacatgaatcggcagaaaccaatcaaggtagggtacttaaggatgaacgcaagcggggatggggtcacgaccgaccgatcgttgctcttctctgtgcgaaacaagcagggaatgtcgctgcaaggcagctccgtatcctttgtattttgcagctttcttttactatttgtttgttttaa

SEQ ID NO: 63002 - DNA, 509 bp, Glycine max
  Peptide Sequence Number=SeqID_154687
gggcattcgtaatggcatcattggaggtttatcatgaatggctgaaagttcgtacacgaggtttagattggcttgccaagctaaagattatcaacgaagagaacttcgaagctccggaagaggatgaagaagttcgagctttgaaaaccgaactaggaaaagcaagacttgccaaagaaaaattcaaattggtcgctacagacatccgaaaagagtgtgtcgggttacgagaagaaaatgcagctaccgcaaaagcccttgaacaagaaaccaagagggctcgcaaggaagagcatggccgtgacaaattccatggagcattgtggggcagcaacacccacgagcatagggtggcaaacgagtatgcccaagtgtacgcggaaaaggaggctagaggaagggtgatcgactcgttacaccaagaggcaaccatgtggatggaccaatttgctcttaccttaaacgggagtcaagaacttccccgattgctagccaaggccaaagcaatg

SEQ ID NO: 63003 - DNA, 399 bp, Glycine max
  Peptide Sequence Number=SeqID_154688
atgatgacaacaaaagatgatgacaaaaagctcaagagaatcaaagaacatccatctcaagaaaatctagaacaagtcaaagagttcaagaatcaagaagaattcaagactcaagaagaaagcctacaaacaagaatcaagattcaagatctcaagaatcaagatcaagattcaagaatgaagaaaagactcaatcaagataaagggtacatctacttggatttgactgagaacaagagagggtacatctcttgtggatcagttctagtggagggtacatccactaggttcaaagagaacaagggagggtacatcccttgtggatctttgcttgtaaaaggtttttacaaggttgaaagaaatcccaaggaccgcaggttgcttggggactggaggtag

SEQ ID NO: 63004 - DNA, 525 bp, Glycine max
  Peptide Sequence Number=SeqID_154689
attagtgccattgtcagtaatgatcttcctagggagtctgtaccgacaaatcagctcactctatatgaatttgaccaccacactcctcatgacattcagaggatgtggcggaacattgacattgtccgcgaacgcttgacatttatggcatttccttacatgggtgcaacaatcgctttccatggtgagccagtaataacctgctctaaggatattcctggccatagcatgcccattggtgtgcgttccaaacgaaccctcgtggacttccttgatcatgtggttcgcctctttggcatccacgcatcgcaggagggtcatgtcatggcttaccgtcccattcctcttccacctaacaacaatgcgcgggtctgccacgacaccagaactcaatgtatggtaggcccccgtgcgatgttagctggaacatggatgccaatgtggaatgcgcattcgccattagattttcctcccggggaacgtgatggaaggagatctcatcaaaggaaccatccaattccttga

SEQ ID NO: 63005 - DNA, 591 bp, Glycine max
  Peptide Sequence Number=SeqID_154690
atggggacaaatcaaaacggaaaaagattctatcaagtcaagattaagggcctagatgtcaccaacctaaaggagttgggatggttgatgggacccctccaaaggcaagccttccgcaaagtgtatagaaagattttagatttgaccacagcggaggtatttacggaagccgttgtatccctcgcccaatactatgaccagccgtttagatgcttgacgtttggggacttccaaatagtaccgactattgaagaatttgaggagatattaggatgccctcttgggggaagaaaaccatatcttttctccaggtttcttccctccttgagcaagattgtagctgtggtcagagattcggccagagagttggatcgtatgaagcaaactcgaaacggcgtagtgggcctaccgcggaaatacttggaaggcaaggcaagggatatggcgagtcaagaagagtgggtcccgtttgcggatatactagctttgctaatctttggggttgtcctctttccgaacgtggacggtttggtcgaccaagccgctattgatgctttccttgcatatcgccatagccaggagagcccggtg

SEQ ID NO: 63006 - DNA, 492 bp, Glycine max
  Peptide Sequence Number=SeqID_154691
atggcgcctaccaggcaccctttggatccagataagtccaacagggccctgggatttcccgcactgatcacaggactctgccagtcgttcggagtccccgtggcagctaccaaggtgattcggccgcccatcacctgggcttttattgagaagtactacacccagagacaggctcagggtgatgctccgcaggccgcagatgcgccgccacctcatcaggctggccaggctggatcgtttgatacggagcggtatttgcggcatttggttcgccagcaggcagccaaccaccgggcacatagtcagggcttcgcttctttttcatgccctactccagaccagttcagggcagaggtcgcatggcccggggattggcccgaggcccaagcaggagaggcgcccccagaggctcccggcgatggagaggaggcccacgaggacgaggagatggccgatttgcttgacttcttgggagggagtggagctacatga

SEQ ID NO: 63007 - DNA, 303 bp, Glycine max
  Peptide Sequence Number=SeqID_154692
atgggttatggccacagtctaagcagcttcttgatgcttcagctagggaatgtacaatctgtggtggagctcatgactctggatgttgtattcctagtgaagaaccaattgttcatgaagtcaattacatcgggaatcagcctagaaatacttttaatggaggaggattcaccggattccaaaatggccagcaatatcaacaacagagacaatggaagaaccaccctggcaatcaattcaataggcctcaatagcaagggcctactctctatgagcgtaccacgaagctggaagagactctag

SEQ ID NO: 63008 - DNA, 576 bp, Glycine max
  Peptide Sequence Number=SeqID_154693
atgcagcaacagcagcaacaacaaaaacaacaagcaactgaggccccttctcaaccttccttagaggagttagtgaggcaaatgaccatccaaaatatccaatttcagcaagagacaagagcctccattcagagtcggacaaatcagatggggcagatggctactcagttgaacaaggctcagtcccaaaattctgacaaattgccttcacaaactgtgcagaacccaaaaaatgtgagtgtcatcaccttgaggtctggcaagcaaattgaagtgcctccaccagtagcagcacctgcacctgaacctgtcaagcttcattctacacctgaaaaagaggatgagatagttgcacaaaaaagaaagcttcctgatcatgagagagctaacaaaaattttcatgcaggtggaccttcttctagtagttctgacttgcagcagcctcctatccctcttccatttccacttagagcaattccaaacaaaaagatggaagaagtggataaggagatcttggagaccttcaggaaagtagaggtgaacatacctctgctatatgcctcaagcaaattctaa

SEQ ID NO: 63009 - DNA, 306 bp, Glycine max
  Peptide Sequence Number=SeqID_154694
atggagagaagtatgatagatgctgccattggtggagcccttggagacatgactcctgctgaagccagaaatttaattgagaagatgacttcaaactcccagcagtttagtgccaaaagtgatgctattgtcattagaggagtgcatgaagtagccacgaattcatcttcattaggtgagactaagaagcttgaagacctttgcccttctgtgcaacaatctgaagcaattgaacagcttgaagcttatgctgcaaacatctacaatagacctcctcaacctcagcagcaaaatcagccaccatag

SEQ ID NO: 63010 - DNA, 222 bp, Glycine max
  Peptide Sequence Number=SeqID_154695
atgggcctgatatgcccgaaagcacattcacatgacacccccgttgttactcctgaacccagccaacatgagaaggctcgcgatgcggaggagctgacggaatcatggcgtcaattattcccccttcgccttgtcggtggcatgcgaaactccggggtggttccttggcatatatcacatggcgttggttgcttcgctcgctgcactagtaattcatggtag

SEQ ID NO: 63011 - DNA, 363 bp, Glycine max
  Peptide Sequence Number=SeqID_154696
atggagggtatatccactaggttgttcaaagagaacaagggagggtacattccttgtggatctttgcttgtaaaggactttacaaggttgaaaagaaatctcaaggaccgaaattccatccatagaccacctatcttcaatggtgagggttaccactattggaaaaaccgtatgcagattttcattgaatccatatatttaaacatttgggaagcaatagaaataggaccatacatacccactgtagtagatgcaagcactagtaccacaacacaaaaacctagagataagtggactgaagaagatagaaggagaatccagtatgatcttaaagccaaaaacattattacttcagacctatga

SEQ ID NO: 63012 - DNA, 411 bp, Glycine max
  Peptide Sequence Number=SeqID_154697
atgaattgcgttttcgttcgtgtgtcctccacctttgagtttggagccatgcgtagtgattgcttagtgcaattctccattcacaatctttttcggagccccatgaattgcattttcgttcatgtgtcctccaccttcgagtttggagctatgcgtagtgattgcttagtgcaattctccattctccacttttttcggagccccgtgaattgcgttttcgttcatgtgtcctccaccttcgaatttggagctatgcgtagtgattgcttagcgcaattctccattctcaccctttttcggagccccatgaatttcgttttcgttcatgtgttctccaccttcgagtttagaggcatgcgtagtgactgcttagtgcaattctccattctcaatcttttcggagccccatga

SEQ ID NO: 63013 - DNA, 162 bp, Glycine max
  Peptide Sequence Number=SeqID_154698
atgggggattttcgcactgggctgcggtttggaccacatgtggtgatacgacttcctaagcattctggttcgccaggggagaggaagctgccttgtcatggcgacaagaacaagcctcgtcgacagtggggccatgctggcgactcggccgtagagaattaa

SEQ ID NO: 63014 - DNA, 237 bp, Glycine max
  Peptide Sequence Number=SeqID_154699
atggcctcctatggtgagataaacatcatatccttactcactccagaatcatcaaagaccacacttttatcaaaacagttcaacaagacatggttggaagataaccagtccataccaagaataacatcaatctggctctgtcgcaacctacccttcggcgggagggcgacgcgagactcgcgggatgcgtgttccacgaaaggaatacgcgcggagtcgccaccaacgtttatttga

SEQ ID NO: 63015 - DNA, 45 bp, Glycine max
  Peptide Sequence Number=SeqID_154700
atggctccggtcatgccaagtgagcagaaaggagcggagccgcag

SEQ ID NO: 63016 - DNA, 222 bp, Glycine max
  Peptide Sequence Number=SeqID_154701
atgagccagctccagtacatggtcattattggttcgttcaaggtcgataattgcacatgcaagggaaacatccggctatgtctccagagaggcatgagtcggctcagcggtggaaatcatagatatggtcatggaccaccggcaacgctaaaggcagaattaatcatggagtacgccaaggcggcagcgctaagtccagacatgaataatgatattccttaa

SEQ ID NO: 63017 - DNA, 180 bp, Glycine max
  Peptide Sequence Number=SeqID_154702
atgcagatcacattcttgcctaacgatgtacgtccgacatgtgatcgtttgaaccaacccctttcccacgcgaccgtgcgtttcgacgaggacgacctccttcaaagccttcatggatataggggtggactggactgtcatggaagctcgttgaggtgggtgaatgttgagcggacatga

SEQ ID NO: 63018 - DNA, 966 bp, Glycine max
  Peptide Sequence Number=SeqID_154703
atggctgagaagacgaagaaaaaactggaggaagttgctcaatccggaagcactgaggccgtgattgactctccatctcccattagacaccacgtgaagtggaagatggcccgcaccaagaaaactgggcagatgacatctgaggcaacaaaggaaattgctgagaagattgcgtcacagggttcctttgtcccccatggacgtgaggatgtcctcactgctgccattgggcgaccgaaacaccctggtcatgtgcgtgttggtggagccggtgtgaccatcaagcaatactttggatcggctccacggacctcccgcacttcatcctccatggctccagaagaactagagcagctgactcaacaaatcaaggaccagctagaggagtcaatcacagaaaaaggacttgcattgcctccgaagcctgaggttggtccctcagctgcgtgtgtcagcacaaaggggagttatgttggtccttcaccgactgatccagagacgggtgactcagacaaatgcgggttgtacatcgaagaaaatcctttccgcctagttgccctaggaagagtttatgagggatctacagcggttcacaacatccctttgttgcatggccaagtgaaggttggtgttgacgaggttaaagatgcagaggcccccattcctgtacccactgacgagctttttttgaagcctctacaggttatgtgggatgctaccgtgttcgaggtgtttaatgaacacttcccattatacataaagcatgaagatctatttgaaatcgcacacgatggtcaatgtctcaacatatctgttatacaattgtggattctgcatatgactgagacaagtataaagttacatgaagagttggatgcaaagttaaaaaagggatgtctaccttggagcctacttgaatggcgcacattggcacagtattatctcaaagttaaaaatcaaacttag

SEQ ID NO: 63019 - DNA, 279 bp, Glycine max
  Peptide Sequence Number=SeqID_154704
atggcagcgcagttgatccatgatcgtgttgtgatggagtgcctggaggttgagccggctcaagtgatagaggtgtcatcctctgaagaagatcttgaagaggatccagaggaattacctcttgaacctgctatggacgcccttgacttacctatgaatgatgaagacccgctccctgatgttgattccctagaggatattatgtcagcatctgaggcagactctacagaggagagtggccctggagggacagcgaatagtgatgactcttcatcgtag

SEQ ID NO: 63020 - DNA, 405 bp, Glycine max
  Peptide Sequence Number=SeqID_154705
atgtctcctgtaaagcctctagatagggcgcatcctgaggtcgatgatcccctatatctgatgacattgaccatcccacaaattttcttgaggtctctccaggttatgtgggatgctaccatgttcagggtgtttaatcaagacttcccattttacatcaagcacgaagatctcttcgaaattgcacacgatggtcaatgtctcagcatatatgttttacagttgtggattctgcatctgactgagacaagtatgcgagcggggaattctgatgtgtatggattcctcgagccacagtccattcagagatctaggcaatcgcagtttgaattggaaagttacatcaagagttggatgcagagttcaaaatatgatgtctaccttggagcctacctgaatgggtaa

SEQ ID NO: 63021 - DNA, 432 bp, Glycine max
  Peptide Sequence Number=SeqID_154706
atggaaagaaggaagaatcggggttcttatttcgtgcagaggatttccgaatgttcccttgatgggaacaaggggttgcatcagttacaatcccgtcttgctataaggcaacttggctatcctatgagaggggcaccgctagaggtagagctcgcgcctgtcatttcacgaggtttcaataagaccaacggggagacacttcagaagaagtataaagaactcaggggcagtaacaatgggcccatcggtggctaccgaaggtggttgaaagcccacgtgcaaggtttggattggctcccaagtttgagaaccgctaaaggggaggaagttgaggcaccggaggaagacgaagaggtgcaggcccttagggcagaactcgagcaagcccaaacagtcaaagaaaggttcaaatcagcagctcttaaaatctga

SEQ ID NO: 63022 - DNA, 141 bp, Glycine max
  Peptide Sequence Number=SeqID_154707
atgggctcaaaattctaccctaaggttcatgagaaccctagggccttctttagtagctctagcccaagcctcttggagtcttctatccaatacccttggggggatcgaaacttagtcttacaagagggatctatggattaa

SEQ ID NO: 63023 - DNA, 219 bp, Glycine max
  Peptide Sequence Number=SeqID_154708
atgcctataggttggacctcccagaagagtggagctgatattgaggaggaggaactaactgatttgaggtcaaatcctcttcaaggggaaggggatgatgcaatcctccctaggaagggaccagtaactagagccatgagcaagaggctccaacaggattgggctagagctgctgaagaaggccctagggttctcatgaacctcagggtagatttctga

SEQ ID NO: 63024 - DNA, 111 bp, Glycine max
  Peptide Sequence Number=SeqID_154709
atggagatcacatcctggccgcctcaacaagggcctaacatcttccagaggactaccaaactagaagaaacccctggctcaattcatgcaagtgaccatatccaaccataa

SEQ ID NO: 63025 - DNA, 706 bp, Glycine max
  Peptide Sequence Number=SeqID_154710
taacatggagagaagtatgattgatgctgccagtggtggagcccttggagacatgacccctgctgaagccaaaaatttaattgaggagatgtcttccaactcccaacagtttagtgctagaaatgatgctattgtcattagaggagatcatgaagtagccacgaattcatcttcatcagctgagactaagaagcttaaaggtaaactagatgccttggttaacctggtaacccaactggccatgaataaaaaatctgcacctgtcgccagactctatggtttatgctcctctgccgaccaccacacagacctttgcccttttgtgcaacaatctgaagcaattcaacagcctgaagcttatgctgcaaacatctacaatagacctcctcaacctcagcagcaaaatcagccacaacagaacaattatgacctctccaacaacaggtacaaccccgggtcaagaaaacagtgtcaaggacctcaaccagtagcatcttcctcattcgccaatgaacctgcccaacctcactctactccagaaaaagatgatgacaaaaatttaaagagtaagttacctaacaatttctatgcaggtgaatctaaagagaagcagcatatccctcttccattccctccaagagaaatttccaacaaaaaaatgcaagaggcagagaaggagatcttggaaacatttaggaaagtagag

SEQ ID NO: 63026 - DNA, 590 bp, Glycine max
  Peptide Sequence Number=SeqID_154711
atgggtgatcaagaggagacacaggaacagatgaaagccgacatgtcggctctgaaagaacaaatgacctccatgatggaggccatgttaggaatgaggcagctcatggagaagaacgcggccaccgctgccgctgtcagttcggctgccgaagcagacccaactctcttggcaactgcgcaccatcctccctcaaacatagtaagacggggaagggacacactggggcatgatgacaaccctcatctgggatacaaccgagcggcttacccttatggattgccgcccaactactcaccacccgtcttgcaagacgatgtgggccatattgcttctcccgtccttgaaagagagcctcctcaacagcccgacgaggtccacaaagaccctcaagactatgctcgaagggatgtcgagttctatcccccgatacccgaagggccggcacccagctcgttgcctcagcccaacatcacgacacaaccaatggttttgtccatggaaggaccgcccccggcaactgaagaaaggaggaagctcgatctcttcaaggagagattgagggccgtggaaggatttggggactatcc

SEQ ID NO: 63027 - DNA, 642 bp, Glycine max
  Peptide Sequence Number=SeqID_154712
atggccccaaggaagcttgcctcaaagagatccaggaaggataaagcggctgaaggaaccagttccgctcccgaatatgacaggcaccgttttaggagcactaagcaccagcagcgcttcgaggcaatcaagggatggtcatttctccgggagcgacgcgtccagctcagggacgacgagtataccgacttccaggaggagatagttcgccggcggtgggcatcactggttacccccatggccaagttcgacccagacatagtcctcgaattttatgccaatgcttggcctacagaggagggcgtgcgagatatgcgatcctgggtgaggggtcagtggatcccgttcgatgcagatgctctcagccagttcctggaataccctttagtgctggaggagggccaggaatgcgagtatggccagaggaggaaccggtccgacgggtttgatgaggaggccatcgcccagttgctatgtataccggggcaggattttgcccggactgctgctggaagacgggtgcgaatcatgcgcaccaacatgaccaccctgactcaaatctggatgactttgctgctcagtaacatccagcccagcgatcataattccgacctccccttgccgaagtgtcagctggtgtag

SEQ ID NO: 63028 - DNA, 1041 bp, Glycine max
  Peptide Sequence Number=SeqID_154713
atgctgctggccgggctgctgatcatctggctgggcggccacaatatggcgcaacggctggccagcatggtggccaccggcttccgcttcgaccacggcatggtcaacgacgataaaattatcgtctcgcacatcggcaacctggtgatgcaggcggtgatcgcgctgctgccgctgatggccgggctggtgatcgttgccatcgccgcgccgatgattctgggcggaatcaacatcagcggaaaatccatcaaattcgatttcaaaaagctcaacccgttaccgggcattgcgcgcatgttctccggtcagacgtgggcggaactggtgaaggcgatcctcaaagcggtgctggtggcgctggtggctggctggtatctgtggagtcactggcaggagatgctgcgtctgatgagcgaatcgccggtgaatgcgctgcagcatggcctgtcgatgaccgccatcagctgcgcgctggtgatgctgggtctgatcccgatggttggctttgatgtgttctggcagctctacagctacttcaaaaagctgcgcatgacgcgccaggaaattcgcgatgaacacaagcagaacgaaggcgacccgcacgtgaaagggcgtatccgccaggcgatgcgtgccgccgcccgccgccgcatgatggccgacgtaccgaaggcggacgtcatcgtgactaacccgacgcactactcggtggcgctgcagtatcaggaaggcaagatgagcgcgccgaaagtgattgccaaaggcgccggtgacattgccctgcgcattcgtgaaatcgcaaaagagcaccgcgtaccgattctggaagcgccgccgctggcgcgtgcgctctatcgtcatacggaaattggccagtttattcccggcgcgctctatgccgccgtggcagaagtgctggcgtgggtctggcagctgcgacgctggaagcgtgaaggcggcctgattccaaacaaaccaaaacatctgccggtcccggcagagatggactttgcaggagagaacaccaaccatggctaa

SEQ ID NO: 63029 - DNA, 1449 bp, Glycine max
  Peptide Sequence Number=SeqID_154714
atggatgtgattggttttgacgatttgccctgcaccctgagctggcgtgaagtggccgatcgttttgatccccaacagcacattagctactggtggagtaatcgcagtgacggctttgcccacgccacgcataaacacagtggcccgctcaccgcgcaacttttttcgttattgtttaacccggcggcgggtgcccagccgggacgcactggtgcacctgtcgccagacggcgagtgccgcctgaccaaccagggcagcgtcacttcagtggtgctgaacggcgtggcgctgcagcgcggctcgcaggtgcggctgcgccacggcgatacgctgcagattggcgaatatggcctggaagtgccgccgccgatccgctgggtatgcagcaggacgaaagcgtgccggaaccggaagtgctgccacagagtgacagtccgcgtcacgaacgccgcccggacgcgcgcctggcgatcgatccgcaaagcgatgcgcccgtgatgccagccgtgctggcgggcgccgatcaggacaaactgatcgccgcgctgctggaaggcatgggcctgaataatggtcaccagacgccgatcaccgaagagcagatgcgcgtcactggccgcatgctcagcctgttttcgcagggtacggttgccctgctctcttcgcgctccatcctcaagcgcggcgttaaagccgacatgacgatgatccttaacgaagccaacaacccgtttaaaattctgccctccggcaaaaccgtgctgatgcagatgtaccagagccagatgcctggctttatgccgccggaagcagcggtgcgcgatgcgctggtggatttacaggcgcatcagctgggaatgattgccggtattcgcgccatcatcgccgcgatgctgcagtcgtttaatccgcagcgtctggaagaggaagcgcgcaaagacggcgtgctgcctaagatgccgttcagcggcggacgcaaagcggcgctgtgggactattttctccgtcactatcagcgcaccgcaggcgagattgaagatgacttccacactctgtttggtgaagcctttctgcatgcctacgacatggaaggtatgcgtgacgaaaaccaggatcgcaccggtgccgaagtcgatgaacacaaagcctgttttctggtgtgcgacggcgtggccggtctgcccggcggcgattatgcggcccagctggtgcgcgataccctgctgacacagctgcagcaaagcgacacgttcacgccggagagtacgcgcgcggcgatagaaaagtgtcagcaaacgctggtcagcgcccaggggaacaatccgaatttttcgcgcatgagcaccacccttgccgccctgtttattgaccgcacaacgcagcgcgcatggtgggcgcacgccggtgatagccggtctggcgcagcagctgcgcgaagccggctatga

SEQ ID NO: 63030 - DNA, 271 bp, Glycine max
  Peptide Sequence Number=SeqID_154715
atgttagccttcctcggcaagtaccaagaagaattaaatctagccacggcccacgagcacaaagtggcagacgaatatgcccgagtgtacgcgaaaaaggaggctagaggaagggtgattaactcgttacatcaagaagcaacgatgtggatggaccggtttgctcttactttgaacgggagtcaagaacttccccaattgttggcaaaggccaaagctatggcagacacctactctgcccccgaggagatccacaggctcctccgctatt

SEQ ID NO: 63031 - DNA, 981 bp, Glycine max
  Peptide Sequence Number=SeqID_154716
atggccccaaggaagcttgcctcaaagagatccaggaaggataaagcggctgaaggaaccagttccgctcccgaatatgacagccaccgttttaggagcgctgagcaccagcagcgcttcgaggccatcaagggatggtcatttcttcgggagcgacgcgtccagctcagggacgacgagtataccgacttccaggaggagatagttcgccggcggtgggcatcgctggttacccccatggccaagttcgacccagacatagtcctcgaagttttatgccaatgcttggcctacaagtggagggttggaatcccattcgatgcggatgctctcagccagttcctgggatatcctttagtgctggaggagggccagaagtgcgagtatggccagaggaggaaccaggctgatgggtttgatgaggaggccatcgcccagctactgtgtatatcggggcaggattttgcccggactgctgctgggagacgagtgtggatcatgcgcaccaacatgaccaccctgacccagatctggatgaccttgctgctcagcaacatccagcccagtgatcataattccgacctccccctgccgaagtgtcagctggtgtacgccatcctgacacggatgagcattcacgtggctcagttaatcattgatgccatctatctatttgcaggtatggcgcctaccaggcaccctctggacctggataagtccaacagggccctgggatttcccgctttgatcacaggactctgccagtcgttcggagtccccgtcgcacctagcaaggtgattcggtcacccatcacccgagcttttattgagaagtattgcacgcagagacaggcccagggggatgctccgcaggccgcagacgcgccaccacctcatcaggctggcccagctggatcatttgatacggagcagcatttgcgacattgggttcgccagcaggcggccaaccacggggcgcat

SEQ ID NO: 63032 - DNA, 429 bp, Glycine max
  Peptide Sequence Number=SeqID_154717
atggaaaaatctgaaaagaaaaatcatagtgagaagaaactaaagaaagcatacatcacatgggatgaaaatgatttggaatcctctgatgattctgaaaatagaagagataaatctttgccttatggcaaaaagttacgaaaatatgtgtctaataaaaatggactagggtataaatctgaaaaactacaaaaggaacatggatattcaacttgctacttcaagaaaaatgacaagaaaaagaaaggaattgctcttaaagcatcatcctcaattcaagaagaaagtgatcaggataatgatccagatgatgatgatgatctaagtctctttgtaaaaagattcaacaagtttcttaaagtaagaggaaatcagaggcgaccaaattttaatcaaagagaaggacagaaaaatcatcctctactctaa

SEQ ID NO: 63033 - DNA, 132 bp, Glycine max
  Peptide Sequence Number=SeqID_154718
atgaagatgctcttgataccacatgatgtagctccattggagctgatgaatggcagcggaatggagaaggaagagagtgaggaaacaccacttcaaggagaagatgagtctagaagaaactcaccaccatag

SEQ ID NO: 63034 - DNA, 261 bp, Glycine max
  Peptide Sequence Number=SeqID_154719
atgttggataaacaaggagctgtgtctccagcaaaacctgtagataggccagatcctgaggtcgatgatcccctttatctgatgacattgaccatcccccaaatttttttgaagttgttgcagcttgtaggcctaggatcttcttcatcaatggattccttttcttctgggaagatgaatggcagtggaatggagaaggaagagagagaggagacgccacttcaaggagaagatgagtctaaaagaagctcaccaccatag

SEQ ID NO: 63035 - DNA, 468 bp, Glycine max
  Peptide Sequence Number=SeqID_154720
cgaccgccgcgccctcctactcatcggggcttggtccttgccccgacggccggcgcgcagttgggcaccgtaacccagcttccggttcatcccgcatcgccagttctgcttaccaaaaatggcccacttggagctctcgattccatggcgcggctcaacagagcagccgcaccgtcctacctatttaaaggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttccagacgggccgaaatggggagcccacaggcccgacgccaggagcgcgcag

SEQ ID NO: 63036 - DNA, 136 bp, Glycine max
  Peptide Sequence Number=SeqID_154721
ggaacctattgggtgagaacttctaatctgcccctaggttcacttaaggctcatgcacggtgcccctcattgccccagtgtaaggctttgaggtttttgcatggtgcctttcgttgccccagtgtagggcttagag

SEQ ID NO: 63037 - DNA, 252 bp, Glycine max
  Peptide Sequence Number=SeqID_154722
atggaggatatatacatggagaataagatgaagaacaaggaattaaagccttggatcttcttcatcaatggagatctttgctttttgaagatgaatggcagtggaatggagaaagtagatgattggagacgccacttcaaggagaagatgagtcaagaagaagttcaccactataggaaggagaagatgagtggagggagagggagagaagaagcacaaaatttactgcctcaaatgaggtttgaactttga

SEQ ID NO: 63038 - DNA, 471 bp, Glycine max
  Peptide Sequence Number=SeqID_154723
atggctaagcgtaccctatgcgctaagcctaagtgtcattctgatgaggctgagctaagcgcgccatgctgcgagtttgacgagttcaaggaggaactcaagagaagacattgggttgagaagttaactgattttgctgacagtagcataaacattgctattgtgaaggaattttacgccaacctctatgaccccgaggataaatcacctaagcaggtgagggtgagaggtaacttagtaaaatttgataaggataccttgaacacatttctgaagaccccgataattttggaggagggggagaatttgtgtacttattctaggtttgcactcttgaggcctgatcctcaagagttggctgctaagctctatatcccagggaggggattcgagctaaatgttgatgggcaaccgttgaagatactgaggaagaacatgaccaccttagctcagacatggggatcctctaga

SEQ ID NO: 63039 - DNA, 738 bp, Glycine max
  Peptide Sequence Number=SeqID_154724
atgggaacaaatcaaactggaaaaaggttttatcaagtcaagattaagggcctagatatcaccaacattaaggagttggggcagttgatgggacctctccaaatgcaagccttccgcaaggcgtacggaaagatcttagatttgaccatagcagagatatccacagaagccattgtatcactcacccaatactatgaccagcccttgagatgcttcacgtttggagacttccaattagtaccgactgttgatgaatttgaggagattctaggatgtcctcttgggggaaggaaaccatatcttttctccgggtttcttccctccttgagcaagattgcagttgtggtcagggattcggcaagaaaattggatcgcataaagcaaactcgaaatggcatagtgggcctaccacggaagcacttagaaggcaaggcaagggatatggcaaatcaagaggagtgggtcccatttatggacgtattagcattgctaatctttggggttgtcctctttccaaacatggaggggttggtggacctagccgcaattgatgctttccttgcatatcaccacagcaaagagagcccggtggtagctatcttggtggacttatttgacacatttgaccgaaggtgcgagaagagtagtgcacggatcatctgctgtttacccgctctttgtgtatggttggttttgcacctattccaacaagacataaggcatccatgtccgctctga

SEQ ID NO: 63040 - DNA, 234 bp, Glycine max
  Peptide Sequence Number=SeqID_154725
atgttgattgatgttggaaatgctttggcatgtgcatgttgtgtatgttcgtggggggcgaagtgcactgatcttccagggtctttggcacttgctttgggccacgttcatacgttggatgttgtgtatgttcgtggggggcgaactgcactgatcttccaggtgtatgttcatgggggatggagtgcactgaccttgttggataacctagacgtgggtggcaagcgtggttaa

SEQ ID NO: 63041 - DNA, 346 bp, Glycine max
  Peptide Sequence Number=SeqID_154726
atggcttcctctgaccaacttgactgagggaagcattgatgtggcaattgcgaaggaattctatgcaaatctttatgtcccagacgaaaagtttcccaagcaagttagggttcgagggcacttgataaaatttgatgttgattccctcaacaccttcttggagactctagtggttgtgaagcaaggggagagcttaccttcttactccaggtttgctagactgaggcctgatcctcaagagcttgtagcccgactgtgtatccctgggaggggatttgttcttaatgctgagggtctgccgtggaagctcttgaggaaagatcttaccactctgacccaaacctag

SEQ ID NO: 63042 - DNA, 162 bp, Glycine max
  Peptide Sequence Number=SeqID_154727
atgggagtttgcaaaatacatagtgacatccagagcaaagggccgctctcctctatagagtctgcctcagatgctgccatgatatcctctggagaatcaacatcagggagtgagtcctcatcatcctttggaagtcaagaacatccacaacaggttcaggag

SEQ ID NO: 63043 - DNA, 138 bp, Glycine max
  Peptide Sequence Number=SeqID_154728
atgggtttgtcaggcttaaaggagcactcaaacccggtgacccccaaagcctacactttgaagagtccgtcagggcatttccctcctgattcaggtccaacccctaaaatcattttagcacacagacattgctcgtga

SEQ ID NO: 63044 - DNA, 525 bp, Glycine max
  Peptide Sequence Number=SeqID_154729
atggagagaagtatgatagatgctaccagtggtggagcccttggacacatgacccctgctgaagccagaaatttaattgagaagatggcttccaactcccagcaatttagtgccagaagcgagaaaaagaagcttgaaggtaaactagatgccttggttaacctggtaacccaactagccatgaatcaaaaatctgcacctatcgccagactctgtggtttatgctcctctgccgaccaccacacagatctttgcccttctgtgcaacaatttgaagcaattgaacagcctgaagcttatgctgcaaacatctacaacaaatctcctcaacctcaacagcaaaatcagccacaacagaataattatgatctctccagcaacaggtacaatcccggatggaggaatcatcccaaccttagatggtggaatccttcacaacagcagcagcaacaacaacagacttattttcaaaatgttgctggcccaagcaaaccatacgttcctccaccaatccagcagcaataa

SEQ ID NO: 63045 - DNA, 1149 bp, Glycine max
  Peptide Sequence Number=SeqID_154730
atgaggattgcctggcagcgatacgcccataaacattacgcgccagccctccaggccaaacagcccgtgctgctcaatcagcgaggcagccagcggtgcgccaaataccaccgtcagcggttgtgccaggtagaacagcgagagaattttgctgcggtggcgcgccggcacccacaggctgagataaaggatggcgcccgggaagaaaccggcctcggcaatccccagcagcaggcgcagcgtgtacagcccttcgacactgctgacccaggtaaacagcagcgagacgatgccccagctgatcatgatgcgcgccagccagcgccgcgcgccgaacttatgcagcgccaggttgctgggcacttccagcaggatgtaaccaataaagaagatgccggaggcgagaccaaactgcagcgcactgaggccgaggtcctgcgtcatgccgtttgggccggcaaaggaaatggcggtgcgatcgaggaagttgataaagaacatcagcgccacaaacggtaccaggcgccaggagattttgcggattgcggtctgctcaaccgcgctgacagcagagtgattcataacgcacctccgaacgtgcgcagtgagacggtgttggccaggcgcaaaaccggcgctggcgacagacaaaatgcgaggtgtcagaccctgtattactggagaaacatgatgaaaactatcgctattggtgccgatgatgcggctatcgatttgaaaaacaccattaaaaagctgctggaagagcaggattatcaggtaactgattacagtaacgacgcgcaaaatgaccgcccgatgtatccggacgtggcgtttgcgctggctacggcggtgcagcaaaagcaatttgagcgcggcattttgctgtgtggcaccggcattggcgtcgcgattgttgccaataaagtggaaggcgtgcgcgccgcgcagtgccatgacaccttctccgccgagcgcgcgcgcaaaagtaacaatgcgcagatcatgaccatgggctcacgcgtaattgggccggagctggcgaaaaacatcgttaacgcctggctggcatccgagtttgaagggggcggttcgaccgtcaaagtggagaagatcggttactacgaacaggtgtcacacgcgaaataa

SEQ ID NO: 63046 - DNA, 1569 bp, Glycine max
  Peptide Sequence Number=SeqID_154731
atggcgctttttccggcacggaaaatctgcttagccagcagcagaaataaaaagcaaatttgcgagcttggttggattatcctcacaaaagctggagatattatgagcaatgacgatcgcaagccgaccaccacggatgctggcattccggtagccagcgacgaacattctttgtccgtcggtccagacggcccgctgatgctgcacgatcactacctgattgagcagatggctaacttcaaccgcgaacgtattccagagcgtcagccgcacgccaaaggcagcggtgcatttggctattttcaggtgacagaagatgtcagccgttacaccaaagcggcggtatttcagcccggcaccaaaaccgatgtggtgatgcgcttctccaccgtggccggcgagcgcggcagcccggacacctggcgcgatccgcgcggcttcgcgatcaagttttacaccagcgaaggcaactacgacatggtgggcaataacacgccggtgttctttatccgtgacccgatgaagttccagcactttatccgctcgcagaagcgccgtgccgacaacaatctgcgtgataacgatatgcagtgggatttctggacgctgtcgccagagtcggcgcaccaggtgacctggctgatgggcgaccgcggcattccgaaaagctggcgccacatgaacggttactccagtcacacctatatgtgggttaacgccgccggggaaaaattctgggttaaataccacttcaaaaccgatcagggtgtggagttcctgacgcaggataacgccgatctgctggccggccaggacggcgattaccatacgcgcgatctgttcagcgccatcaaaaatggtgatttccccagctggacgctgtacatgcagatcatgccgtttgccgaggcggaaacctaccgcttcaacccgtttgatctgactaaagtatggccacacagcgattatccgctgattaaagtcggcaaactgatgctgaaccgcaacccgaccgacaaccacgcgcagattgaacaggcggcgtttgaaccaaacaacctggtacccggcatcgggctgagcccggataagatgctgattggccgggtgtttgcctatgccgatgctcaccgcgcccgtcttggcgttaactacaagcagattccggtcaacgccccgcaggcaccggtgcacagctacagcaaggatggcgcgatgcgcatcaatccggtcagcgatccggtctacgcgccgaactcgaaaggcggtccggcggcggacggcgagcgctacccgacggattccacctgggaagcgcacggcaacatggtgcgcgcgccctacacgctgcgtcaggatgatgatgactttggccaggccaatacgctggtcaataaagtactggatgaggcggcacgtgatcgcctggtaaataacgtcagcggtcatctgctcaacggcgtggaggagccggtgctttcgcgcgcgtttgagtactggcgcaacatcgaccagacgattggcgatcgcattgcccagcgggtacaaaccgagcgcgccaagcgttaa

SEQ ID NO: 63047 - DNA, 978 bp, Glycine max
  Peptide Sequence Number=SeqID_154732
atggataacggcttcaacagcggtaacccctctggcgtaattcgcgcctatgatgtgcaaagtggtcgtctggtgtggaactttgatccggctaatccgcaaaataccgcgccgatagctgctggccagacctatccgcaggatacgccggtggcctggggtacgttgagcgccgacctgaaaaacggcctggtgtatgtgccatttggcaacgcctcgccggatgaactgggcatcgagcgcgatgccaacagcaacactgaaaaattccgtgatgcgttagtggcgctcgatctgcagaccggtgcgttcaaatggcgctatcagagctcccatcacgatctgtgggaccgcgataatccgtcacagccgtcgctggtcgatatcgattatcagggccagaaacagccggtggtgatcctgccgaccaaaaccggcaacctgtttgtgctcaatcgcctgaccggccagccggtttatccggtaaacgacgtgaaggtttcgacggaaggcggcgtgccgggtgagaaattcgccgccacccagccggtatccagcctgaactttattccgcagccgctgactgagaagtcaatgtggggcatcacgccctttgatcaaatggcctgccgtatggatttccgtagcctgcgctatgacggcaatccgtggacgccagccacagaaggcggctcgctggtgttcccgggcaatatcggggtgtttaactggggatcggtggcggttgatccgcagcgtcagatgctgattgccgcaccggtgcgcctcgcctacaaatacaacctgatcaagcgtacgcccgccacggcgacggagcgcctgttcaccaaagatggccagccttactggaacgaaaacttccacgggattacgccatccacatccagcagctggcctctggtctcggcattccgtgcattgcaccgccgtggggccgcatggtcggcgtggatttga

SEQ ID NO: 63048 - DNA, 345 bp, Glycine max
  Peptide Sequence Number=SeqID_154733
atggctattccctgggtcggatctgctgccgggattatcgcgctgatgacgctcggcaatgcgctcaatgcgctggtgaataacgtctactggtcggtcgtgattgacgtgacgccgaaggcatcggtcggcaccttcagcggcatgacgctggccatcgccaacctcgcgtcgatcatttcaccgatgctgtgcggctggctggcgcagtactacggttataacgccatgtttaccgtcaccgcctgtatcgcctttggcagcatgctggccatgacgctgctgcagccggagaaacgcctgcaagccgatgcgccgccagccgccgcgcagcaggctgtgtaa

SEQ ID NO: 63049 - DNA, 130 bp, Glycine max
  Peptide Sequence Number=SeqID_154734
cccaaaacgcgcgcttagcacgcgtcacgggctaagcgggccaggaagtacacccgctaagcacgcctacgaaggcccaaagcccacttcagcaactataaatagagagccagtccaagaggataagtga

SEQ ID NO: 63050 - DNA, 89 bp, Glycine max
  Peptide Sequence Number=SeqID_154735
atggagttgtccactgctttgcctgagaataacaattgcttgaccacaactgttggatcaagtggcctcagaataattaagaaggaggg

SEQ ID NO: 63051 - DNA, 627 bp, Glycine max
  Peptide Sequence Number=SeqID_154736
atggtctcccgtggtggaggcgaaagggacgaatgtttatttcacctcggggagtcgcacgacatggaaacccgtcccgcggtagaagaattgcttcaacggctcatggactgggggcaacttgaagtgtccataggagggagggaagaaccacaagtttgcatgcagtcggaagagaagaaggttcctctaacccccaaggccctagtgatatgttttactaggaaagggaccggctccacacccacatacccccggacggcgcccaagccaacgccatttgcatatcaaagtaataaggtcgttccgtggaagtatacccctcccgcgtccagcgaaagagttgcaaccgaagttgactccctatcagctaaggtaaccaacatcaccggcctcagtggcgtaacccgcagtggtcgggtgttcgcttcccctcacccggcggaattgccctctaaagggaaagcacccatggtcccagagtccacggatatagccaccccctcgaaagaagtagatcctccagtggtaagaggggtcgaaaagaaagaaggtcttcaaggaaaaacagtgactctggaagaggcccataagttccttcgcctcatccaacaaagcgagtttaag

SEQ ID NO: 63052 - DNA, 285 bp, Glycine max
  Peptide Sequence Number=SeqID_154737
atgatagcacaacaacttagtcccgtactaccaaggactttagaatcagaccagttcccattgttgaatgaccctaacaaagcatgcatctacgtgatcacgaacttccttgtagaagcaaggcttcatggtgaatgtgattcaaagatgatgacaaaggtgatgaacaaaaagctcaaagatcaaagaacaactcaagtgaatcaaagaacatctcaagtgaatcaagaacaagtcaagagttcaagaatcaagaagaattcaagactcaagaagaaatcctag

SEQ ID NO: 63053 - DNA, 234 bp, Glycine max
  Peptide Sequence Number=SeqID_154738
atgaaagataaatggaatatgcatgaattgcatagtatgttagttcaggaagaaacgaggcttaagaatcaaggaagtcactcagtccattatgttagccaccaaggaaatcaaggagctggaaagaaatttatgaagaagcatgataaaggcagagggaaatcaggacatttccagaaggattacctaaagtgcaagtcttggttcgaaaataaaagtgagcttaatgctcat

SEQ ID NO: 63054 - DNA, 460 bp, Glycine max
  Peptide Sequence Number=SeqID_154739
atggcttactcaccaaaagaaacttccgctcctggttcacccgctgtaccatcatctccgcaccaggaacaaccagaattcaacatccaacccatacaaataattcctggtcaagcttcagtccctgagaaactggttcccagaagacaacagggagtgaagattgctgaaaaccctagccctgcaacaagtcctagggaagtagacacggagatggataagaagatccgcagtattgtgagtagcattctgaaagatgcttctgtgcctgatgctgagaaagatgttccaacatcgtccaccccaagtgtttctgtgcctgatgctgagaaagatgttccaacatcctccgctccaaatgctgaagccctcccttcacccagtgaagaggaatcaacagaagaagaggatcaagcctcagaggagactcctgcaccacgggcaccagaaactgctccag

SEQ ID NO: 63055 - DNA, 345 bp, Glycine max
  Peptide Sequence Number=SeqID_154740
atgtgggtgcaagccattggtctgtttgctcaagcgacctgtgctcctgagtttggacttccaagaccgttcaatcagagattactcgtcttgcacgttggtgggggtgccgtaaaacagcgaataaaaagtttaagggaagagaggaatgcaaacttgatttatactgattcggccacttcccgtgcctacgtccagtcctcaagcaacccacttgagattttccactctctttgtaaaactccttttacaaagtctgaaccacacagggacaacccttcccctgtgttcaagaatcctctacaacaagagacccacggtctcttaatcccttttcagaaataa

SEQ ID NO: 63056 - DNA, 312 bp, Glycine max
  Peptide Sequence Number=SeqID_154741
agacgaattctgtgcccctttatcattcaggagcagcgagtcgaagtggaacaacaagttgggtggtaaacgcgtagagacagattctgtgccctttatcattcgagagcagcaagctgagtggataaacgcgcatagacaaattttgcgccctttatcattcaggaacaacaagttgggtggtaaacgcatagagacgaattatgtgccctttatcatgcaagagcagcaagctgagaacaacaagttgggtggtaaacgcgcaaagacgaattttgtgcactttatcattcaggaacaacaagttgggtg

SEQ ID NO: 63057 - DNA, 690 bp, Glycine max
  Peptide Sequence Number=SeqID_154742
ttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtcttttgggttccggggggagtctgtgatgcccttagatgttctggggccgcacgcgcgctacactgatgtattcaacgagtctatagccttggccgacagtccatcagctcgcgttgactacgtccctgccctttgtaccacaccgcccgtccgctcctaccgattgaatggtccggtgaagtgttcggattgcggcgacgtgagcggttcgctgcccgcgacgttattgacccgcgaacttgtttattcatctaccgccgggagggaggggatgaccacggcgccccgtgcgcccggcctcctcgtcctcgcgacaaacacaaaccccggcgcttcgtgcgccaaggaactcaaatctgttaagtgcgactcccgggggcccggagacg

SEQ ID NO: 63058 - DNA, 577 bp, Glycine max
  Peptide Sequence Number=SeqID_154743
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaagatcctaacggtcacaacctagatttctgtattaggaacccccagttaaattttcaaggcgatccaatggttaacgaatccgggatgaggactttactgaggtgggcaactggggatggtgtgcttatgcctgggcttgtggaaatgggatatttgttttgtgccatcgcccgatcgccacctagtaccacatatgacggagtggtacgtgaggatatgtcgcgggggtcaggagaccatggggacgtcaggtggggtgctattgcccaaaaccaagcttggccaatcccgacccaacccaggcatagtcagccagtgagaacctgtgacgtacctcagcaggcgagcacctggcagtcaaccaataaaggaacaaaagtccacgaagcagggaggcttggtttaaaaattgaaacagaacgttcagtagctgctg

SEQ ID NO: 63059 - DNA, 222 bp, Glycine max
  Peptide Sequence Number=SeqID_154744
atgttgatcttcagaggagtcctctttccaaatgtggaagggttggtggaccaagcagtaatcgacgcttttctcgcttatcatagccacaaggaaagcccggatttccgaatgttccctcgatggggacgagggggttgcatcagttacaatcccgttcttgctataagacaacttggctaccctatgagaggggcaccactagaggaagaaatcgcgcct

SEQ ID NO: 63060 - DNA, 306 bp, Glycine max
  Peptide Sequence Number=SeqID_154745
gtggaatttgatatccctgaaacttctgattgtaggacaaagaagaaggatgtgtggaaaaaggcacatgtcatccagaaccaaaacaccgtcccccacgtgttgtctcgtgggggttatgaatatttagaacaaaatctgatggttgagaagacaaagaaaaaactggaggaagccgctcagtccgaaagcactgagggcgtcattgatccttcatctcccatcaaacgacacgtgaagtggaagatggcctgcaccaagaaaactggtcaaatgtgttggatcgagtggcctcagaataattaa

SEQ ID NO: 63061 - DNA, 432 bp, Glycine max
  Peptide Sequence Number=SeqID_154746
atggcttcttgtaagagaaaagcactagcttcagtgtcccaggctaggtatgatagatcaagatttttatcccaaaatgtctgggactgttacgcgaacaatgtccttggctggaaggtccttccggaaaggaatgtgaagctgtacattacaaaatttgatgaattcaagagagaaattgagaggaggaattggcataaggagctcactaacttctttgaagggagcattgacatggcattagtgaaggaattctatgccaacctttatgaccttgaagataaatcaccaaagcaggtgaaggtgcgagggcacctaattaaatttgatgatgacgccctcaacacctttttgaagacaccagtggccatcgaggaaggggaaagcttgccctcttactccaggttctgtaggttgaggccagatccttaa

SEQ ID NO: 63062 - DNA, 636 bp, Glycine max
  Peptide Sequence Number=SeqID_154747
atggccccgaggaaacttgcctcaaagagatccaggaaggataaagcggccgaaggaactagttccgcttccgagtatgatagtcaccgctttaggagcgctgaacaccagcagcacttcgaggccatcaagggatggtcatttctccgggagcgacgcgtccagctcagggacaacgagtataccgatttccaggaagagatagttcgccggtggtgggcatcactggtcacccccatggccaagttcgatccagagatagtcctcgaattttatgccaatgcttggcctacagaggaggccgtgcgagatatgaggtcctgggtgaggggtcagtggatcccgttcgatgcagatgctatcggccagctcctgggatatcctttactgctggaagagggtcaggagtgcgagtatagccagaggaggaaccggtccgatgggttcgatgaggaggccatcgcccatttgctatgtataccagggcaggattttgcccggacggctgccgggaaacgggtgcggatcatgcgcaccaacatgaccaccctgactcagatctggatgactttgctgctcagcaacatccagcccagcgaccataattccgacctccccctgccgaagtgtcagctg

SEQ ID NO: 63063 - DNA, 237 bp, Glycine max
  Peptide Sequence Number=SeqID_154748
atgaaaattgctgctaagtatgagcatgtaccttatgcaggcaaaaacccttcacgttgtggatgtgtcatgaggagtactcacggtcttccatgtgcatcggatgctaactgtggtcaccaggcaatagctgcgttattgggggtgtgggtagataaggatctagcttctcaaagaagcatcttgagaaagcttctcaaagaagccactaggaagcttcttgaggaagcctcttaa

SEQ ID NO: 63064 - DNA, 258 bp, Glycine max
  Peptide Sequence Number=SeqID_154749
atggtaccaggaaatgtaactatagaaaaacccagggaacaatgggatgaagaagaaagggaaatggtacaatataacttaaaggccaaaaatataattacatctgcattaggcatggatgaatattttagagtattaaactgcaagaatgcaaaagaaatgtgggacaccttacaagtaacccatgaaggaacaactgatgatatgcaaaagagattcacacatatagtaaatcatcttgcatcattaggaaattga

SEQ ID NO: 63065 - DNA, 546 bp, Glycine max
  Peptide Sequence Number=SeqID_154750
atggtacgtagaaagcttttaccagaaaggaatgtggtaatctattatacagagtttgatgagttcaaggaggaactcaagagatgccattgggataagaagctgactgatttttatgatagcagtatagacatcaccattatgaaggagctttatgccaacctctatgaccttgatgataaatcacctatgcaggtgaaagtgggaggtcacatagtgaagtttgatgaggatactttaaacacatttctgaagacccctgtagtgctggaagggggtgagaatttgtgtacttattccatatgtgcactcctgaggcttgatcctcaggagttggctactaagctttgtatcccagggaggggattcgagcttaatgctgatgggcagcctttgaagattctgaggaagaacatgactactctagctcagacatggagtgtcctttccttttctaacctcattcccacctcccacacatttgatatgaccctagacagagccaaattgatttatgggattattatgaagatggacatgaactag

SEQ ID NO: 63066 - DNA, 294 bp, Glycine max
  Peptide Sequence Number=SeqID_154751
atgatctttcaagcaaacatatacaatccaggttggaggaatcatccaaatttgagatgggaaaaccctccacaaccacaacagcaacaacaacaacctatccctcttttccagaatgctgctggtccaagcaggccatatgttcctcctccaatgcagcaacaacaacaaagacaacaagaaactgaggccccgtctcaaccttccttagaggagttagtgaggcaaatgaccatccagaatatgcaatttcagcaagagacaagagccttcattcagagtctgacaaattag

SEQ ID NO: 63067 - DNA, 126 bp, Glycine max
  Peptide Sequence Number=SeqID_154752
atgatcttgagggggagactgctgctgctgatgatgattgatataccgctgtgcttgattactctgataaagaaagttgctgatcccacttgcataactgctcgtacctgctcaggaagtgtctaa

SEQ ID NO: 63068 - DNA, 80 bp, Glycine max
  Peptide Sequence Number=SeqID_154753
gtgggaatggaagagggataggaggctacggtgtagaaggaagcttgacaggttcaggtgcaggtgctgctactggttga

SEQ ID NO: 63069 - DNA, 270 bp, Glycine max
  Peptide Sequence Number=SeqID_154754
atggcagtggaatggagaaggaagagagagaggagacgccacttcaaggagaagatgagtctagaagaagctcaccagcataggaggccatggataagagcttggaggaagaaggagatgaatgatgggagagggagagaagagcacgaaatgttgtgctctaagagagctctgaactttgaacctaagtgtcacacaaaattgggagggaaaattcaaatttcacttgaatttgaaattgaatttgtggagccaaactttggagcttaa

SEQ ID NO: 63070 - DNA, 528 bp, Glycine max
  Peptide Sequence Number=SeqID_154755
atgagaggggcaccactagaggaagagctcgcgcctgtcatttcacgaggtttcaataagaccaacgtggagacacttcagaaggtccgcaaagcatgggaggtggtccaaaagaagtacaaagaactcaggggcagtaacaatgggcccatcggtggctaccgaaggtggttgaaagcccacgtgcaagctaccaccaaggccttagaacaagagaccaagagggctcgtagggaagagcatggctggaacaagttccgaggggctctgtggggaagcaacagcgagcttaagctctggagagaggaaagggaccaatcacgagtagacagtaagatcttgaaagatgagttgaaggtttgctcaaggttcaaaagaaacttgtctcagcggttatgcgagacagagaccaacatgttagccatcaccagtaagtaccaagaagaattaaatctagccacggcccacgagcacaaagtggtggacgagtatgcccgagtgtacgtggaaaaggaggctagaggaagg

SEQ ID NO: 63071 - DNA, 705 bp, Glycine max
  Peptide Sequence Number=SeqID_154756
ggagtggcaaaagattggctatactaccttgctcccaggcctattttcagctgggatgaccttaagaaggtgttcttggagaaattcttccctacatctaggaccactgccatcagaaaagacatctcaggcatcaggaaacttagtggagaaaccttcaacatagagaggagtatgattgatgctgccagtggtggatctcttggtgatatgacccctgctaaggctaggaatttgattgagaagatggcttccaactcccaacaattcagtgcaagaaatgatgctattgttcttagaggagtccatgaggtggccacggattcatcttcatctactgaaaataaaaagcttgaaggaaaacttgatgccttggtcaacctagtaactcagcttgccatgaatcagaaatctacacctgttgcaagacctgtccatcctttccagaatgttgctggtccaagcaagccatatgttcctcctccaatgcagcaacaacaacaagcaactgaggctcctcctcaaccttccttagaagagttagtgaggcaaatgaccatccagaatatgaaatttcagcaagagacaagagctgatgcaattctccctaggaagggaccaatcactagagccatgagcaagaggctccaagaggattgggctagagctgctgaagaaggccttagggttctcatgaacctcagg

SEQ ID NO: 63072 - DNA, 240 bp, Glycine max
  Peptide Sequence Number=SeqID_154757
atggtcttaaaagaggagttagcttcttgctcaaggtccaaaagaaacttgtctcagcgtttatgcgagacaaagaccagcatgttagccatcgtcaacaagtaccaagaagaactaaatctagccacaacccacgagcataaagtggagggcgagtatgcccaagtgtatgcggaaaaggaggctagaggaagggtgatcgactcgttacatcaagaggcaacaatgtggatggactga

SEQ ID NO: 63073 - DNA, 201 bp, Glycine max
  Peptide Sequence Number=SeqID_154758
atgaccaagagcaagggcaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccaaggttgtgatttgtatcatggcccaaatggaggactaa

SEQ ID NO: 63074 - DNA, 246 bp, Glycine max
  Peptide Sequence Number=SeqID_154759
atgccctttggcctatgcaacgcccctggtaccttccagcagtgtatgcttagcattttcagtgactttttagagagttgcatagagggttttaaaggcgctttatcaaggattttagcaaagtggcccttccactatccaatctgctgcaaaaagaggtggagtttgattttgacgccctggtgcaaagacgcttttgattgcctcaagcgtgcggtgactaccacccttatcgttcagctatga

SEQ ID NO: 63075 - DNA, 327 bp, Glycine max
  Peptide Sequence Number=SeqID_154760
atgtcaggatttacatgcgattctcctcaaatttcagccagcccgcatcaactaccccttgcaccttacgcttcaggcccctacaatgctcaatggaatgccccggggcttctccatgacaagcacacgttgcgttcgagtcgtattctcggagaaatggaggttgatgaaccttggttggggttatggctaccattgaattatcaaatagatatgggagcaagctttctcgctgcaaaattcatttcttggttggtgtttttggtttgtgctaaaggtggtgttcgtcattggaagtgcggtagacagactttgtggttgatttag

SEQ ID NO: 63076 - DNA, 220 bp, Glycine max
  Peptide Sequence Number=SeqID_154761
atggtgaaggagttttatgctaacttatatagcccggaagaccagagccctaagcaagtgagggtaagaggacatttaatcaagattgatgctgatagcctgaataccttcttagagactccaatagttttagaggagggtgagacattgcctacctatttcaaattcacgaggatgaggattgatcctcaagagtttgctgcccgtctctgcatccctg

SEQ ID NO: 63077 - DNA, 105 bp, Glycine max
  Peptide Sequence Number=SeqID_154762
atggaggagatacatggagaagaagatgaagaacaaggaattaaaatccatgggaagcttgtaggccatggatcttcttcgtcaatggagtcctttgatccttga

SEQ ID NO: 63078 - DNA, 333 bp, Glycine max
  Peptide Sequence Number=SeqID_154763
atgcttttgtcaaatggtggagacaatttgacacttcaaaggctgctccggaccaagtcaagaactggttttagagtcacccagaatttctcaaacctactgacccagaaacatcattattttttaatcaaaaatctcaacttgcaacattcctggccagctcaaaatccaaagaaagccttgcgcagaaccttaaagaagttctccagctacttcaacaagaagaagagaaaaaatcttcaaagaaagaggttgaatcttcggaagacattgatgattaagacgatgatcctttctaccagaatgaggatgattgtttcggcatctcattag

SEQ ID NO: 63079 - DNA, 755 bp, Glycine max
  Peptide Sequence Number=SeqID_154764
atgctatcagccagttccagggataccctgtagtgctggaagagggtcaggagtgcgagtatggtcagaggaggaaccggtccgatgggttcgatgaggaggtcatcgcccatttgctatgtataccggggcaggattttgcccggactgctgccaggagacgggtgtggatcatgcgcaccaacatgaccaccctgactcagatctggatgactttgctgctcagcaacatccagcccagcgatcataattccgacctccccctgccgaagtgtcggctggtgtatgccatcctgacacggatgagcattcacgtggctcagttaatcgctgatgccatctatctatttgcaggtatggcgcctaccaggcaccctctggacccggataagtccaacagggccctaggatttcccgccttgatcacaggactctgccagtcattcggagtccccgtcgcacctagcatgagacaggcccagggggatgctccgcaggccgtagacgcgccgccacctcatcaggccggtccagctggatcgtttgatacggagcagtatttgcggcatttggttcgccagcaggcggccaaccaccgggcacatttcagggcagaggtcacatggcctggagattggcctgaggcccaggcaggagaggcaccaacagaggctcccgacgaggcagatgaggcccacgaggacgaggagatgaccgatttacttgatttcttaggaggaagcggggccacatga

SEQ ID NO: 63080 - DNA, 603 bp, Glycine max
  Peptide Sequence Number=SeqID_154765
atggatattaaccccccctacagctgcctggtgggggcgcccgtggttcccactcagtggggagttgtgccttctacactccaccaaaaagctgaaattcgtagggggaggggcacttggtcatcgtgtcaggcgaggaagatatcttgcatttcctccgtggactccctctttgggcagccttgtctgtccgatgcagcggtaatgatggcccgagttatgttggggaacggttatgaacccgggatgggtttaggaaaaaacaacggtggcataactagcctgataaatacccaaggaaatcgtgggaagtatggtttaggctataagcccactcaggcggacatgaaaagaagcatcgcgggaaggaagaacaatggtcaaagttcgcgttggagacaagaaggtgaaggaagcccgccctgccacataagtagaagctttataagtgcgggttcgggagacaaaggtcaagcgtttgcgatatgcgaagatggtattccgagtactttggatttggtacgaccatgccctcctgatttccagctgggaaattggcgagtggaggaacgccccggcatttacacaacaagcataatgtaa

SEQ ID NO: 63081 - DNA, 354 bp, Glycine max
  Peptide Sequence Number=SeqID_154766
atggaacttgcactgcctctagagcctgaggttggtccctcagctgttcgtgtcaacacaaaggagagttgtgttgatccctcaacgaccgatccagacatgggtgactcagacaaatgcgggttgtacatcgaagaaaatcattcccgcctggttgccctaggaaaagtttatgagggatccacagccgttcacaacatccctttgttacatggccaagtgaaggatggtgttgaggaggttaaagatgcagatgctcccgttcctgtacccactgatgaggttattttagtgggacagacacttaacaccttccttgcttggccgacacatctcgtcaagtgtttattataa

SEQ ID NO: 63082 - DNA, 231 bp, Glycine max
  Peptide Sequence Number=SeqID_154767
atggcagtggaatggagaaggaagagagagaggagacgccacttcaaggagaagattagtctagaagaagctcaccaccataggaggccatggataagagcttggaggaagaaggagatgaatgaagggagagggagagaagagcatgaaattttatgctctaagagagctctgaaatctgaacccactaattcaagatcaagtccaagattctccactgagtgtgcttag

SEQ ID NO: 63083 - DNA, 258 bp, Glycine max
  Peptide Sequence Number=SeqID_154768
atgatgacaacaaaagatgatgacaaaggtgatgaacaaaaaactcaaagatcaaagaacaactcaagtgaatcaaagaacatttcaagtgaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaagaaaagacttaatcaagataagtattaa

SEQ ID NO: 63084 - DNA, 351 bp, Glycine max
  Peptide Sequence Number=SeqID_154769
gaacatcctgagttgaagctatcttcccatggaaggaagatggctaagttcgggaggcctgctctagagattgaaggccttgtggcagccagtggactaagtcctttgatcgcttgggcgttccacagcttcgagctacttcatgtcgacgacgctgtcgaaatgttggtggaattgctcgaggtcagcgctgcaaaggtgagacctaagatgattcagtgccgtggctcttatgttcgactatcgtggttgcgcgacgtgtatgagttgaagatcgaggcatgtgaatggatcgtagcagtgcgagcgtatttgttgcatctgcttggatgcaaactctttgctaactag

SEQ ID NO: 63085 - DNA, 96 bp, Glycine max
  Peptide Sequence Number=SeqID_154770
cctatccctcttaagattattgaggccacaaggtccaacaatgtggtgcttgttttcatgggtgctctgagagtaaacagtagactagacacttga

SEQ ID NO: 63086 - DNA, 369 bp, Glycine max
  Peptide Sequence Number=SeqID_154771
atggtcccccgaggtggagatgaaagggatgaatgtttgtttcaccttggggagtcgcatgacatggaaacctgtcccgtggtggaagaattgcttcagcggctcatggattgcgggcagcttgaagtgttcataggagggaaggaagaaccacaaatttgcatgcagtcgaaagagaagaaggttcctttaacccccaaggccctagtgatatgttttactaggaaagggaccggctccacacccatatacccgcgggcggcgcccaagccaacgccatttgcatatcaaagtaataaggccgttccgtggaagtatacccctctcgcgtctagcgaaagagttacaaccgaagttgactccctatga

SEQ ID NO: 63087 - DNA, 255 bp, Glycine max
  Peptide Sequence Number=SeqID_154772
atgtcggaaaagccataccgcagtactggcggttgtgcatgtgctctcagatctcgtggctgtcaaaattgcttcatggctgcacagccctttctcacccactcaacaccatcatggaaaagaggggggaaagaagccgatccacaagcccatgggaccgtaaaacacaattattggcttcgttgtttcatgcattgggaacccagggatgaagggctcgaaccgcatgtgtgcgagccgtcgaaccacgcctag

SEQ ID NO: 63088 - DNA, 213 bp, Glycine max
  Peptide Sequence Number=SeqID_154773
atgtatcctccacttgaattgatccacaagagatgtaccctctcttgttctcagtattacaacccaaggaagaggaagaatcaaaagaattctcaggcggttagtccttttaatcttttggcaagagggagaaggaagaaacaaaagaattctcaggcgattagtcctttgaatcttttgacaagagagagaaggaatgaagaagaagaataa

SEQ ID NO: 63089 - DNA, 759 bp, Glycine max
  Peptide Sequence Number=SeqID_154774
atggttagaacacgaggtctacatcgtgtggtgggcacaggtagaggcagagaccttagtcaggatgtggctgagaatgttcctcgccgtcgtaggcccactgcctcagcacgtaggcaacaggttacccagagagtcgaggatgttcctcagtttcctaaggatgttcctcagttggctgaggatgtgcctcatgcgtctgatggtagcccagagaggacaggagccgccgatggtgctgagtctgatcgagtggctagtgatgggacaattgctgatgatgaggggttccccggtgggccacgcgatccatctgttttgataggatttgctgatcatgtggcacacaacatatggcgtggacaggagcaacccgatctcatgttggtctcccatggtaggaaagtagataaatttgggagaccggctgctgagatcgaaggtatcattgcggccaccggattagatccattgatcaggtgttctgtgatcaccactgatcctggactcatatccgcctttgttgtgaggtggcatagtgagacgagcagcttccacctcccagtaggggaggtgacgatcactctagacgacgtttcgtcgctcctgcatatcccgattactggagcgctgcattcattcgggccactagctacatctgacgcagttgcgctgttgacggagctacttgaggtcaccccagacgaggctacagctgagacacgtcaggcaggtgggcctcatgttcggttgtcctag

SEQ ID NO: 63090 - DNA, 318 bp, Glycine max
  Peptide Sequence Number=SeqID_154775
atgtctcttgccactctttttggcaaattacaggaacatgagatggaactccaacgactaaatcaaaatgaagaaaccgacaagaggaaacgaagcgtagcacttaaagccacctcctcattacaagaagaagaagaagatgaagaagacttctcactctttgtgaagaagtttcacaaatttgtcaagatgagaagaatcgagaggcgtcaaaatttcaaccatggaaaaagattccaagaagactctccaactcttagatgctacaagtgcaaccaaattggtcacatcaaagcaaattgcccctcaaacgagtaa

SEQ ID NO: 63091 - DNA, 287 bp, Glycine max
  Peptide Sequence Number=SeqID_154776
atgcaatctcagggactttcactgcctcccgagcctctggttagtccctccggtcctcgagtaagcacaaaagggagttgtgttgatccctcaggaaacgatcctgagacgggtgactcagataggcgcggcttgtacatcgaagcatatcctgcccgcctggttgccctgggagagtttatgagggatccactgttgttcataacactcctttgttgtttggccaagcactttcacaccttccttgcttgggcgacacatctgggccagtcttttatcacagccag

SEQ ID NO: 63092 - DNA, 687 bp, Glycine max
  Peptide Sequence Number=SeqID_154777
gtgagtgtggaggaggttacagatgcagatgctccagttcctgtacccactgatgaggtttccttagtggggcaggcacttcacatcttccttgcttggccgacacatttggtcaagtctttatcacaacaggtagctgtgtctccggcaaaaccacctccaaagcccgatccggaggtcgatgatccgctttatctgatgacattgaccatcccagagcttttcttgaggccttatcaggttagatgggatgccaccgtgtttggggtctttaatctagatttccccctctacataaagcacgaagacctctccaaaatcgcacacggtggtcaatgtcgcagcatatcagtgttacagttgtggattctgcatctcactgaaacatgtatgcgagtggggaattctgatatttatggattcctcgagccacagtccattcagaggtctgggcaatcgcagtttgagtctgaaagttatataaatagttggatgcatagttcacaacgtgatgtctatcttggagcctacctaaatgggttccactgcagcagacactggcagatggtggtcatcttgcccaaggaacacctagttgtctggttttgttcattgcataacaggccagacaactaccttaaggggattattaataggttagtgttcttttcaatacatttgcattga

SEQ ID NO: 63093 - DNA, 594 bp, Glycine max
  Peptide Sequence Number=SeqID_154778
atgactcaagagctggtagcccgcggagacaccttacggttatccgcacctcgtcattcagtgaccccaagtatgattgacgagcagaggccaatatggtcatctgcgccctttccggagatgtcagcattttccgatggagacttttcaagtctcacaagttatctagaactacgtaggtctgagttcctcattggaggatacgtaggagcaagagccttgcttttgtcggctgccccaggcggcaggcccgatgatacgcggagataccttacggttatccgcacccttttgtcatccagaggcggcgggcccgatgacaagcagagaaaaatttggtcattctgcacccttgtgtcatccagaggcggcgggcccgatgatacgcggagataccttacggttatccgcacccttgtgtcatccagaggcggcaggcccgatgatacgcggagataccttacggttatccgcacccttgtgtcatccagaggcggcgggcccgatgatacgcggaaatacccgagtggttatccgtataaacattcttttgctatctgtaagacagaacgcttgatagcatgcagaggctga

SEQ ID NO: 63094 - DNA, 384 bp, Glycine max
  Peptide Sequence Number=SeqID_154779
atgcgaatgccaaaagagtcggggcaacaggggcaaaaaggaaggaaggggatgcccatgccgtctcttcaacacccgcgtgggtcaaaccccagcaaacacctcatggaatttccctccgaggccattgccggaattcaccccgctcccaatgacgtacgtagatcttctaccatccctcatcgccaatcatttggccgtggtaactcccggaagggtccctcgaaccccctttcccgaagtggtatgaccctaacgcaacttgcaagtaccatgggggtgtctcggggcattccattgaaaaaatgcttggcccttaaatacaaggtccaacatttaatggatgctggatggctgacttccaagaggatcggcccaatgtga

SEQ ID NO: 63095 - DNA, 231 bp, Glycine max
  Peptide Sequence Number=SeqID_154780
atggcagcggaatggagaaggaagagggagaggagacgccacttcaaggagaagatgagtctagaagaagctcaccaccataggaggccatggataagagcttggaggaagaaggagatgaatgaagggagaggaagagaagaacacgaaattttgtgctctaaaagagctctgaaatctgaacccactaattcaagatcaattccaagattctccactaagtgtgcttag

SEQ ID NO: 63096 - DNA, 294 bp, Glycine max
  Peptide Sequence Number=SeqID_154781
atgtaccctctcttgttctcagtcacaacaacccatgtagatgtaccctctacttgtaccacaaaggatgtaccctccaatgtgttaagacaaagttctcaggcgggaaagggaagaatcaaaagaattctcagactgtgtcattttgaattctttgacaagggagaagggagacacaaaagaattcaggcggttagtcctttgttcttttggaaaagggagaagagagacacaaaaagaattcaggcggttagtccttggcgaattctttttggcaaagggagaagagaatga

SEQ ID NO: 63097 - DNA, 63 bp, Glycine max
  Peptide Sequence Number=SeqID_154782
gcatgataatgtgttgtcttgggattatgaaagtgtatgaactctgtgtaagtgacaagtcaa

SEQ ID NO: 63098 - DNA, 204 bp, Glycine max
  Peptide Sequence Number=SeqID_154783
atgggttgggatagggcaaggcccggtcatgttagccagtgtttcacaagtgccgggataatgttcgaggaagaggaggcggcaataggagaagaggctccacaagatccgccgtgtttcgtgcgtccgtgccattacaatttccaactggggaactggcacgtgatgagccagtcagaagtctataccgctgattcaatgtaa

SEQ ID NO: 63099 - DNA, 126 bp, Glycine max
  Peptide Sequence Number=SeqID_154784
atgcatcctccgttatcaagtacggagcctccgatgaggggaaaatatgagaaaggagaaggagagacgggagtcacttatttcaaatcgttttgggttggaactattgtgattgagatcaattaa

SEQ ID NO: 63100 - DNA, 534 bp, Glycine max
  Peptide Sequence Number=SeqID_154785
atggcttctaggaaacacaaaagtattggttcaagacccacaacacaatatgatacaaggagattttcctccttagatgcttggaaccggtacacagataatgtcttggggagaaacatcttgcctgagaggaaggtagagctctatcacactgagctagatgattttaaaactgaattgaagaggcgtaatttccataaatgcctcaccaatttggttgatgggagcatagacttggctttggtgaaagatttctatgcaaacttatacagctctaagggaccttcaccaaagcactatagagttagaggccatttagtgaagattgatgctgacagtctcaacacattcttggagacacctgtggtattggcagaaggtgaaaatttaccaatatactccagatactgcaggttgcccacagattacagagaaattaaggttgccttatgcataccaggcagagggttcatcttgaacactgagggctatcttgggaagattctcaggaaggatttgactactctagctcag

SEQ ID NO: 63101 - DNA, 126 bp, Glycine max
  Peptide Sequence Number=SeqID_154786
atgaaaaagaaggctaagaaggcctacattacatgggatgacaatgatatggattcttatgaggaatcagagaatgaagttgtaaacctgagtctaatgactaagaactatgaaagcgatgaagag

SEQ ID NO: 63102 - DNA, 282 bp, Glycine max
  Peptide Sequence Number=SeqID_154787
atgggtgctttgcaggtagtcctatgtgcccaaagagcaccatctagcctgaaatttctgcctgtccattggtttgggggtggtatggtgtggataccctgtggacaacctgtcgcaacgtgcccttcacgggcgagcgaggcgaggctcacgggtgcgctttccaaaggaggaaagatgcgcggagtcgccaccaacgtttatttgtggaaaacgtcggaaaaacccaaggaaaccggtcaaaaagaaaattctaagttcgggagttgtatttacgcttga

SEQ ID NO: 63103 - DNA, 359 bp, Glycine max
  Peptide Sequence Number=SeqID_154788
atgaagaacaaggaattaaagagaattcaccgaacaaaaagatagaggaaacaaaagaacatcacttagatgaagatgctctgataccacatgatgtaagctccactggagcttgtaggcataggatattcttcatcaatggattcctcatgctctcttggaagatgaatgacagcggaatggagaaggaagagagagagaggagaggccacttcaaggagaagatgagtctagaagaagctcaccaccataggaggccatggataagagcttggaggaagaaggagatgaatgaagggagaggaagagaagagcacgaaattttgtgctctaaaagagctctaaaatctgaagattaa

SEQ ID NO: 63104 - DNA, 324 bp, Glycine max
  Peptide Sequence Number=SeqID_154789
atgggctacatgggagtacgtgagctcaattggaggtgggcaacaggggatggtgggtttatgcgcgcattgtggatggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggtggctggccagctgtgaattttgtgtaatatgtggtttgtggcctctggtaatcgattaccaagggcttgaaaacgaagtcaggaaacttagggagcctctg

SEQ ID NO: 63105 - DNA, 231 bp, Glycine max
  Peptide Sequence Number=SeqID_154790
atggatgagtttgatacgcaggtggccaggccaggagcccaaccttctccttctggagggggtgtacacatggctcaagagaaggagactgccacagaccagattccagagctatctccagcacccatacccgatgatgccatgccatctgcaccagcatctgagccagagcagcctatccctcaggattcaccaactgctcaggtgttggatctcaatgagcatgcatag

SEQ ID NO: 63106 - DNA, 648 bp, Glycine max
  Peptide Sequence Number=SeqID_154791
atggcagaggtctccacggaggtcatcgcctccctcacccagtattatgaccagcctttgaggtgcttcacctttggggacttccagttaaaacccacggtagaagagtttgaagagatcttgggatgccctatgggaggaaggaaaccgtatcttttctcagggttctatccctcattggctagaatttccaaaatagtcaaaatctcggcacaggaattggacagggggaaagtggtcctctttccaaacgtggatgggttggtggacctggcagcaattgacgcttttctcacctttcacgaccgcaagaaaagcccggtcatcgctatcttagccgatctatatgacacattcgaccaaagatgtgagaagaacagtgcaaggattgtttgctgtacaccaaccctctatgtatggttggtctcacaccttttccgccaagaggagagacacgttttcccgctagaaggtcaccactcatgccccgagaagaaagaggcaaactgggaccgactcttagcaagcaaagaaggagcattcatcgaagagagattgagggtcgttgaaggattcggcgattatcctttcgcggacatgactgacctgtgcctagtgccggacattgtcatccctccgaagttcaag

SEQ ID NO: 63107 - DNA, 144 bp, Glycine max
  Peptide Sequence Number=SeqID_154792
atggagaataatatgaagaacaaagaattaaaatcaatggcaacagaatggagaaggaagaaaaatgattggagatgccacttcaaggagaagatgagtcaagaagaagctcaccatcataggaagccatggataagagcttga

SEQ ID NO: 63108 - DNA, 66 bp, Glycine max
  Peptide Sequence Number=SeqID_154793
atgggggtgcaaatagcacccagggcccacttggggcccctccagcatattcctccaggaagggct

SEQ ID NO: 63109 - DNA, 334 bp, Glycine max
  Peptide Sequence Number=SeqID_154794
atggggacaaatcaaaacggcaaaaggttttatcaagtcaaggttaaaggtctagatgtcactagcctcaaggaattagaacgattgatgggacctctccaaaggcaagccttccgcaaagtgtatgggaagattctagatttgaccgtagcggaggtatttacggaagctgtcgtgtccctcgcccaatactatgaccagcccaagattgcagctgtgattggggattcagcaaaagagttgggtcgcatgaagcaaattcggaatggaatagtgggcctgccacagaaatacttggaaggcaaggcaagggatatggcgagccattacaagg

SEQ ID NO: 63110 - DNA, 360 bp, Glycine max
  Peptide Sequence Number=SeqID_154795
atgggcgacacgccctcgcctttagaggactacacgtcctcaccttcagaaggctacacgacctcgccttcagaggactacacgtcctcaccttcagagggctacgcgtcctcgccttcagaggactacacgtcctcaccgtcggaggactacacgtcctcaccttcagaggactacatgtcctcaccttccaaggactacttgtcctcaccttcaagagggctgcacgccctcaccttcagaggactacatgtcctcgccaacaaagggctgcacgccctcaccttcagagggctacacgtcctctccatcagagggctgcacgccctcacctttagaggattacatgtaacaccctga

SEQ ID NO: 63111 - DNA, 270 bp, Glycine max
  Peptide Sequence Number=SeqID_154796
atgctctgcatcagtattggggaattgataatcatgctacaactctcattgaccatattagcccagaaagggagcttggactaccctagcctgagtctaaagggtgaagggcagaaacatttatcaggctggaggggtagacaagtgaatgtgcaacgggatgggttgaggttgagtatattttggattctatatccaaatgatgcaaagccccaagctgttcactcaacagaggaaatggagcctcataagggggcacatcaggtttga

SEQ ID NO: 63112 - DNA, 453 bp, Glycine max
  Peptide Sequence Number=SeqID_154797
atggcgaatcaagaggagtgggtcccgtttgtggacatattagcattgctaatctttggggttgtcctctttccaaacgtggacggtttggtggacctagccgcgattgatgctttctttgcatatcaccatagcaaagagagcccggtggataggaggcagaataatcaactagttttctcgatggaaggaaggaaaggagggagttctcttctcgtgtggggactacctaaacatcccattgatagggacaaggggttccccatgaggggagcaccggcggaagaaagcctctctcctttccttgtgatagatttcggcgcgcaaagttccaagattatacaaagagtccacaaggcatgggaaatctcattaaggagaaataaagaacttaggggcatccgtagtggcatcatcggtggttatcatgaatggctgaaagttcgtacatga

SEQ ID NO: 63113 - DNA, 555 bp, Glycine max
  Peptide Sequence Number=SeqID_154798
atgaggggagcgccaacagaagaaagtctctcgcctttccttgtgagggatctaaacgcgcaaagtctcaaggtgatacaaagagtccacaaggcgtggagaaatccgttgaggaaagacaaggagtttagaggcatccgaaatggcgtcatcggaggagaactttccgctccggaggaagatgaagaagtccaagctaaaaaattagagctagggaaggtgagactcgccaaggagaagttcaaattagccgctacacacatccggaaggagtgcaccgagttacaagaggaaaacgcgaccactgcaagagcccttgaacaagaaaccaaaagggcccgcaaagaggaatatggccgagagaagttccgaggagcattgtggggtagtaacaatgagctcaagctccgaagagaggagagagatcgatcacgggtgcatggcatgatcttaaaagaagatttagttgcttgcgcgaggtccaaaaggagtttggctcaacacttggaagccacggatgtattgccggaagatgggggcgtattctgcggatga

SEQ ID NO: 63114 - DNA, 255 bp, Glycine max
  Peptide Sequence Number=SeqID_154799
atgccaagcacctcacaaggaccaaagaatggtcgcatgtcatcaagcaaagatagcaaaagaatgtttatacggataaccactcgggtatttccgcgtatcatcgggcccgccgcctctggaatgatacaagggtgcagaatgaccaaacttggtctctgcttgtcatcgggcccgccgcctctggatgacaaaaagggtgcggataaccgtaaggtatctccgcgtatcatcgggcccgccgcctctggatga

SEQ ID NO: 63115 - DNA, 474 bp, Glycine max
  Peptide Sequence Number=SeqID_154800
atgaccatccagaatatgcaatttcagcaagagacaagagcctccattcagagtctgacaaatcagatggggcagatggctactcagatgaaccaagctcagtcccaaaattctgacaaattgccttcacaaactgtgcagaattcgaaaaaggtgagcgccatcaccttgaggtctggcaaccaaattcaagtgcctccaccagtagcagcacctgcacctgaacatgtcaagcttcattctacacctgaaaaaaaggatgagatagtttcacaaaagagaaagcttcctaacaaaaattttcatgcaggtggaccttcttctattaatttcgacttacagcagcctcctatccctcttccattcccacctagagcaattccaaacaaaaagatggaagaagcaaaaaaggagatcttggagaccttcagaaaagtagaggtgaacatacctctgctagatgccatcaagtag

SEQ ID NO: 63116 - DNA, 159 bp, Glycine max
  Peptide Sequence Number=SeqID_154801
atgacgggagatgcctcagagttcacaactatctctcctaagaaagggcatgtaacctatggtgacaacaacagagggcttaagcataatttgcttagtgttagtcaattatgtgatagttatagggtatcatttgattctcaaaaaatatgtcattaa

SEQ ID NO: 63117 - DNA, 393 bp, Glycine max
  Peptide Sequence Number=SeqID_154802
atggtgtcatatgcggctatcacaaatgaggcagaagtgcctgaggagagtgaagaggtgcaagccttgaaagttgagctcgaaaagacaaaagtagcaaaggagaagctgaaggtggcagtcactagagttaggaaagaatgtgatgagctgaaagatatcaacatgactgaggctgaagcgctagagtgggaaacaaaaaaggttagaaaggaagagtggtgcagaaacaagttccgaggggctttgttaggcaatcgtaatgagctcaaacttagaaaggccgagagggaaaaatcaaggatggagagcatgatgttggaggataagttaaagagttttcagaggtcgaagagaaatttgaaagagcagtttgagccagacggaagataa

SEQ ID NO: 63118 - DNA, 237 bp, Glycine max
  Peptide Sequence Number=SeqID_154803
atgagcagaaatgtctccgcattgattggtaaatctgttcctcaaattcttgaaaaatgcaaagatccaggtcccttgcagtcaactgatgtggtaattcatttagctaatagaagtgttgcctatcctgttggtttctgtcgcaacctacccttcggcgagagggcgacgcgagactcgcgggatgcgtgttccatgaaaggaatacgcgcggagtcgccaccaacgtttatttga

SEQ ID NO: 63119 - DNA, 588 bp, Glycine max
  Peptide Sequence Number=SeqID_154804
atggaaacaagtccattgctaccttgtttctctaatgcggccttgatggtggcgcgggtaatgctcaggcacggttatgagcccggaatgggtctgggcaaggacagccatgggaatgctgatgtggttgacatttggggtaacccgcacaaatatgggttggggtatgagcccgggaaacctggaagaaggaatgcaccatcaagactcagggcagatagggcatggcccagtcatgttagccaatgtttcacaagggccgagataatgttcgaggaagaggtggcggcaataggaggagaagctccacaaatccgccaagtttcatgtgaggatcgatccttggaggatcctaacaacgagggcttgataatcgattttgatcgagaagtaagtcaaacaataaacgaagaagaggaagaggatgtcctttcaccagagttggagaggttgatcgctcaggaagaacgcgaaatgaagcctcaccaagaggaaaccgaactgatagacttagagaccggagagggaaagaaagaagtgaaagtagggaccggtatgaccgcaccgcacctatccgccaagatttga

SEQ ID NO: 63120 - DNA, 270 bp, Glycine max
  Peptide Sequence Number=SeqID_154805
atggagagatgtcataacttcgacaatgggaagagatctcgagaaggttccccaacacttaaatgctataagtgtaatcgacccggtcacataaaggcacactgtcccacaaatgaatcatggccaaagaagaaaagtcatgaagaaagaagatccaagaaggcgtatattgcttgggatgacaatgactcatccgatggttcggagaaggagatcaaccttctatccaaggactatgagagtgatgagaacatctctcaagaagattaa

SEQ ID NO: 63121 - DNA, 201 bp, Glycine max
  Peptide Sequence Number=SeqID_154806
atggaaaaatctgaaaagaaaaatcatagtgaaaagaaactgaagaaagcatacatcacatgggatgaaaatgatatggaatcttctgaagattctgaaaatgaagagataaatctctgccttaaggctaaaagttacgaaagtgatgaagagaagaggacatggcatatcaacttgctacttcaagaaaaattacagtaa

SEQ ID NO: 63122 - DNA, 222 bp, Glycine max
  Peptide Sequence Number=SeqID_154807
atggagtttaagggaagagaaagtgcaaactcagatttatactggttcggccacacccttgtgcctacgtccagtccccaagcatcccgcttgagagttccactatcttttgtcggaagcctccggtgcctctttgctttcaatgtatcgcttgatatcgaaataccaaggcttactgatggaagcttgcttgtggagcttctatggaggctggatctttga

SEQ ID NO: 63123 - DNA, 309 bp, Glycine max
  Peptide Sequence Number=SeqID_154808
atgactgttgcagacagtactaagacaactctccctaaaatcgaaagtgttgaaaagtttatgggattagtgggagagcactctcaaacagctgataagtctcttgttgggacattaatgagtacattgaccaccatgaaatttgatggttcacgtactatgtataaacatgtcattgagatgaaaaacattgcaacaagacttaagaccttgggaatgactatgaatgagaacttccttgttccatttattctaaactcattaccgtctgagtatggctcgttttcaaatggagctataataccatga

SEQ ID NO: 63124 - DNA, 303 bp, Glycine max
  Peptide Sequence Number=SeqID_154809
atggagggggagcggttaatgccgtcgagtcggatgatagaccaaggccggctagaagtcggcaatgaggggggtgaagagcagcacatatgcatgcagtccacagatgaggaaggtcttggaaagcctaagcctttggtgatatatttcaccagagatgcagctccccaaacgccccgatacccctcggtagttagacctattccgtttccataccaaaacagccacacagttctgtggaggtatgcgcctccaagtgaaaggaaggaagaagccactgacatcagctcgttgtcggccaag

SEQ ID NO: 63125 - DNA, 344 bp, Glycine max
  Peptide Sequence Number=SeqID_154810
tgtgcatcttgatcattctgtgcattttgagcattctgagcattccgagcattatgtgtattctgagcattctgtggccggtgattctgaacattttgattttgagcattcggcgactaattttcatactgagaacatggctcaacctccaccttgtgagaggactgtcgcaacctacccttttgcgggagagcgaggcaaggttcacgggaaaccggtcatgaagaatattccagattcgggagttatctttacgtttgaggaaggtattagcacctttcacgttgacaaaaatggggctcttgctcctacgtaccctccatcgaagaagaaatcagacctac

SEQ ID NO: 63126 - DNA, 303 bp, Glycine max
  Peptide Sequence Number=SeqID_154811
atgcctcctatagtagtcatgactcttgcaagagttaaagtgaaaaacttagtgattattatagagggcgccatagttcacatactaaacatcactccaaaagaagagaaaaggatagaaggcctcaagaggttgaacaactctttgcttgccatcatattagcgaagagagaaaagttccattggctacccttagctttcaagggtgtgccctctattggtggacttcccctgtttgggaacgaagggattcacggggatcctccagtagagtattggaatgatcttaagagtgccccttag

SEQ ID NO: 63127 - DNA, 310 bp, Glycine max
  Peptide Sequence Number=SeqID_154812
gagttcatattcctaccaagaggtttattggagctttcatcacaagatgccttgttggccgaaaataagttgttgtccaagcaacatgaagctttaactaaaacactaagttgcacactttgtggtggagctcatgggtcaggcttgagaaatcccactaaagaaacatctcatgaagttaattacatgggaaaccaacctagacaaaatttgaatgcgggtggattttctggatttcaacatggccaaccttaccagcaacataatcaatggagaactcaccctggtaatcagttcaataaagaccagg

SEQ ID NO: 63128 - DNA, 336 bp, Glycine max
  Peptide Sequence Number=SeqID_154813
atggcttcctcaccaaaagaaacttccgttcctagttcacccgctgtaccatcatctccgcaccaggaacaaccagaattcaacatccaacccatacaaataattcctggtcaagcttcagtccctgagaaactgattcccagaagacaacagggagtaaagattgctgaaaaccctagccttgcaacaagtcctagggaagtagacacggagatggataagaagatccgcagtattgtgagtagcattctgaaagatgcttctgtgcctgatgctgagaaagatgttccaacatcgtccaccccaagtgtttctgtgcctgatgctgagaaagat

SEQ ID NO: 63129 - DNA, 186 bp, Glycine max
  Peptide Sequence Number=SeqID_154814
atgtcagtgaaaaacctcgtcggacgcctaggagtacatgacaagacaaaccacacactaacaagtcaagtcactctcactaggcttaaaggagcactcaaatcgggtgaccccaaggcctacactccgaagagtccatcagggcctctccctcctgattcaggtccaacccaaaaaacattttag

SEQ ID NO: 63130 - DNA, 309 bp, Glycine max
  Peptide Sequence Number=SeqID_154815
atgagaacggcgttgccccagttgacgttcgtactgaagttcagtaaccgtgtaacgcgaatgggagcatctcgtgccaatctttggcgtggaattgtgatgctggattttaaactcctcgcacatttcccccatcatcttgttattcaggttggtgccgttgtccgtgataatcttccttggcgaaccgtatcggcagatgatctctctcttgatgaacctgaccactacacccctcgtgacattggtctaggaggccgcctcgacccacttggtgaaatatctatcgccacaaggatgaagcgatga

SEQ ID NO: 63131 - DNA, 408 bp, Glycine max
  Peptide Sequence Number=SeqID_154816
atggccagaggaggaactggtctgatgggttcgatgaggaggccatcgcccagctgctatagacaggctcagggtgatgctccacaggccgcaagcgcgccaccaccacctcatcaggctggccaggctggggcatttgacatggagcagtatttacggcatttggttcgccaacaggcggccaaccaccgagcacatgtacagacccatgattgtctgtaccagatgagcctcagcatgcagagccagggcttcgcttctttttcatgccctactccagaccagttcagggcagaggttgcatggcccggagattggcccgaggcccaagcgggagaggcgcccccagaagctcccggcggtggagaagaggcccacgaaggacgaggagatggccgatttgcttga

SEQ ID NO: 63132 - DNA, 144 bp, Glycine max
  Peptide Sequence Number=SeqID_154817
atgaatgaagctgatgaagtggatgatggacatgcaaatcgtgtagatcatgatgaaggatcatggccacagatccgacgtctcccccgcagtccgatggtcaatcaaaggcaacttccaagaggaaaaagagaacaagagtga

SEQ ID NO: 63133 - DNA, 294 bp, Glycine max
  Peptide Sequence Number=SeqID_154818
atggttgcctcctttggttaccacaaagagcgtgatggctcttgggtaaaaaaggatgctcaatcaaatgatgatgaaggacacttactggttgaaggagactcttctctccttcagagtattttggacaggtttgatggacttcaaacctatgttggtgagaggtttgactccttggaatgtcatgtggacacacgattcgtggagatgaactcaaggattgcaaaggttgaagaagatgtcaccattattcatgactgctttgatttacctccaccactaccattagtttag

SEQ ID NO: 63134 - DNA, 150 bp, Glycine max
  Peptide Sequence Number=SeqID_154819
atggtgtggcgtctccaatcatcttccttacttcttccctccgctgccattgaacttcaagaagcaaaggactccattgatgaagaagatccaaggcctacaagctacacatggagctacatcatgtggtatcagaacatcttcgtctag

SEQ ID NO: 63135 - DNA, 738 bp, Glycine max
  Peptide Sequence Number=SeqID_154820
atgtatgaccagttagatgaggcttctaggaccaccacacaacagattgcggggtacctgactctattccagtgctggatctatgagcacttcgctagtgtgcaccagtgcgtgacagatgatacataccaggagacgtccccacgcgcttcccggtggttgacgtcgaaggcgcacatgaagggaatcacaggagcaccttacagggtacgttgtgatgctttgaccgtcacaaatgtgtcctggttgccgtacactgagcatcagggggttagggcctttgagctgatttcatcattccagggtcagctaagatggggtcctatggtggtcacagctcgaccggagagggtggtaagacagtttggttacattcagagcatccctccgccgcctgttagtgctcaattgtcacacgatgatatagatgacagttggatgcatttttcggagcacgtactacctgtgggtgagctttgtctagtgcctaggcaggtaggtgaccagcctagagatgcactagccgcagaccctgaggagtacatacagccgtccagcccccaggttccagtgacatttgacccgcctcgacatgcagtgatgattatgacggatatgagacgattgcacagagtttggagcatgtgctcaacctttaggatggtcactgcaggcactgagttatatgaaattatgcaggactgcctgacgattgccagagggggagccagtgcttga

SEQ ID NO: 63136 - DNA, 414 bp, Glycine max
  Peptide Sequence Number=SeqID_154821
atggcagagcaattaatccatgatcgcgtggagatggagttcctagagggattttgggagaccctcgaagccaatgagaggtgccgattccgtggcacgattcgactcacgactacttcattggtacatccagaggaacctgcacgcacgcttcagcggactgtggagtgcatactacctacacctactccatatcgactagtggagccagttcaagtgatagaggtgtcatcctctgaagaagaccctgaggaggacccagaggagttacctcctgagcctgctgtggatgctcttgactttctagaggatgataaggacccactccctgatgtggattctccagaggatgtcatgtcagcatctgaggcagactctacggaggagagcggccctggagggacggcgaaataa

SEQ ID NO: 63137 - DNA, 270 bp, Glycine max
  Peptide Sequence Number=SeqID_154822
atgggcccatcggtggctaccaccaagagggctcatagggaagagcacggccagaacaagttccgaggggctctgtggggcagcaacaacgagcttaagctccagagagaggaaagggaccaatcgcgagtagacagtttgatcttgaaagatgagttgaagcggttatgcgagacagagaccaacatgctagccatcgtcagcaagtaccaagaagaactaaatctagccacggcccatgagcacaaagtggcagacgagtatgcttga

SEQ ID NO: 63138 - DNA, 276 bp, Glycine max
  Peptide Sequence Number=SeqID_154823
atggagagatgccataacttcgataatgggaagagatctcaagaaggttccccaacacttagatgctataataatcgacccggtcacataaaggcacacagtcccacaaatgaatcatggccagagaagaatgagaagaaaacccataaagaaagaagatccaagaaggcgtatattgcttgggatgacaatgactcatccgatggttcggagaaggagattaaccttctatccaaggaatatgagagcgatgagaacatctctcaagaagattaa

SEQ ID NO: 63139 - DNA, 387 bp, Glycine max
  Peptide Sequence Number=SeqID_154824
atggagaataacgcagccaccgccaccgttgttagttcggctgccgaagcagatccaactctcctagctatcgcgcaccaccctatcccaaacgtggtaggacgagaaagaagcgcactggggtacatcagcaacccccatccgggatacaaccgagtggcttacccctatggattaccacctaattacacgccaccagtcatacgtgatgacacgggtcatgtccttaaccccatccttgaaggggagcctcctcgacagtcggatgaggttcacgaggatcgtcaagagcatgcccagggagacatcgaatcctactccccgttccccgtcgaggggccagcacccaacacactacctcagcccaacctcacgggagaaccttga

SEQ ID NO: 63140 - DNA, 399 bp, Glycine max
  Peptide Sequence Number=SeqID_154825
atggtggcccgggtgatgttagggaatggttacgagcccgtaatgggtttaggcaagaacagcggcggcagaaccagcctgataagcgccagaggaaaccgtgggaagtttgggttaggctataaacccacgcaggcagacataataaaaagtgttgcgggaaggaagagcggaagccaaggctcgcaattgggatggaaagtcgaagggggcccgccctaccacatcagtaggagcttcataagcgcgggtctaggacacgaaggccaagtcgttgcgatatgcgaagatgattcttcgagtgggtcggatttggtacgaccatgtcctccttgtttccgactaggaaattggcgagtggaagagcgcccggacatttacgcgacaagcataatgtaa

SEQ ID NO: 63141 - DNA, 866 bp, Glycine max
  Peptide Sequence Number=SeqID_154826
gaattagaccacaggaagcaagtcgaaaatggggtggttggaataccgagaaaatatttggaggcaaaagcccgaatcttggcaggcaaaggtgaatgggccccgttcatagacattctcacactattgatcttcggaggagtcctctttccgaatgtggatgggctggtggacctagcagcgatcgacgcttttctcgcctatcatgaccacaaggaaagcccggttgtcactatgctagccgacctatatgacacctttgaccgaagatgtgagaagagcagtacgaggattgcttgttgtactccagctctttatgtatggttagtttcgcacctttttcgccaagaggagcatctgtcaactggttccctcgatggaaggaaggaagaaccagagttcttatttcacgcggaggatttccaaatggtgccactaaaggatgagctcgcgcatgtcatttcacgaggcttcaataagaccaacatggagacacttcagaaggtccacaaggcatgggaggtgttgcaaaagaaggacaaggaactcgggggcaataacaatgggcccatcggtggctatcgtaagtggttaaaagcccacgtgcaaggtttggattggcttccaagtttgagaaccgctaaaagagaggaagttgaggcaccggaggaagacaaagaagtgcaggcccttagggcaaaactcgagcaagcccaaatagttaaagaaagggaagaacacggccggaacaagttccgaggggctctgtggggtagcaacagcgagcttaaactccaaagagaggaaagggaccaatcacgagtagacagtttgatcttgaaagatgaattgaaggcttgctcgag

SEQ ID NO: 63142 - DNA, 219 bp, Glycine max
  Peptide Sequence Number=SeqID_154827
atggaggaaatgcatggagaagatgatgaagaacaaggaattaaactccacgtaaagcttctaatccttggattttattcatcaatcgagtcctttgcttctcgaagatcaatggcaatggaatggagaaagaagggaggtgattggagatgccacttcaaggagaagatgagtcaagaacaagctcaccaccatcagaagccatggataaaagcttaa

SEQ ID NO: 63143 - DNA, 345 bp, Glycine max
  Peptide Sequence Number=SeqID_154828
atgcaccacaggccacagatgcaccgccaccacctcatcaggctgatccagctgggtcatttggcatggagcggtatttatagcacttggttcgccagcaggcggccaaccacagggggcagcctcagtctgcaaagccagggtttcgcttcttttgcgtgccctactccagatcagctgagggctgaggttgcatggcccgaggagattggcctgaggcccaggcggggaggcgcccacgagagagctcccggcgacgcggaggaggcctcatggatgagtggagtcatggacaatagttttatacggtttttgagggtgggtgtatctaggactgactgttag

SEQ ID NO: 63144 - DNA, 441 bp, Glycine max
  Peptide Sequence Number=SeqID_154829
atgtctcttgccactctctttggaaaacttcaagaacatgaaatggaacttatgagactccatcaacatgaagagaatgatataaagagaaaaagaatagcattcagagcctcatcatcttttattcaagaagaaagtgacaaagaggacttgactgaaacagaagaagatgatgatgatttcagactctttgtgaaaaggttcaataaatttttgagaaacaaaagaaataaaataaaatcaaacatcaatacaaagaagaaagaagaagactcctccttagccccatcatgctatgaaagtaatcaaccttggcacatgagatccgattatcttgtctttgaaagaagaattgaaaaatccgacaagaggaatctcaaagaaaagaaagcatatatcacttgggaagaaaataaaaaaaataattcttcaagtgattaa

SEQ ID NO: 63145 - DNA, 246 bp, Glycine max
  Peptide Sequence Number=SeqID_154830
atgtctaaaccaaggacaagcttcaaccacagcaacacaaaaattgctttgttctttgttctaggtactccaaagcccctcaatttaggattacgtcacaggttctcactgagaatgtccgggttgggtcgggaattgagcaagcttggaactcctcacccattcctagaacttcctcagttcaagcttgtaggcattatggggtttactctcatcaccaacttggtctcatggcagtcgggctga

SEQ ID NO: 63146 - DNA, 261 bp, Glycine max
  Peptide Sequence Number=SeqID_154831
atggatggcgaggagctgccctcgcccgtgaactccgatgtagttaaacgatattacgctttgaaatctggggcaatcgagaggaccgctgcatcaaaaagtagaatcgtctcaggccatggtcagaagtcaagacaaatcaatggcagaaatcaaccaaggtacatagggacggatcgagtggggctagggtcacgaccgaccgatcgttgccccttcccggcgctaaacgagcagagaacgtcgctccaaggcagccca

SEQ ID NO: 63147 - DNA, 195 bp, Glycine max
  Peptide Sequence Number=SeqID_154832
atgggaggtgttgcgaaaaaagggaaaaagaactcaggggcagtacaaatgggcccattagtggctgccccttggaacgagaaaccaagagggcttgtagggaagaactcggtcggaacaagttccgaggggctctgtggggtagcaatagtgagcttaaactccgaagagtggaaagggaccaatcacgagtag

SEQ ID NO: 63148 - DNA, 252 bp, Glycine max
  Peptide Sequence Number=SeqID_154833
atgataataacaaaagatgatgacaaaggagatgacaaaaagctcaaagatcaatcaaagaacaactcaagtgaatcaaagatcaatcaaagaacaactcaagtgaatcaaagatcaatcaaagaacaactcaaaagaattcaagactcaagaagaaagtttagagtcaagaatcaagattcaaggttcaagatctcaagaatcaagatcaagattcaagactcaagattcaagaatcaagagaaggcttaa

SEQ ID NO: 63149 - DNA, 207 bp, Glycine max
  Peptide Sequence Number=SeqID_154834
atgtcccttgccactttgtttggaaagttgcaggaacacgagatggaactattgagattacatcaacatgaagaaaatgacaagaaaaagaaaggaattgctcttaaagcatcatcctcaattcaagaagaaagtgatcaggataatgatccagaagatgatgatgatctaagtctttttgtaagaagattcaacaagtttcttaaa

SEQ ID NO: 63150 - DNA, 273 bp, Glycine max
  Peptide Sequence Number=SeqID_154835
atggttgaggggtctgagctgaaatgctctcctcctctgctgctgctggtgttgtgggctcctcagtcacaggctcctgggctgtggaggccccaccccttccagaggaagaaggctggtctcctggccaggccacctatgcgcaaactcctccatgctcataatggaggtcaagcccaagccctgaaggctctgcatgatgatggactgccctctatggatgctctggagcatggagtgaagcatctgaggagtgaaaataaaatctactag

SEQ ID NO: 63151 - DNA, 489 bp, Glycine max
  Peptide Sequence Number=SeqID_154836
atgaaggaaccactgatgatgaaccctaatgaaaacatccatagcatccagaaaagatttacacatatagtaaaccaccttgcctctttaggaaaaatctttcctaatgaagatttaatcaataaagttttaagatgtataagtagggaatggcagtccaaggaacatgagatggaactccaacgacttaatcgaaatgaagaaatcgacaaaaagaagagaagtatagcccttaaagcctcatcatcaatgcaagaagaaaatgaagaagaagattcaaatgatgaagaagacttctcactcattgctaattgtccttcaaatgaagaatgtcctgagaaaagtgataagaaaaggtatgatgaaagaaggaccaagaaggcctacattgcatgggatgacaatgattcatccgatggttcagaaaaggagataaatcttctaaccagggattatgagagtgatgaaaacagttctcaagaaggttaa

SEQ ID NO: 63152 - DNA, 402 bp, Glycine max
  Peptide Sequence Number=SeqID_154837
atgtctgttggggagtacacggctaagtttaatgagcttctgcagtattggcctcaataccaagatgctcggaatgaggaagatttatgtgctcagtttgagaatgggcttcggatctttgaggacaagatgaaggagaggcaagctagaggcgttggaggaccacagagaaaccatccttttagaggagatagtaataagaggatgaagccgtatgctagcaacaaggggaagcaacccatggctgcatccaacatgagtcagtcaagggggactcgggtgcagtgttttcagtgtgggggaccgcatcttaggaagaattgcccacagctccagcagacacaggagaatcgctgttatgtttgtggcaggtgggccactatgctcgagaatgaagggtga

SEQ ID NO: 63153 - DNA, 198 bp, Glycine max
  Peptide Sequence Number=SeqID_154838
gtgaaggagacatcctcaccacttgtgtttttgcagtctttcaccttgttcttctctttgttgtaaaggagattttcggactatggaaagctaaacctctgttggatcttccctggtcattcaacagtgggaactggtctgattctaaagcccttgatagtacgggactaagttgttgtgctatcatgaggaatcggg

SEQ ID NO: 63154 - DNA, 201 bp, Glycine max
  Peptide Sequence Number=SeqID_154839
atgtggtaccatccccaaggaaatagcctaagtgtgtccacacgacactctcacttaggaaaactaagcagcctaggatcttcttcatcaatggattcctttgcttcttggaagatgaatggcagcggaatagagaaggaagagagagaggagacgccacttcaaggagaagatgagtatagaagaagttcaccaccatag

SEQ ID NO: 63155 - DNA, 336 bp, Glycine max
  Peptide Sequence Number=SeqID_154840
atgtgggcctttcataccgggcatcaacttgactgggcacatttagtcagatatcgcatgcataaggcattgcgattaaatgctccattgccatatccacatcttattactctttttttttgccattttcaaattcctcttgattctgaaccttacgttccaatcaagagatcctttttaattggcgctgttgtgattgctcttgggtcaaaaagggcgctcaacccactgatgaagaaggcaacctaccagttgaagataattccactcttctttgaaggcttatggacaagtttgatgttctttttgatgttgccaaagggggagagaacttga

SEQ ID NO: 63156 - DNA, 198 bp, Glycine max
  Peptide Sequence Number=SeqID_154841
atggagaggactcagttttctcctcaccaagagtcttgtgaagagtgctgctcaagccttgacggtgaatcttcaagcgatggcgccaaatattctgccacttgggatgaagaagagggagctgctaccctttgtcactgggatggttcttggaaaggggtacatggaggccaagaagaggctcaagaagggggatag

SEQ ID NO: 63157 - DNA, 456 bp, Glycine max
  Peptide Sequence Number=SeqID_154842
atggctatactcgtgaatgataaagacttccgctcgagggggagactaccatgtggaagagactcacacttgagggggagatgtgttgggttacaagtgcttccttatgtggtggctcgtggtccacaggtgtacccctcgaatctccccaacattagagtcgatggtcgtgttgtgactggatctagcttcttacattgggatgagttatgcgacaagttactaggggaagtctctccagaaaatgcacgtaagggagctgcactgaagctgacatggttgcttagcatcttacgcgcaccatttcttgaagaaccaacaatacaccaagtacaatgcaagtgtagagcttacataatatggagtggtggtagattagaatatagggccacatgtcatggtgacttggtcggatatagatctcgtatagatcatatggagagtcatgagatataa

SEQ ID NO: 63158 - DNA, 168 bp, Glycine max
  Peptide Sequence Number=SeqID_154843
atgtttgacacagtcattcactcctatacttcttgcccgtacacctgggatgaaccctgctatcctcgtcgtcttattgtggaggtacctggagagcgagttttgggatcatatgacctcgacgatgttaaagaatatgtgcctgtctacctgccatcaacctctgag

SEQ ID NO: 63159 - DNA, 5211 bp, Glycine max
  Peptide Sequence Number=SeqID_154844
atgaaggaagaaaaagacagccaggttgtgcttttatcgggaaatttatcttctcctggtgctgcagttggagaagactgtgtttctggaccaaatattgaagttgatcaatattctgatgtggctatgctggctgatgcatgtttcgctatgcattatgaatcttccagaactgatgtgctttgtcataagatttttatgtacttaaataatgctgatatccactgctacccacatattgctggactgctcattggattctttcataggttgtctgcctatagtagcagttttgagaaatcctctgccagtaatactgttgacatttcaaaaattttctcaagttttgggttacagaagtttggcttctcaaattattttgaatttggtttcactgattctgcttgcattccattggattgctttccatttgtaacgattcacaattctggttctcttggtaatctagagagcgcactcgtacatgccattcctgactggagaaaatattttatcctgagggacagaaaaatcaaaagttccaatataaatatgaggagagggtccaaatttttccaggtctctccctcaaaatccaaatctgattttgtatattctcatgaaactgggattgcgagcacctgtgatattttttctactgaattgcacctatttggaataagagcacattttcatgactcatcatgcattattgggacaatcatggtgcctacttctaagtcttctctattattttgtgaagacagtatggatatattgtcttcttctgaaggattggctcttacatcatcttgggggccgcaaaattttcaagataatctatggggtccctcttcaccaaatttgtctcctattttaaatgtacgagtcaggaaaggacaaaatatatcttcaactattgatttggaaataagcattggcattcagcatgtctactgcatgttaccttccgaatatctctccattatcattggttacttctcattatctgattggggtggtgcttctggtgaccagtgtttctctgacgagcaaagtgatacagatgtaaaaaatgaaatgaaaattacatataaatttgaaatcttggactccaatcttatttttccagtggtaagtaatgaccgtcagtttataaagattgaaatgccacagctttattgtagtttcatcgagaattctggtgttgatgaagtactaaagaacatccctcctgaatgtttggttcctattcataagcttgcaaaaagaaatgattgtttaaatgtatttgggcgagacttgtttgtatcattccttctttacaagaatgatttgcttggcttagcaacagttgaacggaatacggaatttttaacaagtgctttaattgcacccataaatgcagatgtttgggtcagaattccagttggtggcaaatctaattgcaaaagtacttcatcaatatgtttcatgacaagcatcagcagttgtcatattgttgcagaagatttgggtttctcttccgtagtgttttactctccacgtgattctattttagcaaaatgcaccccaacttccttttccatgtcagtacttagtatctctttttctcaatctattggtggaaaaaataaacttgacctttgtctttcatccattgatatttggcttcatttggctgagtggactgaggttgttaaattccttaatcatttccgtttacatttggaaagaactcctgtgaatgcaataacaaatagtttgtccgtggatgcttctaattctgtaaaaaaatcaacagttcaacatagttcaagtttccttgattctgaaagcacctcagcaccttttacttcacaagagattgagaatgatgtctttataattaagtcagaaaatttttgtattacatttcacatccctgtttgggttggtgaggaacctcatgtggaatttcagcattctcaaggtctcaatgtgacacctttaagtgtatcttctgatatagttgaagaaaaagatgcaaaatttcttactgtttctttcaacatgaatggttttgaattagttataagaagcagagatatccaactgacgtccaaaatggaaaaacttagcagtgtaataatgatagttgagaatggaagacatacatcttgcccactgcttgatgtaattgaggttcaagtggatgctgtactctgtaagaatcatacgaacaccattgagctcaatgtggaaattgcatgtgataattcaaatgtatggatttcgcatcctacatttcatttatggaatgctgtaaaatttgatgttccggaatcaggaccttctcaatattcaactagtggcattactttcaaattccagatgaggaaggtttctattctactaacagatggaaggtggagctacaatgggcctgagctggagattctggtcagaaacatcttgtttcatacaattgcaagtggaaagcacatggaatgttctgtcaatggtgatcttcaagtaaactacaataacatcgaaaaggtgtcatgggagccttttattgagccttggaagtttgtgttgacattagtcagggaacaagaaatgagtgttatgccgaataggtccgtttcaacagatatcattctcaaatctacaacccagctgaacattaatattacagaatccttagtagagtgtctttcacgtgctacagagatgttttctgatgccctgggtcttatggtattggatgatcatgaaggcaacaaacttgtgcattcaccatgtgcagaatatatgtgtactagaaaatgtggtgctccttatgttttgcaaaacttgacttctgtgcctcttttatatcaagtatttcatgggcttgtcaatcctgatgatcttcatgattctgatgagaatcatgcaaaatatgtgcaaccaggttcttcaattccgatatacatggatgaaaatgctgaacagcaactttcgcgtttcaggccttctcattcttctgatagtttaaatgagccaaggtcaaatggatttgctcatcattatattactgtgcagcttgaaggaacttctaggtcatctggtcccatttcaatggatttggtgggactaacatgctttgaggttaatttctccaagacatataatgacactgctgaggataatagtctgaatacatcccctacttttgttgttccggttgtatttgatgtttcagtgctgcgccatagcaagttaatacgaatatactccactgttgtacttctaaatgcaacctctacccctgttgagctgcggtttgatattccatttagtgtgtcaccaacgttattaggtccaatacaacctgggcagcagtttccacttccactacatttggctgaagctggctgtgtaaggtggcgaccaatggggaactcttacttgtggagtgaagctcataacctcaccaatcttctttcagtaaacagcaaagttggaaattttaaatctttcatgtgctatccatctcatccaagtagtcgtccgtttcggtgctgtctatcagttaagaatattagcttgacttcatctggctggctgaaaaataatgtccctgcaaatgatgtaaagaagcactatattcatcacttgatcttaagtgctccactaataattaacaactaccttcctaaagaaattttgttgatcagtgagagtggtggggtaggccatactgtgagagtttcagaggtgggaacttctgtatatcatattgatccctcacatgacctaggactggagatctgcattgatggatttaaatgttctaattttaaatttcctcgtttagaaactttctgcacaatggcaaagttcactgaacccaagttttcattttctgaaaccctgatatttgaaccaaatagttctaatggcccagtatatgttactgtagagaaagtgatggatgcttattctggtagtagggaactcatcttttttgttccctttattttatataactgtatgggttttcccctgtgcgtaacggaagccactggtgaaaccaatgaaagggaatttgtcattccttcttattttgacggaggtgaaaatgaaacattatcatataaaaaggatggtctttctttgcttacatccaaccgtgaattacccgtggaagttcctcataacccaaggagttatatgaagaatcataccatttcttacagagaggatggtagtgcaaactctattggtaattaccataagaatttgggaaggcaacacagcaaaattgattctatatttcgaaattcttcttcaggaaaattgaagagtatgctgagctcgaagatccagtccacttggaaggattcaggttctggtaatcatgagcgtgagaaggttcagccatgcatttattctccaagccctgattcctctgtaaatgatgcttttgttaaagtatgtagatgtttttctgaagatgccaaggaacagttgccatattctctgtggtcaaatccattttctctgctaccaccaagtggttcaagcactatccttgttcctcagttgacttcaaattctgcattcattctagctatgacatgtaactcagttactgaacaatatgctgggaggataaatgcaatcacttttcagcctagatatgtaatcagcaatgcatgcagcaaggaaatatcttataagcagaaaggcactgatgccgtgttttatttaggaataggaaaacatgatcatcttcactggacagatacaaccagggagctgcttgtttcaatttgttataatgaatctggatggcagtggtctggaagctttttaccagaccatctgggcgatacacaactgaaaatgaggaactatgtttttggaacttcaaacatgatacgagttgaagtgcaaaatgctgacatatctatgggagatgaaaaaatagttggaaacatcaaaggaaactctgggaccaacttgattcttttgtcagatgatgatacagggtatatgccataccgaattgataatttctcaaaagagctttctctaaattatcatgtgaatgcatctatcttaataccgaaacaacaacaaagccttatcctcctatgtgaggccggcagtacatggatcacacgacgccttttggcttggttgaaaatcatggcttcaggaatattatttatcgtgtga

SEQ ID NO: 63160 - DNA, 1131 bp, Glycine max
  Peptide Sequence Number=SeqID_154845
atggttgttaagtttatgccacaagtggttaataatgtcgtgaggttattgaccatcacatgtgaggaagtactattggagaatgtggagctgatacttgacgcatttgattatctccaacttccatttgcactaaagcaaggtcgagttgggaagttaagcataaaaattccgtggaagaagccttgggaccccattataatcattttagaggatgtctttatttctgcatcacagcgaggcgatcaagagtggagtgctgacgctgttgaacaaagagaatttgctggaaaaaaggccaagctagcagcagcggagttgggaaaattatccagaagggtgtgcggtagtcaagctgggcaatcgtttatttctcatgtcactactaagcaagaaccaaacacttggccacatggtcaaagagactctaataccatgtcaatgactatctctcttatagcttttaggttgctatgtattgacgtaggaatgatccttgacagcatccaagtagacatacggaattttcacgtattatactgtgacatgcagaatgatctggggcatattatgtttggtttgaagtttactagcttgaccatgaagcaaaatcttattggatcttcaaatggaagggtgagagttggccaagaacataaaattgtagaggttaaggggctggaattttattccagaatgtttcatggttcaatggacttggtaaatatgaacaatatgggtaactcttattcagcaaacagtattagatcggaaggaaaacattactattctatactggcaccgtgtgatgtaaccttaattctttcggataacagattgcaaaagctcgatgacaatactcctcagtattctgtcactgctgaattgagtggtttggttatatccttagatgaggttcagttacagcacatgtgccttgtgtgggattatatctgcacttgtagattaagagaaaagtatggtcgctttcgtccctggcattgtcttttaccaagaaaatgtgaaggttggcaaatattttggtggcactatgcacaagaatcagtcctttctgatgttcgtaggaaattgaagaaaacatcttggagataccttggggatcgattgtaa

SEQ ID NO: 63161 - DNA, 210 bp, Glycine max
  Peptide Sequence Number=SeqID_154846
atgaagatgaagacactcatggcaacgacaacgatggatagtggcggcaatgatcggatgcaccaacaacagggtgttggtggagcaagaagaggaagcgaaaacaaagaagggggcgcaccatcagggtggagggtgagggagaggagaagagagaggtgcacaagcatttttgctaggtgcatgaagcaattgccttctttgttttag

SEQ ID NO: 63162 - DNA, 633 bp, Glycine max
  Peptide Sequence Number=SeqID_154847
atgtgcttgtcgttcgatgtctgggaagacattactaatgtcgacgtatttgatctcattattttgcggacaaatcagatgggtcaatctattgtcatacaccgaccaaagaggattgtgcaacagtttgattatgtgaagaccattcctctaacctctgttgttccatttttatctgtaaagaagattgacgataaatggatgcacttctctgaatatcttgcaatggtgggtcagatttgtgttgctcctggacggtgtgcagcagactacatggagtggttctacatgatatttcatcccttcatgagtctaacacaacgtggagttgatccgtccaaaaaaatcaccttagtgcctcttgaaaagaaagtaccaagttggtggaatttgttctacataagccccataagaaaaatcaccttagcacctcttaaaaagaaagtaccaagttggtggaatttgttctacataagccccataagaaaaatcaccttagcatctcttgaaaagaaagtaccaagttggtggaatttgttctacataagccccataagaataaatccaaacaagaactctagggcatttgggatatggtctccttctaatatggatttgcctgaatccaactag

SEQ ID NO: 63163 - DNA, 3183 bp, Glycine max
  Peptide Sequence Number=SeqID_154848
atgctcaagtatttcaaccgaggcagggacagccccgccgccgacgcgtcaccgccttcccccgcggcggcgacgccgtcgtactcgtcatcgtcggcgtctccggtgactggccccgcgaggcccattcgcctggtatactgcgacgagaagggaaagttccggatggatccggaagccgtcgcgacgctccaactcgtcaaggagcccatcggcgtcgtctccgtctgcggccgcgcgcgccagggcaagagttttatcctcaaccagctcttaggaaagagtagtggatttcaagtagcatcaacacatcggccttgtaccaaagggctttggttgtggagtgcacctttgaagaagactgctcttgatggaacagagtacagtctcctgctattagacagtgaaggaatagatgcttatgatcaaacgggcacatacagcacccagatattctcactggcagttcttttgtctagcatgttcatttataaccagatgggtggtatcgatgaggcttcccttgatcgtctttctcttgtcacccaaatgacaaagcacattcgtgttagagcatctggaggaaagacttctgcgtctgaactaggacagttttccccaatttttgtttggctgttaagggacttttatttagacctaacagaagataacagaaaaataacaccccgtgattatctggaaattgccttgaggccagtccaagggagtggaaaagatataaaggctaaaaatgagattcgagattccattcgggctttattcccagacagggaatgtttcactcttgtgagacctttgaacaacgaaaatgatctacagcgactggaccagatatcaatggataaattaagaactggatttcgagagggccttgattctttgacaaagtttgttttcgagagaacaaggccaaaacaagttggtgcaactatgatgactggacctgtattggtcggtataactgaatcttatctgaaagcactcaacgaaggtgccgtgcctacaatttcttcctcatggcagagtgtcgaagaagctgagtgtcaccgggcatatgattctgctactgatgtttatatgtcttcttttgaccgctcaacgccacctgaggaagttgctttgagggaagcacatgaacaagcaaaacaaaagtcaatggctgcttttaatgctattgccataggagttggttcagccaggaagacatatgaggggctccttcttaaattcttcaaaaaggcatttgaggattataggaaagatgcattcatggaagcagatctgcagtgctcaaatgctatacagtctatggaaaaaaggctgagggcagcttgtaatgcttctgatgcaaagattgataatgttgctaaggttcttgatgctcttttatctgaatatgaaaaaactattcaaggtccagggaaatggcaaagacttgctgttttcttacaacaaagttttgaaggccctgtgcttgaccttgtcaagaggctaatagctaccatcgaatcagagaagaggtctcatgctttacaatatcggtctattgaagaaaaagtggaccttctgacaaaacggctggaagccactgaaggtgaaaaatccaactacattaagcgatatgaggatgccatcaatgataagaagaaactcatggatgaatataagaatcgcataactgacctgcaagctaatcgtcgctcactggatgagaggtactctagtttattgaaaacactagactctaccaagcaggattccatggattggaaaagaaaatatgagcaagtcttatcgaggcagaaagctgaagaagatcaagctagttctgaaatagcagccctcaagtcccggagtggtgctgctgaagcaaggttggcagcagcaaaggaacaagctcagtctgctcaagaggaggcagaggagtggaagcggaagtatgatatcgcccgtagagaagcacaatctgctttacagaaagcagctaatgtgcaggagcgcacaaacaagcagacacaattgagggaagatgctttaagagaagaattttctggaactttggctgaaaaagaagatgaaataaaagagaaaactgcaaaaattgagcatgctgagaagtgtttaacaaccctgaatttagagttgaaggctgctgaatcaaagataaggagttatgatacagaaatatcctcactgaggattgaaattaaagagttgactgagaagttgaaagctgaaaatgctaaggctcaatcatacgaaagggaagcaatagtatttcagcaggagaagaaccatctagaacagaagtatcataccgagttcaaaagatttgatgaggtccaggaaaggtgtaaaactgctgaaaaagaagctgcaagggctactgaagtggctgataaagcgcgggctgaagcaggcatggcccagaaggagaggagtgagatgcagagactggcaatggaaagactggcacagattgagagggctgagaggagaattgaaaatttggggagggagaaagataatctggaagctgaattacggagagtaagggattcagagaaggatgcacttaccagagctgtgaaactagaggagaaggtgcaacagagagagaaggatttagaagcccttttggataaagataagacacaccggcgaaatagtgcccagattctcgaacagcttctggaaacagaacgcgaagcacatgcacaggcgaataaccgggcggaggctctctctctacagttacaatctgcacaagccaaaattgattctctccatcaagagctgactaaatttcgactgaatgaaactgcattggacagtaaactaaacactgcttcccatggtaaacgtatgagggtagatgacaacattggtgatgacatggatgtaagtcccagaattgtaaagggaaccaagagaacaaggagtacatactcacaaccagaagatggtggttccatctttgagggtgctgaagaaaatcttagtcagcgaacaagtgaggaggattatagaaagtttaccgtacaaaggcttaagcaagagctgacaaagctcaactatggtgatcagctgcttcggttgaagaatcccaacaagaaagagatcattgctctgtatgagaaatgtgttcttcagaagtcatag

SEQ ID NO: 63164 - DNA, 1368 bp, Glycine max
  Peptide Sequence Number=SeqID_154849
atggagaagaaaagcaaagccaaaagagtccattgtttggtcctagcatatccagctcaaggtcacaccaaccccatgcttcaattctccaagcttcttcaacatgaaggtgtgagagtaacatttgtcagcaccgttttccattgcaagaacatgaagaaactaccacctggcatttcacttgagaccatttcagatggttttgacagtggcaggattggagaagcaaagagcttaagggtctatttggatcaattttggcaagttgggccaaagactcttgttgagcttcttgagaagcttaatggatcatcagggcaccctattgattgtcttgtttatgattcattcatgccttgggctctggaagttgcaaggagttttgggattgttggggttgtttttctcactcaaaatatggctgtgaatagtatatactatcatgtccacttgggaaagttgcaagctcccctcaaagaggaagagatttctcttcctgctctgccccaacttcaacttggggacatgccttctttcttttttaactatgttgagcatcctgtttttcttgatttcttagtaggtcagttttctaacattgacaaagctgattggatcatctgtaattccttctacgagctggagaaagaggtggctgattggacgatgaagatctggccaaaatttaggacaataggaccatccattccatccatgtttttagacaagcaaacccaagatgatgaagactatggtgttgcacaattcacaagtgaagaatgcataaaatggttagatgataagataaaagagtctgttatttatgtttcttttgggagtatggcaatacttagtgaggagcaaatagaagaactagcttatggtttaagagatagtgaaagttacttcttgtgggtggttagagcttctgaagagactaaactccctaaaaacttcgaaaagaagtcagagaaaggcttggtagtgtcatggtgctcccagctaaaagttttagcacatgaggccgtagggtgctttgtaacacattgtggttggaactctacattagaagctttgagcttgggagttccaatggttgcaataccacaagaggctgaccaaagcactaatgccaagcatattgaagatgtttggaaggtgggaatcaaagcttcagttgatgaaaaacatgttgtgagacgagaagtgttgaagcgttgtacaagggaagtaatggacagtgaaagaggcgaagagatgaagagaaacgccatgcagttgaagactttggctgcaaatgttgttggtgagggtggaagttctcatagaaacattactgaatttgtgaatagcttgttccatttgtaa

SEQ ID NO: 63165 - DNA, 363 bp, Glycine max
  Peptide Sequence Number=SeqID_154850
atgattgctagtccagaacgcgcacaactgcaacaacaacaaactacctcttggttgaagcctcccactggatcgctaaagctcagcatcgatgctatgctcttcaaagaattcaacaaatttggggttggcatctttattagaggagatcaaggtacctttgtttctgttaaaacacttctcctcgatggcatacctgaaccaggagaggcaaaagcaataggtctcttgcatgctttaatttgggctcaagaacttgtctacaaaatatcatatttgagcttgacggtaagtggtagtgacaatgctggtggtggttacatcactgttcaaccatcaccacctactactaatcagatatga

SEQ ID NO: 63166 - DNA, 924 bp, Glycine max
  Peptide Sequence Number=SeqID_154851
atgtctgcttttgtggaacgctggcataaggaaacaagcagtttccatttgctcgtcagagaggtgactatcaccttgcctgttgtaggggcgttccacaacttcgagcagtcgagatgttggtggagttactcgaggtcagtgctgcagatgctagagctgagaccattgactgtcacgggtcttatgtgcgactatcgtgactgtgcgagttcgcgagcgtatttgttgcatctccttggatgcacactatttgctgacaagagtgccacacacgtgcacctggtattcttggatgcattgcgtgacctgacgcagagtgcgggttacgcttggggtgttgctgcacttgtgcacatgtatgataatttaaatgatgcgtcgaagagcacggcgaggcagcttgcaggatatatcactctgttacagtatttgatttacgagcattttcgttggacatctggcaaggcactgcttgtggccacgtatcggaggcgtctggatagactgacccttgacgcggtgtgctggattccgtacgtgtctggccattgttcgccagattatctgggttggttttacgtgatctcgcacccattcatctatctgccacagccaggggatcctcttagagtaccatcgattcagcaatatgaagaatttgttgacgcacatatgtatcagcaaccgatggcggcagcggcacctactgaggcacacattgatcaacatgattttggacatgcggtggaggactttgcagcaattgctgataggttgaacaaactactgaacctgaggattttgactgaaggaacattagcctacactgttgttgaagaatgtgtgggcatcgcaagacgctacactggccagccaactgtagccgatagatccaggcgaaggcggcatacgaacggataa

SEQ ID NO: 63167 - DNA, 687 bp, Glycine max
  Peptide Sequence Number=SeqID_154852
atggcagttgaaggatcactcttttttggcatttattcccagacaaaagtgtaccttcaggggggagttcaaagtggggaaccacggcctcaagtgataataccatctgcagcttttagtggtgccatcatcagttttgtgttaggtccaacagatctgataaagtgtaggatgcagatacaaggcactgactctttggttcctaaatccagtagatacagtagtccccttgattgtgcccttaaaactgtaaaagctgaaggggtgaaaggaatttttcgtggaggttgtgcaacattgcttagagaatcaatagggaatgctgtctttttcagtgtatacgaatatgtgcgctatcacatgcattcaaatatcaaagctaattcatccaatcacagaaacctggttgatattggagttgggatcgccagtggtggccttggtggtgtggctttttggttgacagttttgcctcttgacgtggcaaagactttaattcagacaaaccctgataaaaattgtccaagaaatccttttggggtcttgagttcaatctatcaaagggctggattgaaggggtgctatacaggtttgggtgctactgtaagtcgagcatttcctgctaatgctgcaacgattgtagcatgggagctagcattgaaaatgctaggcattaagcgtgactga

SEQ ID NO: 63168 - DNA, 399 bp, Glycine max
  Peptide Sequence Number=SeqID_154853
atgaatggggtttgcacccagcagtcttggaaacacccttatggagttggacacctggtagctggattagatgaatcaggagctcacctctattacaactgtcccagtggaaactattttgaatatcaggcttttgctattgggtctcgctctcaagctgcaaagacatatttggaacgcaagagtgctgtgtgcaccattgctgtggttggagttggtgagccattccacattttggatcaggaaactgttcaacagttgattgatacttttgagattgtgagggaggaagaagccgcaccagctgaagaagaagctcagccagcagccgaacaggatgctcccacagatcagggtgctgctgctgtagaccaaggtggttctcctatggacatctga

SEQ ID NO: 63169 - DNA, 477 bp, Glycine max
  Peptide Sequence Number=SeqID_154854
atgggcacacgtcaaggaaacaaaccttcctctaaaaaatctcatgctgcagaagatagcatttcagctgactcactctcttttgcaggcctagtttctattcaagaccagaattcaaagcctcctattcctaaccacaccacacactactacaagatcacacctgctgatgtgctcatttccaatggaaaaatcaaaccatttcaaccaaatcgacctgtcctcacagatccccccatttccttaagatcattgctagctattgatcatgccaataatagcaagatgtcaaatgtgcaacaagctagaaaatatgatgagcaacgtgtcaaagcaagaatccacaaaagcaaggaaaggagtagtagtgtgacaagaacttggtttggccacaaagtgtttaggtcttttctatctccatgcaggaaatgccaagccactcagccaggtgccgttaaaggacaaagtgtgaaatga

SEQ ID NO: 63170 - DNA, 84 bp, Glycine max
  Peptide Sequence Number=SeqID_154855
atggggacacagaaactcgtttcttctcatggtaccggttcggtctcttcttcgagaaggacaaagtcattagacactggttag

SEQ ID NO: 63171 - DNA, 1143 bp, Glycine max
  Peptide Sequence Number=SeqID_154856
atggggacactcgaggtatttaaaggaagtgaaaggatactcttgacgggagagagagccaacgcgccggttttgacggcgttgggagtgggattccgtggcacaaactcttcttctcttgcgcgttcagttgcgcgaagcagcgtcagttacgatttctcagtttacgattctgtgacccctttccgagtcggggctctgcaaatgtcaatggtggatttggagggcaaagaaggttacaggccttccacggagtacgtggaagacagcaacgaaacactcattaacttgactgactcaaccgagcttttgtttcttaagttgccttcttccaatcatggaatgcgctgcgtcgactttgatcccaccatgtcgcaatcggcagcagaggtcagatctgagttagatctggcgtcatcggtgatgcataaacgtgcggtggtggtgggcagcgaggatgttagagaagggtggcaatgtcgtttcgtaacagaagaagacgaagttgcaaggacggtgaaggtgtttgggtcatggcttcgcaaagttatggtgagccaagggaagtgcagaggtggcgaaggagaacgatctttgggggagaaagtggctggcggtgggaggcagacaacgacggtaggaggccgacggtgggtggctagaatcaacagagaagattatggaagttggacagagagcaacatgaagggggagagcaagcagcgtgaagggagaaaccagtcccttggttcaagcactaagagaaatgaattcttttactctactgcaggaaagatttcaaggcgagtttccactgtccattactctgatcctaaagaacttgaaaatctcaattcaactaacgcaaaacatgcccatggaaattcttctggagtcacagggacaacttcatctcgatattttcctatgcaaagtagtggagcagcttcatcaaaaggtagcagacagagaagctctctaactgaagctagtgagccatctagtatttcaaaacgaagacatgcgtctaaatctaaatccaacttgtccgaggcctcacatggtcacagcactggcatttcctccatgtccccggatcattctcatgaaggaaaagcaaagagaagaaaacataaggaataa

SEQ ID NO: 63172 - DNA, 4626 bp, Glycine max
  Peptide Sequence Number=SeqID_154857
atggcaaggacattccgtgacaatcaatttctaccaaacaagtctgccattaggtctgatgcttctggacagttcagccaatctcatttacatgatctagtggaaggttctgtcagaaatcctccttttgcacatggaaatgaacatctacctagaattcatgctactaaaggtcattcttctcgtgttcgtcttttgtctcaacaagacaagcaattgattccctatcaatctccttctcgggatgatgatgttgccccccaaagggaaatgtacccaaacatagctaatgttggaaagaactctcactttactgatcaccaaattgttgggccagaaaatctccatgctctacatagtggacaagttttgcataacaatgcaacacggattgagaagaaacgaaagagcgatgatgcccaagatgttgaagcccatgagatgaaaatccggaaagagcttgagaaacaagataaccttagacgaaagagtgaagagcggacaagaaaagaaatggagagacaagatcgtgaaagaaagaaggaagaagaaagattgatgcgtgagagacagcgagaggaggaaagagcaagacgtgagcaaaaacgtgaaattgagcgaagggaaaagtttttgctgaaagaaaatttaaaagcagagaaaatgaggcaaagagaagagcttcgcaaagagagagatgcagagagaaggaaagctgctcttgagaaggcgactgctcgtagaatggccaaggaatctatggaacttattgaggatgaacaactggaaatgatggagttggctgcctcaagcaaggggttctcctctattgtccatcttgattttgatactctgcaacaccttgagtcatttagggattcattgagtgttttcccaccaaagagtgtaaagctaagaaaaccatttgcaatcaaaccctggatcaactcagaaaataatgttggcaatcttctcatgataattgctggaattaaggcttctaaatttaaggactcaagattgttgggtgagatacatgttgctcttcttaaggtgataataaaagacattgaagatgttgcaaggacaccttctacaggattaggagcgaatcaaaatggtgctgctaactctggaggtggccatccagagattgtggaaggggcatatgcatggggttttgacatacgaaattggcacaagcacttaaatctgttgacatggccagaaattttccgacagctagcattgtctgctggatatggaccacagttgaagaaaagaagtatttcatggtcatatgcaaataataaagacgagggcagaaattgtgaagatatcatttctacacttcgtaatggttcagcggctgaaaatgcagttgcaaaaatgcacgagagaggtctgttagcccctcgaagatctagacatcgattaactcctggtacagttaagtttgcagcatttcatgttctctcgcttgagggtgagaaaggattgaatgtactagaacttgcagaaaaaattcagaaatctggtcttcgagacttgacgaccagcaagacacctgaggcatcgatttctgttgctttaacaagagatgccaagctttttgaaaggatagctccatcaacatattgtgtacgtgaggcatttagaaaggatcctgctgatgctgagtccattctttcagatgcaagaaagaaaattcagatatttgaaaaagggtttctagctggtgaggataccgatgatattgaaagagaagagtcagaaagtgatgaaattgatgaggatcctgaagttgatgatttagtaaatctgtcaagtgctaacagaacatctgaacagtgtgatgatttctcatcaaatggaaaagcaaatttgggtcataatgttgaacttcaaggtgagtttgataaggatctaccttgttttcctgagagtggttccaagaatgctgatgctccaattgctgtaactggacaacctggtgctgttgaagatctgaatgttggaaatcttggtgaagataatatggaaattgatgaaagcaagcctggagagtcatgggttcttgggcttgcagaaggagaatattctgatctcagtgtagaggaacgtctaaatgctcttgttgtgttggttggtgtggcaaatgaaggaaattcaatccgtgttgttcttgaggatcgtttggaagcagcaaatgctctgaagaaacaaatgtgggccgaatcacaagtagataaagttcgtctaaaagatgatactttcagtaaatccgattttccatctatcaatgggaataaagttgaaatacaatactcttgtccggtcatggagggcaagcaaagcccattgattggcattaatattggcaacaacaacaataataataataataatgtgccctctcccagcattgcagaaaatcaaaaagcagtttttggtgcacagagccagtctattgaaaagcactcttctgctcaagatctatgcactggtccagataaccctcagactcagtcacttggacaatattcaaaaaggtcacgttctcagtggaaatcttatatttcccacatggcggaagagatgtatgtctacagatccttaccccttgggcaagatcgcagacgtaaccgttattggcaatttgttgcatccgcttcttccaatgatcctggttctggcaggatatttgttgaatatcttgatggctattggaggcttattgatactgaagaggcctttgatgcacttctgaattcactcgattcacgtgggatcagggaatctcatttgcgtctaatgttgcaaaaggttgagagttcctttaaggaaaatgttcgtaagaatacccaatgttccaaaattggaagcataggtgaaacatgtgttaaaaatgaagctgatgaaacagattccagtcctgatcggcatactggatctgacagtcctagcagtaccctttgtggcttgaactctgacacttcagaaacttcatcatccttcaaaatcgagcttgggaaaagtgagagtgacaagaaatcggccttgagaaggtatcaagattttcaaaaatggatgtggaaagaatgctataactcatctatattgtgtgcaatgaaatatgggaagaagagatgcaaacctcaggttgtcatgtgtgatatctgtctcaacccttatttctttgaagactcccattgcagtggttgccaccggacatttccctcaaatagtggatttagtttttctaaacatgcatttcaatgtggagataaatcatcgaaagatatttgtattttggattctcttcccttgcggacaagattgctgaaggccatgctagcttttattgaggcatctgttctgcccgaagcattaaaatcaaattggacagaagatattaggaggcattggagtgtgaagttgagtaaatcatcttctattgaggaactgctacagatattgaccctacttgagagagcattgaagcaagactttttatcatcaaccttctctacaacaggggaacagttgggtttgaacagtatgtcaaagagtgctgcacaaacctctactgatcctgaatcagttgctgtacttccatgggttccactgaccacttcagctgtgtctctcagacttcttgagtttgatgcatccattgtctacgtaccgcatgagaaacctgaaccttgtgaggagaaagaagataggtttgctttcttgcagaagcttccttcaagatataatccttctaaatctagtaaagtggctgaagcagcagacttggaccgtgatgaattcatgaaagttaaatctgctcctgtgaaaatagtgcaaagcaacaataaacgaggacgagggagccgtgataaaggacggggtaaaaagctatctaaaaccaaacaaaatactggccgccgtggtgctaaagttgctgggaatgcaggtcagaggattaaaaaacagggagtgggatcacaaggacaagctggtgggcgtggtcgccgaacagttaggaaaagaagagtggggaagaaggctgttgaagatttgttgatgggccatagggatgccagtcatagctccagtattggtagagaatcattgagaagcttggatgatgactgggatgatgaaaaggcaagtcccatgactcccatccacatgggggctgctaacagtaataacagcattgaagaggttgaatctgatgacaatgtcgaagcaatggaatctgatgacaatgttcaagcaatggagtctgatgacaaagtccaagcaatggaatccgatgacaatgtccaagcagcagaatctgatgacaatggccaagctgtggaatatgatcaaggaaactgggaaataggttttaatggtgcccccagcagatggagtagggatttggtaggaggaattagcgatgaggatgaggatgaggatgcggaagcttctgaagatgacaatgacaatggcattggcattgaaaacaatgaggaggtggattcagaggcagatgctatgagtgaggagggttcagatggtactgcaaacagaattgtaaatgaagaaagctcagactcggatgtctctgaagattcttctgattag

SEQ ID NO: 63173 - DNA, 258 bp, Glycine max
  Peptide Sequence Number=SeqID_154858
atgaggaagtgggcacttgcagtcgacaaggacagtgtggacgacactgtttgtgaaaaatatgacattaacaaggagaaatgggtccagttttgtcagacccgcagagaccccttgtgggaggatgtgcggaaaaaggcacaagccatccagaagcaaaacaccgccccccacatgttgtctcgtgcgggttatgaatatttagaacagaagctgatggctgagaacacaaagaaaaaactggaggaagttgcttag

SEQ ID NO: 63174 - DNA, 111 bp, Glycine max
  Peptide Sequence Number=SeqID_154859
atggatcgggggataaatgtatcgggggccccggggctcgttgggggtagaagcactaatgcccgggatcccatcagaactccgcagttaagcgtgcttgggcgagagtag

SEQ ID NO: 63175 - DNA, 399 bp, Glycine max
  Peptide Sequence Number=SeqID_154860
atggagtgcctagagggagtttgggagaccctcgaaggaaatgcgaggtgccgatttcgtggcacgatccgactcacggctacttcgttggtaaatccagaggaaccagcacgcacgcttcagcgcactgtggagtggatattacctacacctactccatatctactagtggagccagtccaagtgattgaggtgacgtcatctgaggaagaccccgaggaggacccagaggagctacctcctgagcctactgtggatgctcttgactttctagagggtgatgaggacccactccctgaggtggattctcccgaggacgtcatgtcggcatctgaggcagactctacagaggagagcggtcccggagggatagcgactagtggaggttcttcatcatag

SEQ ID NO: 63176 - DNA, 111 bp, Glycine max
  Peptide Sequence Number=SeqID_154861
atgcacccgccgccacctccagagccccctctgctcatccacaaaaaggttagagtattgcctacgacacatgaccgacaaataggcgaccaagtccaaggccaaaggtag

SEQ ID NO: 63177 - DNA, 171 bp, Glycine max
  Peptide Sequence Number=SeqID_154862
atgaagatgctctcgataccacatgatgtagctccatgtagagcttgtaggccttggatattattcatcaatggagtcctttggaggaaaggtgattggagacgccacttcaaggagaagatgagtcaagaacaagctcaccaccataggaagccatggataagagcttga

SEQ ID NO: 63178 - DNA, 177 bp, Glycine max
  Peptide Sequence Number=SeqID_154863
atgtggtaccatggagaccagtcagggtcacagtgttttgagagaatgctccaaccatatgggatcaccataggcttaaaggagcactcaaaccgtgtgacccccaaggcctacactctgaagagtctgtcagggcctctccctcctgattcaggtccaacccagaaaacattttag

SEQ ID NO: 63179 - DNA, 738 bp, Glycine max
  Peptide Sequence Number=SeqID_154864
atggtattggaagagggccaggaatgcgagtatggccagaggaggaaccggtctgatgggttcgatgaggaggccatcgcccagctgctatgtataccggggcaagattttgcccggacagctgcaggaaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggtatgacgcccactaggcaccctttggacccagataagtccaacagggctctgggattccccgcactgatcacaggactctgccagtcgttcggagtccccgttgcacctaccaaggtgattcggccgcccatcacccgggcttttattgagaagcggccaaccaccgagcacatgcacggaccctatgactgtctgtaccagatgagccttagcatgcagagccagggcttcgcttctttttcatgccctactccagaccagttcagggcagaggtagcatggcccggagattggcccgaggcccaagcaggagaggcgcccccggaagctcccggcgatggagaagaagcccacgaggatgaggagatggccgatttgcttgacttcttgggagggagtggagacacgtga

SEQ ID NO: 63180 - DNA, 900 bp, Glycine max
  Peptide Sequence Number=SeqID_154865
atgtcacattgtaaggctatgatgtggtatgatgagaggataaataaagacaaacaaacaaacaaaccaaggttttcattatgttgttctgatggaaaaatacaattgcctctgttgcatgaaccaccccatccattaaatcacttacttttcaataaccaggatcctaaagctaagaatttccagcagtacatacgaatatataatctaatgtttgcttttacatctcccgatatcaaatttgacaaatcctataacactagaaaaggacctccaactttccttatacatggacaaacacataatcttattggaagcctcctccctatgcctaataacccacctaagtttgcacaactatatatttatgatacagacaatgagatcatcaacaaactttcgcaaaacccgttagtattcatacttatgtcacacatgatgcatgatatgcttgatgaacagattatcattgcaatcaaagacatgcttgatcatcacaatcactatgctcaaaggtttcgaatggcaagggacaaattgcattctgctgtagttccagacctgaagatgaaactcattagtcaaagacaaacagacggaaggttgtataacttaccaactaccactgaagttgttgccttgattgttggtgatgaacactcagctgataaaagaggtattataatagaaaaacaatccgaacttctgaagagaatacatgaacttcatcctgcatattttcctttgcaatatccgcttttatacccaaaaggagaagatggttacagactaaatatacctcacaaagatcatgccaatatacatgctacaaagaggaaacaagtcacattacgcgaatatttttcttaccgcctacagtcaagaactgatgaagcatag

SEQ ID NO: 63181 - DNA, 225 bp, Glycine max
  Peptide Sequence Number=SeqID_154866
atggagggaataatcagtaaattttataaatctaaacttggttgttatccatttatgtgtttggaaagtgctcaacttatctttgaatcattttggactagatcatgccaccataaacggtatgcacttggtggctttgatggtgacaaaatggttccaagtattgaagtgtttgatccccgtcttggggcatggatgataaggggaaccaatgaatcatcctag

SEQ ID NO: 63182 - DNA, 207 bp, Glycine max
  Peptide Sequence Number=SeqID_154867
atggcaaagtcattcgttgggcatccatatgcgggtcgactgacaaaggataagaagattgttgttgatgatatgacaaagtccatggtgaagccaagaaaaattctgttgacgttgaaggagcacaatgaaaaaaattatacaacaatcaaacaaatttacaatgtcagacatgcttgtaggatcgagtggcctcagaataattaa

SEQ ID NO: 63183 - DNA, 189 bp, Glycine max
  Peptide Sequence Number=SeqID_154868
atgtggttctgtttggaaattgcgatgaacatgctaagcgcgcttgctgcgcttagcctattcatcgcatctgttaaaattttggatttccagatgaacgcactaagcggaccatcgctaagcctgacctgtcaggctaagcgccacgttgattctgctaagcgccagtctgctgcgcttagcgcctga

SEQ ID NO: 63184 - DNA, 330 bp, Glycine max
  Peptide Sequence Number=SeqID_154869
atgtgtagaagcaaagactttgactttgatgttttgatgatgccatatgatcatgatgttttgatgccttatgaaaatgcgcttctcaagtttaattcaagacaaaaatccaagaatacaagatacaacatcaagaagatctctagtgatttaggaagggaattccaaattgaaatagcaaaaggtttggccaagaaatttaagctaaaatgtctttttcaagagatttactctctggtaatcgattaccagaggataacttgtaaagggattttgaaagatagtggaactctcaagcgggttgcttggggactggacgtaggcactagg

SEQ ID NO: 63185 - DNA, 365 bp, Glycine max
  Peptide Sequence Number=SeqID_154870
agggtacatcttttgtggtacaagtttgtaactgagaacaaaagagggtgcatctcttgtggatcagttcaagtggagggtacatccacttggttgttcaaagagaacaagggagggtacatcccttgtggatctttgcttgtaaaggctgaatttgatatccctaaagcatctaacgttaggacaaagaagaaaatacttcagactgttggggagcggtggagacaatttatttctaacttgacgtcaaaatgggcacttgcagccgacaaggacagtgttgatgacaatgtatgtgaaaaatacgacattagcaaggagaaatgggcccaattttgtcaaagccgcagagaccccttgtggag

SEQ ID NO: 63186 - DNA, 633 bp, Glycine max
  Peptide Sequence Number=SeqID_154871
atgaccaccctgactcagatctggatgactttgctgctcagcaacatccagcccagcgatcataattccgacctccccctgccgaagtgtcggctggtgtatgccatcctgacacggatgagcattcacgtggctcagttaatcgctgatgccatctatctatttgcaggtatggcgcctaccaggcaccctctggacccggataagtccaacagggccctaggatttcccgccttgatcacaggactctgccagtcattcggagtccccgtcgcacccagcatggtgattcggccacccatcacccgggcttttattgagaagtattgcacacaaagacaggcccagggggatgctccgcaggccgtagacgcgccgccacctcatcaggctggcccagctggatcgtttgatacggagcagtatttgcggcatttggttcgccagcaggcggccaaccaccgggcgcattttagggcagaggtcgcatggcctggagattggcctgaggcccgggcaggagaggcacctgcagaggcaccagcagaggctcccgacgaggcagatgaggcccgcgaggacgaggagatggccgatttacttgatttcttaggaggaagcagggccacatga

SEQ ID NO: 63187 - DNA, 228 bp, Glycine max
  Peptide Sequence Number=SeqID_154872
atgaagatgaaagcaaacaaaacaagaaatgaattgaaagtctcggatttgaacacttaccggttgaagaacgaagaacagatgaggaacagaggaaaatcttcacagatttgttcacggaaatgtctcgaaagcgttatggaaacatttcgactcgatttttcttcacggaaacatggaataagagaagtgcttgccacccagaggcttcttgaggtagatttctaa

SEQ ID NO: 63188 - DNA, 321 bp, Glycine max
  Peptide Sequence Number=SeqID_154873
atgcatgctttgttagggtcattcaacagtggaaactggtctgactctaaagtccttgatagtacaaggctaagttgtcgtactatcacgaggaatcgagatagtttttacacctgttcatattcccacttatctttacacaccagacatctatttgctgaaataacttaccaaataacacaagttccccgagagttcgatactcggttcttaccattttatactacttgtgcgatccggtgcacttgtcggaatccgaacaagtttttggcgccgttgtcggggaacttctttttatttgggaagttagttggtctttag

SEQ ID NO: 63189 - DNA, 873 bp, Glycine max
  Peptide Sequence Number=SeqID_154874
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagcgtttgggagggcccgtcaacacggcgactcgctcactggttcaagtccaacttgaatggggccacacagagggtgacaggcccgtagagcaggagcggttgtcgtgtgggtctctccttagagtcggtgaaaagaactttgaagagagagttcaagagtacgtgaaactgaagtggtgtaaacggacgagttcgaaaagtccgaatggtgagattcaagcttaccgtgccggtggccctcgggttcagatggcgtcgtcagctcgggcttcggttcgggtcatacggcgtcactcgtcctgggggtatctgtctggtgcggtgggctgcacttctcgcctagtaggacgtcgcgacccgttgggatgttccgttcactggcccctggtggagcccgcgccggagcgtggccttgtgccgcgttgctgtttgcacggacccggggccgcacagaggatgcgttcgatggccgtttcggcctacactcggacaggcctgcacccggtcagcggcgcttctgctttcgatactcgtccgacccgtcttgaaacacggaccaaggagtctaacatgggtgatggtcgttcctacacgggcggcccgcaaccccggggcgtctcgttctctttgagaagtggcgcacccagagcgtacacgttgggacccgaaagatggtga

SEQ ID NO: 63190 - DNA, 502 bp, Glycine max
  Peptide Sequence Number=SeqID_154875
atgctccttcgcgttatcatgttccggccggcgaacgtcaactagggcaacttgctacgttctcattggttccagctaaccgcacggtggaggggtgttaccctacatttgaggtgtcagaagtcccgcgcattgttgccaagtggattaagaggaacaggacggaaaaccttgcgtttattcatgagcggagatactgtgctaaaagaaatcacatgacactcctgcggtgtgtggatgccaaggaggcaaatcacatgatcgaggaagtccatgagggctctttggagacggtgcttaccaacatggatggccaaagagctcctacccgaaatgccacaaatgtcaagctttcaaagaaatgtcaatttgaggcttttagtcccacggccatcgagcccaaggcctcgaatggtcatcgcttcatcctcgtagcgatagattatttcaccaagtgggtcgaggcggctttcatattaccaatgtcacgaggaatgtggtg

SEQ ID NO: 63191 - DNA, 252 bp, Glycine max
  Peptide Sequence Number=SeqID_154876
atgcaagagttttatacaggttcgacaacaacccatgcctacatccaatccccaagtgacctgcggtccttgagatttcttttcaaccttgtaaaaatctttacaagcaaagatccacatgggatccacaacaacccaggtagatgtaccctctacttgtaccacaaaggatgtaccctccaatgtgttaagacaaagttctcaggcgggaaagggaagaatcaaaagaattctcagactgtgtcgttttga

SEQ ID NO: 63192 - DNA, 530 bp, Glycine max
  Peptide Sequence Number=SeqID_154877
atggggacaaatcaaaacggcaaaaggttttatcaagtcaaggttaaaagtctagatgtcactagcctcaaggaattgggacgattgatgggacctctccaaaggcaagccttctgcaaagtgtacgggaagattctagatttgaccgcaccggaggtatttacggatgctgtcgtatccctcgcccaatactatgaccagccgttgaggtgtttcatgtttagggacttccaaatgctgtggttggagattcagcaaaaagagttggatcgcatgaagcaaactcggaacagcgtagtgggcctgcctcagaagtacttggaagacaaggcaagggatatggcaagccaagagcagtggggcccgtttgcagatattttagctttgctgatttttggggttgtcctcttcccgaacgtcaacggtttggtagacttagccgccattgatgctttcctcgcatatctccatagcaaggaaagtccagtggtggctatcttggcagatttgtttgacacctttgatcggag

SEQ ID NO: 63193 - DNA, 450 bp, Glycine max
  Peptide Sequence Number=SeqID_154878
atgggaacaaatcaaaccggcaagaggttctaccaagtcaaggtcaaaagcccagataccaccagcatcaaggaattagggcggttgatggaacccctccaaatgcaagccttccgcaagacttacggaaagataattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttggcacatttgaaccgaaggtgcgagaagagtag

SEQ ID NO: 63194 - DNA, 210 bp, Glycine max
  Peptide Sequence Number=SeqID_154879
atggtgtcataccctaatttcgtccggggacctttgctcgatgacgtgcgaccattctttggtcctcgtgaggcccacttgggattcctccagaaggcggttgcttctggaggaagcaaccctgctcgcctgggcgagctgagctcgcctgggcgagctgagctcgcctgggcgagctgggcggcaaccacctcccctattttgctataa

SEQ ID NO: 63195 - DNA, 116 bp, Glycine max
  Peptide Sequence Number=SeqID_154880
atgccacttcaaggagaagataagtcaagaacaagctcaccaccacaggaagccatggataagagcttgaaggtaggagcagatgagtggagggagaaggagagaaggagaatgag

SEQ ID NO: 63196 - DNA, 417 bp, Glycine max
  Peptide Sequence Number=SeqID_154881
acacttgctagcattgccacacctcttgggcttgagtttgttcctcaagtaaagaagttgttggatgagggtttgcttcacaagagcttaaatccttgtgctttgttggtgcccaaaatagtggttcccatgaaccctaagagaataaaggtcattcctgaatggcccactacaccaacaccactcattgagtgtgtgaggaaccatgttccttcatgggaagatgcccaggaaatgggtgttgagggaaggagcctagagtatgaagaacctcaagatttgaggaagcttctcaaggaagtgagcttagttatgaaaagggtgtgtgtagctaagctcttgcttctcaaggaagttttctcaaagaagcttctcaaggaagttttctcaagaaagcttctcaaggaagctacctag

SEQ ID NO: 63197 - DNA, 708 bp, Glycine max
  Peptide Sequence Number=SeqID_154882
atggctaagagttcatacgcgaggaatttcgaagctctggaagaggatgaagaaatccaagctctaaaattagagctagggaaggcaagactcgccaaagaaaaattcaagtcagccgctacaaacatccggaaagagtgcaccgagttacgagaggaaaacgcggccactgcaaaagcccttgaacaagaaaccaagagggcccgcaaggaagaacatggtcgagataaattccgaggagctttgtggggtagcaacaatgagctcaagctccggagagaggaaagagaccagtcacgggtacatggcatgatcttaaaggaagaattagctacttgcgcaagatccaagaggagtttggctcaacacttggaagccacggagcgaagcatgctagccatcatagggcagtacaaggaagagttgaaccagtctgtgacccatgaacaaaagctagtagaggattttgcgcaagtgtacgccgaaaaggaagcaagagggagggtgattgatgcattgcatcaagaagcgactatgtggatggacaggttcgccttgaccttaaatggaagtcaagatctcccacggctactagccaaagcgaaggccatcgctgaagtgtgttcagcccctgaggaaattcacgggctaatcaattactgtcaacacatgatagatttgatggcccatataattagaaaccgttag

SEQ ID NO: 63198 - DNA, 153 bp, Glycine max
  Peptide Sequence Number=SeqID_154883
gagggagaggccctgcagactcttcagagtgtaggtcttgggttgggggtcacacggtttgagtgctcctttaagcctatgttgatcccatatggttggagcattctcgcaaaacactatgaccctgacaggtctccccatgatattacctag

SEQ ID NO: 63199 - DNA, 390 bp, Glycine max
  Peptide Sequence Number=SeqID_154884
atgggtgatcaagaggagacacaggaacagatgaaagccgacatgtcagctctgaaagaacagatggcttccatgatggaagccatgttaggaatgaggcagctcatggagaaaaacgtggccaccgctgccgctgtcagttcggctgccgaagtagacccaactctcttggctaccgcgcgccatcctccctcaaacatagtaggacggggaaggaacacgctggggcatgacggcaaccctcatctgggatacaaccgagcggcttacccttatggattgccacccgtcctgcaagacgatgcgggccatattgcttctcctgtccttgaaagagagcctcctcaacagcctgacgaggtccacgaagaccctcaagactatgcttga

SEQ ID NO: 63200 - DNA, 499 bp, Glycine max
  Peptide Sequence Number=SeqID_154885
atggttgagaagacaaagaaaaaactggaggaagctactcagtccgaaagcattgagggcgtgattgaccctctatctcccatcaaacgacatgtgaagtggaagatggtccacaccaagaaaactaggcagatgacgtctgaggcgtcaaagggttcctttgtcccctatggacgtcaggatctcctgactgctgccattgggcgatcaaaacaccctagttgtgtgcgtgctgctggattcggtatccaatcacaaggacttgcatttcctccggagcctgaggttggtccctcaactgctcgtgtcagcacaaaggggagttgtgttgatcccctcaatgaccgatctagacacgggggacttagacaaaatgcgagtttgaaggttggtgttgaggaggttaaagatgcagatgctcccgttcttgtacccactgacgatgttattttagtggggcaggcacttaacaccttccttgctttggccaacacatctc

SEQ ID NO: 63201 - DNA, 924 bp, Glycine max
  Peptide Sequence Number=SeqID_154886
atggagttattctcaaatgagaattttgaatgcttccaagcatttgaaaactccaatcttattccattcatgtctctgaaattacctgtctattctgaattagtcaaagctttctattctaatttagaaatccatgtaggtatcctaatgtctgaaatctatgggattaagatggtcattgaccaatccctattttatgatttaacaaaattgcctagtgaaggtgtgccttttgagggtgcactgattgatgattggaaattcaatttttctgtgcatgatgcccaccggttggtttgcaccaaccaagcggatatgatcggaaggattcttgccggttcattggcttttgagagccgtatcctccattaccttattgttcgcatcttactccctagatcttcaaaccttgctcaggtttctgaagaagatctcattgtcatgtgggcctttcataaaggtttacaaattgattgggcacacattgttagatatcgcatgcataaggcattgcgattgaatgccccattgccttatcctcatcttgttacccttttccttcaacacttcaacatccctcttgattctgaaccttatgttccaatcaagagatcattccttataggcgcttcagtcatagcatcctttggttatataaaggagcatgatggctcttgggtgaagaagggtgctagaaatgttggtgaagaaggacatgaaggagaagattcatctcttctttcgaagattatggaaaggtttgatggtcttcaaacctttgttggtgagaggtttgatactttggaattgcaagtggatatgcgcttcaatgaaatggagtcaagaatgacaaaggttgaagaagatgtatcttacatccagtcaagctttgatcttccaccaccgccgccaccatcatcttag

SEQ ID NO: 63202 - DNA, 251 bp, Glycine max
  Peptide Sequence Number=SeqID_154887
atggaaatttatgtgagtgatcgactaggaaaaagtgtgtgtgtatgtttcttgatttcagaagttgtcatcatcgaaaagggggagattgtagaagcaaagcttcatgaagaatcaagattgattcaaagatgttttgatgataacaaagatgatgacaaaggtgataacgaaaagctcaaaggtcaatcaaagaatgagttcaagatgttcaagatagaatcaagcacacttcaagattcaagaggaaa

SEQ ID NO: 63203 - DNA, 147 bp, Glycine max
  Peptide Sequence Number=SeqID_154888
atgttgcaagatggtgaatcaagaggagcagcagcttcatcagttgagtcatcggggatgattatcagaggtggtgccggaggagacaatgtctcaagttccggagaagcaggtggatctactacaggaggttatggttctgctgat

SEQ ID NO: 63204 - DNA, 156 bp, Glycine max
  Peptide Sequence Number=SeqID_154889
atgaagatgctcttgataccacatgatatgaatggcagtgtaatggagaaggaagagagagaggagatgccacttcaaggagaagatgagtctagaagaagctcaccaccattggaggccatggataagagcttggaggaagaaggagatgaatga

SEQ ID NO: 63205 - DNA, 333 bp, Glycine max
  Peptide Sequence Number=SeqID_154890
atggcgaggacgcgtagtcctctaaaggtgaggacgtgtagtcctctgaaggtgagggcgtgtagccctacaaaggtgaaggcacatgaccctttgacgacgaggacgtgtagtcctctgacggtgaggattgactgtccttttgaaagaggtgataattcatgcaacctcatcctatcttttttgcaaatctctccgggaactccctcagaggcttgtctccccccttttttcttgtttaaaaacatcgacgggtgtgaacttttgatcgacccctatgttcacttgaggctcatgcacggtgcccctcattgccccagtgtaaggctttga

SEQ ID NO: 63206 - DNA, 249 bp, Glycine max
  Peptide Sequence Number=SeqID_154891
atggcagtggaatggagaaggaagagagagaggagacgccacttcaaggagaagattagtctagaagaagctcataaccataggaggccatggataagagcttggaggaagaaggagatgaatgaagggagaggaagagaagagcacgaaattttatgttctaaaagagctctgaaatctgaatccacggaagcaacccaatgtggcaagtttgagtccatgtcagcaatcccatgtggcaaggactaa

SEQ ID NO: 63207 - DNA, 318 bp, Glycine max
  Peptide Sequence Number=SeqID_154892
atgaagaaaatggacaagaaaaagaaagaatttctcttaaaaacttcatcctcaattcaagaagaaagtgatcaggaaaatgatccagatgatgatgatgatctaagtctttttgtaaaaagattcaacaagtttcttaaagtaagaggaaatcagaggcgacccaattttaaatcaaagagaaggacagaaacttcatcatctactttaaaatgctttgaatgtaatcaacctggacatctgagggttgattgtccatcttcaagaaaaagatggtacatagatagcggatgctcaaaacatatgaaaaatcagtga

SEQ ID NO: 63208 - DNA, 414 bp, Glycine max
  Peptide Sequence Number=SeqID_154893
atgtcgtacaggatgtcacgacatcacgcttcagaacatgcagattatatgtgtccgtatgaacagattaaacaagtaaataacacaagagaattgtttacccagttcggtgctacctcacctacatctgggggctccaagccagggaggaaatccactctcaatagtgttagttcaaggtctaacagcccctgtttacaaccttctcacctaaccactacccacacaccagagatcaactctgaacaaatgggatcaaccctacacaatagagatcaactctacacacaagagatcaactctacacactcaggtccaacacttgataactcgtgcagccttcgtgtttatatagccatctgcgtttctgggctgcaacggcttgatgctggaggagatctatcttcttcctga

SEQ ID NO: 63209 - DNA, 189 bp, Glycine max
  Peptide Sequence Number=SeqID_154894
atgtaccctccaatgtgttgggacaaagaattctcaggcggggaagggaagaatcaaaagaattctcaggcggttagtcctttgaattctcttgtaagggaaaagagagacataaaagaattcaggcagttagtccttcgttcttttggcaaagggagaagagagacacaaaagaattcaggcggttag

SEQ ID NO: 63210 - DNA, 711 bp, Glycine max
  Peptide Sequence Number=SeqID_154895
atgaccaccctgactcagatatggatgactttgctgcttagcaacatcctgcccatcgatcataattccgacctccccctgccgaagtgtcagctggtgtacgccatcctgacgcggatgagcatccatgtggctcagttaatcgctgatgccatctatatttttgcaggtatggcgcctaccaggcaccctttggatccagataagtccaacagggccctgggatttcccgcgctgatcacaggactctgccagtcgttcggagtccccgtggcacctaccaaggtgattcggctacccatcacccgggcttttattgagaagtactgcacccagaggcaggctcaggggaatgctccacaggccgcgggcgcgccaccaccacctcatcaggctggcccggctgggtcgtttgacatgaagcagtatttacggcatttggttcgccagcaggcagccaaccaccgggcacatgtgcagacccatgattgtttgtaccagatgagcctcagcatgcagagccaaggcttcgcttctttttcatgccctactccagaccagttcagggcagaggtcgcatggcccggggattggcccgaggcccaagctggagaggtgcccccagaggctcccggcgatggagaggaggcccacgaggacgaggagatggccgatttgcttgacttcttgggagggagtggagcttcatga

SEQ ID NO: 63211 - DNA, 240 bp, Glycine max
  Peptide Sequence Number=SeqID_154896
atgtaccctctcttggtctcagttacaacaacccaagtagatgtaccctctacttgtaccacaaaggatgtaccctccaatgtgttaagacaaagttctcaggcagatagtcctttgaaactttgtgaaggggaaacaaaagatatctcaggcgggagaagggagacacaaaagaattctcaagcagttagtccttcgttcttttggaaaagggagaagagagacacaaaaagaatttag

SEQ ID NO: 63212 - DNA, 462 bp, Glycine max
  Peptide Sequence Number=SeqID_154897
atggcgcctaccaggcaccctctggacccggataagtccaacatggccctgggatttcccgccttgatcacaggactctgccagtcgttcggcgtccccgtcacacctagcaaggtgattcggccgcccatcacccgagcttttattgagaagtactgcacgcagagacagatccagggtgatgcaccacaggccgcggacgcgccgccacctcatcaggctggtccagccagatcatttgacacggagtacctgcagagccagggctttacttcttttccgtgccctactccggaccaattcggggcagaggtcgcatggcctggagattggcctgaggcccaagcaggagagccaccagcaggggcacgagcagaggctcccgacgaggcagatgaggcccgcgaggacgaagagatgaccgatttacttgatttcttaggagggagcggggccacatga

SEQ ID NO: 63213 - DNA, 381 bp, Glycine max
  Peptide Sequence Number=SeqID_154898
atggcagcgcagttgatccatgatcgggttgtgatggagtgcctagagggtgtttgggagacccttgaaggcaatgagagtacatccggaggaacccacacgcacacttcagcagcctgtggattacctacacctactccatatcgactagtggagccagttcaagtgatagaggtgtcatcctctgaagaggatcttgaagaagacccagaggagttacctcttgaacctgatatggacgcccttgacttacctgaggatgatgaagacccactccctgatgttgattacccagaggatattatgtcagcatctgaggcagactctacagaggagagtggccctggagggatagcgaatagtgatgactcttcatcgtag

SEQ ID NO: 63214 - DNA, 712 bp, Glycine max
  Peptide Sequence Number=SeqID_154899
atggagagaagtatgatagatgctgccagtggtggaacccttggagacatgacccctgctgaagccaaaaatgatgctattgtcattagaggagtgcatgaagtagccacgaattcatcttcatcagccgagactaagaagcttgaagcttatgctgcaaacatctacaacagacctcctcaacctcagcagcaaaatcagccacaacagaacaattatgacctctccagcaacaggtacaatcccgggtggaggaatcatcccaaccttagatggttgaatccttcacaacagcagcaacaacaaccatattttcaaaatgctgttggcccaagcagaccatacattcctccactaatccaacaacaacaacagcaaccccagaaacagcaaatagttgaggctcctccgcaaccttcccttgaagaacttgtgaggcaaatgactatgcaaaacatgcagtttcaacaagagaccagagcctccattcagagcttaactaatcagatgggacaattgactacacagttaaatcaacaacagtcccagaattctgacagattaccttctcaatctgttcagaatcccaaaaatgtgagtgccattacattgagatcgggaaagcagtgtcaagaacctcaaccagcaaatgaacctgcccaacctcactctactccagaaaaagatgatgccaaaaacgaaaatgtaaaaa

SEQ ID NO: 63215 - DNA, 87 bp, Glycine max
  Peptide Sequence Number=SeqID_154900
atgagggaagggttgagcaatggaatcagatcgagaaagaggcaattggtgagcaaatggaaggagcaaagaatggggtccatgtga

SEQ ID NO: 63216 - DNA, 474 bp, Glycine max
  Peptide Sequence Number=SeqID_154901
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagccgacctatatgacaccttcgaccgaagatgtgaagaaagcaatgcaaggattgtttgctgtactccagctctctatgtggggctggtttcacacctttttcaccaagaaggtaggcccgtctatccgctacaaggttaccgctcgtgcgtcgaaaaaggaaaggcgaattgggaccaactcttggctagcatgggggggcgtctgttaa

SEQ ID NO: 63217 - DNA, 261 bp, Glycine max
  Peptide Sequence Number=SeqID_154902
atgaccgatttatttggcgtcgatttcaatacaccaaattcagtggcatcatatttagctactttacaacagtttgatgcaccacatttatttggagaacaaggtcaaagttcttcaactgcaacaaccaacattgaaaatactaacacagaacaacaacatcatcatgacgtgggagaaccagtcatactggaaagaagaaatctgcgacgtaatcgtcgtccaccaccttgtgggactggtcatcgtcttggtcattga

SEQ ID NO: 63218 - DNA, 333 bp, Glycine max
  Peptide Sequence Number=SeqID_154903
atgactcccgaatctggaatattcttcatgaccggtttcctttggtttttcttacgtttccctttcaataaacgttgggggcgactctgtgcattttcctcctttggaagacgtacccgtgagcctcgcctcgctcacccgcaaaaggatgatgacaaaggtgatgaacaaaaagctcaaagatcaaagaacaactcaaatgaatcaagaacaagtcaagagttcaagaatcaagaagaattcaagactcaagaagaaagcctagaatcaagatttaagattcaagatctcaagaatcaagatcaagattcaagactcaagattcaagaatga

SEQ ID NO: 63219 - DNA, 384 bp, Glycine max
  Peptide Sequence Number=SeqID_154904
atggctcaatccaactcctcaaggctcgaatttcctgccctcatcactaccttatgcatggctcgaggagtcatctcagattccttgacttttgagtccctcaacccaaccattaacttggcttacataaagaagaactgctggaacttggacgaccccacgatcagctttccagggacccgcactagaggatctgagggtccatcttctgctgctccacagacatctatagcaccagctcctattccttcagcacaagttcccgctacttccaatccctccgctcaaagcacagacctcatgatggtgatgctacagagcattcaccagggtcaatacctggtgatgcagagtttacatagtttggctcagcatcagctgtag

SEQ ID NO: 63220 - DNA, 162 bp, Glycine max
  Peptide Sequence Number=SeqID_154905
atgctcaaaagatcaaagaacaactcaagtgaatcaagaacaagtcaagagttcaagaatcaagaagaattcaagactcaagaagaaagtctacaatcaagaatcaagattcaagatctcaagaatcaagatcaagattcaagactcaagattcaagaatga

SEQ ID NO: 63221 - DNA, 813 bp, Glycine max
  Peptide Sequence Number=SeqID_154906
ctcctgggatatcctttagtgctggaagagggtcaggagtgcgagtatggccagaggaggaaccggtccgatgggttcgatgaggaggccatcgcccagttggtatgtataccggggcaagattttgcctggactgctgccgggagacgggtgcagatcatgcgcaccaacatgaccaccctgactcagatcttgatgactttgctgctcagcaacatccagcccagcgaccataattccgacctccctctgccgaagtgtcagctggtgtacgccatcctgacgcggatgaacattcacgtggctcagttaatcgctgatgccatctatatatttgcaggtatggcgcctaccaggcaccctctggacccggataagtccaacagggccctgggatttcctgccttgatcacaggactctgccagtcattcggcgtccccgtcgcacctagcaaggctgcagacgcaccgccacctcatcaggccggttcagccggatcgtttgatacagagcagtatttgcggcatttggtttgccagcaggcggccaaccaccgggcacatgtacagacccatgattgtctttatcagatgagcctcagcctacagagccagggctttacttcttttccatgccctactctggaccagtttagggcagaggtcgcatggcctggagattggcctgaggcccgggcaggagaggcacctgcagaggcaccagcagaggctcccgacgaggcagatgaggcccgcgaggacgaggagatggccgatttacttgatttcttaggaggaagcagggccacatga

SEQ ID NO: 63222 - DNA, 120 bp, Glycine max
  Peptide Sequence Number=SeqID_154907
ggtgacgtgatgcaatcttatcccccaagggcattggatagaagactccaagaacattgggccagagatgcaagagaagatcctagggttctcatgagccataagggctccatagagtag

SEQ ID NO: 63223 - DNA, 567 bp, Glycine max
  Peptide Sequence Number=SeqID_154908
atggtcattggccaatccctcttctatgatttgacccaattgtctagtgatggtgtaccatttgaaggtgcactggatgatgattggaagtttgatttttctgtgcatgatgcccgccagttggtttctgaagaagatctaatagtcatgtgggcctttcataccggccaacaaattgattgggcacatctagtccggtatcacatgcataaggcattgcaattaaatgctcctttgccctatcctcacttagttaccttgttccttcaacattttaacatccctcttgattctgaaccatatgttccaatcaagagatctttcttgattggtgttgttgtggttgcctcctttggttaccgcaaagagagtgatggctcttgggtaaaaaagggtgctcaaccaaatgatgatgaaggacacttaccggttgaagaggactcttctctccttcagagtattttggataggtttgatggacttcaaacctatgttggtgagaggtttgactccttggaacgtcaagtggacacacgattcgaggagatgaactcaaggactgcaaag

SEQ ID NO: 63224 - DNA, 435 bp, Glycine max
  Peptide Sequence Number=SeqID_154909
gtagctgtgtctccgccaaaaccacctccgaagcccgatctggaggtcgatgatccgctttatctgatgacattgaccatcccagagcttttcttgaggccttatcaggttagatgggatgccaccgtgttcgggatcgttaatccagatttccccctgtacataaagcacgaagactctccgaaatcgcacacgagttcacaacgcgatgtgtatcttggagcctacctaaatgggccagacaactaccttaaggggattattaatagtgctatcaagggtcttgatgatgctccacagcctaaatcaaaggctcctgctaggtggattgtcgtcaagtgtaatagacaaaaaggaactactgagtgcggctactatgtcatgcactggatgtccaccatcattttaggaagttttagaaataattgggaagcg

SEQ ID NO: 63225 - DNA, 171 bp, Glycine max
  Peptide Sequence Number=SeqID_154910
atgccaaaagatagggggaggattgtcatcatcaaaaagggggagattgtagacaaagaatcaagccgcgccgatgttttgatgatgccaaaagatcacatgcatctcaaagatttattcaagacaaagcaatggaagatatacaagataaatgatcaagacagtctatag

SEQ ID NO: 63226 - DNA, 231 bp, Glycine max
  Peptide Sequence Number=SeqID_154911
atgatgggagatgcctcaaagttcactcatatctctcccaagaaaagcgtacatatgagttatggcgacaacaataaaggtagaattcttggagtcagaaaaataggtggctttgttcgtgctcacgcgcttagcgagattatgatccgcttagcgcacattagtgaattttgtcttagcgctcttttctcgctcagcggatgggctgaagtggtgcgcttaatgagatga

SEQ ID NO: 63227 - DNA, 420 bp, Glycine max
  Peptide Sequence Number=SeqID_154912
atgtggctcagtttattgctgacgccatctatttatttgcagtcatttggggttcccgtcacacctagtaaggtgatccgactgttgatcacccgggccttcattgagaagtattgcacgcctaggcaggcgcaaggtgatgcaccacaggccgcagacgcaccaccaccacctcatcaggctgatcctgctgggtcattaggcatggagcggtatctacagcacttgggccagggttttgttccttttgcgtgccctactctagatcagtttagggctgaggtcgcatggcccagagattggcccgaggcccaggctggggaggcgcctgcaggatccccgagcgatgtagaggaggcccgcatggatgaggagatgacgaatttgctcagtttcttgggagggagcggagccacatga

SEQ ID NO: 63228 - DNA, 348 bp, Glycine max
  Peptide Sequence Number=SeqID_154913
atggaacttctgggactggaccgacatgaagaaaatgacaagaaaaagaaaggaattgcacttaaggccttatcttctattcaagaagaaagtgacaaagaggacttgaatgaaacagaagaagatgatgattttagtttcttcgtaaagagcttcaataagtttctaaggagcaaaggaaatcaaagaagaacaaactttaatccaaagaaaaaaggagaagattcatcttatgttccacagtgctatgaatgtaatcaacctagacatctaagagttgattgccctagtttcaagaaaagaatggaaaaatttgacaggaaaattctcttgcaaagttactattga

SEQ ID NO: 63229 - DNA, 264 bp, Glycine max
  Peptide Sequence Number=SeqID_154914
gctttactaagaggatttgaattagcttctggtgtaaacattaattttggcaaaactcagtttgggattataggtggtggagtcaattgggctctgaaagctgctaatatcctgcattgcagacaactggattatccttttttttttggaaggcaaaaatattggaaatggtacatgtttcaccaaccagaacagttgtggaataggatcctgatttctaaatatcagggctggagaggattggatcaggggcctcacaaatag

SEQ ID NO: 63230 - DNA, 390 bp, Glycine max
  Peptide Sequence Number=SeqID_154915
cgtccgctaagcgcaacactgctaggctatgcgcgaggaagaatccaaaagacgatgagctatacaggttcgctgagcgcatcgctccaggtcatcaagcgcaccgcttcagctcatccgctaagcgagagaagtgcgctaagccaaaatccaagctttgcatgtctagggtttctagagagagaaaggtccaagttccagagagttttgagagattttgctgtgtgaagatctgcagagaccagagcttgaagcagaagccggcttcctattatggaaagctaaatcctctgttggatcttccctggtcattcaatagtggaaactggtttgactctaaagtccttgatagtgcagggctgagttgtcgtgctttcacgagaaatcagg

SEQ ID NO: 63231 - DNA, 321 bp, Glycine max
  Peptide Sequence Number=SeqID_154916
atggaactaattgagaatatggatgctagtgatcatgctatcttgcgtgatagaacacactatcccaccaagaagagtttattagagttgtcatcacaagatgctctattggttataggttgcacactttgtggtggagctcatgaatcaggctattatatgcccactgaagaatcaacacatgaagttaattatatggggaaccagccaaggcagaattttaatgcaggtggattttctggatttcaacagggccagcattacaaccagcagcaaaatcagtggaggattcaccctagtaatcaattccacaaagactag

SEQ ID NO: 63232 - DNA, 552 bp, Glycine max
  Peptide Sequence Number=SeqID_154917
aagctcctggctaagaagaccaagaagaagctggaggaagttgcacagtcaagaagcattgatggcgtcatcgaccctccatcccccatcagatgccacgtgaagtggaagatggcccacactaagaaaacaggagagatgacgattaaggccgcacaggaaatcgctgagaagatcgcatcacagggatccttcatcccccatagacgtcaggatgttctcaccgttgctattggacgtccagagcaccctggacgtgttcgtgctgctagagccggtgtcaccgtcaagcaatactttggatcggctccacgaatgtcccgcagctattcctcgctgcctcctaaagaattgcaacagctggcccaacaaatcagggaccagctagaggagtcgatcacaaaaaaagtgactcggcagctcatggcatcgttcagccagatgcaatcccagtttcagtcccagatgcaatctcagggacttgcactacctccggagcctctgggttggtccctcaggtcctcgagtaagcacaaaggagagttgtgttga

SEQ ID NO: 63233 - DNA, 537 bp, Glycine max
  Peptide Sequence Number=SeqID_154918
atggccccgaggaagcttgcctcaaagaggtccaggaaggataaggcggccgaaggaactaattccgctcctgagtatgacagtcaccgctttaggagcgcagtacaccagcagcgcttcgaggccatcaagggatggtcgtttctccgggagcgacgcgtccagctcagagacgacgagtatactgatttccaggaggagatagggcgccggcggtggacatcactggttactcccatggccaagttcgatccagaaatagtcctcgaattttatgccaatgcttggccaacagaggagggcgtgcgtgacatgaggtcctgggtaaggggtcagtggatcccgttcgatgcagatgctatcggccagctcctgggatatccgttagtgttggaagagggccaggaatgcgagtatggccagaggaggaaccggtctgatggggaggcgagtgcgaatcatgcgcaccaacatgaccaccctgacccagatatggatgacgttgctcctcagcaacatcctgcccagcgatcataa

SEQ ID NO: 63234 - DNA, 348 bp, Glycine max
  misc_feature (283)..(283): n is a, c, g, or t
  Peptide Sequence Number=SeqID_154919
atggagaggagtatgattgatgctgccaatggtggaacccttggtgatatgactcctgctgaggctaggaatttgattgagaagatggcttccaactcccaaaaattcaatgcaagaaatgatgctattgtccttagaggagtccatgaggtggccacggattcatcttcatctgttgaaaataaaaaaattgagggaaaacttaatgctttggtcaacctacaatctggagtcaatgagcaacctaaagcttatgctgcaaacacttataatagacctcctncacagcaataccaacaacaacagaataattatgacctttcaagcaatagatacaatctaggttag

SEQ ID NO: 63235 - DNA, 417 bp, Glycine max
  Peptide Sequence Number=SeqID_154920
atgtcgcgaaactttacggattacacaaccatcccctctttgacttctggaatgttatggaactttatggattgcgcaataatgcttcctttcgactcccgacatgtcacagaacttcacggattgcctaacgatgggtgtcaagtacctcgaagcggtcaagtgaaggtcgcatcccaccaaacaaatggtcctctttacttgtcttttattggtgataaatgggaacgaaacctgtcgtcagaaagaaaagaaaatgcatcaaaagcatcaacaaacttcagtgtcttgaaaacgacaaagttggacaaccacgacacttcccttttgtcataccctaatttcgtccggggacctttgcttgatgacatgcgacctttctttggtccttgtgaggtgcttggcacccatcattag

SEQ ID NO: 63236 - DNA, 250 bp, Glycine max
  Peptide Sequence Number=SeqID_154921
cgcatttgcatcatttgcatcaaatcatcatgatcatcatcaaaacatcaaagtcatttgcttctacagacctcactcccatagtagagaaaaggaaagaaagcctcaagaggctaacattaacctctcatacttccatggaaagaacaatgtagaggcttacttagattgggaaataaaggtagagcaacaacttaaaaggatgtctactttaaaatcttatggcaaggatcaaaagatcaacgaatga

SEQ ID NO: 63237 - DNA, 183 bp, Glycine max
  Peptide Sequence Number=SeqID_154922
atgaaggtttggagatttagggatgaaggaggcacgaggaggagctttggttacgcagcaagactggtatatggtcaagaaggattccataatcagaaagttgttgcttcatccataagatttgtgcacaacaactgccggcagaaatatattctgttagacaagtggcctcatatatcttaa

SEQ ID NO: 63238 - DNA, 147 bp, Glycine max
  Peptide Sequence Number=SeqID_154923
atggaaaaatctgacaagaggaatttcaaagaaaagaaaacatacattacttgggaagataatgacatggattcttcaagtgattcagaaaatgaaatcataaatctgggtctcatggcgaaagatgactatgaaagaagagaaaag

SEQ ID NO: 63239 - DNA, 207 bp, Glycine max
  Peptide Sequence Number=SeqID_154924
atgccattgcagggtaggattgcatcactttgtcagtcgttcggggtccccgtcgcacctagcaagaggccggcccagggtgatgcaccacaggccacagacgcgctgccacctcatcaggctggcccagctaggtcatttgattcggagcagtatttatggcatttagttcgccagcaggcggccaaccaccgggcgcacgtatag

SEQ ID NO: 63240 - DNA, 696 bp, Glycine max
  Peptide Sequence Number=SeqID_154925
atggtagtacgagctttcgaccgtagtcggcgagaggtgatgggggaaattgacatccccattcccgataggcccccacacttgcaatgtggttttccaagtgatggacataaatcccgcctacaactgccttttggggaggccatggatccacgcactaggagtggtcccctcgacgcttcaccaaaaactaaaattcgtagttggtggactcttggtcatagtgtcgggcaaagaggatatgttggtaagctgcccctcctcggcaccatatgtaaaggcagcagaggaatcattggaaataactttccaatccttcgaggtgccctgatggtggcgcaggtaatgctcaggcactgttgtgagcccggaatgggtctgggcaaggacaaccacgggaatgccgatgtggttgacattaggggtaacccgcacaaatatgggttggggtatgagcccgggaaacctggaagaaggaatgcaccatcaagactctgggcagatagggcatggcccgatcatgtaagccagtgtttcacaagtgtcgggataatgttcgaggaagaggtggcggcaataggaggagaagctccacaagatccgccgagtttcgtgcgaccgtgccatcccaatttccaactggggaattggcacgtgacgagccagttggaagtctataccgttgattcaatgtaa

SEQ ID NO: 63241 - DNA, 117 bp, Glycine max
  Peptide Sequence Number=SeqID_154926
atgaagaaacaacaatggaagaaaagatgcagcggaagacaaaggagaagaggtgagaggaggcgtcatccactagggaataagccatggaaagaaggaacttcaccaccaagatga

SEQ ID NO: 63242 - DNA, 423 bp, Glycine max
  Peptide Sequence Number=SeqID_154927
atgccttggaacgagaaaccaagaaggcccaaaaggaagaacacgtgccagcaaagttttgaagggctttatagggcagcaatattaagcgagactgaagggaatatgtgggccatcatcgatgagtgcaaagagaagctaaatctagcggcgactcacgagcaaaggctagaggatgagtacgccaagatatcagcagaaagggaagcaagggaaagggtaattggttcattgcaccaagaggcaacaatgtggaaggaccgatttgctcttactttgaataggagtcaagaacttcaccgattgctagccaaggccaaagcagtggcggacacctactccgcccccaaggagatccacggatttctcagctattgtcagcatatgatagacttaatggaccatatgattagaaaccgctag

SEQ ID NO: 63243 - DNA, 684 bp, Glycine max
  Peptide Sequence Number=SeqID_154928
atgaccaccctgacccagatatggatgacgttgctcctcagcaacatcctgcccaccgatcataattccgacctccccatgccgaagtgtcagctggtgtacgccatcctgacacggatgagcgtccatgtggctcagttgatcgctgatgccatctatatttttgcaagtatggcgcctaccaggcaccctttggatccagataagtccaacagggccctgggatttccctcgctgatcacaggactctgccagtcattcggagtccccgttgcacctaccaaggtaattcggccgcccatcacccgggcttttattgagaagtactgtacccagagacaggctcagggtgatgctccacaggccgcaggcacgccaccaccacctcatcaggctggccaggctggggcgtttgacatggagcagcggccaacccacaaggcccatgtgcggaccaatgagaccctataccagctgagcctcagcatgcagagccagggcttcgcttctttttcatgccctactccagaccagttcagggcagaggtcgtatgccccggggattggcccgaggcccaggcaggagaggcacccccagaggctcccgacgatggagaggaggcccacgaggacgaggagatggccgatttgcttgacttcttgggagggagtggagctacatga

SEQ ID NO: 63244 - DNA, 441 bp, Glycine max
  Peptide Sequence Number=SeqID_154929
atggaggccataaaagagcaaatggccacaatgataaaggccatgatgagcatgaagaagataatggaagccaatgcggttatagtcgccgctattagcgctgtcgctaaatgtgaacccgatgtccccatccggcctcaagcaaatgaatcatccaacctcaaatatgccaacttcgagccttggctcggatatgccactgaagggcaagcagttggtggtataccccttgaaaacactccggaaggccctcagtatcacccccagctacacctcttgcattccacaataagtaaaaaccctcgtactatggcagaaatgggaaagttggatcatctagaggaaaggctcaaggccattaaaggaggtgaagattatgcctttgttatcctagaagagttgttcctggtgcccaatatcatcacccctcacaagttctag

SEQ ID NO: 63245 - DNA, 48 bp, Glycine max
  Peptide Sequence Number=SeqID_154930
atggctgaaactagccaaaataacactaaaaaaggtgtgaaagataag

SEQ ID NO: 63246 - DNA, 420 bp, Glycine max
  Peptide Sequence Number=SeqID_154931
atgaatcagaagtctacacctgttgcaagagtctatggtctatgttcttctatagatcaccatacagatctatgtccttctttgcagcaatcgggagtcaatgagcaacctaaagcttatgatgcaaacatttataatagacctcctcagcagcaaaaccaacaacagcagaataattatgacctttcaagcaatagatacaatccaggttggaggaatcatccaaatctgagatggacaagtcctccacaacaacaacagtctatccctcctttccagaatgctgctggtccaagcaagccatatgttcctcctccaatacagcagcaacaacaacaacagtcacaacaaagacaacaagcaactgaggctcctcctcaaccttccttagaagagttagtgaggcaaatgaccatctag

SEQ ID NO: 63247 - DNA, 159 bp, Glycine max
  Peptide Sequence Number=SeqID_154932
atgtctttctcaagggatttcctctctagtaatcgattaccaaatgccccatcaccctgtgtaatcgattacacccagatggtaatcaattaccagtgccctatcactctgtgtaatcaattacacacccttggtaatcgattaccaaaggccatttaa

SEQ ID NO: 63248 - DNA, 390 bp, Glycine max
  Peptide Sequence Number=SeqID_154933
gaggaaggcccgaatgttaaaaccaacccgctagctagtcatggaggggctagcgtgaacgccgtcaaagaggacgggccatcacggacaaagaggttaggagaggtggctacttctagacgcttcatctatcaatcactgcaagcggcgtgcatggtctcccgtggcggaggagggagaatgtcaattatttcacctcggggacgttacccacgttctactatgaaaccggtcccgcagtggaagctacatgcttcagctctgttgcgggcatctcgtcttgaatccggagggattgaatccggactacgaaaaggcaagttcgaatatgctgccaatatgcccagacaagcagatagaagagctttaacccccagtagggggccctga

SEQ ID NO: 63249 - DNA, 219 bp, Glycine max
  Peptide Sequence Number=SeqID_154934
atgggattgactcgatcctgcaattctgtcattctttcgcaccaagtggccatcttggcatacagaggacaactcgtaaggtgcttgactgtggtttctattggtccaccatcttcaaggatgcgtggagaatctgtagcacttgtgagccttgtcaaagagcagtggctcactttcatggagacagcaaatgcctcaacaaaccatgttattctatga

SEQ ID NO: 63250 - DNA, 151 bp, Glycine max
  Peptide Sequence Number=SeqID_154935
atgtcttgtggatcagttcaagtggagggtacatccacttggggtttcaaagagaacaagggagggtacatcccttgtggatctttggctcgtaaaggattttacaaggttgaaagaaatcaaaaggaccgtaggtcactggggactggat

SEQ ID NO: 63251 - DNA, 830 bp, Glycine max
  Peptide Sequence Number=SeqID_154936
cactgcttataggccacaagctcagtatgatagcaggagattccaatccttggaagcctggaaccaatatacagataacattttggactggaggatccttccggaaaggaatgttaagatttatcatactgaattcgatgagtttaaggcaaagttgaagaggcgtaacctacacaaacgcctcgccaaccttcaggagggaagtatagatgtggcggtggataaagaattatatgccaacttatacagcccggaaaaccagagccctaagcaagtgagggtgagaggacatttaatcaggattggtgctaatagcctgaattccttcttagagactccagtagtcttggagaagggtgagacactgcctacctattccagcaacttgactcccacttcccacacctctgatcttaatatggacagagctaggttggtttatggcttagtcacaaggatggacatgaacattggcggcaagatctctggacagataaccattatggctcagtccaactcttctctcctaggcttccgaactttaatcacagccttgtgcaggtcgaggggagttggatctgatgctcttacttcttacaagagcctgaggccggtcattaacttggcctatattaaaaggaaatgttgggatgtgaatgaccaagcagttaattttccaagggcaaggaaaactaggtccagagcagctggtgttgcctcttcttctgcaccagcagttgacatcccttcatattctactccagctccacctccaacatcaacaaccccatctgcccaaagctcccagacttcggatgctaagttgcaga

SEQ ID NO: 63252 - DNA, 258 bp, Glycine max
  Peptide Sequence Number=SeqID_154937
atgggacaccttaggtttgtcatactttttggtaggaataatcaatatgaaaatacagaaaaaggtgttgagggaaggagccaagagtatgaagaacctcgggatttgaggtcaaatcctttccaaggtggagggaatgatgcaatcctatcccgcaagggcattggtagaagaatccaagtagattgggctagagatccaagggaaggccctaggattctcatgagcctaagggtagatttcgagcccatgggctaa

SEQ ID NO: 63253 - DNA, 137 bp, Glycine max
  Peptide Sequence Number=SeqID_154938
gcctaggatcttcttcatcaatggattcctttgcttcttggaagatgaatgacaacggaatggagaaggaagagagagaggagaagatcctaggcctgcaagctccaatggagcttacatcacttaagcttacctga

SEQ ID NO: 63254 - DNA, 283 bp, Glycine max
  Peptide Sequence Number=SeqID_154939
ggtcaaggtcggccagcgagacgatgggggataagcttcatcgtcgagagggaaacagcccggggggagcaactaaggcccctaaatgacgggggcggtgataaaggaggtaggggtgcagagacaaccaggagggctaagcgatatgccgaagctgtgggatgtaaaaatgaatcggtaggggagcgttccaccttagagggaaggacccgcgtgagcattgttggacgaagcggaagcgagaaatgtcggcttgaaacttcagaccaacctaaggggggag

SEQ ID NO: 63255 - DNA, 280 bp, Glycine max
  Peptide Sequence Number=SeqID_154940
gagcaggagcctcgcttttgtcgaccgcaccgcttttcgttaccatgacccaaaagctggtagcccgcggagacaccttacggttatccgcacctcgtcattcagtgaccccaagtgtgatttgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 63256 - DNA, 480 bp, Glycine max
  Peptide Sequence Number=SeqID_154941
atgggatcaagtcaaatgccttcacttaaaaagaggttctatcaagtcaaggtcaagagcctagggatcaccagtctaaaagagttagagcagttgatgggtcagccccagcggcaagcttttcgcaaagcttacggtagaggcgaatgggccccgttcatagacattcttgcactattgatcttcggaggagtcctctttccaaatgtggatgggttggtggacctagtagcaatcgacacttttctcgcctatcatgaccacaaggaaagcccggttgtcgctatgctagccgacctatatgacaccttcgaccgaaaatgtgagaagagcagtacggggattgttttgttgtaccccagctctttatgtatggttggtttcgcacctttttcgccaagaggtgaggcatgcttgcccgctagaaagccaccgttcatgcatagagaaaagaggggcaaatttgggaccaacttttag

SEQ ID NO: 63257 - DNA, 399 bp, Glycine max
  Peptide Sequence Number=SeqID_154942
atgggacctctccaaaggcaatccttccgcaaagtgtacggaaagattctagatttgaccgcagcggaggtatttacagaagctatcgtatccctcgcccaatactatgaccagccgttgaggtgcttcacgtttggggacttccaaatggtaccgactattgaagagtttgaggaaatactaggatgccctcttgggggaagaaaaccgtatctcttctccgagtttcttccctccttgagcaagattgcagatgtggtcggggattctgcaagagagttggatcgcatgaagcaaactcacaacggcatagtagggcctgccacggaaatacttggaaggcaaggcaagggatatggcgaaaccagagaagtgggggccgttttgcggatatactag

SEQ ID NO: 63258 - DNA, 420 bp, Glycine max
  Peptide Sequence Number=SeqID_154943
atggtctcccgtggtggaggcaaaagggacgaatgtttgtttcacctcggggagtcgcacgacatggaaacctgtcccacggtagaagaattgcttcagcggctcatggattgcgggcagcttgaagtgtccataggagggagggaagaaccacaaatttgcatgcagtcggaagagaaaaaggttcctctaacccccaaggccctagtgatatgttttactaggaaagggaccggctccacacccatatacccccgggcagcgcccaagccaatgccatttgcatatcaaagtaataaggccgttccgtggaagtatacccctcccgcgttcagcgaaagaattgcaaccgaagttgactccctgtcagctaaggtgaccaacatcaccggcctcagtggcgtaacccgcagtggtcgg

SEQ ID NO: 63259 - DNA, 384 bp, Glycine max
  Peptide Sequence Number=SeqID_154944
atggactcaagaacaattagttgctattttgttggctatgctgaacgttcttggggctataaattttacaatcccaccttaagatcctttttcgagacgggaaatgtgagatttcttgaggaagttgagtttgagaaggaagagaacataatgaatgttgtctttgaggaaaaacttgttatttacaataatcaagtcctcgtacctattagtgttcaagacacaactccagcaataaaagacaatgttcaaactattgacattgttccagaacaagataacaatgaggttctctctcaaatacctttagagcaacctcaacaacctcaagaagtgtcatcaaggagatcgattaaagagaggagaagtgcaatctcaaaatga

SEQ ID NO: 63260 - DNA, 725 bp, Glycine max
  Peptide Sequence Number=SeqID_154945
taggagagttgacgatcacactggatgatgtgtcgtcactcctccatctgcctattagtggcgccttccacagctacgaggctctttctgtggacgagacaatatttttgttgatggagttgcttgaggtgtccgacgagatgccagacacgacgatggattgtagcagctcgtgcttatctcctgcacctgaggcttttcgcgacctgggtcagagtgggggctatgcctggggagctaccgcgctggttcatatgtatgaccagttagatgaagcttctaggaccatgacacggcagattggggggtaccttactttattacaggagcactttccgagtgtgcatcagtgcgtcatcgatgatgcgtatgaggagacgtccccacgtgcctcccggtggctgacgacaaaggcatatatgaagggaattgcaggagtgccatactgggcatgttgtgatgctttgatagtcacaaacggtgctattcagagcatccctccgccacctgttagtgcttcattgtcatatgatgatatagatgacaggtggatgcatttctcggaccacgtagcagctgtgggtgacttttgtatagtgcctgggcaggtatctgcggattacatggagtggtttttccaaatatctcacccattcatcataccgacccaggcaggtgatcagcccagacatccacctgccccagaccatgaggactacatctag

SEQ ID NO: 63261 - DNA, 531 bp, Glycine max
  Peptide Sequence Number=SeqID_154946
atgatgctcgccgcatggtctgcaatgatcaggctaacttttgataatcgcatcatgcactatataattgttagaattttacttccccgctcttcaaatttagcacaagcctctgaggaggatttgactctaatgtgggcttttctcaccggtcgtcagatcgactgggcccatttggttcggtaccgaatgcataaggcattacgggccaatgcacctctaccttatccacagttgataactttgtttctgcgtcattttcaaattccgcttgatgatgagccattcgttcaagtcaagcgttcctttgcaattggtgctggtgctgtgacttcctttggttaccgtaaggatcggaatggtcaatggctgaagaaagacgcactccctcctcaagatgagcgtactccttcacctcctcctcagcgtgaagattcagctctcctgaatgaagttccttgccgaattacgagggattgtcatcatctaaaagggggagattgtagacaaaggatcaagccgatgttttga

SEQ ID NO: 63262 - DNA, 219 bp, Glycine max
  Peptide Sequence Number=SeqID_154947
atggagcatgaacattccttcaaaaaatcaaactacaacatgatcttggtaggatttagcaatattcctctcccgtttgtgtatgacaagctaagctactttccttacacacttatgagtggatcacctggaaaggatatcaatttctcctttgaaaactattttagaaaatttcccaagacaccgaccactgatggaggctttggaggaagattataa

SEQ ID NO: 63263 - DNA, 726 bp, Glycine max
  Peptide Sequence Number=SeqID_154948
atggatagagctaggtccaaaggagtcatttccgatagcttagcctttgaacgtttgagcccgatcattaatttggcctacatcaggaaaaactgttggaacccggatgatccaacagttattattagggggaccagaagaccaagggcaaggccagctaaggttcctgctacatcagcagctcctcctccatcacgtatgacagcagctccttctaccctacctcctacagattttcaacgtttcgaggccatgcttcggagcatacatcaggggcatattattttactgcaaagactacagctggtagcacctctagactccatcccgacggtagagcaatttaatgaatgggtagcttggctagggactcagcctccttttcacagagaagacgaagatcccgccactcaggtaccccatcagtcggaggatgagtcatcagaatcttccactcctgagcccttgatcaggaaaatgagggtagttgtaacccagaaagctgcagccacctctgaaaagtctcttgaagctactccagagcttccggcaccagtggcaaataccacttctccacagcaggcagtagacccttccacgcctgaggatcaaaccaccccagtcctatctctgaacacctctcctgtagctactccagtacttcatttgtcaaaagaggaggagggtcagacacaggacacccaggaccaatcacaggatatttaa

SEQ ID NO: 63264 - DNA, 399 bp, Glycine max
  Peptide Sequence Number=SeqID_154949
atgccgtcttatagctgtcctctatgtgaccatgaagaagaatcgatttatcatcttatgttcaactgtgaaaagactaggagtctttggtgggagacaatgagatgggttaatagagtgggtcctcattccatagatccaaagaatcactttttacaattcacccagtggaatagcaaagctaggacaaacaaaagatgggaatttctgtggctaaccctgtccttctccatttggtatcatagaaatgccatgcttttcaagaaccagccgttcactcctgaaaaggtcatggatgatgccttgttccacacctggtcctggctaaaatgtgtggagaaggacttcaatatgcattttactttctggtcaaccaatctaaaggatgttttttcctag

SEQ ID NO: 63265 - DNA, 294 bp, Glycine max
  Peptide Sequence Number=SeqID_154950
atgactaacgctgtggctagaaaagaggaagagcgtacagagattgaaacacatcaagaaagcatttgtcaagttacctcactccatcatcaattgaccaatgaagaggaaacgcctaaagtctccaatactccagaatatccctacttggctattgttggctatgttggagggaaagataaaggtaggttgaaacttaacatagaggataaagagatctctttttacctctttctggccatgaaacacccagatatgggtgatgcctattttgaagaagaagaggtggaatag

SEQ ID NO: 63266 - DNA, 359 bp, Glycine max
  Peptide Sequence Number=SeqID_154951
atgtctccttcccctctaggatctcacaatcactcacaaactcatctcaagctctcagaacggcttccgcttcgagctctcatctctacagatcttcacacaacaaaatctctcaaaactctctggaacttggatctttctctccctagaacttcctacacatgcaaaagcttcaagccaagcccagactctcgtgcatgctgtcataccctaatttcatccggggaccattgtttgatggcatgcaacctttgtttgaccgcttcgaggtactgggcaccctgtgttgcacaatacgtgaagttccgagacatgccggaaatcaaaaggaagcattgttacacaatccgtgaaattcc

SEQ ID NO: 63267 - DNA, 99 bp, Glycine max
  Peptide Sequence Number=SeqID_154952
atggcagcagaatggagaagaagaagagttgagaggagacgccacttcaaggagaagatgagtcaagaagaagctcaccaccataaaatgcaagcctaa

SEQ ID NO: 63268 - DNA, 297 bp, Glycine max
  Peptide Sequence Number=SeqID_154953
atgaatcagaaatctgcacctgttgcaagattctgtggtctatgttcttcttcagatcatcatacagatctttgtccttctttgcagcaatctggagtcaatgagcaacctgaagcttatgctgcaaacatttataatagaccccctgagcagcaaaaccaacaacggcagagagtattgatcctttcaagcaacagatacaatccagcaagagacaagagcctccattcagagtctgacaaatcagatggggcatatggctactcagttggaccaagctcagtcccaaaattctga

SEQ ID NO: 63269 - DNA, 234 bp, Glycine max
  Peptide Sequence Number=SeqID_154954
atgtcgctgcatgttctttatctttatgcgttttctggatttcccccagggatttcccgtctgctgtatctctcgttacaatctttcaaagaaatgaacgggcaggatcatcttgagctaccttctggggtgaggaccaaatgtggacagcagaaaccaatcaaggtacttaggaacggatgcaagtggggatggggtcacgaccgactgatcgttgccctttctctgcgctag

SEQ ID NO: 63270 - DNA, 156 bp, Glycine max
  Peptide Sequence Number=SeqID_154955
ttgagcttagctcatcagtgggctaagcgcgcatccaccgctaagcgtagcttcagcgcgcttagcacaacagaagaatctgacagggcatcagcatcaaggtcgtgcgctaagcgcgagatcagtgcgctaagtgcagcagttgtctttagctag

SEQ ID NO: 63271 - DNA, 282 bp, Glycine max
  Peptide Sequence Number=SeqID_154956
atgttgatgatgttggaaatgcatgttgtgtatgttcgttgggggtgcattgaccttgtcaaatgtccctggtgggagaaaatagagtggttaaagagtttaaacatctctgaggggatgtttaggatctttaattcatccatggtctttgtacttgatggtgctcacggggtgcatcacctggtaggcaactcccttgtggcccaagctgatcaccgagggggggagttacggtgcacgactaggtggcctcgacaattacagcatagtttccctaagtga

SEQ ID NO: 63272 - DNA, 447 bp, Glycine max
  Peptide Sequence Number=SeqID_154957
atggcttcaaactcccagcaatttagtgctagaagtgatgctattgtcattagaggagtgcatgaagtagccacaaattcatcaggtgagactaagaagcttgaagactctgtggtttatgctcctctgccaaccaccacacaaacctttgcccttctgtgcaacaatctgaagcaattgaatagcctgaagcttatgctgcaaacatctactacaaacctcctcaacctcaacagcaaaaatcagccacaacagaataattatgacctctctagcaacaggtacaatcccggatggaggaatcatcccaaccttagatggtcaaatccttcacaacagcagcagcaacaacaacaacaaacttattttcaaaatgttgctggcccaagcaaaccatacgttcctccaacaatccagcagcaacaacagcaacagccccagaaatag

SEQ ID NO: 63273 - DNA, 369 bp, Glycine max
  Peptide Sequence Number=SeqID_154958
atgacacgcagagacaaaatttggtcattctgcacccttgtgtcatccagaggcagcgggcccgatgacatgcggagataccttacggttatccgacacccttttgtcattccagaggcggcgggcccgatgacacgcagagacaaaatttggtcattctgtacccttgtgtcatccagaggcggtgggcccgatgacacgcggagataccttacggaacaacggtgcatttacatgcggaaattcttacggtatcccgcgacccggtcagccgagaggaacgaaattagtgcgggcccgatgacacgtggagataccttacgggttatccgcacccttttgtcatccagaggcggcggggcccgatga

SEQ ID NO: 63274 - DNA, 207 bp, Glycine max
  Peptide Sequence Number=SeqID_154959
atgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcggggatcctctag

SEQ ID NO: 63275 - DNA, 492 bp, Glycine max
  Peptide Sequence Number=SeqID_154960
atggaaacctgtcccatggtggaagaattgcttcagcggctcatggattgcgggcagcttgaagtgttcatagaagggaaggaagaaccacaaatctgtatgcaatcggaagaaaagagggttcctctaacccccaaggccctagtgatatgttttactaggaaagggaccggctccacacccatatacccgcgggcggcacccaagccaacgccatttgcatatcaaagtaataaggccgttccgtggaagtatacccctcccacgtccagcgaaagagttgtaaccgaagttggctccctatcagctaaggtaaccaacatcaccggcctcagtggcgagacccgcagtggtcgagtgttcgcttcccctcacccggtggaattgccctctaaagggaaggcgcccatggtccaagagcccacagacatagccaccccctcgaaagaagtagatcctcccgtggcaagaggagccgaaaagaaagagtga

SEQ ID NO: 63276 - DNA, 393 bp, Glycine max
  Peptide Sequence Number=SeqID_154961
atggatcttgaagaacggtcgagaatcttcgccaaaataggggagaagcttgccgcccagctcgcccaggcgagcaagctttcgaagaagttacggaaacttacggattgcgcaaaaacacctcttttcgacttccgccacattacggattttcacggatcgcgcaaccctgcttcctttagatttctgagacctctcgggacttcatttattgtgcaacaaaggacgccaaatatctcaaagcggctaaccaaaggttgcatgtcatcaagtaataatccccggacgaaattagggtatgacagtaagcttttggtcaagtggcttgtatatacaacaatagccttcatcatatccaaattcatgcttttcattctaaaattcagagattga

SEQ ID NO: 63277 - DNA, 470 bp, Glycine max
  Peptide Sequence Number=SeqID_154962
agggtacatctgcttgggttattgtaaatgagaacaagagagggtatatctcttatggatcagttcaagtggagggtacatccacttggttcttcaaagagaacaagggagggtacatcccttgtggatctttgcttgtaaaggattttacaaggttgaaagaaatctcaagaaccggtggttgcttggggactggatgtaggcataggttgttgccgaaccagaataggtcattccaaaatcatgatgaagaccaagtcaacttgtgtcttatgacaaaatctcatgaaaacaacaaagaagaatctgtaaggaagaagtggtatatcgacagtggatgttccaagtatataacgggagatgtatccaaatttacaaccatttctcccaagaaaagtggacatgttacatacggcgacaataatatcagtaaaatctcaaaagaggtaacatctaagccatctctatga

SEQ ID NO: 63278 - DNA, 549 bp, Glycine max
  Peptide Sequence Number=SeqID_154963
atgagcatccatgtggctcagttgatcgctgatgccatctatatttttgcagggccctgggaattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccggggcccaagcaggagaggcacccccagaagctcccggcgatggagaagaagcccacgaggatgaggagatggctgatttgcttgacttcttgggagggagtggagacacgtga

SEQ ID NO: 63279 - DNA, 594 bp, Glycine max
  Peptide Sequence Number=SeqID_154964
cagaattgcaactgtggtcaaggattcagccagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggagagtccggtggtagctgtcttggcagatctatttgacacatttgaccgaagaatagattgggaccagctcttggccgggataggaggtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttcctggtgagggatctcggcgcacagaattccaagactatacaaagaatccctaaggcatgggaaacccc

SEQ ID NO: 63280 - DNA, 648 bp, Glycine max
  Peptide Sequence Number=SeqID_154965
atgaccagtaaggaatctgacactcctaaaccgaaaataaaacccaaaataacatgttacaattgtggaaaacaaggccacattagcaaatattgtaggttaaagagaaaattgagaaatcttaacctagaaccaaccattgaagagcagattaataatctgcttattgaaaccttagaggaagaaacaaaaacttcatcttccacattctctgaggagaacctcaacataatcaaacaagatgaccagccatcatctacggacgatgatgaacgagaaatcaatactctaacaagagaacaagatctcttgtttgaggcaaacaattccataccagatccccaggaaaagaaggtttttctggaaaaattaaagaaaactctggaaaccaaacccagaccaaaagattttattacaaataataaattcgatgttagtaatatattcaagagattagaaaacacttcagcaaaatcaaccacaattcaagatctccaaatagagatcaataattttaaaaaggaagtaaaggaacgtcgtcaacaacaagaaattcatcagatcatcctatctcaacttgaagaaaacagtgattctgagagtatagaaaagaatggactgattcaaactgcattttggaaggattag

SEQ ID NO: 63281 - DNA, 1083 bp, Glycine max
  Peptide Sequence Number=SeqID_154966
atgggtcaacttcaacggcaagcctttcgcaaagcctatggtaagatttgggacctagctacgctagtgccgactgtggaagagtttgaagaaatcctgggatgcccgctgggaggaaggaagttgtatcttttgttgaggttctatccctccgtggttagagttgccaaggtagtgaaaatcttggcacaagagttggaccaggtaaagcaaaattggaatggggtggtcggagtaccaaggaggtgtttggaggagaaggcaaaggccttggcaaatcaaggcgaatggacttcttttattgacatcttggcatttttgatcttcggagttgtcctctttccaaatgtggaagggttagtggacctagcagtgattgacgctttcctcgtctttcatcatggcaaggaaagcccgatcgtctccatttttgccgatatgtctaacatgttcgaccggagatgtgaaaagagcggcacaagaattgtttgctatataccagctctctatgtgtggttggtttcacacctttttcgccaagaaggtaggcccgtctgttcgctacaaggtcaccgctcatgtgctgagaaaggaaaggcgaattgggaccaactcttggctagcatggaaggggcatccgataattggttcccttgctggaaggaaggaagaacgaggattttgtcctcgtgcgaaggatttccaaatgttcccttgatgggaacaaggggttgtattagttataataccatccttgtcatcagacagcttggctaccccatgagaggagtgccatcggaggaaagcatcgtgcctttcatcgcatggggttttagtgaccccaacgcaagggtacttcaaggagttcacaaggcatgggatgtgctaagggctgcaagagaggaagaggccgaagctcaggaagagagtgaggaggtacaagccctaaagacggagcttgaaaaagcccaagcagtcaaggagaagttcaagtcagcaaccatcaaagtccgaaaggagtatgataaattgaaggacatcaacatggccaccgcccgaagctttggaataggaaactgttag

SEQ ID NO: 63282 - DNA, 220 bp, Glycine max
  Peptide Sequence Number=SeqID_154967
atggccgaatatgaagcgtgcgcccttgggattcaagcggccattgattttgacgtaaagctactcaaagtgtatggagactcggctttggaagagcaagatgggaaaccgtggtatttcgacatcaaacaatatgttgagaacaaagaatatccaccagggatttccgacaatgacaaaagaacgttaaggagattggctactggtttctttgtgagtg

SEQ ID NO: 63283 - DNA, 242 bp, Glycine max
  Peptide Sequence Number=SeqID_154968
atgaagatgttggatgcatgggtgattttacaaaagagggttgcaccactcaacacattcatcataccatctatcatagggatttggtgcctcataatacctattttaggcaccaacaaagtacaaggagtttatgctcttacgaaccaaaccctcatccaacaactcatttacttgaggaataacctcaagctcaagaggtatggcagtgtgctaagggatgtttcctttgataggagaag

SEQ ID NO: 63284 - DNA, 654 bp, Glycine max
  Peptide Sequence Number=SeqID_154969
ggcctagatgtcaccagccttaaggagttaggacgattgatgggaccgctccaaaggcaagccttccgcaaagtgtacagaaagattttagatttgactgcagcggaggtatttacggaagatgttgtatccctcgcccaatattatgaccagccattgagatgcttcacgtttggggacttccaaattgtaccgactgttgaagaatttgaggagattttaggacgccctcttggggggggggggagaaaaccgtatcttttcttcgggtttcttccctccttaagcaagattgcagctgtggttggagattcggcgagagagttggattgtatgaagcaaactcgaaacagcgtagtgggcctaccgcggaaatacttggaaggcaaggcaagggatatggcgaatcaagaggaatgggtcccgtttgcagatatactagctttgctgatctttggggttgtcctctttccaaacgtggacggtttggtggatctagccgcaattaatgctttccttgcatatcaccatagcaaggggagcccagtggaaggaaaggggggagttcttttctcatgtggggactaccctaacgttccgttgagagggatgaggggttgtattaactataatcccacacttgccataagatag

SEQ ID NO: 63285 - DNA, 219 bp, Glycine max
  Peptide Sequence Number=SeqID_154970
atggaggagatacatggtgaagaatatgaagaaaaaataattaaactccatgtggagcttgtaggacttgaatcttcttcatcaatgaagtcctttacttcttgtagatcaatgaaagtgggatggagaaggagtaaagatgattggagatgtcacttcaaggagaagatgattcgagaacaagctcaccaccataggaagccatggataagagcttaa

SEQ ID NO: 63286 - DNA, 382 bp, Glycine max
  Peptide Sequence Number=SeqID_154971
atggtgggagcaggtttgaaaaaggatcttagagtgtctagggttgtgccaggagggtctcttaatgccttcccttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggagggtttcctcatttgggatcctggggaagaggatcaagctggcccatcaagcttatcgataccgtcgacctcgagggggggcccg

SEQ ID NO: 63287 - DNA, 360 bp, Glycine max
  Peptide Sequence Number=SeqID_154972
atggcagcggaatggagaaggaagagagagaggagacgccacttcaaggagaagatgagtctagaagaagctcaccaccataggaggccatggataagagcttggaggaagaaagagatgaatgaagggagagggagagaagagcacgaaaatttgtgctctaaaagagctctaaaatctgaattattgttcaacccactaatccaagatcaattccaagattctccactaggtgtgcttaggtgtcatgagacatcctatgggctcgaaatctaccctaaggctcatgagaaccctagtgccttctcttacatctttggcccaatcttcttggagtcttctatccaatgcccttggagg

SEQ ID NO: 63288 - DNA, 684 bp, Glycine max
  Peptide Sequence Number=SeqID_154973
cgaccgccgcgccctcctactcatcggggcttggtccttgccccgacggccggcgcgcagttgggcaccgtaacccagcttccggttcatcccgcatcgccagttctgcttaccaaaaatggcccacttggagctctcgattccatggcgcggctcaacagagcagccgcaccctatcctgagggaaacttcggagggaaccagctactagacggttcgattagtctttcgcccctatacccaaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 63289 - DNA, 252 bp, Glycine max
  Peptide Sequence Number=SeqID_154974
atgataaaattaagagcgatgctaagcattatatttgggatgacccctatttgtggaagttgtgcagtgaccagaggacagctcgcaaggtgcttgactgcggtttgtactggcccaccatcttcaaggatgcgtggagaatctgtagcacttgtgagccttgtcagagagcaggcagctcacctttatggagacagaaaatgcctcaacaacctatgttattctgtgaggtgtttgatgtctggggtatag

SEQ ID NO: 63290 - DNA, 415 bp, Glycine max
  Peptide Sequence Number=SeqID_154975
gtcgactctagaggatcccacgcacggttatgagcccggaatgggtctgggcaaggacagccacgggaatgccgatgtggttgacattaggggtaacctgtatatatatgggttagggtatgaacccgggaaacttggaagaaggaatgcaccatcaagactctgggcagatagggcatggcccggtcatgttagccagtgtttcacaagtgccgggataatgttcgaggaagaagtggcggcaataggagaggaggctccacaagatccgccaagtttcgtgcggccgtgccatcccaatttccaagtggggaactggcacgagaggaagaggacgtctttcaccagagttggagagattgatcgctcaagaagaacgcgaaatgaagccttcaccaagaggaaaccaaactga

SEQ ID NO: 63291 - DNA, 352 bp, Glycine max
  Peptide Sequence Number=SeqID_154976
atgattttgaggggccaagacatttatagtagccaagataaggctactaattcaccttcctctagtgaaagtgaaaaagcaaaagggggagaatctagtgaagaaatctacccccaagaagaaggacaaccattagtggttaaagagaagtgtaaggaggtaagtgtctcctccaagagtgatcaacgggttcccatgaaccctaagagaataaaggtcattcctgagtggctcactccaccaacaccactcattgagttggtgagaaaccatgttccttcatgggaagatgcccaggaaatgggttttcagaccttaccttacttcaacataccaaacaccactaatacat

SEQ ID NO: 63292 - DNA, 267 bp, Glycine max
  Peptide Sequence Number=SeqID_154977
atgagatcgagtttcccctttccttccgtttccgggggtggtcctcttacggacagaaacatcgtctgtgttgggtggcttcgaggctctcccatgatgttgggttgcggtagtgcattgggcgccgccccttcagtgggacacggggacaaagatccacaagggatgtatcctcccttgttctctttgaacctagtggatgtaccctccactagaactgatccacaagagatgtaccctctcttgttctcagtcaaacccaagtag

SEQ ID NO: 63293 - DNA, 136 bp, Glycine max
  Peptide Sequence Number=SeqID_154978
tggcgtctcctctctctcttccttctccattccgctgactttcatcttccaagaagtaaaagaatccattgatgaagaagatcctaggcctacaagctccaatggagcttacatcaacttggtgactactgctctt

SEQ ID NO: 63294 - DNA, 201 bp, Glycine max
  Peptide Sequence Number=SeqID_154979
atgtggtttaggaaatggccccaaggaagcttgcctcaaagagatccaggaaagacaaggcggttgaaggaaccagttccgctcccgaatatgacagccatcgttttaggaccgctgagcaccagtagcgctttaaggccatcaaaggatggtcattcctccgggagagacgtgtccagctcaggacgacgagtatactga

SEQ ID NO: 63295 - DNA, 770 bp, Glycine max
  Peptide Sequence Number=SeqID_154980
ggccaggaatgtgagtatgaccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacattgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtattttacggcatttggtttcgccagcaggcggccaaccaccgagcacataccagttcagggcagaggtttgcatggcccggagattggcccgaggcccaagcaggaccccccacccccagaagctcccggcgatggagaagaagcccaagaggatgaggagatggccgatttgcttgacttcttgggagggagtggagatac

SEQ ID NO: 63296 - DNA, 252 bp, Glycine max
  Peptide Sequence Number=SeqID_154981
atgtgggatactcttcagttaacccatgaaggaaccacagatgtaaaaagggaatggcagcccaaggtaactgctatttctgaaagcaaagatctctcttccatgtctcttgccactttatttggtaaattgcaggaacacgagatggaacttcaacgcctcaatcagaatgaagaaaatgaaaaaaagaagagaagcatagcccttaaagcctcatcttcaatacaagaagaaaacgaagaagaagattaa

SEQ ID NO: 63297 - DNA, 903 bp, Glycine max
  Peptide Sequence Number=SeqID_154982
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcaaggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgagatcctgggttaggggtcagtggatcccgttcgatgccgacgctatcagccagctcctgggatatccgatggtgttggaagagggtccaggaatgcgagtatggacagaggaggaaccggattttgcccggactgctgcagggaggcgagtgcgaatcatgcgcaccagtatgaccaccctgacccagatatggatgacgttgctcctcagcaacatcctgcccaccgatcataattccgacctccccatgcctaagtgccagctggtgtacgccatcctgacacgggtgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacagggtcagggtgatgctccacaggccgcaggcgcgcccccaccacctcatcaggctggccaggctggggcattttga

SEQ ID NO: 63298 - DNA, 492 bp, Glycine max
  Peptide Sequence Number=SeqID_154983
atgcatagatcttccacaggcaatttagctcctctggacttagaaattaaagctgcattgcggaggaacaaggccgagaggagaaggaaacttctgcaagacagaatagttgcatccattcttgaggaggagactcatttctctgacttattatcacctgattcaccatcatcaagggaatctgccactcaattacctaaagccattaccatggtagaagagcatgaccagaggattacccttgaggattattcaagtagttcagtaccacaatttttcaccagcattgcacgtcctgaagtacaagctaacaacatcaactatccacattccttaattcatttaatacaggggaacttatttcaaggattacctaatgaagatccctatgcacacttggcaatgttcattgaaatatgtaacactgttaagattgccggtgtaccaaaaaggtcttatcctctcaaaagcaaaattatcttatcctcttaa

SEQ ID NO: 63299 - DNA, 423 bp, Glycine max
  Peptide Sequence Number=SeqID_154984
atggaggaaggattttctaaaggatcagttcccatcattctaggcagaccttttatgaaaactgctagaactaagatagatgtatatgcaggcacactatctatggagtttggtgatataactgttcattttaatattcttgatgctatgaaacacccatctgaagatctttctgtatttcgtgttgaaataattgaccatattattgatgaatacatgactgatcttcattctaatctgcatgtctgtcactcttcatgcattgaatctgaatttgtacttgatcatatgtctgaatttgatgctgagagtgaatctgaatttgatattgattacatggctgctgatgttttacctcttgagattgcttttatagaatcggatagaactaaccatgtttcaggaaagtacacatacctctga

SEQ ID NO: 63300 - DNA, 429 bp, Glycine max
  Peptide Sequence Number=SeqID_154985
atgtggcctttcataccggccgacaaattgattgggcacaccttgtccgtcactcttttccttcaacattttaacatccttcttgattctgaaccttatgttccaatcaagagatctttcttgatcggtgttgttgtggttgcgtcctttggttaccgcaaagagcgtgatggcccttgggtaaaaaagggtgctcaaccaaatgatgctgaaggacaattaccggttgaaggggactcttctctccttcagagtattttggacaggtttgatggacttcaaacctatgttggtgaaaggtttgatgctttggaacgacaagtggacacgcgattcgacgaaatggactcaaggatcacaaaagttgaagaagatgtcaccatcattcacgactgccttgatttacctccaccaccaccatcagtgtag

SEQ ID NO: 63301 - DNA, 344 bp, Glycine max
  Peptide Sequence Number=SeqID_154986
agtacattgagaaagctaaacctattgggcttcttgagtatcggcatgaagaaagagtgggacgtaagggttcaagaggactgcatgttatcactccaactgtaagagagagtgggatgctccttaacattcaaggcaagacaaaagatggtttgaatactcgtcaagatctagctaagataggtatacgattgaagttgcatcgaagcaaagtcctttatcctgtgaagttagatgagctggaaaacaaggctgctattatattgtgtcagttggagatgcattttcctactgctttctttgatatcatggttcacttatttgcggtggatgtagccggttga

SEQ ID NO: 63302 - DNA, 726 bp, Glycine max
  Peptide Sequence Number=SeqID_154987
atgcagtcatgggtgaggggtcagtggattccctttgacgcagatgccctcgaccagttcctgggtgacccgctagtgttggaggaaggccaggagtgcgagtttagtcagaggaggaacagggccgatgggttcgacgaggaggccattgcccagctattatgcacaccgaggcaggatttcgcccagaccgctgcagggaggcggacccggataattaagtctaacagggccctggggtttcgagcattgatcaggggcctctgccagtcattcggggttcccatcacacctagtaaggtgatccgaccgccgatcatccaggccttcattgagaagtattgcacgcccaggcaggcgcagggtgatgcaccacaagccgcagacgcaccgccaccacctcatcaggctgatcctgttgggtcgttaggcatggagcagtatctacaacacttggttcgccaacaggcagccaaccaccggggacaggtgcggatacacgagtgtctctaccagcttagcctcagtcagcagggccagggtttcgctccttttgcatgccctactccagatcagtttagggctgaggtcgcatggcccggagattggcccgaggcccaggcgaaggaggcgcctgcaggagctcccggcgatgcagaggaggcctgcatggatgaggagatgacaaacttgcttggcttcttgggaggaagcggagccacgtga

SEQ ID NO: 63303 - DNA, 64 bp, Glycine max
  Peptide Sequence Number=SeqID_154988
atgaatccttctttccctaacaagggaaatccaccgatagaaggcatacccttgaaagctaagg

SEQ ID NO: 63304 - DNA, 600 bp, Glycine max
  Peptide Sequence Number=SeqID_154989
atgaagctcgagcaagcccaagcggtcaaggaaaagttcaagtcagcagtcgctaggatccgaaaggagaatgccgaactaagagacatcaacatagccaccaccaaggccttggtgcaaaagaccaagagggctcgcaagaaagaacatggccggaacaagtttcgaggagaggaaagggaccagtcgcgagtagatggcatgattctgaaagacgaattgaagacttgcctaaggtcgaagaggagtttgtctcagcagttatgcgagaccgaaacaaacatgttggccatcattagcaagtacaaagaagaattagatttggccaccgcccacgagcacaaagtggcggacgaatacgcccgagtgtacgcagaaaaagaggctaggggaagggtgattgactcattacagcaagaagcgacgatgtggatggattggtttgcttttactttgaacgggaatcaagatcttccccgattactggcaaaggccaaagtaatggcagacgcatacttcgcccccgaggaaatccacgttctcctcagctattgtcagcatatgatagacttgatggcccatataattaggagccattag

SEQ ID NO: 63305 - DNA, 597 bp, Glycine max
  Peptide Sequence Number=SeqID_154990
atgtcgcgacggaacgcctgcggcagctacaccaacagcaccaccctcgtgcgtgagtgccgacaaattgtaacgggatcaactatgaaaaagtctttcgcgctgttcaccctgctggcagcctcttttaccgggttcgcccatgcggatgacgccgctattaaacagtcactggctaaactgggcgttaccagcagcgacatccagtctgcaccggttgccgggatgaaaacggtactgactaacagcggcgtgctgtatgtcaccgaagacggcaaacatatgattcagggcccgccaatgtatgtgagcggcgcgcagccggtcaacgtcaccaaccagctgctgatgaaaaacctgaacgcgctcgaaaaagagatgatcgtctataaagcggcgcaggaaaaacacgttattaccgtcttcaccgacatcacctgcggctactgccacaagctgcatgaagagatgaaagactacaacgcgctgggcattaccgtgcgttacctggctttcccgcgtgcaggcgtgcagagccagccggagaaggacatgaaggctatctggtggtgcgaaagaccgcaacaaagcgtttga

SEQ ID NO: 63306 - DNA, 777 bp, Glycine max
  Peptide Sequence Number=SeqID_154991
atgtacgattaccatgagaaagaaagcccccctgatcttgaaattattttggcagacttcatgacataccaagctagatctaaaggttactgttattttatgcaacaacagggaactcaatttgaaaggaaccagtcttctgcaggttatcaatgggagtcataccggaaatctgattatcacaataaagcagaaggagttcttaatctggatgatctgttaatgcaattcaaagatactgtagagtcaatacaagaagcctttagaagaactgaaactcagattaaggaaaagcctgaagtctccagtactccagaatatccctacttggccactgttggctatgttggagggaaaaataaagatagattggaactcagcgtggaggatcaaaagatctcttttgacctctttaaggccatgaaacactcagatatgggtgattcctatttcgaagaagaagaggtggagcaggaaatagcattattagcctcaaccatggtactacagtctcctttggaaaaagaacctggctatgggagagattgcttagcttgtgatgaagagcttgatgattcaaaagacagttgtgttgaccaggtggcttttgaagaattggaaaaactgagaccagtagaaaagcccaaagcacaattaaagacccttccggcacatttaaagtatgtattcttggaagaagatgagaccaaacttgttataattagcaactctttgaagaaagaagaagaagatcaactggtgcagattctaaaatga

SEQ ID NO: 63307 - DNA, 132 bp, Glycine max
  Peptide Sequence Number=SeqID_154992
atggttcatgcctcatatgacactggaaatagtataaattgtggcagtatgtactttgtactagggggtgtgtcacttggctatttccttggtattggatacggtacgtaccgcattgcatctgagagttga

SEQ ID NO: 63308 - DNA, 1017 bp, Glycine max
  Peptide Sequence Number=SeqID_154993
atggcggaaccatcaaagaagcgaaagggttcttcgagttggagtcaatggcattccgagactcaggaaacgctgattccttcctctatttcctcttcatcattgttctcatccaaagaacaacggatacagtacacaaatcttttctcttctcgttccattattgatccaaaattcattgatatggatttcttttcaaatgagagttttgcatgcattcaagcatttgaaaactccaatcttattcctttcatgtctttaaaattgcctgtttactctgatttagttaaagccttctattcaaacctagaaatccaagaaggcactttaatttctgaagtttatgggattaaaatggtcattgaccaattcctattctatgatttaacccaattatccagtgaaggtgtaccatttgaaggtacactgattgatgattggaaatatgaattctctgtgcatgatgcccgccggttggtttgcactaaccaagcggacatgaccagaaggcttcttgccggttcattggcttttgaaagccgcatccttcattatctcattgtacgtatcttgcttccaagatcttcaaaccttgcacaggcattgcgattaaatgctccattgccatatccacacctagtcaccctctttcttcaacacttcaacatccctcttgattttgaaccttatgttccaatcaagagatcctttctaataggcgctgcagtgattgcatcctttggttaccgcatagagcataatggctcttgggtgaaaaagggtgctcaacccattgatgaagaaggacacttacatggtggagaagattcctctcttcttcaaaagattttggacaggtttgatggtcttcaaacctttgttggtgaaaggtttgatactttggagttacaagtggacatgcgattcaatgagatggaatcaaggatcaccatggtcgaaaaagatgtctcttacattcgtacaagctttgatctaccaccaccaccgcccccataa

SEQ ID NO: 63309 - DNA, 418 bp, Glycine max
  Peptide Sequence Number=SeqID_154994
atggaaccatcaaagaagcgaaaaggcacttcgagtcggagtcaacggcattccgggtcacaggaaacgccaattccttcctccatttcctttggatcattattttcatcagaggagcaatggatacggtacacaaaccttttttcttatcgttccattattgacccaaaattcatagatatggatttcttttcaaatgagagttttgaatgttttcaagcatttgaaaactccaatcttattccattcatgtctctaaaattgcctgtttattctgatcttgtcaaagccttctactcaaacttagaaatccaagaaggcaccctaatgcatgaggtttatgggattaagatagtcattgaccagtccctattctatgatttaacccaattgcctagtgaaggtgtaccatttgaag

SEQ ID NO: 63310 - DNA, 138 bp, Glycine max
  Peptide Sequence Number=SeqID_154995
atggagaaagatgttgatgcaatcctccctaggaagggaccaatcactagaaccatgagcaagaggctccaagaagattgggttagagctgctgaagaaggccctagggttctcatgaaccttagggtagatttctga

SEQ ID NO: 63311 - DNA, 96 bp, Glycine max
  Peptide Sequence Number=SeqID_154996
atggcacgagaatgcttcccaaatgaatatctgatgtggaattgcccctcaagagtaggaaatggccccgaggaagctcgcctcaaagagatctag

SEQ ID NO: 63312 - DNA, 930 bp, Glycine max
  Peptide Sequence Number=SeqID_154997
atgaaaaataataatatgcaccgtcgcgcagcggcgcggcgcctctctttgcttgccggttgcattacggtcatgatggctccggccatcagcgtaatggccgattcgaccagtgaactgatgatgtttgccgagatgagcggacatcgcccggccgcccccgctgcggcaccggtacgtagcgcgccggtacagcgcgtgcccgttgcgccagtccagcgctttgcaaccgcgccggcaccgcaaccgatgtttacgcaatctcaggccgcgccggttgcgccaccgatcgccgcgccacgcgctcagccggcacctacaccgacaccttcaccggcaccagcgccagcagcgccgattgccccgccgccggtacagccggtacagggcggcggttttctgacggaggagcagcgccagccggaaccaaagcagactaatccgctgctgaaatcggtacgcactttcaactcgcagcagcctgcgccggtgccggtgaatgaagcagaagtaaaagcacagagcgagttcagctatgtcagcccgccggtagcggaaaccagaatcaccgccgccgatgccgccgtggcgcgttcaccggtcagcctgagcggcgcggtggatgaaaccgtggctgaatccgagctgcggcagaaattcctatcggccgcgcgcatcacctggcgcatcagtccggcactgaaatcgtccgtggcgcagaccgatgccgccgccgccagtgtggatgaggcgaaagggcagcgctggccacagctggatgtcagcgccagttcggcgaccaaagagtttggtggcggggtaaaaagcgacggtagtcagagcaacgtgccggcgctcggcgtgtcgatggcgaccaacctgattgatttcggtcagaccagccgcaccatcgagagccgcgaagagcgc

SEQ ID NO: 63313 - DNA, 171 bp, Glycine max
  Peptide Sequence Number=SeqID_154998
atggataagagcttgaaggtaggagaagatgagtggagggagagagaaagaggggaacaaaattttgagagaaagaagagggagaatgagctatggttcaaccgactaatccaagaaatccaagattctccactaagtgtgcttaggtgtcatgagacatgtaaagcatga

SEQ ID NO: 63314 - DNA, 252 bp, Glycine max
  Peptide Sequence Number=SeqID_154999
atgagtgaaacaataaaaattggtatggtgtacttcaaatgtatgagatggccccgaggaaacttgcctcaaagagatccaggaaggataaagcggccgaaggaaccagttccgctcccgagtatgacagtcatcgctttaggagtgcggaacaccagtagcgcttcgaggccatcaagggatggtcatttcttcgggagcgacgcgtccagctcagggacgatgagtataccgatttccaggaagagatag

SEQ ID NO: 63315 - DNA, 321 bp, Glycine max
  Peptide Sequence Number=SeqID_155000
atgcctctgtggtgggaattcaactcctgggttagggaggacagagttcttcattgtaggcccatggataatttcctccagcactcctccatagcagcctcgaaggtttccaataaaagaaggaaaatatggtggataatagctacaaggtcaatatggaagctccgcaatgatatcatctttcataatcagcctcttcacatctctaagttggtggataacagaaattttctcacttggtcctggctgagggggcgggaaaaggactttaatgttcctttccatcaatggtcctcagctatgtctatggcttttaattag

SEQ ID NO: 63316 - DNA, 429 bp, Glycine max
  Peptide Sequence Number=SeqID_155001
atgaagcttgacaggttcaagtgcaggtgttgctactggtggaggcacttgaatttggttgccagaactcaaggctctgaatggaggctcttgtctcttgctgaaattgcatattctggatggtcatttgtctcactaactcttctaaggaaggttgaggaggggcctcagttgcttgttgtctttgttgtgactgctatttttgcattggagaaggaacataaggcttgcttgggccagcaacattctgaaaaggagggacaggttgttgttgttgtggaggacttgtccatctcagatttggatgattcctccaacctggattgtatttgttgcttgaaaggtcataattattctgttgttgttggtttttctactgaggaggtctattataaatgtttgcagcataagcttcaggttgctcattaa

SEQ ID NO: 63317 - DNA, 442 bp, Glycine max
  Peptide Sequence Number=SeqID_155002
gtcgactctagaggatcccactgactctgacaggtgcggcttgtacatagaagcagatcctgcccgcctggttgccgtggggagagtttatgagggatccactcttgttcataacactcctttgttgcctggccaagtaaaggtgagtgtggatgaggttaaagatgcagatgctccagttcctgtacccactgctgaggtagttgtgtctccgccaaaaccacctccgaagcttgatccggaggtcaatgatccgctttatctgatgacattgaccatcccagagcttttcttgaggccttatcaggttagatgggatgccaccgtgttcggggtcgttaatccagatttccccctgtacataaagcacgaagacctctctgaaatcgcacacggttgtcaatgtctcagcatatcagtgttacggttgtggattctgtaa

SEQ ID NO: 63318 - DNA, 435 bp, Glycine max
  Peptide Sequence Number=SeqID_155003
atgcagggcttctttggcggcgggttgcagcctacccagcagtcggtgctgctcgactacttcaagccggaggaccggggcaaagcgtttggtctctcctctattgcgattatcgttgcgccggtgctcggccccacgctcggcggctggatcaccgacaactactcctggcgctgggtgttctttatcaacatcccggtggggatcgtcacggtactggcgatctatcagctgctggaagatccgccgtgggagagtaaatcgaaagagaagctaaccatcgactggacggggatcgggctgatcgccttagggctcggttgtttgcaggtgatgctggaccggggagaggatgaagactggttctactcaaactttatccgcactttcgccgtgctgacgctgatcggcattattggcgcctttactggctga

SEQ ID NO: 63319 - DNA, 682 bp, Glycine max
  Peptide Sequence Number=SeqID_155004
atgggggatcccatcagcagactctccttccctgaaaacaccgagactttttcaagtctcacaagttatccagaactacgtaggtctgagttcctcattggaggatacgtaggagcaagagcctcgcttttgtcgaccacaccgccttttgttgccatgactcaagagctgaccaagtttggtcatcctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggcccgatgacaagcagagaccaa

SEQ ID NO: 63320 - DNA, 213 bp, Glycine max
  Peptide Sequence Number=SeqID_155005
gggcctcaactgttggctgtttctggggttgttgctgttgttggattggtggaggaatgtatggctggaccatctgaggttagggtgattcctccatccagggttgtatctgttgctggagaagctactcaattgctccaggttgctgcatggaagggcaaaggtctgtatgggggtcagcagatgagcacaaaccacaaacccttgcaacag

SEQ ID NO: 63321 - DNA, 608 bp, Glycine max
  Peptide Sequence Number=SeqID_155006
atgggatcacatccttatggactcgttgagaataattctgatctagttcatggcctattagaagtagaaggcgctctggtgggatcctcacgtacagaaaaagattgcagtcagtttgataaggatcgaagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactg

SEQ ID NO: 63322 - DNA, 378 bp, Glycine max
  Peptide Sequence Number=SeqID_155007
atggggtccgatcatcgtctaccttcgaccagagagggtggttcggcagatggtactgatatagacgaccgatgggtacagtttgcagatcatgtagcgcctacaggggaactctgtgtagttcctgggcaggtggccccagactacatggagtggttttttcagatttcacacccctttgtgacgccgacggaggacactgctgagcccagacctgcgccttcccttcccactcatgatgatgacttcgtggagccacctgtcgcccaggttccagtcacgtcagatccccctgcgcattctatggttgattgcacaacatgtgtcaggatgggaaggattgctgagcatttgaagcacgtcatcaacctcaggatg

SEQ ID NO: 63323 - DNA, 303 bp, Glycine max
  Peptide Sequence Number=SeqID_155008
atgctactctacccgtatggagaacaggacgtggtgctccgacttcctccccggcctatatgtgatgagctacttgaaccaacaccatcctcacccggtagtagtccagctagtaggttgagaccggcaccatcgagtaacgcttgtgcaggcaacttggttcagcctagtcctactctagctatccgaccagtccgagaagctactaggcaacttcagaccccttccgtaccgagctactactataggcttagcaactggtcctcgccctcctactatataattgcactatcaagacgataa

SEQ ID NO: 63324 - DNA, 537 bp, Glycine max
  Peptide Sequence Number=SeqID_155009
atggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctctgggagcgacgcgtccagctcagggacgacgagtatactgatttccaggaggaaatagggcgccggcggtgggcatcactggttactcccatggccaagttcgatccagaaatagtccttgagttttatgccaatgcttggccaacagaggagggcgtgcgtgacatgagatcctgggtaaggggtcagtggatcccatttgatgccgacgctatcggccaactcctaggatatccgttggtgttggaagagggccaggaatgtgagtatggccagaggaggaaccggtctgatggggaggcgagtgcgaatcatgcgcaccaacatgaccaccctgacccagatatggatgacgttgctcctcagcaacatcctgcccaccgatcataa

SEQ ID NO: 63325 - DNA, 537 bp, Glycine max
  Peptide Sequence Number=SeqID_155010
atggctgcaagcgacattgctattttgagagatagagctcacgttcctaccaaaaagtgtttattggagttaacctctcaagatgcattgttggcacaaaataaattgttgtctaagcaactggaagccttgactgaaacactaaaacaccccactcatgaagtcaattacatgggaaatcaacccagaaacaatttgaatgtaggaggattttctggattccaacatggcctgcaatataatcagcagcagggacaatggaggaaccaccctagaaatcagttcaacagagatcaaggtggaccatccacaaggccacaacagcaagggcctagcctctatgatcgcacaacaaagctggaagagactctagctcagtttatgcatgtttctatgtctaatcagaagaacacagagtccgccataaagaatcttgaggtccaagtgggacagcttgcaaagcaattggcggtagatcatcaagtagttttacagctaatacagagaaaaatcccaaggaggaatgtaaagctgtga

SEQ ID NO: 63326 - DNA, 273 bp, Glycine max
  Peptide Sequence Number=SeqID_155011
atggaggttaaacagaattttgcacaagtgcagaaaaatgcttatgtgtggttggctgtggaaagtctagtgcagaatgagttctggatgtttgctagtagatcccaacggcttcagaggattgatggggacccggtgttgagagaaacgaggatatgggctacgtgggagtacgtgagctcagttgaaggtgggcaacaggggatggtgggtttatgcgcgcattgtggatgtggaaagcttgttgtgcaccatcgcccgaccaccacctag

SEQ ID NO: 63327 - DNA, 267 bp, Glycine max
  Peptide Sequence Number=SeqID_155012
atgtccccagtggagtcgccaactgtcgcaacctacccttcggcgggagggcgacgcgtgactcgcgggatgcatgttccacgaaaggaatacgcgcggagtcgccaccaacgtttatttgaggaaaacatcggaaaaaccggaaaaggcgcgatctacgaacttttaagtgaaaggttcgggagttgtatttacgcacggggaagaggtgatcattttaaggcgttggaccttgagaatgatccattttacttagtaagaaattga

SEQ ID NO: 63328 - DNA, 204 bp, Glycine max
  Peptide Sequence Number=SeqID_155013
catggtgatgcggtggttgacggcggggacatcggttttgatcgccgaattcgctgcccagcgcagccggttggctggcaggctgacgaggaagatcagccggacctgagcgctcgcctaaacgatcgtgcggcggctcaggctcgggaatcggctgcggttgcggcacgggttcgggaatcggtggcggatcggtcgggatag

SEQ ID NO: 63329 - DNA, 408 bp, Glycine max
  Peptide Sequence Number=SeqID_155014
atgtggatgacattgctgctcagcaatgtcttgcctagtgatcataactctgaccttcctctaccgaagtgtcagctggtgtatgccatcctgacacggatgagcgttcacgtggctcagctgattgctgacgccatctatttatttgcaggcggccaaccatcggggctggtgcagatacatgagtgtttctaccagctctgcctcagtcagcagggccagggtttcgttccttttgcgtgccctactcctgatcagttttgtgctgaggtcgcatggcccggagattggcccgaggcccaggcaggggaggcgcctgcagaggctcctggcgatgcagaggaggcccgcatggatgaggagatgacggattttctcggtttcttgggagggagcggagccacatga

SEQ ID NO: 63330 - DNA, 267 bp, Glycine max
  Peptide Sequence Number=SeqID_155015
atgcctttgcgccataatcaaatcaagtttagtgttgaggaagtgagagatgaagattctcccattcctgtacccacccaagaggagaaacctgtagataggctgaatcatgatgtcgatgatcccctatatctgatggcattgaccatcccacatctttttcttaagtcattgcagattatgtgggatgctaccacttatgatcagacaagtatacgagctgggaatgttgatgtgtatggattcctcaagccacggtccatataa

SEQ ID NO: 63331 - DNA, 246 bp, Glycine max
  Peptide Sequence Number=SeqID_155016
atgagggttcactattatcaagcaagtcggagacccagtgatgtgatcctatactcattcacctccactccttatgttcccatggatccagtccccagtggagtcgccaactgtcgtaacctacccttcggcgagagggcgacacggggctcacgggtgcatcttccatgggaggaaatgcacggagtcgccaccaatgtttattcgaggaaaacgtcggaaaaactggaaaggtgtggtctatga

SEQ ID NO: 63332 - DNA, 735 bp, Glycine max
  Peptide Sequence Number=SeqID_155017
atgaaggagagggagatgatcacaattatggtagatacgttgcctacgttctactatgaaaagctgataggatacatgccagctaactttgcggatctcgtctttgctggagaaagaattgagtccggactgagaaaaggcaagtttgaatatgcctccaacatggcccccaacaacaacagaagagccccaatggtgggcgcgaggaaaaaggaaggagatacccacacggtcaccaccgccccgacatggatgaaagcaccccaaaatgtccaaaactcataccagcacaaccccccaaacttttcaatccgagccaggagttcccttctaactcaagtgaaaggaccctcccgcaacagaaagaacgtctgcccaacacagctccagccactccccggccaaccaataatacaactcctggcgcgagctataataatgcacgccccccccccccccccccgagagaagatttttctcctattcccctggcatactccgagttggggcctttattattggaaaaacatttggggggggccccccccgggaaggtcttccaaccactgtaccccaagggggacaactcggatgccaagggggcataccaaaggggagctcccggaaacaaaattgactcctgcctgccgttcaagtataaggggcaacacccaaaaaatgccgggtgggtatcattccaagaggagggcccccacgttaaaaccaacccactag

SEQ ID NO: 63333 - DNA, 374 bp, Glycine max
  Peptide Sequence Number=SeqID_155018
gactctgccagtcgttcggcgtccccgtcacacctagcaaggtgattcgaccgcccatcacccgagcttttattgagaagtactacacgcagagacaggtccagggtgatgcatcacaggccgcggacgcgccgccacctcatcaggctggtccagccggattgtttgatacagagcagtatttacggcatttgatgagtctcggcctgcagagccagggctttacttcttttccgtgccctactccggaccagttcagggcagaggtcgcatggcctggagattggcccgaggacagggcaggagaggcaccagcaagggcaccagcagaggctcccgacgaggtagatcaggcccgcgaggacgagagatga

SEQ ID NO: 63334 - DNA, 279 bp, Glycine max
  Peptide Sequence Number=SeqID_155019
atgaattgcgttttctttcatgtgtcctccacccactttgagtttggagccatgcgtagtgattgcttagtgcaattctccattctcaacccctttttcggagcctccatgaattgcggtttcgttcatgtgtcctccacccctgagtttggagccatgcgtagtgattgcttagtgcaattctcgattctcaacccttttttcggagccccattaattgtgttttcgttcatgtgtcctataccttcgagtttagagccaggggtagtgattgcttag

SEQ ID NO: 63335 - DNA, 723 bp, Glycine max
  Peptide Sequence Number=SeqID_155020
atgctgctgggcggcgtgatgtatccgctgacctgcaagccggaagatgttctggagacgctgcaggaaaaccgcacctggcaattctttggcgacgtgcagtgtcgcggcgcctacccgggctatatgcagcgcttcttccgcgacaacggcattcagctagaggtcacggacgccgaccgcgaggcgctgaaatctaccgtcgattttatctccttcagctactatatgacgggctgcgtcaccgcggacgacgccctcaaccagcaggcgcgcggcaacatcctgagcatggtgccaaacccgcatctggccagttccgaatggggctggcagattgaccccatcggcttgcgtaccctgctaaacgtgctctgggatcgctatcagaagccgctgtttatcgtggaaaatggtctgggagcaaaggataaaccggacgcggacggcacggtgcaggatgactaccgcatcagctaccttaacgaccatctggtgcaggtgcgtgaagcgatcgaagacggcgttgaggtgatgggctataccagctggggaccaatcgacctggtgagcgcatcaaaagctgaactctctaagcgttacggctttatttacgtcgatcgcgatgacagtggaaaaggtacgctggcgcgcagccgcaagaaaagcttctactggtataaagaggttattgcgacgaaaggcgcgtcgctgaaagtttaa

SEQ ID NO: 63336 - DNA, 531 bp, Glycine max
  Peptide Sequence Number=SeqID_155021
atgagtcttcattcttcatctagtgttaatggtaagcattatactcctaaggaccccttgtataagatattagatgagttgagatcccttaagttgtggaaagaaaaacaagagagaaaagaaaatggtaaaaaaagagtggaagaaataagtcaagatgaaagaaagaaaataagagaggaagaaagaagaaaaataatgaaagaaatgaaaagagaaaaacatgcctcatatagtagtcataactcttgcaagagcctaagtgaagaacttcgtgactattatgaaggaaggcataggtcacatcttagacctcactcctataggagagaaaatgaaagaaagcctcaagaggctaacattaacctcccatacttccatgggaaggacaatgtagaggcttacttagattgggaaataagggtagagcaaaatagtgatcaaggggttcccatgaagcctaagagaataaaggtcattcctgagtggcccactccaccaagtataaagaaaaatttggggcttccatga

SEQ ID NO: 63337 - DNA, 62 bp, Glycine max
  Peptide Sequence Number=SeqID_155022
atgggggatgcaaatagcacccaggctcatttgggccctccagaagattcctccagaagccg

SEQ ID NO: 63338 - DNA, 234 bp, Glycine max
  Peptide Sequence Number=SeqID_155023
atggatatctctgaagatactgacatccctgtaatattgggaaggccattcatgttgaccacaagcctactccagaatacaatgtttgcttacagtcctttcgctaagcgccagcctcgcgctaaacgcatctctgttcatgcgctaaactgcgagtctcaagcgcttagcgcccaaaccttgcatctgaagctgatttggtccgctaagctagccaaggttgagctaagctaa

SEQ ID NO: 63339 - DNA, 339 bp, Glycine max
  Peptide Sequence Number=SeqID_155024
atggctcactcttccatcaatgaagacttcaaaggcttagaagttgttcaccaagaatctcaacatgcaaaactttatctacaagtgacaaaagacacaactttcttgagaaacctaacattcatgaaacaagacaacgatgctagtgatgttggtcctcttcaatcttcatcagtggatcgacatcaagaatatgcattgtaccgacaaagatgcctagtgatgtataaccccttaagaaccttcgagaagaaggaagaaaaaatgtctttgaagaagagaataaccaaagaaggatacaaaaacaaccatgggtttcgtttcatgagagtgttctga

SEQ ID NO: 63340 - DNA, 228 bp, Glycine max
  Peptide Sequence Number=SeqID_155025
atggaggaaacatcattcacagcttgccatatgctcgatgggctattcaggaaagatgacaaacaacattggtatggacctcatccattacaaagattcaaggcaaagtttggatcaccttccaaagagatatgcacattgtgcttgagaaatcccttctcattagcagtttcaccaccatcgatggtcgagaaatcccttctcattagcatgcttgatgatatttaa

SEQ ID NO: 63341 - DNA, 479 bp, Glycine max
  Peptide Sequence Number=SeqID_155026
atgccaccttcttactgcgtgaaggagagaaaaccatgtgtgagatgggtcgagaaatatttcaaagattgcctttgcaatttgaaagatgaaatctcgttcagcttcggcctcacaagtctagtgttctggggtgtggctgaaattcctcaaataatcaccatttttcgtaccaagaaaagccatggagtttcccttgtctttctcctcacttgggttgctggggatatatgcaatttgacgggttgcattcttgaaccagctactctttacacaatcactacgatcgtattactactgctaatcgtatactatgactacatcagcagatggtacaaacatcgtcagaaggtcaacctcaaaagggatcatgaagaggagaaaaagccattgaagccaccgaaaccaactagcaaatctggaattccaataccaaatggcacacccaaggcagcacctagacaggagcactattatat

SEQ ID NO: 63342 - DNA, 84 bp, Glycine max
  Peptide Sequence Number=SeqID_155027
atggtttacatgggagggtggagggtggaggaattcggacttcagatatctggagttggagttgtagagtgttgcgtcaattga

SEQ ID NO: 63343 - DNA, 1099 bp, Glycine max
  Peptide Sequence Number=SeqID_155028
tgccgtgaatttgaacacatggccacgccccagcttcattttgaaccaaaccgccacaagaagatccagatcctccccaacctctcatttctttcacggcgtcaataagttaccgtcacccatttcctccctcaccgttgccaaacgctcatttacgctctcggcggtgctgacgaaagaggacaccgtggagacggaagagaagccaccgattttcgacttcaagaactacatggtttccaaagcgagcgcggtgaacaaggccctcgacgacgccgtttcgctccgcgagccgcagaagatccacgaggcgatgcggtactcgctcctcgccggcggcaagcgcgtgaggccggttttgtgcgtggcggcctgcgagctcgtcggcggcgaggaggccacggcgatgcccgccgcctgcgccatcgagatgatccacaccatgtcgctcatccacgatgacctcccctgcatggacaacgacgacctccgccgcggtaagcccaccaaccacaaggtcttcggcgaggacgtcgccgtcctcgccggcgacgcgctcctcgccttcgccttcgagcacatcgccgcctccacccggggcgcctccccggggcggatcgtccgcgcgatcggcgagcttgcgcggtcgatcggctccgagggacttgtcgccggccaggtcgtcgacatcaactccgagggcctggccgacgtggacctcgagcgcctcgagttcatccacgtccacaagactgccgcgctcctcgagggtgcggtggtgctcggcgccatcctcggcggcggcaccgacgacgaggtcgagaaattgagaaaattcgctcgctacattggtctgctctttcaggttgttgatgacattctcgatgttaccaagtcatctcaggaattggggaaaaccgcaggaaaagaccttgtggcagataaggttacttaccccaaacttttgggtattgagaaatctaaggtgtttgctgcgaagttgaacaaagatgctcaggatcagcttgttgggtttgaccctgttaaggctgctcctttgattgctttagccaattacattgcttataggcagaactag

SEQ ID NO: 63344 - DNA, 60 bp, Glycine max
  Peptide Sequence Number=SeqID_155029
atggcttcctgtggggcactccaagtcaaagtttatttggtactctatcttcaagcatag

SEQ ID NO: 63345 - DNA, 1866 bp, Glycine max
  Peptide Sequence Number=SeqID_155030
atgagagttccctcatccccacaacccaacaacaaccattcccctacctcaaacctcgtcctccacacaaacaacaaccctactacaaccttcacctacgaacccacctcggtccttgacctctgccggagcccgagccccgaaaaaaaactcactgttcccaagccagaaccacaacacaacaacaacaacaacaacctaaacctagacctggatgatcatgtcttgcctaattcggattggtgggagtccatcatgaaggacttagccctacccgaagactctcccacaccccttttgaagaccaacatcaatccatcatgcatccctgatttcccaccttcttctcaagacccaccctttgatcacccccaagatttcacctctctctcagaaatctacaaccaaaacctaccctacaattaccccaccaacactttagaacattccttttacgacctaagccataaccaccaccacaacaacaacaacaacgttaacaacaacaattgggacttcatcgaagagcttatccgtgccgccgattgcttcgacagcagccacttccagctggctcaagccatactggagcggctcaacaaccggctccttcgctctcccatgggcaagccgctccaccgagccgcgtttcacttcaaagacgcgctccagtccattctcgccggttcgaaccggaccagttcgaaccgcctctcctccatggctgagattgttcagacaattaaaacgtacaaagccttttcgggaatttcaccgatcccaatgttctccgttttcacaaccaaccaagccctacttgaaaccttaaatggatcttcatttgtccacgtcatcgatttcgagatcggcctagggatccagtacgcttctctcatgaaagagattgccgagaaggccggcgccggagcctcgccgctcctccgcatcaccgccgtcgtgccggaggagtacgccgtcgagagccgcctcgtccgcgagaatctcaaccagttcgcgcaggatctagggatcagcgcgcaggtggacttcgtgccgcttcggaccttcgagacggtgtcgttcaaggccgtgaggttcgtcgacggcgagaagatcgccgtgttgctgtcaccggcgattttcagccgcctcggaagcaacggaggcagcgtcggcgcgttcctcgccgacgtgaggagggtgtcgcccggagtggtggttttcgtcgatggcgaggggtggacggaggcggcggcggcggcgtcgttccgacgcggggtggtgagcagtctagagttttattccatgatgctggagtcgctggacgcgtcggtggcggcggggggaggcggcgagtgggtgaggaggatcgagatgatgctgctgcggccaaagatcttcgccgcggtggaaggcgcccggcggaggacgccgccgtggagggaggcgttttacgacgccgcaatgaggccggtgcagttgagccagttcgcggattatcaggccgagtgtttgcttgcgaaggtgcaaatcagaggcttccacgtggacaaacgacatgctgagttggtgctctgctggcacgaacgagtcatggttgccactcccgctctcactctcactctcacccttcagtctcgcgacagttctctccctcacgaccctgactcaccaccatcactcgcgaagttagtgcttgaaaatgtgctctctaagaaccacctttgcttcgtgtttgaaaatgtgctagttgaccttgatgttattgcttcatgtctgagtgtattcacatattgcattgttcataatggttggtcatcttgtttgaaattgataatggtgctaaatgctactaaaccatcatga

SEQ ID NO: 63346 - DNA, 1224 bp, Glycine max
  Peptide Sequence Number=SeqID_155031
atggccgctcccgcctccaacgctgtgctcctcggagacgttcacttcgacgacgtcgccgcaaagccttgcggcgttcacttccgcggcgaaacgcggcgaggcgcgctccgagccaccgtgaatctccgaaagccgaaaacgttgagcggtattctgaatttcgggtgttccacatcggatgcaagttggaggagctggaatccgagttcgctccacaggaactcgtccttcgcttgctgctccgccgagacaacgccgcatgttcagcacctcgcaacctccaccttctcgattgaccagactaattttggtggcgagaggttgaagctgttttcggggtcatgttacctaccacatccggataaggaggacacaggtggagaggatgcacattttatttgcacagatgaacaagcaattggtgttgcagatggtgtaggtggctgggcagatgttggtgttaatgctggactctttgctcgagaactcatgtctcattctgttagagcaattgaagaggaacccaaaaattctattaatccggctagggttttagagaaggctcactcatgtacaaaggccaagggttcatcaacagcttgtatcattacccttactgacacgggactacatgccattaatttgggtgacagtgggttcatcgtggttagagatggatgcaccattttcaggtcccctgttcaacagcatggcttcaattttacatatcaactggagagtggcaatggaggtgatctacccagctctggtgagaaaaaagaaaagggagaggggagtgaaaatggagaggctttaattttgccttgttggtacatggtagggagggtgaaaaatgaaaggctaacacatctgtcacaatcacatatccaggtctttacaatacctgttgccccaggagatgttgtcgttgctggaacagatggattgtttgacaatctgtacaatgatgaggtcactgaagttgttttacattcagttagagctggactagaaccccaagtaactgctcagaagatagcagtactggctcgtcaacgagcactggacaggaataggccgacaccattttctacggctgctcaagaggctgggttccgttattatggtggcaaacttgatgacataacagttgttgtgtcatacataaccggctcaacatgtggactgggttgccagccttgtctgtcatttttgacctga

SEQ ID NO: 63347 - DNA, 771 bp, Glycine max
  Peptide Sequence Number=SeqID_155032
atgacactcgcgcaaaccaaatcacacgagacagatcaacgctgccgggagaagcgtgaaaatagggtgttgatcccagttctcacgtttagttgtgtaaatggatccgtttcagaagagaggaaacaaacaaaattaggttgggaattagtgcctttggtggtcaccatgttccttcttagaaggcaaacccagaatcaccatgagaatgattcctcatatcaagatacaaaggtggctgaactcaagacagctcttgggcccctctctggtcgtcaattaaagtattgcacagatgcatgtctaaggagatatttagaagcaaggaactggaatgttgataaaaccaagaaaatgctggaggaaacacttgagtggagggcaacttataggccagaggaaatccgttgggctgaaatagcacatgagggtgagacaggcaaagtctccagagctaactttcatgatcgacatgggagggctgtgcttattatgaggccagggatgcagaatacaacatcggctgaagataatatcaggcatttagtctatctgttggaaaatgctatcctgaatctttctgaaggtcaagaacaaatgtcatggttgatagacttcacaggattatcacttagtacaaatatatctgttaaaacatctcgtgatattattcacattttacaaaaccactatccagaaaggcttgctatcgcttttctgtacaatcccccaagaatatttcaggctttctggaagttaggaaaaatttag

SEQ ID NO: 63348 - DNA, 784 bp, Glycine max
  Peptide Sequence Number=SeqID_155033
acctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctaccattggattgttccaataacattatgctttggctcttatgatgtccgcaagagtttcctcttgcaatcaaaatttgaaacacatgatgtcaaagatttccttggttccacacacaaagtagagaaacaactcttatctgcatcagaccgatttggcattttggatgattcatttgcactttgtatggctcgccaggaatcattgacctccttgattaacttgatgggatcttacagggaggaagttaattataccgtgttgtctaacctgatgactacaagtcttaaagttcaacgtattgcagctgatgcaataccagactttctagaatatttcatgcagttctttattaacctttttcagtactctgctgagaggcttgttgttgtgtgttgtgggcttgtttgggtcaagttgatgaaagctacagcaattgaaatcgcgctgagtggctaccctcgtaacacacgtgtcgatgaagctcagcctgtgccagccatggtggaggtagaggcggtggcttcggaggtggtggtggtggatgtggcggcgggcgttgacgttgatgacgaacaaagcaaagctgagtctcagtag

SEQ ID NO: 63349 - DNA, 516 bp, Glycine max
  Peptide Sequence Number=SeqID_155034
atgggacaatgggagccaacttggagcacaagagctgcagaagaagctgaggttgtggcagcaataccatgttcaggacatggaagagcctacttagatggtcttattcttaaagatatgaataagtctctttgtgaatgcaattcatgctatgctggatctgactgctcccagtttttatctgattgccctgccaacgctgatgggaaagtacatcgtatttggaagtggctcaaccctcttctcaatgctgctgtttatgccttgtctccctactcttcaatgtttccagcaaaagtggtagccacagcaccatattatccgtttgtgacttcaccaaacaatccagatggaaagttgaacaagggagttctcaaaggctctgatgtgaaaaccatttatgatcgagcctattattggccacatttcactgctatttcttcaccagctgatgatgatcttatggtgtttacaatttctaagctcacaggccatgctgggagtagattttggtga

SEQ ID NO: 63350 - DNA, 744 bp, Glycine max
  Peptide Sequence Number=SeqID_155035
atgtctgaagaagtgaatatgaattatgaaaatgaagaagaatgtgatgtgaatgtaccacatgtcgattgttcagaagcgtttaatacttctcaggtgtttgacagccgaggtgatgttttgcggtgggctcaatccattgcttatgaaaatggatttgtggcagtgattgtaaggtttgacacatacagaggtagtagaggaaggacttcgtttgtgttaattggctgtgaaaggagtggcgagtataggtgtaggaagaaagaatttgttagaagagacactaggactaggaaatgtgaatgtcccttcaaatttcgtggcaagccagtggatggagaacaaggctggatggaaaacactgtacatcccatcggcgatcgaagactgaactggtgcggccaattcaatttcagaaagaagcaagatgataaaagcagtgctggtgttgaacacggaggggaagcctcgtctcgccaaattctaccaatttcagatcagtctgtggagaagcagcatgaagctattcgcaatgtgttttcagtcttatgctgtagacctgaacatgtcagcaattttgtggatgccgagtccttctttggcccggactctcgccttgtctacaagcactttgcaactttatatttcatgttcatatttgatagttctgaaaacgagcttgctatgcttgacttgatacaaggtagattatggtattacctaactatttactgcattgtttaa

SEQ ID NO: 63351 - DNA, 285 bp, Glycine max
  Peptide Sequence Number=SeqID_155036
atgagtccgcgagttcacgaaaccctcagtcgcagtcctctgtcctccgtcgtcgttgatgccttgcaggtcctcactcgcgctccaagctttgctttacatcacgatgctaaggtggtgatggttgagtttctcaagaaatttgctgacacaaagaggctaaattggggacaatggggtatctgcattggtttagccttagtttcttggccaattggttgggttgtgaagttaataccaatcccaaataaaccattcctcagttttttgagtaagaagaaatga

SEQ ID NO: 63352 - DNA, 4581 bp, Glycine max
  Peptide Sequence Number=SeqID_155037
atggaagtacttccttgttctggtgttcagtatgctgggggatctgattgctctcagtcaagttcaggaacaatgtttgtaaaccagggagaaagtggtggtcaggctaagttggaagatgatcgactgaatgactcattacaaacggaagggcctcagatagaaagacaaggccaaacacaacagaatatttgtgaacccttgattaatatagcttgccaatgtggtggagcttcatgttgtgactgccaagtggaaggccagaaggaatccattagtttccgtgatgttgaagatgatggaataaatgagccttgcttagcctttgaaaacttagtctctattgcagatacaaatgaaagtgaatcaccaaatggtagtagggaagtagagctgtcattttctgaaccaacttggctgaagggagatgagcctgtggcattgtgggtcaagtggagagggagctggcaggctggtatcaaatgtgcaaaggttgactggccattatcaactttaaaagcaaaaccaactcatgaccggaagaaatattttgttatattttttcctcacacaaggaattattcttgggctgatatgctgcttgttcgatctatttatgagtttccccagcctattgcatacaaaactcatcaagccggattgaaaatggtaaaagatttgactgttgcacggcggtttataatgcaaaagctaaccattggtgtactgagcattgttgatcagcttcatcctaatgccttgctagaaactgctcgtgatgtgatggtttggaaggagtttgctatggagacttctcgttgtaacagttattcagattttggcagaatgcttctagagttacaaaatgaagttccatgtcgcctgcgtcaattctttgggtgcaatactgttgggcaacttcacttagtgccaattggttttaagttgaaatctaacatggtatcagagcctataggggaggtgttaggaagtcctgcatcaactgcctcaattctcaggagcatagtgaagcactacacagatgctgactggatacaacattcatcttactcttgggctgaacgatgccagaatgcaaatagtgctgaatcagtagagctactgaaggaggaattgtttgattctattttgtggaatgatgtcaatgctctttgggattcactggtgcaatcaacattaggttcggagtggaaaacctggaagcatgatgtgatgaaatggttttccacatcaccttccttttctagcagcaaggatatgcagcacatgacctctgatgggttgttccaagtaagccttcaggttggtagaaaaaggcccaaacttgaagttcgccgtgcagatacgcatgctacactggtggaaacaaatggttcagatcagccaattactctcaaaactgacccaggtttctataggaatcaggacacattgaatacattagaatctgagacctctacactcaaagatattaaagaggtacctgtggcaactgatttacctagcaatttgaccaataaatggaatgaaattgtagttgaggctaccgattctgagatcttgcatggcaatggaacacaatcaacacctatgaatgagatggctggtaaaaaagttgtagaacctggtgctaagaatcgacaatgcatagcttatgttgaagccaagggaagacaatgtgtgagattggcaaataatggtgaggtatactgttgtgcgcatttgtcatctcaatttttgggaaactcagggaaagctgaaaaacctgtttcagttgatactccaatgtgtggaggtacaactgttcttggtactaaatgtaagcatcatgcccttcctggctcttcattctgtaagaaacatcgtccccatgctgaaacaaatgagatctcaaatttaacccataatacgctgaagagaaaacataaagaaaatcacattggttcagggggcttgatcagcaaaggcatggtattgataaatgctgaaagttcattgcaagtagaaccagtgcctgccattgatggtaattccttccttgagagaagcaacttagatgagaggcccgccctttctggtaatgatcagattgcaatggaggcacttcactgtataggctctcctccttatgatgacaaggacccctgtttggaagcaccaaagcggtatatcttgtattgtgagaagcaccttccaagctggctaaaatgtgcaagaaatggaaagagtaggataatatcaaaagaagtgttcacagaaattttaagggactgctgctcatggaagcaaaaggtgcacctgcataaagcatgtgagcttttttacaggctagtcaaaagcattttgtcacaaagaagcccagtttctaaggaagttcagttccagcaggctttaacagaagcctcaaaagatactagtgtcggggaattccttacaaagttggttcatagtgaaaaggagagaatcaaattgatttggggattcaatgatgacatagatgtatcctcacttttggatggactacctctcgttccttccacagataatgacagctttgataatgaaaatgtcattaagtgtaagatttgctgtgcaaaatttcctgatgaccaaactcttggtaatcattggatggacaaccataaaaaggaagcacagtggctgttcagaggttatgcttgtgccatttgtctggattcttttacaaacaagaagctattggaaacccatgttcaggagagacatcatgtgcagtttgttgaacagtgcttgcttctccaatgcattccttgtggtagtcattttggaaatatggagcagttatggctgcatgttctatcagtccaccctgttgaattcaagccattgaaagctcctgagcagcctttgccttgtgaggacacttcggaaaaacttgagcagggaaattcagcttttttggagaataattccaagaatccaggtggtttgcggaggtttgtttgccggttttgtgggttaaaatttgatttactacctgacctgggtcgccatcatcaagctgctcatatgggccgcaatctaggtaccagccgctctacaaaaaggagtgtttgttattatacgcatagattaaaatctggcagacttggtcgtcctagatttaaaaatggtttggcagcagcatcatctagaatcaggaatagggctaatgctaatttaaagagacagattcaggcaacaaagtcacttgacatggtggaaacaacaataaaacctcatgtaaatgagacagaaaatattggtaagttggcagaatatcaatgctcggcagttgcaaagattttattttctgagattcagaagactaaactgcggcctaacaattttgatatcttgtcaattggtcgttctgcatgctgtaaagttagtcttaaagcctcactggaggagaaatatggaattttgcctgaaaggctctatttgaaggcagcaaaactttgcagtgatcataacattcaggtgagttggcaccaggatgggttcatttgtcctaggggttgtaaggttttgaaggaccaaaggcatctctctcccttagcatctctttttaatggtttcctaaagccaaaatcagtaattttatcagatcctgcaagtgacgagttggaggtggatgagtttcattacatccttgattcacatcatttaaaagtagggtccttacaaaaggttactgtcttgtgtgatgacataagctttgggaaggaatcaattccagtgatttgtgtagtagatcaagatattctaaactctcttcttagacatgggtcggatgaggaagatataaatctctctaggccttgggagagctttacttatgttacaaagccaatccttgatcaatcacttagtcttgattctgagagtctgcaactaagatgtgcttgctcattttctgcctgctgtcctgaaacatgtgatcacgtctacctttttgataatgactatgatgatgcaaaagacatatttgggaaaccaatgcgtagtaggttcccatatgatgagaatggtcgaataatattggaggaaggttaccttgtgtatgaatgcaaccagatgtgcaaatgctataaaacctgtccaaacagaatattgcagaatggattacgggttaaattggaagtctttaaaacagaaaagaagggatgggcattaagggctggtgaggctatccttcgtggaacatttgtgtgtgagtacattggagaggttttagatacgcgggaggcacaaaaccggcgcaaaagattgattgaaggacaggcccattatgtcattgatacaactagatttggaaatgtctctaggtttatcaataacagctgctcgcccaatcttgtgagttaccaagttcttgtagagagcatggattgtgagcgtgcacatattggtctttacgcaaatcgagatattgctttgggtgaagaattgacatataattatcattatgagcttgtgcctggagagggatctccttgcctatgtggttccactaagtgtcggggacgcctgtactag

SEQ ID NO: 63353 - DNA, 604 bp, Glycine max
  Peptide Sequence Number=SeqID_155038
gaatttacaagatagtggaactatcaaccgggttgcttggggactggacgtaggcataaggatggcatctaagaagaggaaagcaccctctacacctacccaagccagatttgatagatccaaattcacttcccaagaggcttgggagagatacactgacattatggtacgtagaaagcttttaccagaaaggaatgtggtaatctattatacagagtttgatgagttcaaggaggaactcaagagatgccattgggataagaagctgactgatttttatgatagcagtatagacatcaccattatgaaggagctttatgccaacctctatgaccttgatgataaatcacctatgcaggtgaaagtgggaggtcacatagtgaagtttgatgaggatactttaaacacatttctgaagacccctgtagtgctggaagggggtgagaatttgtgtacttattccatatgtgcactcctgaggcttgatcctcaggagttggctactaagctttgtatcccagggaggggattcgagcttaatgctgatgggcagcctttgaagattctgaggaagaacatgactactctagctcagacatggagt

SEQ ID NO: 63354 - DNA, 204 bp, Glycine max
  Peptide Sequence Number=SeqID_155039
atggggatagctgatcagaagatcaactttgatttgtttcatgaagacaagcatttgctcagccagagtgtctgttcagaggtaaatgaaggatggaaggagatggttctcaagggcctcgctgagcgagccctgtgcgctaagcccaaaaacttctctggaatttcatcttttggaattaggctaagcgagtcatctcgctaa

SEQ ID NO: 63355 - DNA, 131 bp, Glycine max
  Peptide Sequence Number=SeqID_155040
tccatgggcccgaaatctaccctaaggcttatgagaaccctagggccttctcttgcatctttggcccaatcttcttggaatcttctatccaatacccttggggggtaggattgcatcaattaggagataag

SEQ ID NO: 63356 - DNA, 114 bp, Glycine max
  Peptide Sequence Number=SeqID_155041
atgccggggcgttcctccactcgccaatttcccagctggaaatcaggagggcatggtcgtaccaaatccaatggcgggcttccttcactttcttgtctcaaccgcgagctttga

SEQ ID NO: 63357 - DNA, 450 bp, Glycine max
  Peptide Sequence Number=SeqID_155042
gaactaacagatttgaggtcaaatcctcttcaaggggaaggggatgatgcaatcctccctaggaagggaccagtcactagaaccatgagcaagaggctccaagaagattgggctagagctgctgaagaaggccctagggttctcatgaacctcaggagcacaaaatttggtgctcttctcctccctctcccttcattcatctccttctttcctccaagctcttatccatggcctcctatggtggaatccattgatgaagaagatcctaggcctacaagctccaatggagcttacatcaaggtggcacccccaatgacgaaaagggagatgataacaatgatagtagacacattaacagtgttctactatgaagaatggtgggttacacaccttcaagttttagggatttggtcttcgccagctaatggattgatgtgggtccgaaaagag

SEQ ID NO: 63358 - DNA, 732 bp, Glycine max
  Peptide Sequence Number=SeqID_155043
atggatttcttttcaaatgagagttttgaatgcattcaagcatttgaaaactccaatcttattcctttcatgtctttaaaattgcctgtttattctgatttagtcaaagccttctattcaaacctagaaatccaagaaggcactttaatttctgaagtgtatgggattaaaatggtcattgaccaatccctattctatgagttaacccaattatccaatgaaggtgtaccatttgaaggtacactgattgatgattggaaatatgaattttctgtgcatgatgcccgccagttggtttgcaccaaccaagcggatatgaccggaagacttcttgtcggttcattggcttttgagagccgcatccttcattatctcatagtttgtatcttgcttccaagatcttcaaaccttgcacaggtctctgaagaagatcttattgttatgtggacttttcataaaggtctacaaattgattgggaacatcttgttagatatcgcatgcataaggcattgcgattaaatgctccattgccatatccacacctagtcaccctctcccttcaacactttaacatccctcttgattctgaaccttatgttccaatcaagagagggtacatctcttgtggatcaattctagtggagggtacatccacttggttgttcaaagagaacaagggagggtacatcccttgtggatctttacttgtaaaaagatttttagaaggttga

SEQ ID NO: 63359 - DNA, 456 bp, Glycine max
  Peptide Sequence Number=SeqID_155044
atgtcgcaggggtcagaagaccttggggacgtcaggcgagctcctggcagtcaacagataaaaggaacaaagaccacaaagcaaggaggcttgtgtggtggctggccagctgtgaactttgagtttatatgggatgtggcctctggtaatcgattaccaatggtgggcttgaaaacgaggtcaggaagctatgagggcttctggcctctggtaatcgattaccagtctggtgtaatcgattacacagaggaatgggtcactggtaatcgattaccagggatgaaaagccttgagataccccttttacttgcatgtagtggtcatgagacgcattgtgttgcggcgtatggagatggagtgcctagagggagcttgggagaccctcgaaggcaacacgaggtgccgatttcggggcactattcgattcacggctacttctttggtgcatccggatga

SEQ ID NO: 63360 - DNA, 408 bp, Glycine max
  Peptide Sequence Number=SeqID_155045
atgtctgaatttgatgctgagagtgatattgattgcatgtctggtggtggtgttttacctctcgagattgattttatagagtcagataggactaaccatgtttcaggaagtacacatacctctgactttctttatgtggtaaaggctgagaaaccatctccttctaccactgtccagccgaccacaccagaattgaagcctctgccatcaaatttaaaatacgcttacttggatgatagcaagagttttccagtgattatatctgcctcccttgctgatgagcaagaggagaagcttttgattgcctcaagaagcataccacccccatcatcaggcacccgattagcggacaacccctggtttgagcttatgtgtgatgcatcgaataaatttagaggatggagctaa

SEQ ID NO: 63361 - DNA, 258 bp, Glycine max
  Peptide Sequence Number=SeqID_155046
atgtgtgttcaagaagaggagagattgataatggaagagggtgagaaggtaaatttgactacttttacttctggaaaggataggaagaagtctgtaggcaccaataaaggaaagattccgactcagccaacaattaaaaaggagtcaaagtgtttcttctgtaaaaagaaaggacacatgaagaaggactgccccaaatttaaaagttggtttgagaataaagggtatggaaagcctaaggaagccagtgggaagtga

SEQ ID NO: 63362 - DNA, 126 bp, Glycine max
  Peptide Sequence Number=SeqID_155047
atgacttctaacagcgtcgaagaagaagaagctgacgacgttcatgctaatcgaccatggctactccacctgcctcgcctcctcctcgtcttcctcctgttagacaagtggcctcagatatcttga

SEQ ID NO: 63363 - DNA, 576 bp, Glycine max
  Peptide Sequence Number=SeqID_155048
atgtcattctctgctgggtttgcatatttggagggtgagcgtgttaataatattgtatgggatttggaacgatttcgaggtctatttttaagaaacgatcgtctccctattcttattgccactaacagagacctagcactgatgaatgtagtgaaaactgtgttcccggagtgtacaaacttgttgtgcagggttgaatcagctcattgggctctaaaaagagtattacaaaatagccttggagacctgtgtagtgtttgggatgccatgaacaacatgatcacgctgcaacatgttgaaattaaagcatcctttgaaaccagtacgcatgtggttggacatctttctaggtatactgctggcagcatctcagtgtattcagtccatatgttctggaggagactttgcttttcataccaagggttatgtgaggtcgaagtcagcatcaaggaagagattgagaccatatctaaaagatttgaggaacttgatgtgtgtggaaaactaactctcaagagtaaacttcgagatattgcataccctgatcataactctatgtggcctcctccgtcaaag

SEQ ID NO: 63364 - DNA, 156 bp, Glycine max
  Peptide Sequence Number=SeqID_155049
atgacaagggctagtgcaaggaaagccaaggaagctcttcaacaagtgttgtccatactatttgaatacaagcccaagtttcaaggagaaaagtccaaggttgcatcagccttttgggagaccaaatggtggctgattgatggctattgggggtaa

SEQ ID NO: 63365 - DNA, 903 bp, Glycine max
  Peptide Sequence Number=SeqID_155050
atggcagaaccgtcgaagaagcgcatgggttcttcgagtagaagccaaacggcactcggaggctcaggatactccaattcctcccttcttttcctcatcctcattgttctcatcgaaagaacaccgtacacagtttatgggataaagatggtcattgaccaatccctattctatgatttgacccaattgtctagcgaaggtgtaccatttgaagaaacactggatgatgattggaaatttaatttttctttgcatgatgcccaccggttggtttgcaccaaccaagcggatacgactggaaggctgcttgccggttcattggctcttggaagctgcatcctccattatctaattgtccgtatcttactccctagatcttcaaaccttgcacaggtttctaaagaagatctaatagtcatgtgggcctttcatactggccgacaaattgattgggcacatctagtccggtatcgcatgcataaggcattgcgattaaatgctcatttacccaatccacacttagttactttgttccttcaacattttaacttccctctggattctgaactatatgttccaatcaagagatctttcttgatcggtgctgcggtggttgcctcctttggttaccgcaaagagcgtgatggctcttgggtaaaaaagggtgctcaaccaaatgatgatgggggacacttatcggttgaaggggactcttctctccttcagagtattttggacaggtttgatggacttcaaacctatgttggtgagaggtttgactctttggaacgtcaagtggacacacgattcgaggagatgaactcaaggattgcaaaggttgaagaagatgtcaccaccattcgcgactaccttgatttacctccaccaccaccatcagtttag

SEQ ID NO: 63366 - DNA, 249 bp, Glycine max
  Peptide Sequence Number=SeqID_155051
atgggtatagatgcagcaattttaatgtgccttagagacattaggcataacaaatttgaagactccttaataggaaccgtagaaacaagcctaggacaagtgagtctgatggacaaaaacattcttgactctctgttcttgaacatccactttcatggccttgacatgaaagaaggctcaatcccaatagctttaatctataggatccaatacaaagtcatgtatacttgtgcatcaagagtcctataa

SEQ ID NO: 63367 - DNA, 51 bp, Glycine max
  Peptide Sequence Number=SeqID_155052
atgatgaactatcaggtgcaagggtcaacagtccttgcaggcacagagtaa

SEQ ID NO: 63368 - DNA, 316 bp, Glycine max
  Peptide Sequence Number=SeqID_155053
gaacagggatgagaagagaaggaaacttctgcaagacagaacaattgcatccattcttgaggaagaaactcatttttctgattcattatcacctgattcaccatcatcaagggaatccgctactcaatttcctgaaaccagtatcatggcagacgagcagcaccaggtgatcacccttaaggattattcaagtagctcagtgctgcaattctttactagcattggacgtcctgaagtgcaagctcacaacatcaactacccgcattctttaattcatttaatacaggggaatttattccaaggattacctaaatga

SEQ ID NO: 63369 - DNA, 309 bp, Glycine max
  Peptide Sequence Number=SeqID_155054
atgaaggccaccatcccagagccatttgttataggagaagaggcagaggagacacatgtgagacaggtagctgttgccacacctgagcgatcccttgaggctacttcagagccttctgcacaaggggaggacataccctcacctcagcctgcagcagacccctccactcctcttctagagatgctagaggacccgactacatcggtcctggcaatggacacttctcctccagctactccagtattgcatctgacatatgaggaggatgttcagacacaggacacccagggccagtcacgggaattttga

SEQ ID NO: 63370 - DNA, 207 bp, Glycine max
  Peptide Sequence Number=SeqID_155055
atgggcccatcggtggctaccgcttgctcgaggtccaagaaaagtttgtctcagcggttatgcgagacagagaccaatatgttagctatcatcaccaagtaccaagaagaactaaatctagccacagcccacgagcatagagtggcggaagagtatgcccaagtgtacgcgaaaaaggagctggctagaggaaggccgttcgactag

SEQ ID NO: 63371 - DNA, 558 bp, Glycine max
  Peptide Sequence Number=SeqID_155056
atgatgctatggtggaaaggtagtgatgatgagtataaggagactactatggacaatcatgcattattgttgtctaattatgtcattgctactgaggtggagttgtttgtggaatgtgttggtggtaatgagggggttatggataacaatttttctgtggacaaggctggtggtggtaaaaaggctactagtggtgatgtaccctctacttgtaccacaaaggatgtaccctccaatgtgttaagacaaaaatctcaggctgttaaacctttgatactttgtgaattaggatacaaaagaattctcaggcgggagaaaggagacacaaaagaattcaggcagttagtccttcgttcttttggaaaagggagaagagagacacaaaaagaattcaggcggttagtccttggcgaattctttttggcaaagggagaagagaatgaaaagatgaatagcataagttttcaaggtttagaaaaccagaaaactttagaaagcttttggcacaaagaagaagaagaagaagttcaaagagattcaaggcttgtaaaggattga

SEQ ID NO: 63372 - DNA, 237 bp, Glycine max
  Peptide Sequence Number=SeqID_155057
atggaagctctcaagaaattcaaatggtcattacttttcacacggatgttcgattcaggcatatcacatatacagacgcttgaaattgaacaaaggaagctctcgagaaattcaaatggtcataacttttcacacggatgtccgattaaggtgattcgggcacgtaatatgtctgagatgcttggaattgaatttgtggaccacttggaagctctcgaaaattcaaatggtcattaa

SEQ ID NO: 63373 - DNA, 361 bp, Glycine max
  Peptide Sequence Number=SeqID_155058
atgactatgcaaaacatgcagtttcaacaagagaccagagcctccattcagagcttaactaatcaaatggggcgattggctacacagttaaatcaacaacagtcccagaattctgacaagctgccttctcaatctgttcagaatcccaaaaatgtgagtgtcatttcattgagaaaagtagaggtaaacatacctcaactggatgcaataaagcaaattccaagatatgctaaattcttgaaggagttgtgcactaataagcggaagcttaaaggaagtgaaagaattagcatgggcagaaatgtctccgcattgattggtaaatctgttccccaaatccctgaaaaatgtaaagatccag

SEQ ID NO: 63374 - DNA, 300 bp, Glycine max
  Peptide Sequence Number=SeqID_155059
atggtggttccaaagtcagaaagatgcaaagacaagctaaaaataacaaggaacaaacatggaatcatggttacctcaaaggaaatgaaaggtcagattagggtttcgttctctatcgaaatcgcgagccaagttggaagattccgcttcggtcgaagggttcctctcagtatggggttgcaacggagaacaacgatggtttgcggtggcgaatggtggctgtgggtgatggagaaagtgcttgggacgttagaaatggctttggaagaaagaaaggagaagaaatgggatatttcctaa

SEQ ID NO: 63375 - DNA, 786 bp, Glycine max
  Peptide Sequence Number=SeqID_155060
atggtattggaagagggccaggaatgcgagtatggccagaggaggaaccggtctgatgggttcgatgaggaggccatcgcccagctgttatgtataccggggcaggattttgcccggactgctgcaggaaggcgagtgcgaatcatgcgcaccaacatgaccaccctgactcagatatggatgactctgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccaatcgttcggagtccccgttgcacctaccaaggtgattcggccgcccatcacccgggcttttatcgagaagtactgtacccagagacaggctcagggtgatgctccacaggcagcaggcgcgcccccaccacctcatcaggctggcccggctggggcatttgacatggagcagtatttacagcaattgctgagcctcagcatgcagagccagggcttcgcttctttttcatgccctactccagaccagttcagggcagaggtcgcatggcccggggattggcccgaggcccaagcaggagaggcgcccccagaagctcccagcgatggagaggaggcccacgaggacgaggagatggccgatttgcttgacttctag

SEQ ID NO: 63376 - DNA, 633 bp, Glycine max
  Peptide Sequence Number=SeqID_155061
atgtacgaccagctgaacgatgcatccatgagccacagtcgacagcttagcggttacatcacactgctgcaggactacgacgaggcttctccgcgtgcgtgcaggtggattgcgacgaagaagaccgtgaagagcattcgcacgccgtcgtatagggagcgcctgaaccgactccgaatttcagatgtctgttggatcctgtatggggagcatcgggaagtccaggacttccacgtcagatcatgctactccggtctcttgcactgggggcttgttgctgtgtattaccgaccggagaaggtcgtgcggcagtttggttacacgccagccattcctgctccacctgtcgattcatgggtctcgtatgatgatatacacgacaggtggatgcactacgagggtcatatcgtacctgtaggtgaggtgtgcgtggtgctaggggcgtgttccagtgactacatcgaatggttctttcgcatctctcatcctttcatgacaccaggccacgcagtagatcctttgcctcatggtcacgccccgcaaccccgagtcgtccctcaggccccgcagacggatatccctcgcgtgacggagccaggagcatcgtcgacatctgcggaggggatcctctag

SEQ ID NO: 63377 - DNA, 166 bp, Glycine max
  Peptide Sequence Number=SeqID_155062
atggcacatcagcgacgcgagggcttatgggtgcgtcttccaagggaggaaggcacgcgaagtcgccaccaacgtttattcgaggaaaacgtcggaaaaaccgaaatgtgtggcctaccaactttgagtgtgaaaggctcgggaattgtttttacacacggcgaag

SEQ ID NO: 63378 - DNA, 1170 bp, Glycine max
  Peptide Sequence Number=SeqID_155063
atgtgtaccaacgtgcagccgttcttcgaaaacacctgcatcgaaggcaccacgttaaatatttactgtttccgcgcgcaaaacagcggcggcacggtgattaaagcgctggatacgctcgacagtaaatttgaccagatctacacgctgtggacctatggccgggtgtttgatattggctggtcgaactcgccaaacggcaagtgggaccactcaacggctatcgagatctgcaactgtaacttccagaccggctacggcgacgccacgctgtacatgccgcgcgtgacgcagggcatcatgcgtaacgtgtggattgagcacacgcgtaatccgggcgatctgtcggacggtgcctggagcattgatacgctgaacattgaggattgcggcacgccgttcaatctcaataatgcgcgcgtcatcatgcgccagattggcctgcagtccggagcgaagatctcgaacgatatggccggcacgcgctggctgtcgacttttgactatggctatcgtcgcgaagagcatcacggcacgctgatcaccggctcattccgcgcgggctactacagcggccacaaagtcaccaacaataccgacaccgataactggtatcgcctcggccagctgttctttccgacggcgaatcagcagtgggtgatggagctgattggtaaagccgacgccacccagccaaccggaacggccgcctcgccggtcaatctggcgggcaccgggaaaacgtggattaacctgcagcggctggaaacggtatgggctgacgcctgccatatggggcagccggcggtgctggatattcgctacagccgcgtcggcaccacgtatgccgtggtgtgggtgaagctgcgcgccaacagcggcgacacgctgattaacctgaagaccaccggtccgacgcgttttgaagccggctcctgctcgctgttccagcctgacttctcggtggtgacggataccaccaaaatgggcaccctcaaaccggcggcgcgctttggcctgcacaatggcgtcgcgggtattggggctaacgagaaaggcgtgcttaccgtcgcgacggcagcaggtacgccgaccaataaaaccacgccgacgggctttgtgctggtcaatatcaacggtgtcgatcgtaagcttccttattacgattga

SEQ ID NO: 63379 - DNA, 108 bp, Glycine max
  Peptide Sequence Number=SeqID_155064
atgcacaaaaatgagagagatggaaaatggaagaatggtctcaaggtaagggtggatatgagaaggatatttaagctaaaattaagggaaaaaaggtgcaatggggga

SEQ ID NO: 63380 - DNA, 486 bp, Glycine max
  Peptide Sequence Number=SeqID_155065
atggagagaatcattagaggagtgcatgaggtagctacaaactcagctgcatcatctaaaactaagaagcttgaaggcaaactggatgcattggttaacttggtaacccaactggccttgaaccagaaatctgtacatgttgcaagggtctgtggtttgtgctcctctgctgaccaccatacagacctttgcccttccatgcagcaacctggagcaattgagcagcccgaagcttatgctgctaatatttacaatagacctcctcaacctcagcagcaaaatcaaccacagcagaacaattatgacctctccagcaacagatacaaccctggatggaggaatcaccctaatctcagatggtccagccctcagcaacaacaacagcagcctgctccttccttccaaaaatgctgctggcccaagcagaccatacattcctccaccaatccaacaatagcaacaaccccagaaacaaccaacagttga

SEQ ID NO: 63381 - DNA, 384 bp, Glycine max
  Peptide Sequence Number=SeqID_155066
gattctattgaaaacattattgatgtcaaaacatatggtaattgtggttatcgtgcaatagctgcgttattgggtataggtgaagaatcgtggtcattggtgaggaaccatctgcataaagaactgactagctggtccaaagtgtatattaacctggttggtggcattgagaaatttgaggaattaaagtgttctctacttgttgacgacttatctaaggttttgttacgagatcactgtcctttgccaccagtggcgttgctgtggagtacacattgtcattatcgggcaaaacagtggctcactctgtacatagctagaatgcaacattacacaactttgtctaggctgaataccgaatttgttgatttaggtgaaccatga

SEQ ID NO: 63382 - DNA, 432 bp, Glycine max
  Peptide Sequence Number=SeqID_155067
atggcagcgcagttgatccatgatcgcgaggtgatggagtgcctagagggtgtttgggagaccctcgaaggcaatgagaggtgccgattccgtggcacaattcgactcactgctacttcattaatacatctggaggaacccgcatgcacacttcagcagcctgtggaatggatactacctacacctactccatatcgactagtggagccagttcaagtgatagaggtgtcatcctctgaagaagatcttgaagaggacccagaagagttacctcctagacctgctgtggatgcccttgacttacctgaggatgatgaggacccactccctgatgttgattctccagaggatatcatgtcagcatctgagggagactctacagaggagagcggccctagagggacagcgaatagtgacgactcttcatcgtag

SEQ ID NO: 63383 - DNA, 225 bp, Glycine max
  Peptide Sequence Number=SeqID_155068
atggggctccgaaaaaaatgtggagaatggagaattggcgaacagcgctacgcagtaacttcgcggggctccagactggatggtggaggatgcatgaatagtgtgctaggcaataaattcatggagctccgaataaagtggagaatggagaattggcgaacagcgctacgcaataacttcacggggctccagactcgatggtggaggacacatgaacagcgctag

SEQ ID NO: 63384 - DNA, 78 bp, Glycine max
  Peptide Sequence Number=SeqID_155069
atgaagaacgagaaggtgaacaaggtgaagtctttggaatgcacacataccaggagaattataagcaattgggcttga

SEQ ID NO: 63385 - DNA, 171 bp, Glycine max
  Peptide Sequence Number=SeqID_155070
atggctagcaatagtcaacatcgggaagaatggaggaaccaccctagaaatcaatttaatagagatcaagagaaaaatcccaaggaggagtgtaaagctgtgatgactagaagtagaagggcaatccatgtgggtgagagtgaaactgagaagaaaatggagaaacattaa

SEQ ID NO: 63386 - DNA, 381 bp, Glycine max
  Peptide Sequence Number=SeqID_155071
atgaacttgctaagcgagcatgttgcactaagcgagttcatcaatactcattgtagaatcgctaagcccagaaaaagaaagagcattggtaccaggctcacatctcagtatgacacaaggagattctcttcattagatgcttggaccagatacactgataatgttctgggaatgaacattttacctgagaggaaagtaaagctatatcacactaagctagatgactttaaggccgagctggagaggcgtaatttccataaacgcctcaccaatttagtcgatgggagcatagatctggcttttgtgaaagagttctatgcaattcatacagttctgaggatcgtccaccaaagcagtccagagttagaggtcatttggtga

SEQ ID NO: 63387 - DNA, 387 bp, Glycine max
  Peptide Sequence Number=SeqID_155072
atgcataaggcattgcgattaaatgctacattgccatatccacacctagtcactctcttccttaaacactataacatccctcttgactctgaaccttatgttccaatcaagagatccttcttaatcggtgccactatgattgcatcctttggttatcgtaaagagcatgatggctcttgggtgaaaaagggtgctcaacccattgatgaagaaggacatttacatggtggagaagattcctctcttcttcaaaaggttgatggtcttgagttacaagtggacatgcaattcgatgagatggagtcaaggatcaccaaggtcgaagaagatgtttcttatattcgtacaagctttgatctaccaccaccaccaccaccatcatcttaa

SEQ ID NO: 63388 - DNA, 183 bp, Glycine max
  Peptide Sequence Number=SeqID_155073
atgtgggtgcaaaccattggtcagtttgctcaagcgacctatgctcctgagtttgggacttccaagaccgttcaatcagagattactcgtcttgcacattggtgggggtgccagagaagtgagttatcaagaataggatgttggacaaatggcctcagttaccttaagaaaaaggggggttga

SEQ ID NO: 63389 - DNA, 777 bp, Glycine max
  Peptide Sequence Number=SeqID_155074
atggcgctgtcagcgcgcggctggcaggtgaccggcagcaaaacctcaccggacggcgtcgatgcggcgcgccgctgtggtattgatgcgtctcagctggtgctgtcaccggagctggagtgtgaagcagacgatttggccgcgctgatggcggtggatgcgctggtggtgacgctgcccgccagccgcaccgtgcagggcggcgaagattacatgcaggcggtgcagaacgtggtcgataccgcgctggcgaataaagtgccgcgcatcatctttaccagctctacctcggtatacggcagcggcgacggcgtgagaaaagagagcagtgcgctgcagcccgagacggtggcaggcaaaacgctggtagagctggaaaactggctgcatgacctgccgggcaccagcgtagatatcgtgcgtctcgccggcctggtcggcccgaaccgccatccggggcgtttcctcgccggtaaaaccaacctggaaaacggcgcgcacgcggtgaacctggtgcatcttgatgatgtggtcgacgcgattgtgctgctgctgcaaacgccaaaaggcgggcacgtttacaatctgtgcgccccgaaacatccatcacgcgacagcttttacccgagcgtgtcgaagcagttaggcctggtgccaccgacgtttgttgccgagccggtgcgcgccagcggcaaggtgattgacggttcgaagatttgtcacgagctggggtttgattacagctacgatgacccgatgaagatgccgctggagtag

SEQ ID NO: 63390 - DNA, 370 bp, Glycine max
  Peptide Sequence Number=SeqID_155075
atggctgatcttcacatcgcgcagctgcggaaaggtgcgcagcagcttgggccggatcaacgcctcgatgtcttccggttcgcgcgccccatacaccacgccgccgccgtacagcaggcggttgtcggcagtcaggcggaagtaatccagcagatagttacaatcttccacacagtggttattgggcatcagccccagcgcctgatcgcggctcagcggctcggtggtgacgatctgcgagccgcacggcatgcttttgcgccccagccgaggttccagttgcgagggcagataggcgttgccggcaaaaatcacaaaggtggcgctgacttcaccctgcgcggttttgacccggttgggtgcgccgtag

SEQ ID NO: 63391 - DNA, 346 bp, Glycine max
  Peptide Sequence Number=SeqID_155076
atgactagaggaaatccatttgacttacaaccctttgatcctgagatagataggacatttcatagattagttaggcatagtgtgcatcctgatcattctgtgcattttgaacattctgagtattctgttgctagtgattctgaatattctgattttgagcattccactgctaatttttatactgagaacatggctcaacctcaacctcatgagaggactcttagggagatggatgcacctaatttcacttatgaaagcttatgcattcaatatcctgataagggtgttccatatgttttcaagactggactaatacatttgttgcccaagtttcatggtcttgcag

SEQ ID NO: 63392 - DNA, 606 bp, Glycine max
  Peptide Sequence Number=SeqID_155077
atggataatgaagagggcgtgcaagaacagatgaaggccgacctatcagccttaaaagatcaaatggcttctatcacggaggccatgctaaaactccagaaaactatagaggataatgccacggtgaccgcctccaatgcaactagggaagcggaaccggtgctacagcctgcaataaacttgggccgagatagaaacacgacggtgttcggtcggaggtataatccgcaagcttacccttatggcttgcctccaaacttcactccccgtgccactctggaagatttgagccaagcccctaccttcgaggggaaactcccaccttatgccgactatcccctgcaagaagatgatgaaggagatacccatctaggccctttgcttcccctcaaagatccggccccccatgaattaccccaaccaaacatagtccgccatgtcccatcttcacccgcacccgtaaaagaatccgttcccttcgcagaggataagggaaagattaattcacttgaagagaggctaagagcggtagagggcctcggcaattacccgttctcggatttagcggacctatgtctggtacctgacatcgtcatccctccctag

SEQ ID NO: 63393 - DNA, 231 bp, Glycine max
  Peptide Sequence Number=SeqID_155078
atggcctcatccaactttccatttcttgagggaaattctattaataggcctcttatgttcaatggcgagggttatcactattggaaaacccgaatgcagatccttattgaagccatagatttaaatatatgggaagccattgaagttagttcttttattcctacaaaggtagtgggaaatgcaactatagaaaaaccaagagaagaatggaatgatgatgaaagaagaaag

SEQ ID NO: 63394 - DNA, 1053 bp, Glycine max
  Peptide Sequence Number=SeqID_155079
atggatctcaaccagattctgaattatgcagctccttcgtttacctcaaattcaaccacagttgcagacgggacggatcatattgatccggctcagttgagagggttgggtcccgaccaggtattggttttgcttaatggtaaaagaagacatacctcttcgctggttaatgtaaatggttctcccggaagaggttctgtgggaaccgatctgaatgcattgcctgcatttgctatagaacgtctggaagtcctgagagatggagcttctgcacaatatggttccgatgctattgcgggggtgattaatgttatcatgaagaagaatactaatgcatttacttcggcaattacagcagggggatttaattccaaagggtccaatgaccacagcggaggctgggatggagaaaatgaaatggcatatagagggcttgcgagaaatgattttaatatgagagtagggcagtccaggttgacatcggggcagtttttcatgaattctgaatttgatcttgcttcttccgtaaaaggatatgcttttggggggatttcctatagaagtggcaatgcgggaggttttttccgcaggccttatgagagtagggcttctacttctatttatcccaatggtttcctgcctgaaatcgcttctgatgttatagatctttccctggcaacaggttttaaaggtaaaatagggaatattaattatgatataagcaacacatacggtaggaatactttcgattataccataaaaaatacggcgaatgcttctatgctttatccgagtaaaacagaatttaaagctggaggactcaatttttcacagaataccgttaatgcggattttgatacaaaagttgactggcttcaggggtttaatattgcatttggtggagaggccagatttgagaggtataaaattcaaagtggagaacaggattcctgggcactctatgatattaatggcaatgttcaggatgtttcaacacctgctaatcttaaaccgactgatttttttggtgcggtgagacccggtggagctcag

SEQ ID NO: 63395 - DNA, 273 bp, Glycine max
  Peptide Sequence Number=SeqID_155080
atgtcaaacacaatcaggattgagaaattcaatggaaagaacagcttcgatctgtggcgcatcaagatgcgtgctttgttgaaggaacaacgtgtttgggctcctgttgcttctgcatctctgaagaaagaaatggcttctgaatccaaagaaaaggcctctgtgatgcaatcctaccccctaagggtattggatagaagactcctagaggcttgggctagagctactaaagaaggccctagggttctcatgaaccttagggtagatttttga

SEQ ID NO: 63396 - DNA, 240 bp, Glycine max
  Peptide Sequence Number=SeqID_155081
atgaaggagaagaagatgagtatgacctggatactgatgaagttcaacaaagtgctgaacagaaagacaggaggaccagtgaaaccaccaattctggatcggaaccctatgaatactggaaagcaaggatggtggccttcctcaaatcactggatagcagcaacctggaaagctgtcatcaaaggctgggaacatcccaagatgctggacacagaagcgaaagcctcactaatgaattga

SEQ ID NO: 63397 - DNA, 312 bp, Glycine max
  Peptide Sequence Number=SeqID_155082
gagtatgttgatgcttttcattctgttcaaagcagcaactctccagtcaaacgtagtgcatcatgttctgaaccgcctcagccaacaaggatcatcccgatgttggatcaatttgcgccattcattcaaggtttcattcgtgacgttgtggatgtgaaagcggacggtaactgtggatatcggtccattgccgctttattaggtatgggggaagatttgtggccgttagtgcatgaggagatgaacctcttcggtggcacagagagatttgaacaattaaagttgtctctgcttgttgatgggttttcgaag

SEQ ID NO: 63398 - DNA, 297 bp, Glycine max
  Peptide Sequence Number=SeqID_155083
gccagacatagatctctgccagatggtcatgctgcgcaaccccgagtcgtccctcaggtcctagagacagatatccctcacgtgtcggagccaagagcaccatcgacatctgcgagacccactatgcaggagcctaaacatgcagtggttggagcaccatctgagcctaagggggtcacgtcaggctcatcgacacatgaggtgattgaagaatgcctcaggatggtcaggagtgtcacacaggaccagctagtatatgttaggtctcgacgcaaacggtgcacggatcaggcatag

SEQ ID NO: 63399 - DNA, 1563 bp, Glycine max
  Peptide Sequence Number=SeqID_155084
atgactatcggctgggccttcgcctttatgattgagggcgccagcggctttggcacaccggccgccatcgccgcgccgattctggtcgggctgggcttcaacccgctgcgcgtcgccctgttgacgctggtgatgaactcggtaccggtttccttcggcgccgtgggcacccccacctggttcggctttgccaacctcggcctgtcggacgccagcctgctggaaattggccggcaaaccgcgctgatccactttgtcgccggcttcgtcattcctctgctggcgctgcgctttatcgtttcctggcaggatatccgccgcaacctaccgtttatcctgctcagcgtgctgagttgcaccgtgccctatctgctgctggctcaggtgaactatgaattcccggcgctggtcggcggcgccatcggcctggcgctctcggtactgttggcacgctgcggcatcggcctcacccgcagcgacaaatcgcagagcgccgggcaggcggtgccgttcttacaggtggtcaaggccatgaccccgaccctgctgctgattgctattctgatagtgacgcgcatccatcagctgggcctgaaggcgctgctcaacaacaccgcgctgctgtggcaggaaaacctcggctggctcggggagctgcgcatcagccgggcgctgatcgtcgaactgcagcaggtgctgggtacctccgccgctgccggctacaaaacgctgtatgtcccggcgctgatcccgttcctgctggtggtgctactgtgtattccgctgttccgcctgaatggcgaccaggtgcggcaaatgttcagcgaaaccggcgggcgcgtcgcacggccctttatcgccctgttcggcgcgctggtgatggtcaacctgatgatgcagggcggcgacaacgcgccggtgatcctgatcggcaaagcgttggcggcgctgaccggcgagagctggctgctgttctcgtcgttcctcggcgcgctgggctcgttcttctccggttccaataccgtctcgaacctgaccttcggcggcattcagcagtcgatcgcccagagcagcggccttgacgtcaatctgacgctggccttgcagtccgtcggtggcgccatgggcaacatggtgtgcctgaacaacattatcgccgtctgttcgatcctcgggatcggcaacgccgaaggcaaaatcatcagaaagaccgtgctgccgatgctggcgtacggcgggattgcggccgcaagacaagaaggtaaacactatgatcatctccgcgtcaaccgactaccgggccgccgcccaggccaaactgccaccgtttctgtttcactacatcgacggcggggcctacgcggagcatacgctgaagcgcaataccgcagatctggccgatattgccctgcgccagcgcgtgctgcgcaatatgtccgaactcagcctgcagaccacgctgttcggcgagcagctggcgatgccggtggcgctggggccggtggggctgaccggcatgtacgcccgccgcggcgaagtacaggccgcgcgcgccgcggctaa

SEQ ID NO: 63400 - DNA, 444 bp, Glycine max
  Peptide Sequence Number=SeqID_155085
atggtcattgaccaatccttcttctgtgatttgacccaattatctagtgctggtgtaccatttgaaggtacattggatgatgattggaaatttgatttttctgtgcatgatgctcgccggttggtttgcaccaaccaagcggatatgaccggaaggctacttaccggttcattggctcttgaaagccgcatcctttactatcttattattcgtattttacttctaagatcttcaaaccttgctcagagatctttcttgatcggtgctgctgtggttgcatcctttggttaccgcaaagagcgtgatggctcttgggtaaaaaagggttcgatggactccaaacatatgttcatgaaaggtttgatgctttggaacaacaagtggacatgtgattcgatgcaatggactcaaggatcacaaaggttgaagaagatgccaccataa

SEQ ID NO: 63401 - DNA, 90 bp, Glycine max
  Peptide Sequence Number=SeqID_155086
atggtgacaacaacaaaggtagaatccttggagttggccttaagcacagcctgcttagcgttagtcaattatgtgacaaaggctatctag

SEQ ID NO: 63402 - DNA, 324 bp, Glycine max
  Peptide Sequence Number=SeqID_155087
atggccagcaatacaataaacagcagggacaatggaggaaccaccctagaaatcaattcaatagagatcaaggtttctatgtccaaccagaagagcacagagtctgccataaagaatctggaggtccaagtgggagagcttgcaaagcaattggcagatagatcatcaagcagctttacagctaatacagagaaaaatcccaaggaggagtgtaaagctgcgatgactagaagcagaatggcaatccatgtggacgagagtgaagctgagaagaagatgaaggaacataaaccacaactggcacctaagccagcacttgaacct

SEQ ID NO: 63403 - DNA, 240 bp, Glycine max
  Peptide Sequence Number=SeqID_155088
gtagctgagggaccagcgaaacctgtagatatgtcggatcctgacatcgatccgttgtacctaatgacattgatcatcccgcagcttttcctaaagtcgttgcaggtgtcgtgggacgctagcgtgtttggggtgtataatgataacttcccattgtacataaaacatgaagatctttctaaaatagttcacggtggtgaatgtctgagcatctctgttatacaattgtggattctgtaa

SEQ ID NO: 63404 - DNA, 309 bp, Glycine max
  Peptide Sequence Number=SeqID_155089
atggacccgtcaacaaccaactggggggaggaggttgatcttccaaccgaggatcaaaacgataccataaacgatcttagagataagtgtgcgattcttctagaatccttctctaaaaaccaatcaagagaccgctttacatggcaagatatcgcacaacgcctcgttttggaggggaagggaacgaccgctgaagtgggtgccaccagggaagacttccaacgtctgcttggagaattaaaaaatccaggagagagcgacgtcgtctatcttcgggttttaaaggccctggagaagcatagacgctga

SEQ ID NO: 63405 - DNA, 321 bp, Glycine max
  Peptide Sequence Number=SeqID_155090
atgagtctagaagaagctcaccaccataggaggccatggataagggcttggaggaagaaggagatgaatgaagggagagggagagaagagcacaaaattttgtgctctaagagagctttgaaatctaaactatggttcagcccactaatccaagatcaagtccaagattctccactaagtgtgcttaggtgtcatgaggcatgctcatacttagctcatggcccgaaatctaccctaagcctcatgagaaccctagggccttctcttgcatctctgacccaatcttcttggagtcttctatccaatgctcttgcggggtaa

SEQ ID NO: 63406 - DNA, 342 bp, Glycine max
  Peptide Sequence Number=SeqID_155091
atggggagttgtgttgatccttcaccgaccgatccaaacacgggtgactcagacaaatgcgaatttggttcacaacatcctttgttgcatggccaagtgaaggttggtgataaggaggttaaagatgcagaggctcccgtttctgtacccactgacgaggcagctgtgtctccagcaaaacctccatataggctggatcatgaggttgatgatcccctttatttgatgacattgacaatcccacagctttttttaaagcgtcttctggttatgtgggatgctactgtgttcggggtgtttaatgaacacttcccgttgtacataaagcacgaagatctctga

SEQ ID NO: 63407 - DNA, 99 bp, Glycine max
  Peptide Sequence Number=SeqID_155092
atggggagcagaatcgtcttaggccacagtcagaagtcaagacaagtcaatggcggaaatcaaccaaggtacttagggatggaggcaaatggaggatag

SEQ ID NO: 63408 - DNA, 414 bp, Glycine max
  Peptide Sequence Number=SeqID_155093
atggtgacgtcattcactgcggtgcatgacgttgcgcgttttggggcagaggtattgcgtgcctccccgcgtcaggctgacctgatggtggtggccggaacgtgctttaccaagatggcaccgggtattcagcgcctttatgagcagatgctggagcctaaatgggttatctccatgggcgcctgtgccaactccggcggcattggatgtatacatcccgggttgcccgccgcgtccggaagcttatatgcaggcgctgatgctgctgcaggaatctatggtaaagaacgccgtcctctgtcgtgggtggttggcgatcagggcgtctatcgcgcgaacatgcagtctgagcgcgagcgtaaacgtggcgaacgtattgccgtcaccaatctgcggactccggacgagatttaa

SEQ ID NO: 63409 - DNA, 339 bp, Glycine max
  Peptide Sequence Number=SeqID_155094
atggtggcgcgtgttatgctcaggaacagatttgagccagggatgggtctaggcaaggactgcctcgggaatgccgatgtggtcaatatcaagggaaatccatacaagtatggattagggtatgaacccgggatgccggggaggaggaatgtgccgtcaagatttcgggcggatagggtatggcccggccgtattagccagtgtttcaccagcgctggaatggtgtccgaggaggaggtggccacaatagaggaagagctccctcaagacccaccaagttttatgcaaccatgccaccccgattcccaagtggggaactggcgcgtgataagccagtga

SEQ ID NO: 63410 - DNA, 324 bp, Glycine max
  Peptide Sequence Number=SeqID_155095
atggatctctacttcaaatgggagtacctcttccgttccataaaccaaggaatatggtgttgccccagtagaagttcgtacagaagttcagtatccattaatgatcttcctagggagtccctaccgacaaatcaactccctctttatgaatctgacatctacactcctcgtgacattggtgtaggaagctgcttcgacccatttggtgaaataatctattgccatgagaatgaagcgatgaccgttcgaatccttgggttcgatggcccctatgacgtctatcccccacatggaaaaaggccaaggggcggacatgacatttag

SEQ ID NO: 63411 - DNA, 166 bp, Glycine max
  Peptide Sequence Number=SeqID_155096
atggggaagagaaagctggagttaggttttgaagaccagaaaattgatttcgacttgtttgtggaagacaagcctgctccagaacacaatgtttgcttgcagggtaatgggagaaggtcaagaggttttgaaggtgagaaccaaaacatgagatttccccagagag

SEQ ID NO: 63412 - DNA, 183 bp, Glycine max
  Peptide Sequence Number=SeqID_155097
gaatcctctacaacaagagacccactggtgcaagctccattggagcttataggcctaggatcttcttcagcaatggattcctttgctccttggaagattaatggcagcggaatggagaaggaagagagagaggagacgccacttcaaggagaagatgagtctagaagaagctcaccaccgtag

SEQ ID NO: 63413 - DNA, 324 bp, Glycine max
  Peptide Sequence Number=SeqID_155098
atgttgggcaatgatagaaatctggcgggagatgaggtagcccagattcatgtccatcttcatgataatgccataaatcaacttggcccgatccattgtgatgtcagaagtgtgggaggtagggaccaagttggcaggctgaccatcagcattcagttcaaatcccctccccaggatgcagagcttagtagccaactcttgaggatcaggcctcaagagtgcaaatctagatatatgatgcaatcctaccccgcaagggcattggatagaagactccaagtagattggccagagatccaagggaaggccctagggttctcatga

SEQ ID NO: 63414 - DNA, 549 bp, Glycine max
  Peptide Sequence Number=SeqID_155099
atgaccaccctaacccagatatggatgacgttgctgctcagcaacatcctgccctgcgatcataattccgacctccctctaccgaagtgtcagctggtgtacgccatcctgacacggatgagtgttcatgtggctcagttgatcgctgatgccatctatctatttgcaggtatggcaccgaccaggcaccctttggacctagataagtccaatagggccctgggttttcccgcactgatcaccggactctgccagtcgttcggagtccccgttgcacctaccaaggtgattcgatcgcccatcacccgggcttttattgagaagtactacacccagagacaggctcagggtgatgctccacaggccgcaggcgcgccaccacctcatcaggcggaccagttcagggcagaggtcgcatgtcccggggattggcccgaggcccagacaggagaggcacccccagaggcccccgacgatggagaggaggcccacgaggacgaggagatgaccgatttgcttgacttcttgggagggagtggagctacatga

SEQ ID NO: 63415 - DNA, 531 bp, Glycine max
  Peptide Sequence Number=SeqID_155100
atgttggggtacgactacgagcccggaatgggtttgggcaagaataacggcggcagaacctgcctggtaagcaccagaggaaaccgtgggaagtttgggttaagctataaacctacgcaagttgacataaggaaaagtatctcagaaaggaagaacagaggccaaggctcgcggttggggcaacaagccgaaggggccccaccctgccacatcagtagaagctttataagtgcgggtctaagatacgacggccaagtcgccacgatatgcgaggatgactccccgaggaggtcggatttggtacggtcatgtcctcctggttttggactaggaaattggcgagtaaaggagcgcccagacttttacgcgacaagcataatatccgatgacaagtccctcgaaggtactaatacccgggacccggccgttgattttgagcaagaagcgggtcgaatgaagagtgaagaggacgaggatgtgggacttcccccaaagctggagaggataatcgctcaggaagaccgaaaatga

SEQ ID NO: 63416 - DNA, 828 bp, Glycine max
  Peptide Sequence Number=SeqID_155101
atggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgcctaagtgccagctggtgtatgccatcctgtcacggatgagcatccatgtggctcagttgatcgctgatgccatctatatttttgcaggtatggcgcccactaggcaccctttggacccagataagtccaacagggccctgggattccccgcactgatcacaggactctgccagtcgttcagagtccccgttgcacctaccaaggtgattcggccgcccatcacccgggcttttattgagaagccgcaggcgcgcccccaccacctcatcaggctggccaggctggggcatttgaacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcagggcagaggttgcatggcccggagattggcccgaggcccaagcaggagaggcacccccagaacctcccggcgatggagaagaagcccacgaggatgaggagatggccgatttgcttgacttcttgggagggagtggagatacgtga

SEQ ID NO: 63417 - DNA, 312 bp, Glycine max
  Peptide Sequence Number=SeqID_155102
atggcagcgcagttaatccatgattgcgtggtgatggagtgcctagagggagtttgggagacccacgaaggcaatgagaggtgccaattccgtggcacaattcgactcactactacttcattgcctgtggagtggatactacctacacctactccatatcgactagtggagccagcccaagtgatagaggatgatgaagacccactccctgatgttgattctccaaaggatatcatgtcagcatctgaggcagactctatagaggagagcgaccctagagggacagcgagtagtgaagactcttcatcatag

SEQ ID NO: 63418 - DNA, 459 bp, Glycine max
  Peptide Sequence Number=SeqID_155103
atgtgtcaggcaacaaaaaaccatgattttgactcattaaaacggtgtaataatgtgtctccatcatgtggaccttttggtcaagttgctggtggctccttcacgaagcctaatttagactatgttaacaatgatgatgtaactagtgtgctgagtgagttggtgaggagaaaaaacacagttattgtaggggagggtgtggccaatgctgagggagtagctagggaggtgatggagaggtttgaggtcacatttttcagtgattttcaagctcaagagagaagcaaggtgtttttcaaggatgtggcttttgaagatagaatagtagtcagaaaccgtctaacttgctgcaaggattgcttcataaattttcaaaaagaagctcagaccataactaactgtacaagcaacaaagtttgcactgctagtagcttgccaaaccaaaccaaaccaatctag

SEQ ID NO: 63419 - DNA, 802 bp, Glycine max
  Peptide Sequence Number=SeqID_155104
tgacaagggtatactcaaggaggatttttcaggcttccaagtagggttccctccctataatcaacaaggacagtggaggacacaccctggaaaccagttcaacaaagaccagagtaggccttcaaacaagccaatccaacaagggcctaacatattccagaggactactaagctagaggagaccttgactcagtttatgcaggtaacaatgtcaaatcataaaagcactgagtcagcactgaagaaccttgaggtccagatgggacaactgtccaagcagatagctgacaagtcatccaaaagttttgtggcaaatatagaacataatcccaaggaggaatgcaaagctatgatgacaaggagtaagaggtttgtggaagttgaggatgaacaaagtgtagtgcacaaagagaaagcggctgaaaagaaaggtactgaagttaagaaaaatgatgtgagaggtgaaggaaatcaggaaaaagggaaacaaataatggtccaggataaagaattgaaggaccaagaaaaagaaacagaagtagaaaaagaaatagaaaatgaaaaaaaaatgaaaaagaagaaaaaaataagaatgcaaagaagagtagaagtgaaaaagttgtggatgaaggtgtggaagtaccatatcctgtggtaccttcaaagaaggaaaagatcattatctagcgagatttttagatattttcaggaaactggaaataaccatgcccttcggagaagctttgcagcagatgccactctactccaaattcttgaaggatatgttaacaaggaaacataa

SEQ ID NO: 63420 - DNA, 746 bp, Glycine max
  Peptide Sequence Number=SeqID_155105
agctggatgaattcaagggcgagctggagaggcgtaactttcacaagcgcttcaccaacttagctgatagtagcattaacctcatgttggtgaaggagttctacgacaacctctatagtcctgaggggccttcacctaaacaagtcagaatctggggccacttaataaggattgatgcaaacagcctcaatgcctttctagaaacacttatggtgcttgttgaggaaggtcacccggggaagatcctcagaaaagatctaatcactcttgctcaagtctggagtgttctatcctactccaacctggctccgaactcccacacatcggatctgactgtggatcgagctaggtttcttgctcttatcacagctttatgtaggactagaggagttgcctccgacagtcttgtctttgaacgtctgagcccggtcattaatttggcctacataaggaagaattgttggaaccctgatgatccaaagattattattaggggggccagaagaccaagggcaaggccagctgaggctccttctacatcagcagctcctcatctagcttctacatcggcagctcctcctccaactcgtattgcagcagctccttctaccctacctcctgcatattttcaacgtttcgaagccatgcttcaaagcatacatcaggggcagattatttttctgcaaagtcttctgctggtagcacctccagactccatccctacagtagagcaatttaatgaatgg

SEQ ID NO: 63421 - DNA, 411 bp, Glycine max
  Peptide Sequence Number=SeqID_155106
atgtctccttcacctctaggatctcacaaccactcacaaactcatctcaagctctcaaaacagcttcctcttcaagctttggtctctgcagatcttcatgtggaagcaatgtcttccaaggttgttttgatgatgccaaagaatcaagagtcaagcaaaattcaagattcaagaatcaagcttcaagaatcaagattcaagaataatcaagatcaagattcaagactcaagattctagaaacaagggaagactcaatcaagataatgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaa

SEQ ID NO: 63422 - DNA, 103 bp, Glycine max
  Peptide Sequence Number=SeqID_155107
atggatccactcggtgggagtcgttccctctacgctccaccaaaaattgaaatttgtagtagagggacatttggttatcgtattgggcgaagaaggcattttg

SEQ ID NO: 63423 - DNA, 414 bp, Glycine max
  Peptide Sequence Number=SeqID_155108
atgacagtcaccgctttaggagcgttgtacaccagcagcgcttccaggccatcaagggatggtcatttctccgggagcgacgcgtccagcttagggatgacgaaggagggcgtgcgtgatatgaggtcctgggtgaggggtcagtggatcccgttcgatgcagatgctatcggccagctcctgggatatcctttagtgttggaagagggccaggagtgcgagtatggccagaggaggaaccggtccgatgggttcgatgaggaggccatcgcccagttgctgtgtataccggggcaagattttgcccggactactgccgggagacgagtgcggatcatgcgtaccaacatgaccaccctgactcagatatggatgactttgctgctcagcaacatcctgccccaccgatcataa

SEQ ID NO: 63424 - DNA, 378 bp, Glycine max
  Peptide Sequence Number=SeqID_155109
atgaagacttgggaggagtggatgacatctactatgccgccctcatcaacaaagttcttttggaatactaagtcttccatgtcttcaaaggaagggatgatgactgctagcagtccattatcaacaagggcagcttcatcactagataacaacacttcagtgttgcagaagaaactggccaaggctattgctaataaagacaaggctttggaaacttttggccttgctatgaaggttaaaaggatccttagggagcagaagggaaaggtccaaaccaaaaagcctgcccatcaacaaaaggaggaggaaaaaattgttatagaggagcaacggatgaagaagaaacatgaagtgcccagaccctctcttccagtgtag

SEQ ID NO: 63425 - DNA, 297 bp, Glycine max
  Peptide Sequence Number=SeqID_155110
atgttcaatttcgagggtctcgcgcactgtggagtggatactacccacgcctacaccacatcgtctagtggagcccgtccaattgatgaggtaacgtcgtctgaggaagaccctgaggaggatcccaaggagctacctcctgagcctgctgtggatgctcttgactttctagagggcgatgaggacccacttcctgaggtggattctcccgaggaagtcatgtcggcatttgaggcagattctacggaggatagtggcccgggggagatggcgatcagcggaggctcttcatcgtag

SEQ ID NO: 63426 - DNA, 575 bp, Glycine max
  Peptide Sequence Number=SeqID_155111
atgtcttggaagaggacacattacttctcaatgtcccaccaagaaaatcacatgattatgaggagccaagacatttatagtagccaagatgaggctactacttcaccttcctctagtgaaagtgaagaagcaaaaggggaagaatctagtgaagaaatctacccccaagaagaaagacaacctttaatgtttaaggaggagtgtaaggacgtaagtgtctcctccaagagcttagctaaatgggaaagacattttgaaataaagataaatattaaagaaatttcccctcttagacaacctccacattttatccttcgcaaaaagacacttgttagcattgccccacctcttgggcttgagtttatttctcaagtaaaggagttgttggatgagggtttgattcgcaagagcttaaatccttgtactttgttggtgcccaaaataggtattattaggcaccaaatccctaaaataggtggtatgatgaatgttttgagtggtgcaaccctcttttgtaaaatcactcgtgcatccaacatcttcatgatttgtgtacatagggactcattaggtag

SEQ ID NO: 63427 - DNA, 282 bp, Glycine max
  Peptide Sequence Number=SeqID_155112
atggggacccgtgttgagagaaacgaggatatgggctacgtgggagtacgtgagctcagttggaggtgggcaacaggggatggtgggtttatgcgcgatttgttgacatggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacctgggcatagtcggtcagtga

SEQ ID NO: 63428 - DNA, 687 bp, Glycine max
  Peptide Sequence Number=SeqID_155113
aacttcgaagctccggaggaagatgaagaagtccgagctctaaagttagagctagggaaggcgagactcgccaaggagaagttcaaatcagctgctacacacatccggaaggagtgcaccgagttacaagaggaaaacgctgccactgcaagagctcttgaacaagaaaccaaaagggcccgcaaggaggaacatggccgagaaaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctagccatcatagggcaatacaagaaagaattgaaccagtccatggcccatgaacaaaagctagtggaggattttgcacaagtgtatgccgaaaaagaagcaaaagggagggtgattgatgcgctgcatcaagaagcgactatgtggatggataggttcgccttgaccttgaatggaagtcaagacctcccgcgtctgttattagccaaagcaaaagccatggccgaagtgtgtactgcccccgaggagatctataggctaatcaattactgtcagcacatgatagatttgatggcccatataattaggaatcgttag

SEQ ID NO: 63429 - DNA, 399 bp, Glycine max
  Peptide Sequence Number=SeqID_155114
atgactagaggcaatccatctgacttacaacccttagatcctgagatagataggacatttcataaattagttagacatcatttagtaccttttgaacatcctgagcattctgttattggtgattttgagcattatagctttgaacattctgattttgaacattctgagaacatggcactacctccaccccgtgagagaactctaagggaaatggctgcacctgatttcacctacgaaagcttgtgcattcaataccctgatgagggtgttccatatgttctcaaaactggactaatacatttgctgcccaagtttcatggtcttgcaggtgaagatcctctcaagcatcttaaggagttccatattgtttgttccaccatgaagccccctgatgtctag

SEQ ID NO: 63430 - DNA, 201 bp, Glycine max
  Peptide Sequence Number=SeqID_155115
gggcaggatcatcttgagctaccttctggggtggggacaaaatgtggacggcagaaaccaatcaagggacggatgcaagtggggatggtgtcacgaccgaccgatcgtcgccccttctctgcgcgaaacaagcagagaacgtcgctgcagggcagccccgtatcctttgtattcgcagttttcttttactatttgttttaa

SEQ ID NO: 63431 - DNA, 149 bp, Glycine max
  Peptide Sequence Number=SeqID_155116
gtggggttgaggagtggaggtcgatttgtggtcacgcagggtccctgactcgcttgataatagtgaaatctcatctagagttttcctcttttggtgatgcattgtcactaatagtcccttttgccccagtgtattacctaagaggatga

SEQ ID NO: 63432 - DNA, 195 bp, Glycine max
  Peptide Sequence Number=SeqID_155117
atggattcctttgcttcttggaagataaatggcagcggaatggagaaggaagagagagaggagacgccacttcaaggagaagctcaccaccataggaggccatggataagagcttggaggaagaaggagatgaatgaagggagagggagagaagagcacgaaattttgtgctcaaaaggagctctgaaatctgaa

SEQ ID NO: 63433 - DNA, 273 bp, Glycine max
  Peptide Sequence Number=SeqID_155118
atgcatagatctcccacaagcaatttagttcctctggacttggagattaaagctacattgagaaggaacagagccgagaggagaaaaaaattactgcaagacgggacagtagtgtccattcttgaggaagaaactcatttttctgattctacatcatccgactcaccatcatcaagggaatccgcaacctatttaccagaagtcgtttccatggctgatgaacaccagcaaagagttacccttaaggactattcaagcagttcagtactgtaa

SEQ ID NO: 63434 - DNA, 475 bp, Glycine max
  Peptide Sequence Number=SeqID_155119
atggccccgaggaaacttgcctcaaagagatccaggaaagataaattggccgaaggaaccagttccgctcccgagtatgacagtcaccgcgttaggagcgctgaacaccagcagcgcttcgaggccatcaagggatggtcatttctccaggagcgacgcgcccagctcagggacgatgagtataccgatttccaggaggagatagtttgccggcggtgggcatcactggttacccccatggccaagttcgatccagacatagtcctcgaattttatgccaatgcttggcctacagaggagggcgtgagagatatgaggtcctgggtgaggggtcagtggatctcgtttgatgcagatgctatcagccagttcctgggataccctttagtgctggaagagggtcaggagtgcgagtatggccagaggaggaaccggtccgatgggttcaatgaggaggccatcgcccatttgctat

SEQ ID NO: 63435 - DNA, 562 bp, Glycine max
  Peptide Sequence Number=SeqID_155120
atggcacacaaaatcaggtatgtgtcggctcctgaagcatgttggaagatttttgcattcccaatgcatgggcgtgcactggcagttgaacatctttatttccacctagaaaatcaacagcctgtttattggaaagatagtcaagaaattggcacagtactggctaagagtacaatcaaagaatcaatatgctggaaaccaaggaaacaaggaaatactattggcaggctgatttgggtgcccctttccagtggagagttgttctacatgaggatgatgctttcctctactaaaggatcacaatgttatgaagatattagaatagtagaaaatgttgtctatcatacattcagagaagcatgctttgcaaaaggttttctaggaagtgatcaagaatttgttggtgccttacgagaagcaaacacttggggaactccacactatcttaggaagttatttgtgaaactgctatttatgaataccatggataggcctgaatatgtgtggaaacaaacttggcaatggatggcagatgatattgtatttaatcataaaagacaag

SEQ ID NO: 63436 - DNA, 249 bp, Glycine max
  Peptide Sequence Number=SeqID_155121
gcagtgcaacctgcccattcttcagtcatgcacattgggggatgcaacatttgtggtgggggctatgagtcaggcatgtgcatggtttctctatcaaatcccaagagcactgagtctgccatcaggaatctagaggtacaagtgggccaattagctaaacagttggctatagcgtccacgaacagttttgaggccaacacggagaagaatcccaaggtggagtgcaaggtaattttcactaagagttag

SEQ ID NO: 63437 - DNA, 411 bp, Glycine max
  Peptide Sequence Number=SeqID_155122
atggacttgaaagaaaattgtacttatgtcatgcacaattttaaagtgctaaaaaacaatggtcagtacagagtgtgtgatcatcaatttaaattggtgtttattggggttactattgtggctgaccagtttaaacctggactattggttgatgttattggtgttgtggaggaggttgtctttcgacaagtttcaggaaaaggtagaagggtagtcttcaaactaaaggacttgagccagcaattgctatcttgcattttgtgggatgattattgctcacagtttttgaagttcttagatgattatgaaggtgatggcccaattacagttctattgagccattgtaggatcaaggaagcacatggatcttatcctacatcgatcaacaattctttcaaggcttcaagttaa

SEQ ID NO: 63438 - DNA, 891 bp, Glycine max
  Peptide Sequence Number=SeqID_155123
atggctacctcaccaaaagagacttcatctcctggttcaccttctgtaccatcatctccatcatccaccaaagcaccatcaaaccaggaacaacctgaattccatatccaacccatacaaatgattcctggtcaagcccctgttcctgaaaaactgattcccaaaagacaacagggagtgaagatttctgaaaaccctagccttgcaacaagtcctagggaagtagacccggagatggataagaagatcccgcagtattgtgagcagcatttgaaaaatgcttctgtccctgatgctgatgaagatgttccaacatcttccacccctaatgtttctgtcgctgatgctgataaagatgttccaacatcttccaccccaaatgctgaagtcctctcttcacccagcaaagaggaatcaacagaggaagaggatcaagccacagaggagacccctgcaccacgggcaccagaacctgctccaggtaacctcattgacctagaagaagtagaatctgatgaggaacccattgccaacaagttggcacctggcattgcagaaagattacaaagccgaaagggaaaaacccccattaagaggtctagacgaatcaaaactatggcacagaagaagagcactccaatcactcctaccacatccagacggagcaaagttgcaatcccttccaagaagaggaaagaaatttcctcatctgattctgatgatgatgtcgaactagatgttcccgacatcaagaggaccaagacatcagggaaaaagacttgccttggaaagagaactgggaagagatgccttggattgcaaggagatcatggacctcatcaaggctgctggactgctgaaaactgtcaccaagttgggagagtgctatga

SEQ ID NO: 63439 - DNA, 183 bp, Glycine max
  Peptide Sequence Number=SeqID_155124
atgatgataacaaaagatgatgacaaagttgatgacaaaaagctcaaagatagaatcaagaacacttcaagattcaagaggaaagttgaattcaagaatcaagaatcaagattcaagagatccagattcaagactcaagattcaagaatcaagagaaggcttaatccagacaagtatgaaaag

SEQ ID NO: 63440 - DNA, 333 bp, Glycine max
  Peptide Sequence Number=SeqID_155125
ttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgttgttgctgctgcaagtcacaaattaatcacatgtattttatgcttcgatgagcattcacttgcatatgatgctgttggatatggaagaggatctcacattccagcagtagccattacatcatcaggcactgcaatttccaaccttcttcctgctgtatgtttcattattttcatgaatttattttag

SEQ ID NO: 63441 - DNA, 93 bp, Glycine max
  Peptide Sequence Number=SeqID_155126
cggaaaggagaagaagaagagttgaaaagagacgccacttcaaggagatgtggaatcaagaagaagctcaccaccataggaagccatggataa

SEQ ID NO: 63442 - DNA, 304 bp, Glycine max
  Peptide Sequence Number=SeqID_155127
gatagagaacaccaccaagaaggccaatgagctcaccgttctctgcgatgccaaggtttctattattatgttctccagcactggaaaactccacaagatcgagcaatcaacaaagcaattcttcgatcaataccagatgactctgggagttgatatttggaactctcattacgagaatatgcaagagaacttgaagaaactgaaagagagaatgggagattgtctgaatgagctgggcatggaagatctcaggctccttgaggaaggaatggacaaggccgccaaggttgttcgtgagcgtaag

SEQ ID NO: 63443 - DNA, 624 bp, Glycine max
  Peptide Sequence Number=SeqID_155128
atgttgaaatatcttcttcgccgcctgctcccgctgccgttgatgctgcttgccgcctcggcgatcatcttcctgttattacgtcttggcgccggcgacccggcgctggactatctgcgtctctccaacgtgccgcccaccagcgaaatgattgccgctacccgcgagcagctcgggctcaatcagccgctggcgctgcagtatctacactggctgtggcgcgcgctgcatctcgattttggcgtctcctacgccagccagcgcccggtgctggacgacctgctgcattttctgcccgcgacgctgcagctcaccggcgcggcgctggtgattattctgctgacctcgctaccgctggggatctgggcggcgcggcatcgcgaccgcttacctgatttcgccgtacgattgattgccttcctcggcgtctcaatgcccaacttctggctggcatttttgctggtaatgctcttttccgtccatctgcgctggctaccggcgatgggctacggcggctggcgacatctgctactaccggcgttttccatcgccctgatgtcgctggcgatcaatgcccgtctgctgcgcgccagcatgctggaagtgtccagccagcgccacgtg

SEQ ID NO: 63444 - DNA, 237 bp, Glycine max
  Peptide Sequence Number=SeqID_155129
atgtactccatattctccgggcaaatcaatcttgaccatcctgatgaggacatgaccaagagcaagggcaagggtccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 63445 - DNA, 141 bp, Glycine max
  Peptide Sequence Number=SeqID_155130
atgtgttctaaaagttggttatggaattcagagagtgcaggttctagagcaattgaagaatcaactttaactaataagattgaatctaatgatgaaggtggatctttgggccgtagcattactccacatttgcaagattag

SEQ ID NO: 63446 - DNA, 797 bp, Glycine max
  Peptide Sequence Number=SeqID_155131
gattttctggacaactgaaaggatggtgggataattatctcactaacgaagagaaatcgaaaatttacagcgcagttaagacggatctcaatggaaaagtcattactaatgacgatgataaagagattcctgacgctgttaacacattaatttttacaatagcccaacatttcattggagacccatccttgtggaaagataggtctgcagaattattgtcaaatcttaagtgtagaaccttagcggattttaggtggtatagagatactttcctaactagggtttacacaagagaagatagtcaacaacctttttggaaagaaaaatttctagctggtcttcccagatcattaggagacaaggttagagataaaatccgtagtcaatctgccaatggagatattccatatgaaagtttaagctatggtcaattaatttcttacgtccaaaaggtagccttaaaaatttgtcaggatgacaaaattcagaggcaattagccaaagaaaaggctcaaacaaagagagatttagaaacctcgaaggaggaaacagaaacagaaacttcatcctctgtgctttccgatgaaaacctaaatctaatccagcaagatgaccaactatcatcaacaaatgatgatgggcaaatcaatactctaacgagagaacaagatctcttgtttgaagcaatcaattccatacctgacccccaggaaaagaaggttttcctggaaaaactcaagaaaacattagaggtaaaacctagacaaaaggattttatcacgaacaacaaatttgat

SEQ ID NO: 63447 - DNA, 336 bp, Glycine max
  Peptide Sequence Number=SeqID_155132
atgaaagatgtggtaacctctaggtggtttatattgaaggcacatgatgtagaggcatgccctatggcagaggatttgctgcaagggataatggatcaaggccggtttgagattggtaagaagcctgtcccgtttccctacaagagttacaaggcagtcccatggaagtatgcctctcaaaagcccgacggaaggaaggatgagtccatcagggatgacctatcctctgccaaagtcactaacatctctggcatgagcggtgtgacccgtagcgggcaaatcttcgcggcacccaacccgttggtgtggtccaaggacatgaagggaaaggcgaag

SEQ ID NO: 63448 - DNA, 246 bp, Glycine max
  Peptide Sequence Number=SeqID_155133
atggcatcttcatcatcatcttcatcaaatattaaaattaagtctggtccgattgatggagacgtactatggatgcaagctaaacatgtttcagaacatgtttggaacggagaagaagaccgcaaattacacataagacgagctgtccccacgtatcaaggggaagaagaaattccagaggaaactattcctcttcttcggcaatgcggtttttattggataatcaagatgggctatttaaaataa

SEQ ID NO: 63449 - DNA, 517 bp, Glycine max
  Peptide Sequence Number=SeqID_155134
atgcctcatatagtagtcataactcttgcaagaagaaagaaggaaaatactaagattgtgactattatgaagaaagacataggtcacatcttagacctcactcccataggaaagaaaaagaaagaaagcctcaagaggctaacattaacctctcatactcccataggaaagaaaaagaaagaaagcctcaagaggctaacattaagggtagagcaacaacttaaaagaaagtctacttcaaaatcttatggctctcactcttatccaaagaaagaccaaggtcaaggcatcttaggggtgacaccttctaagcccaaagatgataaggggaagacaatagaaaagcaaccccttaaggctagtatgaaagagaagggtagctccatgaagtggtttaattgtcttggaagaggacacattacttctcaatgccctaccaataaaaccatgattgtgaggggccaagacatttatagtagccaagatgaggctactacttcaccttcctctagtgaaa

SEQ ID NO: 63450 - DNA, 241 bp, Glycine max
  Peptide Sequence Number=SeqID_155135
atggaaggtaagggtaagaccatagagaaacccacccctaagactagttcccaatcaaggaccagcaacattaaatgcttcaaatgtcttaggagaggtcacattgcctctcaatgccccacaaagaaaaccaggattatgagggttcaagacatttatagtaggcaagatgagactacttcttccccttcctctagtggaagtgaagatgaagcaaggggtgcagagtctagtgaggaag

SEQ ID NO: 63451 - DNA, 609 bp, Glycine max
  Peptide Sequence Number=SeqID_155136
atgaagaacaaaaataatgaaactcgacataggctaaaaccgtactcgacccctcccaagcaatatggtaatcgtcctaacaatcaaaggactattgctctagggtttgtgggtggtagtggtagcaaacccaatactttccccactcagatcacttgttacaaatgtggtaagccaaggcacatctcctcaaattatactgataaaggcgtgacctattttaattgtagacaaaaggggcatgttcagagagattgtccatatcccaataaggagcaaaatggtgggggcctgaatgaccaaactggacatctgaaggccacgggaaaagtctttacccttaacggtgccgaagcttcgaaatccaaagatctaatccaagtgagtaagaatatgatatttatctctgccaaccaagttgtgacatctttaaaggaaaatgctcaagtgtacatgatcttgtttgacctagaaatagagacaaaggtttccatgtgtgacctctctgttgtcaaagagtttcctgaagtgttccctgaggatatatctggtctaccacccgagagagagagagagagatttttccatagacttagtacccggtgctag

SEQ ID NO: 63452 - DNA, 302 bp, Glycine max
  Peptide Sequence Number=SeqID_155137
ggtacatctacttgggtttgactgagaacaagagagggtacatctcttgtggatcagttctagtggagggtacatccactaggttcaaagagaacaagggaggatacatcccttgtggatctttgcttttagctgagaagtcatccaacagctttggagcaaataccgagaaaaatcccaaagaagtatgcaaagttgttatgacaagaagcaggaagcttgtggcagctgaggatgaggatattgtcgctttgaaggagcaagttgtttcgaaggacactactgataaaaagagtgatgag

SEQ ID NO: 63453 - DNA, 550 bp, Glycine max
  Peptide Sequence Number=SeqID_155138
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactgccagttacctcggttcaaagagtggtagctcagagacttcgaaaaccgcctgcaggcg

SEQ ID NO: 63454 - DNA, 706 bp, Glycine max
  Peptide Sequence Number=SeqID_155139
agaagtccaagctctcaaaagcgagttgggaaaggcaaacctcgccaagaggaagttcaagttggccgctacacacgttcggaaggagtgtgccgggttacgggaagagaatgcaaataccgcaagagcccttgaacaagagaccaagagggctcgcaaggaagagtatggccggaacaaatttcgcggagctctatggggtagcaataatgaactcaagttgcgaagggaagaaagggaccagtcgcgagcacataacatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctattggaaaaacaccataactaaacgcgccgcaagggatccctatcgcaccagatccaaatctagaacgatgggtgatcaagaggagacgcaggaatag

SEQ ID NO: 63455 - DNA, 261 bp, Glycine max
  Peptide Sequence Number=SeqID_155140
atgatgacaacaaaagatgatgacaaaagtgatgaacaaaaagctcaagtgaatcaaagaacatccatctcaagtgaatcaaagaacatccatctcaagagaatcaagaacaagtcaagagttcaagaatcaagaaaaattcaagactcaagaagaaagcctacaatcaagattcaagattcaagatctccaaaatcaagatcaagattcaagactcaagattcaagaatgaagaaaaaactcaatcaagataagtattaa

SEQ ID NO: 63456 - DNA, 90 bp, Glycine max
  Peptide Sequence Number=SeqID_155141
atggtgacaacaacaaaggtagaattcttggagtgggtcttaagcacagcctgcttagcgttagtcaactatgtgacaaaggctatctag

SEQ ID NO: 63457 - DNA, 489 bp, Glycine max
  Peptide Sequence Number=SeqID_155142
atgtgggcttttcataaaggtctacaaattgattgggcacacttagttcgatattgcatgcataaggctttgcgattaaatgctccattgccatatccacacctagtcaccctcttccttcaacactttaacatacctcttgtttgtgaaccttatgttccaatcaagagatcctttctaataggcgttgttgtcattgcatcctttggttatcaaaaagagcatgatggctcttgggtgaaaaagggtgctcgacatgttgatgaagaaggacatttacatggtggagaagattcctcgcttcttcaaaagattttggataggttcgatggtcttcaaacctttgttggtgaaaggtttgatactttggagttacaagtggacatgcgcttcaatgagatggagtcaagaatcacaaaggtcgaagaagatgtttcttacattcgtacaagctttgatctaccaccaccgctgccaccatcatcttag

SEQ ID NO: 63458 - DNA, 375 bp, Glycine max
  Peptide Sequence Number=SeqID_155143
atggaggaggtgctaataccttcctcaaacgtaaatacaactcccgaacttagaattttcattttgaccggttttcttcggtttttccgacattttccacaaataaacgttggtggcgactccgcgcatctttcctcctttggaaagcgcacccgtgagcctcgcctcgctcgcccgcaaaggcctgttgcttctggaggaagttgggactccctggggagctatttttgtgagtctagcccctattttgctgattgtgaaatagggggaggagtgaagaagaaaaaggttgtcttcttggcacttctctgtctctcgaaattactgaggaaaattatttccgtgaagaaaatccaagccgaggcgcttccgtaa

SEQ ID NO: 63459 - DNA, 453 bp, Glycine max
  Peptide Sequence Number=SeqID_155144
aggactacacgtcctcgccttgagaggactacacgtcctcgccatcagaggactacatgtcctcgccatcagaggactgcatgtcctcaccaccagagggctgcacgccctcacctccagaggactataagtcctcgccttgagaggactacacgtcctcaccatcagagggctgcacgccctcacctccagaggactacatgtcctcgccttgagagggctgcacgccctcactttgggtactggttaccctcaccgttgagaggactacacgtcctcgccttgagaggactacacgtcctcaccatcagagggctgcacgccctcacctccagaggactacatgtcctcgccttgagagggctacgccctcgaccttgggtactagttaccctcaccgttcagaggactacacgtcctcaccttcagaggactacacgccctcacctttag

SEQ ID NO: 63460 - DNA, 471 bp, Glycine max
  Peptide Sequence Number=SeqID_155145
atgtcttgggggagaaacatcttgcctgagaggaaggtagagctctatcacactgagctagatgattttaagactgaattggagaggcgtaatttccataaacgcctcaccaatttggttgatgggagcatagacttggctttggtgaaggagttctatgcaaacttatacagctctgagggcccttcaccaaagcaatccagagtcagaggccatttagtgaagattgatgctgacagtctcaacacattcctagagacacctgtggtattggcagagggccgagggttcatcttgaacactgagggccatcctgggaagattctcaggaaggatttgactactctaactagggtgtggagtgttctctcatactccaacctggcccccacatcacatacctccgatctgacagtggacaaagctaggctgatctttggcctagtctctcgcatggtcatgaacatatga

SEQ ID NO: 63461 - DNA, 219 bp, Glycine max
  Peptide Sequence Number=SeqID_155146
atggataacctcaaaaggagattgcttggtggttctatgaatccccctgttgtaggaaaattctacatgaggaagatactaatcccaagacttatggtgtgccatcttgctaaacctatccaccaccataaagatagagtctacacgtctttgggttcaaggaagcccaagaacaaagtccatactaatgtctaccgagggtgcaaatgggatgagtaa

SEQ ID NO: 63462 - DNA, 67 bp, Glycine max
  Peptide Sequence Number=SeqID_155147
atgaagaaagatcctaggcctacaagctccaatggagcttgcatcagtggtaataccttcctcaaac

SEQ ID NO: 63463 - DNA, 117 bp, Glycine max
  Peptide Sequence Number=SeqID_155148
atggtgtttgatggttttggagacatgaccaagagcaagggcaaggatccacttgaaggacttggaggacctatgacaagggctagagcaaggaaatccaagaaagctcttcaataa

SEQ ID NO: 63464 - DNA, 293 bp, Glycine max
  Peptide Sequence Number=SeqID_155149
attaaacaccttatattcccagctgatttcattgtcatagacatagaagaggatgctgacattcctctcattcttggccgcccattcatgtatactacaagctacatggtggacatggaaaagaagatactgcagatgggcatagaagatcagaagattagctttgatttgtttcaggaggacaaagatccacctcaccaaaatgtctatttcaaagtgcatgaactcttttggatcttggataacaagacgatgcgtcaagctagtgacgttaaaagagcacttactgggag

SEQ ID NO: 63465 - DNA, 252 bp, Glycine max
  Peptide Sequence Number=SeqID_155150
atgaaagataagagggatgaggaagaaaaacaaaagaaaaagaaggatagtaaggccttgtcttcaaaggccaaggggaaggaaaaggaggaaaaggattcctccaagaagattgttaacatggaaaatcatgttgcaacaaaaggtgatattaaaagagcactccttcttaaacaatctttctaccttctcctatcaagggaaacatcccttagcaccgccatacctcttgagcttgaggttattcctcaa

SEQ ID NO: 63466 - DNA, 165 bp, Glycine max
  Peptide Sequence Number=SeqID_155151
atgggctcatacttagcccatgggcccaaaatctaccctaaggctcatgagaaccctatagccttctcctacatctctggcccaatcttcttggagtcttctatccaatacccgtggggggtgttgaggaaaaaagcccagagtttcaagaaccttgggatttga

SEQ ID NO: 63467 - DNA, 762 bp, Glycine max
  Peptide Sequence Number=SeqID_155152
atgttggaagagggccaggaatgtgagtatggccagaggaggaaccggtctgatgggttcgatgaggaggccatcgcccagctgctatgtataccggggcagggttttgcccggactgctgcagggaggcgagtgcgaatcatgcgcaccaacatgaccaccctgacccagatatggatgacgttgctcctcagcaacatcctgcccaccgatcataattccgaccttcccatgccgaagtgtcagctggtgtacgccatcctgacacggatgagcatccatgtggctcagttgatcgctgatgccatctatatttttgcaggtatggcgcctactaggcaccctttggacccaggtaagtccaacagggccctgggatttcccgcactgatcacaggactctgccagtcgttcggagtccccgttgcacctaccaaggtgattcggccgcccatcacccgggcttttattgagaatatttacggcatttgggttcgccagcaggcggccaacccccgagctcatgtacagacccatgattgtctttaccagatgagtctcagcctgcagagccaggggtttacttcttttccatgccctactccggaccagttcagggcagaggtcgcatggcctagagattggcctgaggcccgagcaggagaggcgccagtagaggctcccgacgaggcagatgaggcccgcgaggacgaggagatgactgatttacttgatttcttaggagggagcggggccacatga

SEQ ID NO: 63468 - DNA, 171 bp, Glycine max
  Peptide Sequence Number=SeqID_155153
atgggacaccataggtttgtcatactttttggtaggaataatcaatatgaaaatacagaaaaaggtgttgagggaaggagcccagagtatgaagaacctcgggatttgaggtcaactcctttccaaggtggagggaatgatgcaatcctaccccgcaagggcattgggtag

SEQ ID NO: 63469 - DNA, 567 bp, Glycine max
  Peptide Sequence Number=SeqID_155154
atgctggattttaaactcctcgcacatttcccccatcatcttgttattcaggttggtgccgttgtccgtgataatcttccttggcaaaccatatcggcagatgatctctctcttaatgaacctgaccactacacccctcgtgacattggcataggaggccgcctcgacccacttggtgaaataatctatcgccacgaggatgaagcgatgaccattcgaggccttgggctcaatggccccgatgacatctattccctacatggagaaaggccaaggggcggacatgacattcagaggatgcggtggagcattgacattgtctgcgaacgcttgacatttgttgcatttccttacatggacacaacaatcactttccatgcatgcccgttggcgtgcgttccaaacgagccctcatggacttcctcgatcatgtgtgatgcaagctccattggagcttgtaggcctaggatcttcttcatcaatggattcctttgcttcttggaagataaatggcagcagaatggagaaggaagagagagaggagacgccacttcaaggagaagatga

SEQ ID NO: 63470 - DNA, 195 bp, Glycine max
  Peptide Sequence Number=SeqID_155155
atgaaggcccagaggcagagaaggactttttggcatttgataaaatttggtgagagtttctctctgagttccttgttgaaccaatctcagacttatgaaggtaatccttgtggcgtctaccctgacttatcttccttcaccggaagtggcgtcatccagaactccatagcctgtatcaaacgttccgccccgtaa

SEQ ID NO: 63471 - DNA, 132 bp, Glycine max
  Peptide Sequence Number=SeqID_155156
atggcttctaaaagtgaagatgaggggtatgaagaggatgagggaggaaggatgaatgagaggtatagagagagaagaaatcatagaagatatgaaggtagacaaagagaggaagggattgagggagtgaag

SEQ ID NO: 63472 - DNA, 159 bp, Glycine max
  Peptide Sequence Number=SeqID_155157
atgaacaaatgcctaggatcttcttcatcaatggattcatttgcgtcttggaagatgaatggcagcggaatggagaaggaagagagagaggagacaccacttcaaggagaagatgagtctagaagaagctcaccaccatatataggaggccatggataa

SEQ ID NO: 63473 - DNA, 324 bp, Glycine max
  Peptide Sequence Number=SeqID_155158
atgtcacacttatcagagcatgtctctatcacagacaaagtctttccgactctatcatggaactcatcatatgatggctcacctgaaataaatggcaatcagcccaaacacaaacaacaaacacacaccgggatgaaaaacctcgtcgggcgcctaggagtacatgacaggacatgcctcacaatggggagaccagtcaaggtcacgttgttttgcgagaatgctccaaccatgtgggatcgacacaggcttaaaggagcactcaaactggatgacccccaaggcctacactccgaacagtccgtcagggcctctccctcctga

SEQ ID NO: 63474 - DNA, 182 bp, Glycine max
  Peptide Sequence Number=SeqID_155159
ccgaattgcggtgttcgacaccaattaccacacaaagcaaaggatcactcagtgttttgatcaagaatacaaaaggataccaaggaagggggaaaaggggtcttcttcttgatttttctagaccccagctcgcccatgctagcatctggctcgcctgggccatggaattacctcttggctaa

SEQ ID NO: 63475 - DNA, 354 bp, Glycine max
  Peptide Sequence Number=SeqID_155160
atgtgggatactctccaacttacacatgaaggcaccactgatgtgaaaagatctagagtcaacaccctcacacatgaatatgaattgtttaggatgaatcctaatgaaaacatccatactttaagatgcttaagtaaggaatggcagcccaaggaacatgaaatggaactccaaagtcttaatcaaaatgaagaaatcgacaaaaagaaaagaagcataacattgaaagcctactcatcaacgcaagaagaaaatgaagaagacttctcactctttgtgaagaagtttaaaaaatttgtcaagaagagaagaatcgagaggagtcaaaacttcaacaatggaaaaaagatctaa

SEQ ID NO: 63476 - DNA, 159 bp, Glycine max
  Peptide Sequence Number=SeqID_155161
atggtgcaaaagagggacaagaaacttagaggcagtagcaacgggcccatcggcggctaccataggtggttgaaagcctacgcacagggtctggattggctcccgaatttgagaaccactaaggggttggagtttgaaactccggaagaagatgacgag

SEQ ID NO: 63477 - DNA, 318 bp, Glycine max
  Peptide Sequence Number=SeqID_155162
atgacaattgaggaatcaatacatgtttcttttgatgaaactaatattatctctccgagaaaggagtttcttgataatattgcagattctttggaagatatgtacaatcaagaaaagaatctaaaaaggaagagaaatgaagaaaacaaggatgttcaagatgacatagcccaagaaaatgatgatctttccaaagaatggaaaacttcaagaaatcatcctcttgacaacatcatcagagatatctcaaaaggggtaacaactagacactctcttaaagatttatgcaataacatggcatttgtttctatgatataa

SEQ ID NO: 63478 - DNA, 177 bp, Glycine max
  Peptide Sequence Number=SeqID_155163
atgtaccctccaatgtgttgggacaaagaattctcaggcggggaagggaagaatcaaaagaattctcaggcggttagtcctttgaattctcttggaaagagagaagggagacacaaaagaattcaggtggttagtccttctattcttttggcaaagggagaagaaaagaaaagatag

SEQ ID NO: 63479 - DNA, 612 bp, Glycine max
  Peptide Sequence Number=SeqID_155164
atgggtcggctccagcagcaagcttttcgcaaagcttacggtaaaatctgggacttagccatggtagaagtcttcacagaggccatttcctcccttgcccagtattatgatcagccgttgaggtgcttcacctttggggacttccagctatcacctatggtagaagaatttgaagagatcctaggatgccctctagggggaaggaaaccatacctcttctcagggttctatccctcattagctaggatttccaagatagtccaaatcccggtgcaggaattagaccacaggaagcaagtcgaaaatggggtggttggaataccaagaaaatatttggaggcgaaagcaagaatcttggtaggtaaaggcgagtgggccccgttcatagatattctcgcaatgttgatcttcggaggagtcctctttccgaatgtggatgggttggtggacctagcagtgatcgacgcttttcttgcctatcataaccacaaggaaagcccggttgtcgctatgtgtcgcaacctacccttcggcgggagggcgacgcgtgactcgcgggatgcgtgttccacgaaaggaatacgcgcggagtcgccaccaacgtttatttga

SEQ ID NO: 63480 - DNA, 504 bp, Glycine max
  Peptide Sequence Number=SeqID_155165
gcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcgccggaagaggacgaggaagtccaagctctcaaaagcgagttaggaaaggcaaaactcgccaaggagaagttcaagttggctgctacacacattcggaaggagtgcgccgggttacgggaagagaatgcaattaccgcaaaagcccttgaacaagagaccaagagggctcgcaaggaagagtacggccggaacaaatttcgcggagctctatggggtagcaataatgaactcaagttgcgaagggaagaaagggaccagtcgcgagcacatagcatggttctgaaagaggagtttgttcaaagtccaaaagaagcttgtctcagcgtttatgcgagacggagaccaacatgctag

SEQ ID NO: 63481 - DNA, 114 bp, Glycine max
  Peptide Sequence Number=SeqID_155166
atgatattaatggcagcagaatggagaaggaagagagagaggagatgccacttcaaggagaagatgagtctagaagaagctcaccaccataggaggccatggataagagcttag

SEQ ID NO: 63482 - DNA, 213 bp, Glycine max
  Peptide Sequence Number=SeqID_155167
atggccactgttcaacacctaatgattgccaataggaagaggaagcctattatttgcaaaatcaatccagaccttaacaaagattccaaggaaactaccaaggctatagaggcccttctaacaactcttatgcagatctttcaaataggggtccacaacaacaacgacaacaagctcagtcggatagtatctcaaagatggaagatactttaa

SEQ ID NO: 63483 - DNA, 171 bp, Glycine max
  Peptide Sequence Number=SeqID_155168
atggcggaagcacttgcgcatgcaccttctgatgtggagcagcttagacatgcagtggaggcttgccaagcaaaagctgaaaggttagagcagttgcttaacctaaggatagtgactaaaggcactgaaacatacaatgtcatgcaagattgcctaaggattgctagtgtt

SEQ ID NO: 63484 - DNA, 237 bp, Glycine max
  Peptide Sequence Number=SeqID_155169
atggataaagttgatatctttgtccctcatcctctcacaaacgcatgtttgcttattcaacttccaccggaatgtgagtgtaagccattggtctgtttgctcaagcaacctgcgctcggacaacccttcccttgtgttcaagaatcctctactacaagagacccacggtctcttaatcccttttcagaaataagaagaagagaagaagaggtctctcgtaaaaaaggtagattgtaa

SEQ ID NO: 63485 - DNA, 294 bp, Glycine max
  Peptide Sequence Number=SeqID_155170
atgtggaggtccaagtgggacaacttgcaaaatagttggcggataggccgtcaagcagctttagtgctaacactgaaaaaaaatccaaaggaagaatgtaaagctgtcatgataaggagtagaatggaaacccatgtggatgaaagaaaagctgagaagaagatcgaggaacataaacaacagttggctgatgaactgccgctggaaccggttgatgatttagttgaacttgaagaaattgttgaggaagtagaaggtgatgaagaaggagagataccaataaaagactgttaa

SEQ ID NO: 63486 - DNA, 341 bp, Glycine max
  Peptide Sequence Number=SeqID_155171
aactcaaaaacttcgacatccttaccttcaggaacactcgaaaggtggcaacgccactaaaaaaggcacgactttggctacgtggcggtggtgggagcagcaggtccacttcggcttcaagtagcggtggtgggagcagcgggaaacaaaacgtcagggtggtagcgggacggagttcacggcgggatgaagtagttcaggcaatagtgggggtgctaggtttttggagggacggtgtacctacaagcaccgtctttgatgacttccatcaaaactacaacgacagggttatagacaaatgtcgttgtacaacaaatgcgccacataaaaaacttatataa

SEQ ID NO: 63487 - DNA, 342 bp, Glycine max
  Peptide Sequence Number=SeqID_155172
atggcagaaacgggaaagttggatcatctagaggaaaggctcaatgccattgaaggaggcgaagattatgcctttgttaacctagaagagttgttcctagtacccaatatcatcacccctcccaagttcaaggtgtcggactttgacaacttctcaaagaagcctgttgagaaagcttctcaaagaagccacgaggaagcttctggaggaatcctcttaatgaagcttctagagaaagctacatgcagctacctcggtaaaaacgcttcccagccttcattaaccgttggatcttctcgaaatttggccttaaacttcacaagacacttgtccatgatctga

SEQ ID NO: 63488 - DNA, 120 bp, Glycine max
  Peptide Sequence Number=SeqID_155173
atggtgtgtcatcgtcgtcgtgtcaaaccgatcgcattgaaggctaggagctcttgggaaacattcagttggtgttattggtggcttgttcacttacctggaggtcgtactgttccgtag

SEQ ID NO: 63489 - DNA, 225 bp, Glycine max
  Peptide Sequence Number=SeqID_155174
atgaagctgttcttgataccacatgatgtagcttcatgtggagcttgtaggccttggatcttcttcatcaatagagtcatttgcttcttgaagatcaatggcagtagaatagagaaggaggaaaggttaattaggcaagctttgaaaattgctatttttcaccttctcgctaaaccaatatgctggcttagcgagcgtccactaagcgcaacactcatgggctaa

SEQ ID NO: 63490 - DNA, 481 bp, Glycine max
  Peptide Sequence Number=SeqID_155175
atggatgggttggtggacctggcagcgatcgacgcttttctcgcctatcataaccacaaggaaagcccggttgtcactatactagccgatctatacgacacctttgaccgaagatgtgaaaaaagcaatacaaggattgtttgctgtactccagctctttatgtatggttagtctcgcacctttttcgccaagaagtgaggcatgcttgcccgttagaaagccactgttcatgcacagagaaaggaagggcgaattgggatcaactcttagcaagcaaagaaggagcatctatcaactggttccctcgatggaaggaaggaagaaccggagttcttatttcatgcggaggatttccaaatgttcccttgatggggacaaggggttgcatcagctacaatcccgttcttgctataagacaacttggctatcctatgagaggagcaccactagaggaagagatcgtgcctgtcgtttcacgag

SEQ ID NO: 63491 - DNA, 222 bp, Glycine max
  Peptide Sequence Number=SeqID_155176
atgacaaggatgatggaagcaatgatgagcatgaggaagatgatggaggataacactgctatagttattgctgcgagtcaagaaggtgaggtagtgaaaaatgcatatgggcctcatcatgttcaggttcagagcaagcatttcttcccaccatatgggttgcctcctaattatacaccgcccactgttatatgttggatcaagtggcctcagaataattaa

SEQ ID NO: 63492 - DNA, 874 bp, Glycine max
  Peptide Sequence Number=SeqID_155177
gggtcagtggatcccgttcgatgcagatgctatcagccagttcctgggatatcctttagtgctggaagagggccaggagtgcgagtatggccagaggaggaaccggtccgatggttttgatgaggaggccatcgcccagttgctgtgtataccggggcaggattttgcccggactgctgcagggaggcgagtgcgaatcatgcgcaccaacatgaccaccctgacccagatatggatgacgttgctcctcagcaacatcctgcccagcgatcataattccgacctccctctgccgaagtgtcagctggtgtacgccatcctgacacggatgagtgttcatgtggctcagttgatcgctgatgccatctatctatttgcaggtatggcgccgaccaggcaccctttggacccagataagtccaacagggccctgggttttccccgcactgatcacaggacactgccagtcgttcggagtccccgttgcacctaccaaggtgattcggccgccccatcacccgggcttttattgagaaagtactgcacccagagacaggctcagggggatgctccacaggccacgggcgcgccaccaccacctcatcaggctggcccggctgggtcatttgacatggagcagtatttacggcatttggttcgccagcaggcggccaaccaccgggcacatggcttcgcttctttttcatgccctactccagaccagttcagggcagaggtcgcatggcccggggattggcccgaggcccaagcaggagaggcgcccccagaagctcccggcgatggagaggaggcccacgaggacaaggagatggccgatttgcttgacttcttgggagggagaggagctacatga

SEQ ID NO: 63493 - DNA, 696 bp, Glycine max
  Peptide Sequence Number=SeqID_155178
atgggatcaagtcaaatgacttcgcttaaaaagaggttctatcaagtcaaggtcaagagcctaggaatcaccagtctaaaagagctagggcagttgatgggtcagctccagcggcaagcttttcgcaaagcatacagtaaaatctgggacctagccatggcagaagtctccacagaggccattgcctccttcgcccagtattatgatcagccgttgaggtgctttacctttgggaacttccacctgtcacccatggtggaagaatttgaagggatcctaggatgtcctctagggggaaggagaccatacctcttctcaggacattctcgcactattgatcttcggaggagtcctctttccgaatgtggatgggttggctaccctatgagaggggcaccactaaaggaagagctcgcacctattattgcacgaggtttcaataagaccaacgtggaggcacttcagaaggtccgcaaggcgtgggagatggtgcaaaagaaggacaaagaattcagaggcagtaacaacgggcccatcgacggctaccgtaagtggttgaaagcccacatgcaaggtttggattggctctcgagtttgaggaccactaaaggggaggaagttgaggcaccggaggaagacaaagaggtgcaggcccttagggcagaactcgagaaagctcaaacattcaaagaaagg

SEQ ID NO: 63494 - DNA, 473 bp, Glycine max
  Peptide Sequence Number=SeqID_155179
gatgaattcgattataacagtgttgtatttcaatggaagggtatatgaagataatgatggtgtaatatttgaaggaagtaaaaaagcgattcagattaaacgaaaatatattgccttgcaaatttgtgatgacgaagacgttgaaacgatgttggaaagttttaaacaacaagaccaaatgtcagttctggaattgtacatagaaaaggatgtcgctggtggttcaatgtttcattctgcaaattcgcttacatcatgtggaaattatttatctaatgatgagacacaactggcaacaaatatgagcaatttacatattgacgaagatgatgatgatgatgatgattatcttgtgtctaactcatacgttgaagagtctgtagacgaagatgacagtgttgacggtatatctgaaacagatgatgaagtcaccgacattcctcaaccagtaagaattgttcacccagcagaag

SEQ ID NO: 63495 - DNA, 110 bp, Glycine max
  Peptide Sequence Number=SeqID_155180
atggccgctttggagagagaaggtagcgacggacttggttccacctcaaaggattggaaagccgtttccaatgattcttccgccgcttccacgtatggtgcggaggacgg

SEQ ID NO: 63496 - DNA, 900 bp, Glycine max
  Peptide Sequence Number=SeqID_155181
atgggtaaggactggggtcctggcgctgctgatgcatggtatactgataaaagctctcattcaactgcacttggcccctatgattggcctcctactggtcatccaaatgccgcatgtagagttccatcctctgcatgtgagcagagatggactctagagatggttgctactatagaggtagcggtggtgcatctgtggctggctgctactgctgtacttttctatgaaggacttgttaatgggaggccggatgagcttcgtgggtgtaactggcaccctatagaactggcagagatctgtgatcaaggccaaaaatctcagtgctctgttggacttttccaggtccactgggggaagatcagaattatgatcgctaggaaaaatgttgctgaggagcagcgtcatccaaatttgtgtcaaggtggtcatgctagtgcgcatgatctgcacccgtcttcctatcacactgcatgcaaagtcctatcccggaacgcacaacagctggcttatggcctcctcgtcaaatcccgaagcctggctcctcttttcactaaactcgcaacgttgtccctcttccaggaccaatggatgccccaagaactgattaatggtatcttcatcaaaggggacccattggcctcacactcaagagcgcttatccctgactccttcctctgtgggccatgcattagcatagaattccatgactatttctgggtcatatttagccatgggccctgtgagttgagtccattgcctcttggcaacttcctcctggaacttagtgtattctccctctctcagtctgacccgtctctccttgaggaaagaccaactcttgattgcttcaaagcgacgttggtgttcctcacttcggaatcgatgtccgtcaaattctat

SEQ ID NO: 63497 - DNA, 129 bp, Glycine max
  Peptide Sequence Number=SeqID_155182
atggataagagcttgaaggtaggagaagatgagtggagggagagggagaaagggagcacgaaattttgtgcctcaaatgagcccactaatccaagatcaagtccaagattctccactaagtgtacttag

SEQ ID NO: 63498 - DNA, 339 bp, Glycine max
  Peptide Sequence Number=SeqID_155183
atggtggcgcgtgttatgctcaggaacggatctgagcccggaatgggtctaggcaaggacagcctagggaatgccgacgtggtcaatatcaagggaaatccatacaagtatggattaggatatgagggtcaattctttgaggatcctaacaacgagggtttgacaatcgatttcgatcgagatataagccaaacgataaacgaggaagaggaagaggacgtcctgtcaccagagttggagaggttggtcgctcaggaagaacgtgaaatgaagcctcaccaagaagaaaccgaattggtaaacttggggaccacggaggaaaagaaagaagtaaggtag

SEQ ID NO: 63499 - DNA, 391 bp, Glycine max
  Peptide Sequence Number=SeqID_155184
atgaggttaaagcttcggaagaaagtgatgagggcagcaatagtgagctcaagctccgaagaggtgaaaggaatcatcacgagtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactctgcccccgaggagatccacggacttctcagctatt

SEQ ID NO: 63500 - DNA, 910 bp, Glycine max
  Peptide Sequence Number=SeqID_155185
atgggatcaagtcaaaagccttcgcttaaaaagaggttctatcaagtcaaggtcaagagcctagggatcaccaatctaagagagttagggcaattgatgggtcagctccagcgacaggcgtttcacaaagcttacagtaaaatctgggacctagccatagcagaagtcttcacgaaggccattgcatccctcgcccagtattatgaccagtcgttaaggtgcttcacctttggggacttccgattatcacccatggtggaagaatttgaagagatcctaggatgccctctagggggaaggaaaccatacctcttctcagggttctatccctctttagctagaatttctaagatagtccaaatctcagtgcaggaactagaccacagaaagcaagtcgaaaatggggtggttggagtaccgagaaaatgtttggaggcgaaagtaagaatcttggcaggtaaaggcgaatgggccccattcatagacattctcgcactgttgatcttcggaggagtcctctttccaaatgtggatgggttgggggacctagcagcgatcgacgcttttctcgcctatcatgaccgcaaggaaagcccggttatcgctatactagccaatctatatgacacctttgaccgaagatgtgagaagagcagtacgaggattgtttgttttactccggctctctatgtatggttggtttcgcacctttttcgccaagaggtgaggcatgcttgcccgctagaaggccaccgttcatggacagagaaaggaggggcaaattgggaccgactcttagcaagcaaagaagtagcgtctgtcaactggttccctcgatggaaagaaggaagaaccgggattcttatttcgtgcggaggattctcaaatgttccattgatagggacgaggg

SEQ ID NO: 63501 - DNA, 1194 bp, Glycine max
  Peptide Sequence Number=SeqID_155186
tggggggtgccagtggagcgtggaccaaaagacttaaaagatttaccgcaatactttggccagcaaggtaaagccccggatctgacgcaacatagtgtcacgatatttgctgaaattgtagatgcgcctgatcttagtatcgagcaaattatcgctaaagccacccattttaagcagcagggcgcagacgtgatcgacttgggttgtctgcccggtaaaactttttcgcatatgacagatgcggtgcaggcattaaaggctgaaggttttaatgtcagtgttgactccatgcgcgaggacgatttgctggcagctggcaaggccggtgctgattatctgttaagcctgcatgaaaaaagcttatggattgctgatgaagtgccttcaacgcctattctgattccagctaaacctggcagcctgtccagtttgcaacgtgcgatagatcactgcttgaaacgtggcaaggcatttattgctgaccctattcttgatcccattcattttggattgactgattctattgtgcgttatcacaagctgcgtaaaaagtatcctgacattgccattatgatgggcgtcggtaacctgactgagttaactgatgcagacactacaggcgtcaacgccatgttgtttggcatgatcagtgagttgaatatcaatgcggtgctagcgacctcggtgagtccgcacgccagtgaagcagtggcagaggccgatgttgctcgccgcgtgatgtatcgcgcccaacaggataagcgcttgcccagggggtattctaatggtttgctggggctgcatgaccgaaaaccatttccgtataccgcgcaagagattgttgagatggcgggtcagatcaaggatcccagcttccgtatcatggtcagtgaagagggtgtgcatgtctataacagggatggcctccagcaggatactgatccttaccgcttttacgccggtctcaatgtccaggaagatgcatcgcacgcgttttacctgggggttgaattggcgcgggcgcaaattgcctggcaattgaaaaagcgttacgttcaggatgagttgctggagtggggcgtggcctcggtacagcaaaacaggcaagcaaaagtcgcccatcgcgaagcgtctatcaaagagcgcctggaaaaaacacgtaatgataaagatggtgacccaatctcggaataa

SEQ ID NO: 63502 - DNA, 270 bp, Glycine max
  Peptide Sequence Number=SeqID_155187
atgttctgccctcctccccctatttataggggaaaagagggaggtggttgccgcccagctcgcccagattacgcaatcatcccttctttggcttccggaatgttacggaactttacggattgcacattaacacttcctttcaactctcgacatgtcgcggaacatcacggattgcctaacgatgggtgccaagtacctcgaagtggtcaagcgaggttcgtatcccaacaaatagatggtccccggacgaaattagggtatgacagttag

SEQ ID NO: 63503 - DNA, 318 bp, Glycine max
  Peptide Sequence Number=SeqID_155188
atggctaagtctcctcaggagcaggtacagatggtggagatggttgaggggtctgagctggagtggtctcctcctttgctactgctggtgatggtgctggtgttgtgggctcctcagtcacagggctcttgggctgtggaggccccaccagttggatcaaatccactagggatgtaccctcccttgttctctttgaacaacctagtggatgtaccctccactagaactgatccacaagagatgtaccctctcttgttctcagtcaacaacccaagtagatgtaccttctacttgtaccacaaaggatgtaccctctaa

SEQ ID NO: 63504 - DNA, 321 bp, Glycine max
  Peptide Sequence Number=SeqID_155189
atggggttgaaccaagctcatgctttttcgaaaaaagttcatcaagtcaagttgaagtatggaagacacgctttacggtgcccttaccgaactcgtgctagagctagagtaatgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatg

SEQ ID NO: 63505 - DNA, 468 bp, Glycine max
  Peptide Sequence Number=SeqID_155190
atggcggaaccatcaaagaagcgcaaagaagaacaacgtatacagtacacaaacaccttctcctctcgttctatcattgaccctaagtttatagatatggatttctttcttgatgagagtttcaaatgcattcaagcatttcaaaactcaaatctcattccctttatgtctctaaaacttgcctgtgtattcggaatggtaaaagctttttattctaatcttgaaattcaagaaagtaccttgatttcagaggtttatgggataaagatggtcattgaccaatccctcttctatgatctgactcaattgtctagcgaaagcgtaccatttgaaggtacactagatgatgattggaaatcgatttttctatgcagagtcccaccagtgtattgcaccaaccaagcggatatgaccagaaggctgcttgccggttcattggctcttgaaacgcatccctggtgcttataa

SEQ ID NO: 63506 - DNA, 469 bp, Glycine max
  Peptide Sequence Number=SeqID_155191
agtcattctagaccctaagtaccttgaccttgaattttttgatggagaaacatttgattgttaccaagtgtttcaaaattctgctttggtttatttcatgtctctgaaacttccctactttcttgaattagctaaagttttctataataatttgaagattcaagatggtgttgtttactctgaagtgcatagtattcccaatgttgttgatcagtccttgttttattcgttgactaagctacccattcaaggtgttccttttgagggcactcttgctgatatgatcggcagattacttgttgggtctttcactttcgattgtcgcatcatgcattatattattgttcgtattttgcatcctcggtcttcaaaacttgcccaagcctctgaggaggatttgattctattgtgggtccttcagactggtcgtcagattgactgggcccatctagttcggtaccggatgtaa

SEQ ID NO: 63507 - DNA, 426 bp, Glycine max
  Peptide Sequence Number=SeqID_155192
atggggcagatggctactcagttgaaccaagctcagtcccaaaattctgacaaattgccttcacagactgtgcataatctgaaaaatgtgagtgccatcaccttacggtctggcaagaaaattcaagtgcctccaccagtagcagcacctgcacctcaacctgtcaagcttcattctacacctgaaaaagaagatgacttagttgcacaagagaagaagctccctgatcatgagggagttaacaaaaattttcatgcaggtggaccttcttctagtagttctgacttgcagcagcctcctatcactcttccatttccacctagagcaattccaaacaagaagatggaagaagtggaaaaggagatcttggagaccttcaggaaagtagaggtgaacatacctctgctagatgttgtaacaccctga

SEQ ID NO: 63508 - DNA, 372 bp, Glycine max
  Peptide Sequence Number=SeqID_155193
atggcgcctaccaggcaccctttggatccagataagtccaacagggccctgggatttccctcgctgatcacaggactctgccagtcgtttggagtccccgttgcacctaccaaggcggccaaccaccgggcgcatgtacagacccatgattgtctgtaccagctgagcctcagcatgcagagccagggcttcgcttctttttcatgccctactccagaccagttcagggcagaggtcgcatggcccggagattggcccgaggcccaagcaggacaggcgcccccagaagctcccggcgatggcgaggaggcccacgaggacgaggagatggccgatttgctcgacttcttgggagggagtggagctacatga

SEQ ID NO: 63509 - DNA, 468 bp, Glycine max
  Peptide Sequence Number=SeqID_155194
atgactaggggcaatccaggtgatttgcaaccctttgctcctgaaatagatagaacctttcatagattagttaggcatagtgtgcatcctaatcattctgtgcatttcaagcattgtgagcattttgagcattctgagtattctattgctggtgattctgaatattctgattttgagcattcaactactaattttcatactgagaatatggctcaacctccacctcgtgagaggactcttagggagatcacagcacctgatttcacttatgatagcttgtgcattcaatatcctgatgagggtgttccatatgttctcaagactggactaatacatttgctacccaagtttcatggtcttgtaggtgaagatcctaataagcatcttaaggagttccatattgtttgttccaccatgaagccccctgatgtccaagaagatcatatctttctaaatgcttttccttaa

SEQ ID NO: 63510 - DNA, 165 bp, Glycine max
  Peptide Sequence Number=SeqID_155195
atggcgtctccattcatctttctccatctccattccactgcaatcagatctcaagaagcaaatgaatccattgatcaagatccaaggcctacaagctccacatggagctacatcatgtggtatcaagagcatcttcatctaggttctatcatttttcagtcataa

SEQ ID NO: 63511 - DNA, 279 bp, Glycine max
  Peptide Sequence Number=SeqID_155196
atggtggcttcctcaaatcactggatagcagaacctggaaagctgtcatcaaaggctgggaacatcccaagatgttggacacagaaggtagtgaataccacaaaaagtcagatgaaaagcccagtcacagcagaggaattcaatgccatgggtgtgaaggctatgggcacatcaaagctgaatgtcccacccatctcaagaagcagaggaaaggactttctgtatgtcggtctgatgatacagagagtgaacaagaaagtgattctgacagagatgtga

SEQ ID NO: 63512 - DNA, 178 bp, Glycine max
  Peptide Sequence Number=SeqID_155197
aaaaagaatcagcaaaaaaggcaggggtgtatttagtaaacagggggtgcaaatagaaatcaggccgacttgggccttccaggaagttcccccagaaggcggtgccttctggaggaagcaacctagctctcctgggcgagctgggtggcaagctcctccctcattttcctataaatag

SEQ ID NO: 63513 - DNA, 444 bp, Glycine max
  Peptide Sequence Number=SeqID_155198
tattatcctggtcatcaccaacatcaatcatatgcggaacctaatgtacctccagtgcatgttcctaaatttatgtcccaacatcatccatcacaagcacaatatcaatcaacaagtttttctggtcatacgtctcaaggatgtcaacaaagttttcaaccactggggttctcatcatatatacctcaatattcatttcaagtcccttctacctcaaatgttttttatggctcctcacaaatgtttgccaccactttcaacactccttcatctgcatataatcttgcaccatctagttcttgttatcgtccatcattacctactcaaatacgtgacatgagtcacgaagatgaggacgaggatgaggataacaacaataacaacgatgacgatgatgatgttgatgatgatgacaacagtggtcatcatgttcctcaacaataa

SEQ ID NO: 63514 - DNA, 460 bp, Glycine max
  Peptide Sequence Number=SeqID_155199
atggcgaatcctctagttttagttttatttgcaagtataacgggcagtataggctccggtgaggaacctcctgatgacaatggtgttagtgtacaacctcaacagaagatgtcttttagggataagactatggtgaacaaggagaaaccgtctcctaggcaacgagctaggtttcaacatcatgaaggaacaattgataagacatgtaaactcactacaaattttgatctgatggatgtgggcaatgacttttacatggtcaagtttgatcttgaggaggacagggcaaaagtgattggagaaggtcctttatcactacctaacaatctagactttgactccagacttcgtttcatcgcaataggcaagcccatgagaatggataccaataccttggacatgcgatgtggtcactttccaagggtctgtgtggaggttgacttgaacaagcctgttgtgg

SEQ ID NO: 63515 - DNA, 825 bp, Glycine max
  Peptide Sequence Number=SeqID_155200
atggctaccaagcaaatacatctgcatttctttgtagaaggtcggcaatgcgacggtgctcatggtttcatctcgcggatctatgtcaaattcatcaccccgaattgcttggtagatggtcaagtcttggatttaagaccggtctcggatttgagacctttcatccacactcatggcatgagtgccttcagttgctgtggggctctctgcatagcactgtcatgcttgcttttggtcagccttggcggttacaatttcctctgtcaggaccgtccgcaaacttgtcggggcatagggcgaagagcatggaatgcaacactacctcagggtggccaaggtcatgcggtgagacctactggtggcatactgcgcattgaatctttcaacgaggatgtcgaagctgtctatggacctagttgggagttcaccatactaggtcaatgttgcccccttgagggacctgatcatagtcagtctttagctttctcagctcctcctcgtggcaccgctccatctccacaatgcaggccagaccaaatgctaaccatggatgaacaggagagaattgacgagagaccgtggggtacgttttactgcgaccccacgagggctcctagacttcacacgttagctttgagagatgcctttgtcaggaggagaggaggagggacttgcaaagcaaaggactctgacgttcaaagggttcgatggaacttggtatttataggagtggagcgtaactgtcggtccttgtttgtaggggttgttgtagcctttgcagataattcccagcttgcagataatagctgggagctagtagataat

SEQ ID NO: 63516 - DNA, 273 bp, Glycine max
  Peptide Sequence Number=SeqID_155201
atggtagatttggtgggaggtggatggatttgtgcaatggtggaatgggttggagttatgaaggaaaacttggggtttgggagaatgaaggtgggggatggtaagaataagtgtctaatggaagagggggaggagtcgatcgtggccattggaatggagaaggattttaggaggatagtagaaatgttggtgtggttagcggtggagtttctcaagtatggttgcaacaacaatggttttggtggctacaatgattgtggtggccaccagtaa

SEQ ID NO: 63517 - DNA, 285 bp, Glycine max
  Peptide Sequence Number=SeqID_155202
atgactcttaggagaagaaaggaagaagaagaagaagaagaagaagaagaagaagaagaagaagaagaagaagaagaagaagagatagtgacatctcctaagaaattggacataacagacttagatcctacaaacattactcttcaccttgttgatcgtttagttgtctatcctagaagggctattgaggatatgctggttaaggtggacaagttcatcattccagttgattttgaaattttagacgtagaggcagatgaagatgttcctatcatatttgaatga

SEQ ID NO: 63518 - DNA, 1437 bp, Glycine max
  Peptide Sequence Number=SeqID_155203
atgtctatgaacaacaacaacccttccaatccctatggaccctcttccaccgccaacccacattcccaaattacccctggccagggccagtatccccggtcccaggcccacgccatcatccaagcccagttccaggcccagctccaagcccacgggctcaccctcaaccccaacgccaagcgtttccctccaaaaccccctattcacaccgccaccacgccgtttaaacaaacggaacccgctcccaccgtaccggctcgaaggaagaagcataaaccaaacgagaaacatcttcctgagaaagccttagcaattctcccagaatcggagatttacacgcagcttctcgacatagaagcgcgtgtggacgctgcactcgtgagaaagaaggttgacatacaggaggcactgaaaaacccaccctgcattcagaaaacgctgagaatcttcgtgttcaacacgttcgcgaaccagagcagcgcggattcctcggctcccacgtggactcttaagatagttgggaggattttggaagatggtgaggaccctgaacaggcaggggatgttgctgcccagaggatgatgccccctttgtatccaaaattctccgcgttttttaaacgagtaacgatttatcttgacaagaggctgtatccagataacaatgtcatctcttgggagaattcgcggtcctcggccgctcacgaaggttttgaggtgaagaggaagggtgacagggagttcccggcgcagattcggttggagatgaattacatgctggagaagtttatgctgtcccccgcgttgagagaagtgcttggtgttcaggttgacacgcgggcgaggattgtttccgcaatctggcattatgtgaaggcgaggaaattgcagatcccgaatgatccttcgttctttcactgcgatcaggctctgcagagggtgtttggggaggataaggtgaagttcacgatggtttcacagaagatttcgcagcatttgtttcctccacaggttatacttttggagcatatgatcaagctctccgggaatagtccggttgggtctgcttgttatgatgtgatggttgatgttccttttcccattcagagggaattgaatgctctggtggccaatgtggagaggaccaaagagatcgatgcatgtgatgagtccatatgtggaatcattagaaaaatacacgagcaccgaaggaggcgagcattctttgttggttttagtcagtctcctctggaatttattaaggccttggttgaatctcaaaacaaggatctgaaagttttacttggagaatctcgtcacaatgctgaaaaggaccgcaagtcagatttctttaagcaaccctgggttgaggatgctattgtgcgctatttgaatcgcaaaccagctgcaggaagcgatgctccagggagcacataa

SEQ ID NO: 63519 - DNA, 384 bp, Glycine max
  Peptide Sequence Number=SeqID_155204
atgactaggggcaatccaggtgatttacaaccctttgatcctgaaatagatagaacctttcatatattagttacgtatagtatgcatcctgatcattctgttcattttgagcattctgagtattatgttgctggtgattctgaatattctgattttgagcattcaactactaattttcatactaagaacatggctcaacctccacctcatgagaggactcttagggagatggctgcacctgatttcacttatgaaagcttgtgcattcaatatcctgatgagggtgttccttatgttctcaagactggactaatacatttgctgcccaagtttcatggtcttgcagcgaatatatataacacatcacaacacaattacatgtaa

SEQ ID NO: 63520 - DNA, 396 bp, Glycine max
  Peptide Sequence Number=SeqID_155205
atgtcatcagtcattgcatgccttcaaaaggcgacaatgtcttcatttgcatttcgaagacgacaatgtctttgtagaagcaagcttcatgatgatgattcaacccaaaagaatgatttcaagattgagtcaacaagttcaagatcaagattgatttcaagattcaagaaaagacatcaaaattcaagagaagatgaattcaagattcaagagaagaaatcaagaagcaacaagtcaagacttcacaagggaagtattgaaaaggatttttcaaaaacaaaacatagcacaattttgttttacaaaagagttttctcaaatttttccaagttaccagagtatttactctctggtaatcgattacatggtaatcaattaccagtgataaaaatttga

SEQ ID NO: 63521 - DNA, 90 bp, Glycine max
  Peptide Sequence Number=SeqID_155206
atggggttggagttggacggtaggtgcatagcaactgtcttcacttgtctcgtagtgatcatttcatggttactcacgtttatacaataa

SEQ ID NO: 63522 - DNA, 213 bp, Glycine max
  Peptide Sequence Number=SeqID_155207
atgacttatcaaggtaatccttgtggcgtctacccagacttatcttccttaaccggaagtggcgtctacccagacttatcttccttcactggaagtggcgtctaccctgacttatcttccttcaccggaagtggcgtcatccaaacctttgtagcctgtatcaaacgatccgctcctactcaggttcacatcaccttttgctatatcaattag

SEQ ID NO: 63523 - DNA, 659 bp, Glycine max
  Peptide Sequence Number=SeqID_155208
ctcaagacaacccgaccgggcacatgcggacaacactgacgccagggtggcccaccgggctcaaagccctccccaaccatatcctcaaacagcctcaaagcctcgttggagcagaaattctgggcatacccacaaaccatagtggtccaaagactcgaaattttctcaggcgtttcatcaaacacttgacgggcactgacgcagtgtcccgaaacagagtaacatcgaaccaatgcatcaaccacgtgggaatcaaagtccaacccgaacttgatgacatgtacatggacctgttgggaagctgtgaacgagcgcacacgagcgcatgccttgaggaggaaggggaaggtgtgcttgccggggaggacgttgcttcggcgcatggctacgtagagggagagcgcgagttgggacgcggggtggagtggaagattctgaaagcgagggagaggtcgccgaagggggagagggcgcacgagaagaacaggcggctcgcggcgaaggggtcggtggcgacgacggcggagacgatcatctgggcatggacctgcttcagctggtctagggttgtgcatttgtcggatatgagtgccagagtggcgagggttctttgcagcggcggtggtttaaagggttgcaattttggcgccaacatttga

SEQ ID NO: 63524 - DNA, 339 bp, Glycine max
  Peptide Sequence Number=SeqID_155209
atggaaacagagaaacgaaacaaggttgttctcatttccgaacacaatatccgttgtttaaggaagccgaaggcgtcagtgaatcgacccccaacaccagatgtggtcgaaaatgtccctgaaagagaacccacgcttcaagagctcatcaacatcaagttgatcgagactggagagaaggagcgcctcatggagctgttgagggaaaggcttgttgattgcggttggaaggatgaaatggaaactctctgcagagctgttgtgaagaagaaagggaggaataatgttactgttgatgaacttgtacatgtaatcactccaaagggacgaggtagttaa

SEQ ID NO: 63525 - DNA, 720 bp, Glycine max
  Peptide Sequence Number=SeqID_155210
atggaacagacccattctggtaaatattttgtaaaagtgacccaatatggtgattttgccaccgttgcgcttctcatattctcttcagtaacgctccaatcacataacggaagaagcacccatcgtctcaacgaaatggccctcactcaagaccctgacaccaatgtcttcgaccaccaccccaagaaaagcgtgccttgcatgacaccgctgccatgtgcaggcggcgatgcccctggctggggtcggtacgccgttgaggtccgcgacctacagtcaaaggagtggcgttggcttggcaccttcgatatggtggaggaggctgcatgcacctatgactgcgtcacacgagccatatgcagcgccaaggacggcaccaacttcgtctacccctccccccctgttcgacgaccctgtcgccaaaccatcgtctttctactccgctgccaatgccaacgtcgacttcgatcccaactactacaaccgcttcctcctccacgacttctccgatatctgcctctccaagaccaatgctatcaagaagtcactagacttgctattattgcattgagaaagagtcgatgcctatctggtaaaggcatgccttccaagaatgacttgaatagcacaagtgatctttcatgttgtgagaaaggggcttcatgggaggcacctctaacagtagcaaatgagtccatctacctacctaagtttcattaa

SEQ ID NO: 63526 - DNA, 402 bp, Glycine max
  Peptide Sequence Number=SeqID_155211
atgggagggaatcagcccagacaaggttataatgcaggcgaatattcaggttttcagcctggtttgaattttaatcagcagcaagggcaatggagatcccaccctagcaatcaattcaacaaagagcagggtggaccatctaataggcctcagcaacaggggcctagcctatatgagagaaccacaaagctggaggagacccttgctcagtttatgcagaaaaatcttctagtacttttggagcgaacaatgagcagaatccaaaaagaagagtgcaaagctgtgatgaccaaaggtagaatggcaaccatggttgagaatgagggaagagtagttgatgaccaagaactagtagttgttgaagaaaaggatgatgaaagccgaaagccaaacattatataa

SEQ ID NO: 63527 - DNA, 2655 bp, Glycine max
  Peptide Sequence Number=SeqID_155212
atggtggacttttggacgtctgttccttcttatgagttgaaaattaatggcatcccaagaacagtagttgcaacaagcaaaccagaggacctgataattttcttggacttcagcattcctataacaaactcaactgagcaagttctaaatgcactacatgttaactctggcgtcttaattcctctccatggcagaagcaatggaacccgcggatttagttttaaactcaagaacatatcaggaactgagattatcacaattgaattacaagctgcatccatacttggaaagacaggcactcctgtctctcctgttgctccgatcacattcctttatgatcctatgaaacccaatgtggtactaaggaccagctccctcactgaaacaagggatttcaacatcaacataatggctgagttcacaaagccagtatttggctttgggacatctatagtagaagtctcgggaggaagactgataaggcagggtaaaggaactatcaagagctttatactcgttgactgtccaagcagtgacaaaggaggtgtcagttaccattcctgcagggaagactccaccccagcaatatccattgcactagactcatttatcagtgccggaacaatagcaacatcactagtagctgctatggtttcactttcctcagcaaatttagaagcattaagcatacttgctttgggaggtgcaagtagtcctgcttccaatccatcaattaatctacatggaatgattggacacctacaagtctttgccctcacaagttggttttcaactaatcaatttatcaaatactctgagacaacaagaggtcttaggtggctcatacctcatcacaagcttccctggaaaaaaattgatacttggaagaaacttggatggagaagtaacggccaatctgcaggagagagagatcaacaacaaactgatttaatgagcttgtcttatattgatcccaaactatcatttcaaactgaaaataccaccaattttggtcggtttcacaatcagcatgatttaagtaagacaagtacattatatggtctacctctcaattccatcgaatatttcacttatttcttgagaggagaaccattgtctgctagcaatgtcatcaaaggaatggagagttacaaagggtggcaggacatggagatgaacttattctggcttggtgtgggaggaggctgtttacttttattccatgttttcatgatattcttcctaagacacaggactgggagatcacctcaaggcagtttatcagttcctaggtttgagctctttcttctgatcctcatgctaccttgtctttctcagtcatcaacatttgtaataaaaggtcgtacaactgggggaattattactggggtgttgctactagcaatccctgtggcattcatcttatcagcattgctatttcttattattgcaatctacgcgggaagctttgcccaatacaaacaattcaaaaaaataaccaatgaagaaaaatggtacaccaagttattgttctgttttatcgggaggtctacaactgggaagtggtttaacagggaagggctaccttcctctttcctctcgcgctttggaattctctttgatgattggaagggtcctccagtgctcattttaggtgatcaaaatgaacagaataataccataaccaagtggagcgaaagtggcaaaagtgggaacggaagaacgaaaacagtgtgttcagaggacagtaatgaggaaatcaaaatctccacattcaagaaggtattgggctgcatgagagcatcctatatcatccttgacttactaagaagagttggtttgggaataatatctgtagcttacccatcagaaagctcaaacaaaagcctttttgcattgataatcacatcaatgcagttcatttatctattcactaccaaaccatacatcaatagaggcgtccatgttgtggaaagtgtttctctcttgtgtgagacaggtgtgtttagtatcttagtcctccacaatggttcacactcagttgaatccaaaacttgggaattggttatgctgtttcttctgatgtttaccttcattgctcagcttaccaatcaatggtatgctatggtaaattccctatggaaactctcacaaactcagaataactctttaagggatggagtaaagttagctgccaagggcctcatcctgcctttccttccaagcaagcattggtcgagcgtgatatcgacattctcccagccggagacgaaccagctttcagtcaatcctacatgctcaggaatagattttgaaagaagaaatagaaatggatatatggatccaattagcaccatgacggctacggtagtccccgtgcaaagtccaagcacacccaaccacaatgttgttgaaagaagagatcctacaacctgggagacaggtgcaagttcacatattgaagtggaaggtaaatggctaaaggggcacaaggctgggcttaagaaagagctaaggatgttgagggagcttgcaaaagctagcttctctggggataccaggtttgatgaagccagtactagctacactttaggggaacaacagcattcatctggtgaaatctatttgggtaatccaaagcgaagatattgctga

SEQ ID NO: 63528 - DNA, 228 bp, Glycine max
  Peptide Sequence Number=SeqID_155213
atgttgaacgtgtcaaccacagagagaaacttaggcttgtcaaccactgatacaaggaggagtgttgaacgtgcatcagcagttatttcaccagcaccacctgtgtttgatggtgacaattatcaaatcaggacaacgagaatggaggcacatctggaggcaaatgatctctgggaagctgttgaggaagactacgaagtcttcccttaccaactaatccaacaatga

SEQ ID NO: 63529 - DNA, 345 bp, Glycine max
  Peptide Sequence Number=SeqID_155214
atggtggcacctccaaactccatttctttagtagaccagtttaatgagatggtagcctggcccggaacccaaccttctcttcatagggaagacgaaggtcccacggcccaggtacctcagcatatggaggatgagtcatctgaggccaccatcccagagccatttgatataggagaagaggcagaggagacacagccttctgcaccaatggtaaacctaccctcgcctcagcctgcagcagaccccttcactcctcttctacagatgccagaggacccgactacaccagtcctagctgtggacacttctcctccaactactccagtgcttcagttgacagattag

SEQ ID NO: 63530 - DNA, 144 bp, Glycine max
  Peptide Sequence Number=SeqID_155215
atgggtgccaagtaccttgaagtggtcaaacgagggtcgcatcccaacaatggatggtccccggacgaaattaggggtcagtatgacagagattgtggggtggccgacaaaagcgaggctcttgctcctacgtatcctcaatga

SEQ ID NO: 63531 - DNA, 498 bp, Glycine max
  Peptide Sequence Number=SeqID_155216
atgcgagcggggaattctaatatctatggattccttaagccacagtccattcagaggtcaaggcaatcgcagtttgagactgaaagttacataaagagttggatgcagagttcaaaacgcgatgtctaccttggagcctacctgaatggcggacactggcagatggtggtcatcgtgcccaaggaacacctagttgtctggttttgttcattgcataacaggtcagacaactaccttaaggggataattaacagtgctttaaaaggttttgatgatgctccacaacctaaatcaaaggctcctgctaggtggattgtcgtcaagtgtaatagacaaaaaggaagtactgagtgcaactattatgtcatgtactggatgtccaccatcattttaggaagtttcaggaataactgggaagcgtattttaacgatcctagaccattggagccagagagattaaaggcgctgcgaatccagtgggcacagtattatctctga

SEQ ID NO: 63532 - DNA, 702 bp, Glycine max
  Peptide Sequence Number=SeqID_155217
atgcttgctttggttatgcatgacttgacagtagcaagtgaaggttcttctgaacctgaagcaggatggtttgatctatttagtagtcgatataggaaagtggtcagtgtaggagcaacacttttcttgctccagcagttggtaggaataaatacaacagtctattattcaacttctgttttccgcagtgctggaattgcttctgatgctgcagcaagtgcactggttggtgcatcaaatgtttttggcacaattgttgcttcgtccttgatggacaaaaaaggaaggaaacgtctccttatcacaagctttagtgggatgctgcattgtggtggaaggaaaatagaacattgtggtgctgttggcaggagggatgttagagatagggattggagggatagagaaactaggggttactgggagagggatatcaaaggattgcctcatattgaccagttccttaattcacctcatattgaccattggaatgtagttgttagaattttgaggtttatcaaaggatcgccttgggaagattactgtatgagaaccggggacataaagatattgtttcttattttgatgcagactggactagatctccttaggataggaggtacacctcagcatattgtgttctctctggggggaacctcatttcatggaaaagcaaggaacaaaatatgtaggaggaagtactaa

SEQ ID NO: 63533 - DNA, 495 bp, Glycine max
  Peptide Sequence Number=SeqID_155218
atgactaatgcaaactgtccgcaagaatcattgcattcagtctcaaacgggaatctaagggtttgtgtctgtgtcatgaaggggtgtgtgtttgtgattaggggggtgtgtgtgtgtatttttcatgagggtgtgtgtgtgtctatgacgaggcctagtagaaaacagggtccacagtatccacctatggttagacaaggctcatattatagcctcctcacccttgatgatgagggaagcctctccatagtattgtcgcaaccttcccttaggcgggagggcaacgcgagggctcacgggtgcgtcttccatgggaggaagatgcgcggagtttccaccaacgcttattcgaggaaaacgtcggaaaaaacggaaaggagtggtctacgaactttaagtgtgaaaggttcgggagttgtatttacgcatggggaagggtgtttcccttgctcctacgtattcctcaattgtgataaggaattcagacctacgtag

SEQ ID NO: 63534 - DNA, 684 bp, Glycine max
  Peptide Sequence Number=SeqID_155219
atgaataagttgcaaaaccaattggagaaagtcgagtctcttactcaagatcttgaagaagggcttgagtttctatttagaatattcctccagaaggctgttgcttctggaggaagcaaccctgctcgcctgggcgagctgggcggcaaccatctcccctattttgctataaataggggaggaaccgaggcgcttccgaaacgtttccgtaacgttttccgtgaagaatttcgcaaaggttttcgaccgttcttcgacgttcttcattcgttcttcatcgttcttcgatcttcaacggttgtggctgatactcatgaaaatgcaaagattgcagcaagaagatttcatgttgagtatgaagagctcctagccatcctttcaatacgggatgccgtcaatgctagaagggaagttcagatgggaggtcaggaacacttttatttggagccacatagcactttgatatggacagtggatggtggaaatgaagttcatatgatatcatctactcaagctcctcagaagaaccagaaatatgtttctcatgctcttggccttcccatgtcaaaggagacaagatcagcctttattgttgttgctgcttcagttcaatcttatctgttaaatcgaccagtgaaaatcacactagaccgagatgtggacatgatgataactgggcaatga

SEQ ID NO: 63535 - DNA, 312 bp, Glycine max
  Peptide Sequence Number=SeqID_155220
atgatgaacaaaacaaggccatgcaatgcatacttttatctagaggctaaaagcatcaatatatttgtacctcttgagatagaggaaagcactccagccgacgagtgcaactacgcatctaagtggaaggacggtggttcgagccttggaggtcgacgacgccagtggaacgatacgacggtcaccacaacactgccaacagaaaccaaaagtctaacaggatggaaaaaggctttgagttcagcaagtcatcataaaattgatgacgatgatgataactcagacaagtttcttgaagggatgtttttgtga

SEQ ID NO: 63536 - DNA, 738 bp, Glycine max
  Peptide Sequence Number=SeqID_155221
atgaagttgacctcgtccagttcaacggaagaaggggtagggcttcaatgtcaaagagatgaggtcaatgtcaaagaaaggagcaaggtgaacaaacatgcgagggttcaaagaaaggagcaagcagaaaggtcaacaaacacgctagggttcaaagaaaggagcaagctagcagaaagcattcttccaagaggttgcaactcctctttcatagcacttgtggttaaagtggaggacccacaatcattgggagaatttagaccaatctcattggtgggggtgttagagagctatgctaccataatgtattctaggctcattaaattgccctttacatatcttggaattcttgttggtgccaacccaaggaagatggagacttggaaccctatagtggataaaattacaaaaagattgcactctgggaagcacaaatctttgtcttttactggaaagggagaggaagatagcatggatcaagtggaggaagagtctttgaagtggtttgattccatggtgaagaggaagatggaacttgaggtggtggagagattgttttatgtgggaggaatatttgacatcgaaattgatgctcttgttaagtcgagtctcactacaattattgttcttccgggtactgtcactatgcattatttacaaccaaggggtgcatgttcaggaaaaattgcaagtgaggcgaattcagccgcttgtatcaaagcacttatgaagggataa

SEQ ID NO: 63537 - DNA, 393 bp, Glycine max
  Peptide Sequence Number=SeqID_155222
atggctcaaggaatctcaatgagaggtgtacctaggagcttacttaaatcagggccattggcaactagtagtactgtgtcctgcgatcaatgttgttgcatggttttgttcgttactgcaatgaagatagcaaacacaactgcgaatggtacaaataatcaagcaactcctaagtggattgaagtcaagagccatgttcaaagcggagggtatgagtgtggctattgcatgatgcattggatgtggaacatcgtcagtgggggtttaaagaatgattggagcatgtggtttcttgatggaacgacgttagacaaggaaacaaatgtgcagcatattttcttaaagttcaaagcaatcaatatggaaggatatcaagtaagggaatacccttag

SEQ ID NO: 63538 - DNA, 462 bp, Glycine max
  Peptide Sequence Number=SeqID_155223
atgccttttaggtggcatcgctttggttattggactgtactgtgtgctgtggggaaagagcagagagcaaatgccaaaagcctcgttagacttggaggagacatcatcagattttggccaaacttcttgcaatgccctgcatcatcagatttgaaagtcaataaaaaagacaggcatctaggttggggattgctttatcacgtttgcacacttaattactgtgttggtggtgagattttacatttaattgttacatctatctttgcttgtcatatgcttttatgtgtggctcattttctggaatcacgaggtatgatagaagatgctcttgaagtacctactgaccctgactacagatttgatctaccaatacaacttggaaaactagatgcaaagagtattgcaatagaattgcagagcgagcagcagttgggagaattagctatgtttactggaaattaa

SEQ ID NO: 63539 - DNA, 264 bp, Glycine max
  Peptide Sequence Number=SeqID_155224
atgaaaaataatatttgcctaaagaaaaagtacgtctccacaaccaaggatgacatcgacaaatatcctgtgcttttaaacatcaaatttgtagtcatatgcccccaacattgtaccaataatttttgggtaactaatcaagtcattcatctccacttggcttattcgcatggatatccccaagatgttgttggaccttgtggcctcaataatcttaagagggatagacttagaatgcagaagaagcaacaacaatcaatttaa

SEQ ID NO: 63540 - DNA, 279 bp, Glycine max
  Peptide Sequence Number=SeqID_155225
atgatgtatgtcgcaacctacccttcggcgggagggcgacgcgtgactcgcgagatgcgtgttccacgaaaggaatacgcacggagtcgccaccaacgtttatttgaggaaaacgtcggaaaaaccggaaaagacgcgatctacgaacttttaagtgaaaggctcgggagttgtatttacgcacggggaagggtgtttccctttgctcctacgtattcctcaattgtgatgaggaaatcagacctacgtagttctttcataacaaagtgtttgggttaa

SEQ ID NO: 63541 - DNA, 582 bp, Glycine max
  Peptide Sequence Number=SeqID_155226
atgggggagaagcttgccacccagctcgcccaggcgagcaagcttttgaattggcaagaggatccatcttcagccagtcaagaacaacatgaaccagaagtggtggacttgatccgatgggactcgcctggaatgggatctttggcatggcaatcaaatggcttagtcgttttcgaccgtttaaccacaaacattggaaaatacatagacaagaacaaaacccctactgccttagacttacccaatttgagcaaagaatcatggaaggtctacaaagggttggtcgaacaaggaaggaatctcatcatcgacgatggggaaacccaagatagtagctacgtcttgcaacgtgatggtcataaagctgaaagggaacacaaaagtgtttgttgcagtggaccaaaagtagaagaagctaaatatcaaagggtaatgctcgaggaaggtaacaatgtcgattacatcattagcacaagggcgaaggtgatgcaatcctatcccgcaagggcattgggtagaagactccaagtagattgggctagatatccaagggaaggccctagggttctcatgagccttagg

SEQ ID NO: 63542 - DNA, 1321 bp, Glycine max
  Peptide Sequence Number=SeqID_155227
atggttagaaccagaggtttagggcgtgccttatctagggttatagacaaaggctcgattagagaggatggtcatcatgaagatgatgttccccaacgtcgtaggcctaccgcatccgctcgtaggcaaagggtagatgttgcaattgttgaggatgttcctcaggtgactgaggatgttcttgagaggactgcgggcgtagatgctgtggacatagaaggcataactattgatggtgttgagggatcacctgctgatcatgctgagggatttcctggtgggccacgtgacccattggtccttacttcatttgctgaccatatggcacatagcatctggagtggacaggaacgacttgagttgaagttggtctcccatggtaggaaggttgataaatttgggaggccaacgcttgagatagaaggcctagtggtagcaaccggattaagtccattgatcgggtgttttgtagtcaccggtgatcctggacttatattcgcatttgtcgagaggtggcatagggagaccagcaccttccaccttccagtaggagagttcacgatcaccctggacggtgtggcggcactcctccatcttcccatcataggcgcgttacacagctttgagcctctgcttgtggacgaggcggtcttcttgttgatggagctgcttgaggtcttcaatgaggaggctagagctgagaccgtactggcgcatagggcatacagtgcaacacatgttcatgtggttcatctggagggtttccgagacctgggtcaaacaggggtctatgcttggggagctgcggcactggtgcacatgtatgaccagctaaatgaagcttgccagacccatacacgacagatggctgggtacttgactttattacagtgctggatatatgagcactttcctagtgtgcatcagtgcgtcactgatgatgcgtatgctgagacgaccccatgtgcctcccggggctttgacctgatttcctatttccagggtcaactgagatggggtcctattgtggtctttgttcaaccagagagggtggagataaacgataggtggatgcatttctcggaccatgtagcacctacgggtgagatttgtgttgtccctggacaggcaggtgatcagcccagacatccacttgccccacatgatgaggaatatgtcgagccacatatcccagaggttctagtggcatctgatctccctagacattcagtgaaaggttggagcgtgtgctctacctcaagatggtcactgaaggcacagagttacacgagatcatgcaagattgcctcaggatcgctag

SEQ ID NO: 63543 - DNA, 152 bp, Glycine max
  Peptide Sequence Number=SeqID_155228
atgggcccaattttgtcagaaccgcagaaacccctcatgggagaaaagaagctgatggttgagaagacaaagaaaaaactggagcaagctgctcaatccggaagcactgaggtcgtgattgatcctccatcttcaatcagacgagacatgaa

SEQ ID NO: 63544 - DNA, 300 bp, Glycine max
  Peptide Sequence Number=SeqID_155229
atggaggagttgattaacaaaacacaactctctcccaagtctaatttcaacgtcatcacgtcggctcggtggctccacaatagaatctcactttcggcaccctactgctgtcattctgctcccacgaacatagttcgcgatcatcacagtatttgtcgaggccacccaactgtgcaccataactcctccctcggtgatctgcctgggccacaagggagttccctatctggtgacacaccccctagtacaaagtacacactgccacagtttatactatttcccgtgtcatatgaggcatga

SEQ ID NO: 63545 - DNA, 237 bp, Glycine max
  Peptide Sequence Number=SeqID_155230
atgttgattgatgttggaaatgcattggcatgtggatgttgtgtatgttcgtggggggcaaagtgcactgaccttccatggtctttagcacttgctttgggccactgcactgaccttccatggtctttggcacttgctttgggccacattcatacgtcgtatgtagtgtacgttcatggggggtggagtgcactgaccttgtcggatggcccagacgtgggtgacaagcgtggttaa

SEQ ID NO: 63546 - DNA, 126 bp, Glycine max
  Peptide Sequence Number=SeqID_155231
atggcaaggagaatgatggggaagaagatgaatagtaacagcgagattgtgaagaaagcaaagaagaagaatgagagaatggaaacggaagttacaacaatacccttaaacaaatttgatgcataa

SEQ ID NO: 63547 - DNA, 615 bp, Glycine max
  Peptide Sequence Number=SeqID_155232
atgtttgatgaaaaaggggagaggatggtggtgctgaggaagaattgctcccatacctatcctggaagcatcgatttctatcacaaatgggacggagaagtctggttctgcactgattgtggaggtggccattgctgcacggcggtgtcccaaatactcgacttgttgagtggcaaaggagcatttggacagtttgaggacaaagctgttgtcggaaagaatctaaaagattttgtgcaagtgttccaggtgatcagaaaaggttttactatagaccaagatatcgtcgaagaagactataatgaagttccgcaaataaggcccaaaattggtgttcatagtttcctgaaaggaagaaagggcgttgcaaagcccaaacggcattaccagaaattcataatggccgtggagaaccggggaggagaaggggcttgtactaggacaaatgatgccattttgaagcatcgtattgacctgggattcaatttcctgcttctggaaatgggggtgaatggaatggttggtggtgcgggatggaggaagttgtgttggtggtcagaaaagggttgggaattggttgatgatggagaggatagtgggatgagtagttggtag

SEQ ID NO: 63548 - DNA, 534 bp, Glycine max
  Peptide Sequence Number=SeqID_155233
atggttcattcttttatcaaacacccactcctcccttcccttttgcttcttttatgttctgtgttttccttgtgttcagccagaacggtgaaaatacgcgacatttgctcaaaacacccgaagcctgacatttgtggcaaaattctactctcattacctggtgcagctgaagctgtggatcttcgcagcgcttccttgtatgtcatcaatgtggctcatggcaatgctactgagggtaagttccaaaccactcgtatcgcaagaggcgctggagaccctgaaacgagacaacgttacaatgcatgttctaaggattataccgatgtgttgctttcccttgctagggctaagaagtcttacagctctggaaattactccgacctgaaatccaatggcgcaattgtgatcaaagatgttcaagattgcgacacaaaggctactgattcaacctatgtcttgttgataaaccaggatgtggtagatacaagcaggatcattgtgattctagcagactatctggctgggaaatattga

SEQ ID NO: 63549 - DNA, 794 bp, Glycine max
  Peptide Sequence Number=SeqID_155234
gagaaattaggggtgtgcaacgggttggattgatcaagttcaagctagaaaaccagcctgaaatacaccttcagttagagagggttttgggttgggcgggtgctgagttcttagttcggttagagagggaacccttaaccttaaccgtggcaccaaatttggtgggagaggaggagggagttgatggctcgatgtggaagttggtggcgagtggcgacgctggtcagagagggatatggagatgtagacattggcgtggtggcaccgtggagatgccggttgctagggtgtttcaattaagggaaggaagaagtgagggtaagccttgggccttacccattctaatctatatcagggatgagggaagggatattaggtttcagttcacaagaagaagtcttagtcaagttcgcgcaggacaacaaagttattcctccgcgtcattggtgactacatcgatctcctttgtgttggagtacaagtgtgaggtgaagtcccacatagaagtggaaaggtctccttatatggtggctcgtggtctacaggtgtatccctcgaatctcatgtggaagagactcacacttgagggggagatgttggagtacaagtgtgaggtgaagtcccacatcgggtctccttatgtggtggctcatggtctaagggtgtacccctcgaatctccccaacactttgcctccatgctccctcgaccctcaacaatcattgagcttctccaaaaaaggttcgggtcaaacccgactcaacccaatcaaactcaaccagcatatgagttag

SEQ ID NO: 63550 - DNA, 501 bp, Glycine max
  Peptide Sequence Number=SeqID_155235
atggcgtttctggtgctctctagagctcctcctatggttgctctgttaggattcttgagagtcagagaaaaaggaatagaaataagcaaatggatggttgttatagaacccaggccttgtaaacctccaccaccaccacaaagaagaagtgacccagaaaatggaccatggacgggaataaaaaagaaatatccagaagaccctttctggaaagaaaagagaatggctgaaattcttagatggaatcatccatctttgaatattcctaagactgacaatgctagagctcataatcatctcttgaagaggatagatgagaagattgacaagatctatacccaagtaggcataagtgatgaaaatttacaatatctgtccgaaagggtgaagaagcaatatcatcaactttccaaagagatttctcatcttgaaaacgaatggaaaaagactatttttagtgcggtttcaaacgccaaagaaagagaaaaaaaggaggcttaa

SEQ ID NO: 63551 - DNA, 516 bp, Glycine max
  Peptide Sequence Number=SeqID_155236
atgttgtctcgtgggggttatgaatgtttagaaaagaagctgatggttgagaagacaaagaaaaaactggagcaagctgctcaatccggaagcactgaggtcgtgattgatcctccatctcccatcagacgacacatgaagtggaagatggcccgcaccaagaaaactggccagatgacatctgaggcagcaaaagaaattgctgagaagattgtgtcacagggttcctttgtcccccatggacgtcaagatgttgtgactactgccattgggcgaccagaataccctggtcatgtgcgtgatgctgaagccggtgtgacgatcaagcaatactatggaccgactccacggacctcccgcacttcttcctctatggctcccgaagaactagagcagttgactcaacagattagggaccagttggaggagtcgatcacaaaaaaaaatgactcgacagctgatgttatccttcagccagatgcaatcacaggaacttgcactgcctccgaagcctga

SEQ ID NO: 63552 - DNA, 375 bp, Glycine max
  Peptide Sequence Number=SeqID_155237
atgtcgacacggagggagaacaccaccctcaaaatgactgggatactcaacaccaacgaccaccatgatcgcagaacacagtctcccaacgcggaggaagaagatgacgctcacgacgggaacgcggcacggaggatcgagccaggggtacaaaggtattttttgcatcaactgctgggtgcaccaacaaaaatgctgggtgcacctagcagcactcctttggttgatgagagactcagcattaaaggaactgggcttccctttgggcttagccacaaccttcttggcatgcaccaacggaacccaatattgctgataacagtggaatccaaagtgagaatctttggtcaaattttggatatattttattcctga

SEQ ID NO: 63553 - DNA, 246 bp, Glycine max
  Peptide Sequence Number=SeqID_155238
gtggacgagagagagggggaaggtcacacgagggggagagggagggggaaggaggcagcggcggaggaagaagaaagaaagaaacagtgtataaggaaggagagagagatggagaggagggtcgcgaggctgcggaggggagggggagggggaggtagtgtgaagtggaagggatggggagggaggaaggagaaggtggaggccaggagaagaagaaagctcaggaaacaagaaggagaaggataa

SEQ ID NO: 63554 - DNA, 643 bp, Glycine max
  Peptide Sequence Number=SeqID_155239
tttggctccaaagaggactccccccgtaatagaaaataaaccactcggacacaggtggctgcgacgtggaaatcaacatattggcaatgatgatttaatagtttttcgtcgcaaattggatatcatgaaacgacatgagtttctgtgggagccttacatagcaatggttatgtcagcgttgcctccaatttgtctggttggaagtgtagcgtggtgcgtggtggtgccactcatttgtttccaagttgttgagtggcaccaacccgatagagttttgagacaatttggaatgcaacaacctattccagggtgtccttcgcaaccccagaatattcatggcggcctattgagttttaactccgactacatgatcgagtataggcaaaaaacgaagatgttcgttgatcctaaggatgcaaacacagctacattgagaatcactaagcctgtgtcacatggtccaccaccagagcatgaatttgcaccacaagagtttcatattctttcgtcaagtgttgaaactcaaggcataggcagacgaagggaggctatagaagtggaaccatatttctacccacagatggaaaaccatggccatggaatgtattacacaccaccaacattttctcagtatccgacatag

SEQ ID NO: 63555 - DNA, 363 bp, Glycine max
  Peptide Sequence Number=SeqID_155240
atgtgtcaaaaattagttattacaaggaaggagctacaactccctatggaggaaaaaaggaaattccttgtagaaggaagtcatgataaagaaattgagcttgatgaaactcaattaaccaatgaaacaactcaagactatgggatgaaaactgaaatacctttctttaatgttctgaagttaccacaaaggtcatcacctccagcaattgtggttcaagagccagctatagttcaagatcaagtttatcatgatgatgatgatccaagaatttatgaagaggctatgcgaagcttggattgtaagaaatggcaagaagctatggaatctgaaatggaatcaatgaagatcaacaaagtatga

SEQ ID NO: 63556 - DNA, 435 bp, Glycine max
  Peptide Sequence Number=SeqID_155241
gttgaggaggagcctcagttgcttgttgtctttgttgtgactgctgctgctgtattggaggaggaacatatggcttgcttggaccagcagcattttgaaaaggagggacaggctgttgttgttgtggaggacttgtccatctcaaaattggatgattcctctaacctggattgtatctattgcttgaaaggtcataattattctgctgttgttggttttgttgctgaggagattgctgcaaaaaaggacagagatctgtatggtgatctgcagaagaacatagaccacagactcttgcaacagatgaagatgaatctggtcatatcaccaagagctccaccattggcagcgtcagtcatactcctctccatggaagaatttctccaagaacaccctcttaaggttatcccagctgaaaatggacctgggagcaag

SEQ ID NO: 63557 - DNA, 282 bp, Glycine max
  Peptide Sequence Number=SeqID_155242
atgtcgtcactgccattgtctttgaacgatgtttgttgctttccttgcagccattccattggcaccaaagcactttttgctcttctttgtactcgcaatcacaaggaaagttgtactttgactatttcaagctttagataccctgagactaggctcaggccctttgatttgcgctatatcagagaacaaccaagtgagcctgcaaccctagttacaccgccaccatcaatagaacccaagccacaaccagtctctactccttcaccaaagaggatccattga

SEQ ID NO: 63558 - DNA, 165 bp, Glycine max
  Peptide Sequence Number=SeqID_155243
ggttttttgcggttccactggaggagaggggaatgggggcgaaggaagaatgtggcgttgggggcgatggtggcgccagggagaaggtggagaaagggtaatgggaagaggagagacgaggaggagaagaagacaacaagtgagtggaaagaggaacggacttga

SEQ ID NO: 63559 - DNA, 246 bp, Glycine max
  Peptide Sequence Number=SeqID_155244
atggcgtctcctctctctcttcctttctccattccgctgccattcatcttccaagaagcaaaggaatccattgatgaaaaagatcctaggcctacaagctccaatggagcttacatcagttttactctctgggaatgctctgggattacttcatctgggctttctaaaatggctccaaccccactgcttttttcatttgatgaaccatgcacatacaacttccaccataatatttttcttctataa

SEQ ID NO: 63560 - DNA, 426 bp, Glycine max
  Peptide Sequence Number=SeqID_155245
atgaagggaagaacgcataaatatgggtttaacaacaataaacgtgagaaggcagagaagataatgggttctccacctgcctccactcctcctcctcctcctccttcacctccttctcctcctcctcctacttcagacgcatcgacttcgccgtctgccgtgaagcggacacgcaaagcgtcacgtctacgatcgctgtccactagaccacctggtgctgagagaccagtggtgcatgttgatcctgctaccgggaaggccgacggtccccacaggaagaaattaagaacatatttggggattgtggcgcgtgataaggtggatgtcacctacgagaactggaaggaggtccctactgctcagaaggacctgatttgggaggatattcaagtatttttctttgcttatttgattttgtttaattaa

SEQ ID NO: 63561 - DNA, 576 bp, Glycine max
  Peptide Sequence Number=SeqID_155246
atgggaatcaaggtggctagggagatgaatctctatcatgttatttttgagatggactccatggactggaagccttccctttctcatgtctatagaaaggctaatcatagtgctaacttcttagctaatcttcgtcataatggttcctttgttatgactagggttctttctccccctcccttgttgcgtctcatccttgttgatgatgctcagggggttgtccttcctgcaggtaacatcggttttgtcaaaactgatgttaacgaggctattcttgcaaacccaccctcgtcattgccattgtccctgactccccacgctaagtctcgcaaagccaccctcaagtcgtcgtcgcgctctggtcgtgtttgttgtgacgctcaccatcgtgtcctgccattccattggcaccaaagcactctttgctcttctttgtactcgcaatcacaaggcttcaaataccctgagactaggctcaggccctttgatttgtgctatatcaaagctttaggagttgtacttgctatttctttcatccacaaaaggaacgttgcggaggatccattgaaatcttag

SEQ ID NO: 63562 - DNA, 234 bp, Glycine max
  Peptide Sequence Number=SeqID_155247
atgttgatctctggaggagcttacctctgggcagtaggaattttgattcctctgtattttcctttttacgttatcataatacacattgctattcccaattgttcctatcttttactgctaaattgttattccctgattgtggttcctaacaatctgacaatggagaagtccactcccaaagaacttgaatcaaaggttcctccgaaagacattcctaaggaggacaaacattaa

SEQ ID NO: 63563 - DNA, 324 bp, Glycine max
  Peptide Sequence Number=SeqID_155248
gattgtcatcatcaaaaaggggagattgtggaagcaatgccttccaagattattttgatgatgccaaagaatcaagaggcaagcaagtttcaagaatcaagattcaagaataatcaagatcaagattcaagatcaagattcaaagcgtacatctacttgggttgtgatactgagaacaagagaggttacatgtcttgtggatcagttcaagtggagcgtacatccacttggtttttcaaagagaacaagggaaggttattggaaatctcaagaataggcggttgcttggggactggatgtaggcacgggttgtggtcgaactag

SEQ ID NO: 63564 - DNA, 201 bp, Glycine max
  Peptide Sequence Number=SeqID_155249
atgttaaacgacgaacgcctaatgttaaaacgaaaggaagtacctcaatggataagacgatctccacaaacacgatctccacaatgtggttgcagtcacggaagcacaggcgactttgacacaaggagaaagaagaagaacgatagggttcaagctttgtctcatgggttttggtctatattcgataagttatttcaatag

SEQ ID NO: 63565 - DNA, 372 bp, Glycine max
  Peptide Sequence Number=SeqID_155250
atggcctgtgattccttagaggagcaggcctcacagggttcctttgtcgcccgtggacgtcaggatgtactagttgctgccattgagcgaccagaacaccatggtcgtgtgcgtgttgctggagaaaatgttgttatctggttttgttcgttgcacgataggccagacaacttcttgaaaggaattattaacagtgctttgaagggatttgacgatactccacaaagtaaatccaaggttgttgctaggtggattgttgttaaatgtaatagacaaaaaggaagaattgagtgtgggtattacgtcatgcactggatgtcaactataatcctaggaagtttcaagaataattggaaaatggtaattgtttga

SEQ ID NO: 63566 - DNA, 465 bp, Glycine max
  Peptide Sequence Number=SeqID_155251
atgcgacttagaactgcatctggagacgtggtccctattaacttagaaattgaagcttcttgtcggcgtaacaatgctgcaagaagaagaagggagcaagacacagaaggaagcagttacacctcatctcctctttctccaaatcacactcagatggacggggaaccaacacaaagagtcacactagaggacttctctaataccgccactcctcaattcttcacaagtattgcaaggccggaggttcaagcaactaacatctcctacctgcactctcttattcagttaatccaagggaacctcttaaatggtcttccaagtgaagatccatatgtgcatctagcctcatacatagaaatatgcaacaccgttaaaatcgccggagttccagaagatgtgatacgccttaacctcttctcttttttccctagcaggagaggcaaaacgatggttgcactcttttaa

SEQ ID NO: 63567 - DNA, 573 bp, Glycine max
  Peptide Sequence Number=SeqID_155252
atgtcattcgggttatgtaacgcactagccatatttcagaggtgcatgctagccattttttcagacatggtggagaagagcatcgagactaacttggacagaggacgacaaggtatttacaccatctattatgctagcaaggtcctgagccacaagatctcagccagagggattgaggttatgcaacccagaaaaggagatctagccattgtctttgccgcagaagttcaggtcatacttgatagggtcgaggaatttgacatcatcatcaaggagaagaaaggatccgagaatgtggtagccgatcatctatctcaattaaagaatgaaaaagtcaccaaggaagaaccagaggtaaaaggtgaatttcctgatgagtttcttttgcaggttaccgctagaccttggtttgcaggagatgcgtcacaaaggaggaagcacgaagcattctttggcactgccacagttcaccctatggcggtcaccacagtggggacagaacgacagcaaaagtgctacaatcagaaagcaccgccttctggagaacttcttggaaggcctaagtgggcctga

SEQ ID NO: 63568 - DNA, 198 bp, Glycine max
  Peptide Sequence Number=SeqID_155253
atggagttttaccaagacagctatgggtttctgcgggaaaggaaaaggctacgatgcgaagagtatttctctcagctcagacatgatatcgaaattcccaacggtgagaatgctcggaattgggttgcgaacctgatatttaaatttcatgacgatccaacgatgactgagtctgagatcgtcatttttctgagatag

SEQ ID NO: 63569 - DNA, 712 bp, Glycine max
  Peptide Sequence Number=SeqID_155254
atgcaaacatccaaaggaaaatctattgcactcaaagcttctcagaaagccaagcttaataagttgtccatggtactaagctcagtatcaaaattagaagttgaggatagtgatgataagttttcttataaagaagataaactaatactcctgacaagaagagtgcaaagaatgctcagaaaaagaaaaggatcaaataaattcttttctaagaggggatatcagcaaggagaaagctcaaaagagaaagtgagagcttggaagaaccaaaacaaagcagctctttcatggcaatggctaaaggttattgagattcgtcatgaaaaggtattagacttgtttaaggctattgatgaccaattcatcacttcagataaggctttagtaagcaccctgattttgaagttctcctctctccgactcattagtgtgaaaggtgtgtgtgagtacataatgcaaatgcaagatatttcagctcaccttaagaaactggaggaagaagaaaggcttgtaatggatatgggtgagagtgcattactaacaactgcttgtgggaagaacaaagcaactaagtctcaagctaatcagaaagggaatggtaaaataagacctcaagttgatattaagaaggtggcaaagtgtttcttttgtaagaagaagggacacatgaagaagaattgccccagattccagaaatggcttgagaagaaag

SEQ ID NO: 63570 - DNA, 288 bp, Glycine max
  Peptide Sequence Number=SeqID_155255
atgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttggctttagttcaagttgtaataagggcccaattggcaacctaggcatcagccttttgggagaccaaatggtggctgacttgttggctgttgggggtgacttttggttgccaacaatttcagttacactcagccattaa

SEQ ID NO: 63571 - DNA, 282 bp, Glycine max
  Peptide Sequence Number=SeqID_155256
atgaacattgtgtttggaatgaaatccaatctgacccttgatgcttgggacaaacccatgctggaaggccaagagaagttcggtgtctatgatcatatgtatttcctcggattttctgttttctgtaggtatccatcatattgcagaccaaacatatggcctagaaacgctttaccagaacttgaagtggctttcaaagcacttgggaaactgatatttgacattggattgatgttggcatatcactgcgatcaatatggtaagacaacaattgatatttaa

SEQ ID NO: 63572 - DNA, 237 bp, Glycine max
  Peptide Sequence Number=SeqID_155257
atgcggcaagaatatgaaggagatcagtggggtcctgatccaaggagaaagaggattgcaaagggtcgtcccgtttcaactcgcattcctactgagatggacgaagacgaaaatgaacgagcaagtagaaaaaaatgtggactttgccggcaacatggtcataacagaaataattgtcctaatgaagaagggaagtcggggtgccagaacccgacttccgtgaaaagcatgaactga

SEQ ID NO: 63573 - DNA, 639 bp, Glycine max
  Peptide Sequence Number=SeqID_155258
atgtggttgcaggatcaagtgcagaagcagaattcagagctatggctcaaggtgtttgagaaattggacagtgatcttatagccatcgaatacatcccttcaaagcttcagttggcagatatgttcaccaagggacttcccacggagcagcttcaagaccttacttgcaagctggaaatgatagatatacattcaccagttcacctagagactttagtcaaacccacaaacacaagtagttcttccttggcattctcaggtacttcccaagcctatgctctcagcgttctacaatctactgcacaagggacatgggttgttgatactggagctacagattgcatgacccattcctctactgaatttatctcatatagaccttgtcccaacaataaaaaaattgcaactgcagatggcacatttattatagttgttggaaagggagacattctcttgtgtcaggatttaattttgagagatgttttacatgatcagggaacgggaaagatgattggacttgttagggagaaaaatgggctctaccttcttgaggaagctcgtgggacatgtagcaataagagtcaacttccattgtctttgctgtcagagtcacctccttcccacaataaagacatctga

SEQ ID NO: 63574 - DNA, 291 bp, Glycine max
  Peptide Sequence Number=SeqID_155259
atggagctcattgttcaaatgaagggaagattgaagttgaatgttaccacaaccagtagtgggggtatgagaaccattagcaacagtgatgtgttggttaccataccagaagcattaaaggataggaagctagaactcttaccagccatggttagggaacaagagctagatgtcttactgaaagggtccataaaggctcgtagacgttccaatgacgacggcggaaggtggttgatgacgaaggacagcgtcaaatggcgactagtggtatacgcagtgactgggcattga

SEQ ID NO: 63575 - DNA, 844 bp, Glycine max
  Peptide Sequence Number=SeqID_155260
atggagaatgattgttggcagaaagctattgaaacagaactactagctcttgaagaaaatcaaacatgggatgttgttccatgtcctccatcaattaaacctcttggcagtaaaccagtgttgtcaaatggcggttatggcggcgccatgacagtatggcgtggcggatttttgataaaaggccaccaaatagcggtggcgttgcgggtttcaaatgacggcaccatggcggccgccataggtttaacggtggcggcggttatgacggaagaaatccctcttctactatctacaatggctgaaccatcatctattctaaggatacaagcaccattgtttgtaataacgagagccaaagaacacttggttgggaagtcggataacgttgcatcttgcaagaaaactccaccagatgtagtcaaagagctcaagggatatatggctaacaaaaagagtgggaccacttacagtagtactggtagtgatgagtttgaggactcttgcaatgctactgctttggccgcaaagacaaagtgtgagactaaaaaaggaccaatggacagccattggtcaatatgggccacattttccattccaagctatcatgatatcagagttccactcctgaagaagaaagttgaatacactgaaaatttgatgaaaagccacagggagcaatgggtcaagtatgctggtataatgtttttgaagtctgttgatggctctgattttgtgaagataggtgaaaagctttttgagttgcttgatgctattgtggaggaagttggagaagagaacgttgttcaagttgtaactgataatgggagcaactatgttttagcgg

SEQ ID NO: 63576 - DNA, 900 bp, Glycine max
  Peptide Sequence Number=SeqID_155261
atggctcaacgtaaaaatatctacaagattccttctggggcctggagagaaaaggacgaatataatgttaggatgacaatgatgcaatgtggcttaactgatcaatggctaagctatcctcccggtattcacatcagacgcaccaccaccatcaagttcatgcctgatcgaatagctccgaggttgccaccattggatcccacaaagaagaaaggcgagactattgcattaaagtctagtgttgagtttgatcaaaataatgccatgctcttttattttaaagacatgcaaggagacaatgagttttatcaatgcttaatccaagatactcctcctattcattctcggtttgtctttgactttcataagtactttaaagctacaatgagaaaagccattgtcattgcttgggcaaggaaacaagacaaagtaaactatcaattgatggagatgcaaaaagaggtcgatgttgttgaacctgcgctgactgaagttacttcacaacctccacaaattgttgaagataccttagcaactatcagcatttccaatacacctcgcgagatcactcctttgaccacctttgctccaactggtctgtctgaagagagaattcgtgtgccttcaacaggacaacctagaagagaccatgaaaaaaagaacactttggagtcttcactcaaatccttcaatgattttgtgctctttaacatgaatttgatggtggaacaaaggttgcctccattcatccaaacacccccgtcaccaccaactactattgtacaacctcatcctgaggttcctacacttgcaataactgttgatcttgtgctcgtgcctccgcatttgccaccaaagtcaccacctcccattcctcaacctctgtccactaaaggttga

SEQ ID NO: 63577 - DNA, 285 bp, Glycine max
  Peptide Sequence Number=SeqID_155262
atggccaaccaagataggtcaattgataatggtcatggtcaattcgtgagggtcgtggtcaaccaagaggaccatggtcaatccatactgacccaaggtttcaacgtcacttttggccacggctgtggtgaattcaccatggtcgtaagcgcaaagccagggatcactttgggttttgatcaagaaaacaaaaagatacaagggaaagggggcaaaagggtcattttgtggatttttctggacccaagctcgcccaggctagcatttggctcgcctgggccatga

SEQ ID NO: 63578 - DNA, 270 bp, Glycine max
  Peptide Sequence Number=SeqID_155263
atggcttgtcttgtcaagctgtctctatccctttttgatcttcaagttggcatcagagctggttctccggccaccatcgtcgccgccgccgtccgccgccagccgccgccgtccgccgccagccgccgccgtccgtcgcagccgccgtcaaattcgccggcaagttcagggttttgtgcgcctcgaggagcgcgacacaaccccgcaaaccgcgtggccagattcgctgccacgcgccgctctacagcagcgcctcttcccggtgcgtga

SEQ ID NO: 63579 - DNA, 1338 bp, Glycine max
  Peptide Sequence Number=SeqID_155264
atgggagtgaatgaaaatggaacagaagtgcagccaacacttgacaatcaatattcccagtcaaagccaagcttcagctccacaaatcaacccagtttctcaaagccacaccatcaggaaaatcaaacatcttactctgggttggttgatagcagagaagataagtctcaagaagaaacacctgcaataatctctgagctctttgaaggttttctaacaattggaactcttggtgcagaaacagtcaccaatgaaccaggaacaccaacatttgctatgccttcagaaaacataacatcgagaagtgaagaggtgacaggaaatgaactgaagctcataagttacgagcttgagaaatttcttgagactgaaaaagaagaaagtttgtatgattcatcaggaagaaacagctatgttagcattatcacacttagtgaaaaggaaatagatggacccaaagctgaagattacagaaacaaagctgtatgtccactgcaaggatatttactggggtcctcatttgaactaccagaaacaaaagaagtaaggaaagaaagagcatctcttgctgagctactttataagacaaagtcaacaagtcaagattgtatagacacaggaatacaaggagaaacacaagtcaagagaacacctaagtctgctgccatgcatattatgagaaagatattgaaaagggtccacagttcttcaaaaagctgtaacacttccaggaatgatgctgattctgcttcaaccaataaaaaactccaaaaggcaacaaactctgtttcttctgcttccgcttttccgagttcaatctcacagaaacttgatgatttgaatttctcactatggcgacagaaaattgagcctgtcatcaaatcctacaaacttcaaaggtttgttacgaatccgcaaattccgttacagctcctcactgaggtaggccgcgatgcagggattgagaatcctgcatatgaggcctgggaacagcaggatcagtcgatgcgtgagtttctgcttagaatcctagccatttccaactcacttgcctctgtcggaaatccaatttctcttcaggaacacattgatgctacacttgaaggccttctgcaagattattattcagtaatctcgattattgaaagcaaattccaacctcttcctattgaagaagttgaagcgttgcttttagctcacgaagctcgattgcggaattttcgaaaacacatctttgatttgcctttgactattgggaaaaatccaagtctcacatctgctagagatactgccaagatagagtatataagtgggggcaaccctcaccctataaactag

SEQ ID NO: 63580 - DNA, 333 bp, Glycine max
  Peptide Sequence Number=SeqID_155265
atgctggcaagaatccctcaagttgtggttgcgtgttgcatcccacttggttcaattcatatgttctggaggagactcagtttttcagaccaagggttatctgagcccgaggtgggcatcaaagacgtaatggaaacaatataccaaaaattcgaagaacttgatgtttgttgcaagtttactctaagaagtaaactttgggaaattgcacacactaatcagaattcgatgtgtcctcctccagcaaaggttaacacaaagggacatcgaagaaaactacgagtaggaacccaaggtcaacaaagtgcgatccatcttactgggagtatgtag

SEQ ID NO: 63581 - DNA, 348 bp, Glycine max
  Peptide Sequence Number=SeqID_155266
atgaccattattgtcaatgcagaagcttgtggttacgtgagcatgaactactaccaatatatagatgttgtttacacgaatgagcacatcttaaaagcatactccacacattggtggcctcttgggaatgaagcggcaattcctccttctgatgaggcatggacactaatccctgacccaactacaattcgtgcgaaaggtcggccaaaatcaacaaggagaaggaatgagatggattggctcgaaccatctgaccaccgacaaaaatgtagtagatgtggagcagaagggcacaataggcgccgatgtccaatacaatctgaccgtgggagtaattcatttaattga

SEQ ID NO: 63582 - DNA, 594 bp, Glycine max
  Peptide Sequence Number=SeqID_155267
gtcttccggaagtgcgcgtcttccggaattcttccggatgaaccacttcttccggaaagttcccggaagaggttttccgggagtcttccggaagaagtgttcttccggaagacgtttggttacttccggaagaacacttcttccagaaactttccggaaaaggttcttccggaacttccggaagaacccctaacgggtcttccggaagactccgtcgtcagccttttgcgccattttttccggcgtcctctcgtcttctcccctctcgtcttctaccctaaggttactatcctaaggttccattgctatgctaacaatgctgcatattacaagcaaagggtagggagggagactaacctgttcgcggagaagaagaagaaaaccttgccttgggcgcgcctcgcggagaagaaggaagttcacgaagaagataagaagaaccaggttcacggaagaggaagagaagacgaagctgttcgaacaaacagtgtcttccgggagactgagaacaaggagattgaagaagcttacaactcacaacgttcacatttcaagtgcctttgtatggaagacttaaagatagaaaaatggtga

SEQ ID NO: 63583 - DNA, 114 bp, Glycine max
  Peptide Sequence Number=SeqID_155268
atgtggctatggggtggtgccctggtgttgctcagtggatggagaggttgcggatttgagtggacgatgattctagtgttctattgtggtgattatggagtttgcagaagatga

SEQ ID NO: 63584 - DNA, 554 bp, Glycine max
  Peptide Sequence Number=SeqID_155269
atgctggaaagttttaaacaacaagaacaaatgtcagttctggaattgtacatagaaaaggatgtggctggtggttcaatgtttcattttgcaaattcgcttacatcatgtggaaattgtttatctaatgatgagacacaagcgccaacaaatatgagcaatttacatgttgacgaagatgatgatgattatcttgtgtctaactcatacgttgaagagtctttagatgaagatgacagtgttgacggtatatctgatacagacgatgaagtcaccgacatcattcaaccaataagaattgttcacccaacaaaaggtgtacaaggaattcaaaatccattttggaatgatgctttgcattataataatatcaactggagtcatcctgatgaagatgacatttgtggtttggagatgccatccagttttaatgttggccaagaattatatgttggcatggattttgatagtaaagatgtagtcaagaatgcagtcaaacaatatgttatgaaggtgcatcaaagtttcaaagtggttgaaagcaaatgggagaa

SEQ ID NO: 63585 - DNA, 605 bp, Glycine max
  Peptide Sequence Number=SeqID_155270
atggaggaagatggagatgatgtgctccaaatgagtggtagctggcttcccatgtggcttcttgcacccaacgagcttcttgggttgagcgatcttgacgcgttgagtgaggttgtcgtactgagtgcgattctccagctctttaatgctcttccatgccttctaacaggagaaactagtcatggctcaaatgtagttcaatacagtgtttccaaatgtcctattcaaaacatgatcaatgatgcttttgaatttgataggcaccatgcaaatgaagtacccattatatcaaatgcagatgttaacttggagaaagatgtgatgtcgaatgtaactcaagaagggcacaaagctagagagtactattacttaacaagagatggagaacaacctttgtatgaagggcaactaaggaatggtgcaaggagtacttatgaggttgacaagaaagtccatagagagtttgttccttggtttaacaatcgtattcgcaacaatctcgatagtcttagtgcactagataaagatgttctccttagtcttgcacaaggtccttttgacaaagttagaaggagttactctagcaataatgatgctgaaatgag

SEQ ID NO: 63586 - DNA, 1113 bp, Glycine max
  Peptide Sequence Number=SeqID_155271
atggccatggtgggtgcgaaacacagttttgcatatgtcgtcttcatgcagaatccaaatttggtggtatccttggagaaggtccaacttagagaaccagctcgtgccccccaattcatcaaggatttcatcaatggtggggataaggaagcgggacaaaaatggacttgtgctaggtctaataagccccttctgaagcatgggttcaacctgggtctcaatttcatgtttctggaaatgaggataacgatagggcttaacattgacaggcgcaaaattggggatgaggaggaatatggtgaaagtgagttcgggttgaaggtgttgcacaaagttgatatcgccctggaattcaaccaagcgtccattatgggagaatttcatggtgaagctgatatcctgaatcaaaatggtaatggcttcataaaggcggttacaggggaagtactgaccattacccaccataacgctcaacgaggggcttgtgtggcgtttcaggggccaaatgacccgcgagcgagtgaaaacttatttgggtcattgttgggtttggatggtctggtgggttgggtaaaggccccaaagcaagagtgtcttcctgagggggcaatggagttggatttgggaaaaaatgaccctgttgatgacgccgattatcaaccagcttttcctcctggagttttgctagccttgccgcctgaccaaagagaagtggaggtggaagaccaattatgcgattggccaaatattcaaactctgagagggcttgtgggaatgttggccatgactttcatggtatgcgaaaaattggttgaccttgaagatccaaccgagaggattggttccatcaaaccttggaacatccaatttaatacgatgagggatggtgaccgtggtcagagagggtatcgctgtggaggacgagggagaagggcttggaaaatcccgaggttgtattttgtgaataagctcatcaagcttaagggtcatattgttcagtctggtaaagcttgcatagtggtactgctattagaagcctttgactacatcgattatgctatggtaatcaaatgggtcaaattgaaaaaccttgagcatatcgggattggttaa

SEQ ID NO: 63587 - DNA, 213 bp, Glycine max
  Peptide Sequence Number=SeqID_155272
atggtgagccaaggaggacaatatggtgttggaggctttgagacggtgggaaaggaagaaactgtgataatgacggaggaaaaaggagcaacaatggtgacaattttagacggaggttccaaggagggaaatcttgggatatttgaaactaaggagatgcaatgccttgtcttgatgaatggaattgaagtgagtatttacaagacactctag

SEQ ID NO: 63588 - DNA, 432 bp, Glycine max
  Peptide Sequence Number=SeqID_155273
atgatagccaaccagacatcaccgaaatggtcgtccactgatgctaccaatgttcacactgatggtgaaccaactattcacattgagcacttcttctacatccacaagttagagaaagttggcctcaaacttcacgagaccctacttttttgtggtgcaagatgctactccaacgaaccacaactcatctacccagaactcataaggatgttctggacaacaagaccattgtttccaaggttgaagagtggaagaaagctagatcaagacaaaaagctaaagaggatactgccaagtgaatccactcaagctaagcaatctcatgaagtcaccttcatccaacaagaggttattatatactccactagctcaagcaatccaaaagatgttcctccaatcaactacgttgcccttgttgcactcactgagtaa

SEQ ID NO: 63589 - DNA, 342 bp, Glycine max
  Peptide Sequence Number=SeqID_155274
atggaaggatttatagccacacaaggagatgttgtggtcacacatgctggtgtcatggtcatgtggtggttgtcgatggcgaagaggcgaaacaagaacaaaggagatttactaggggggaaactgagaataaggagtaaccacggcgtgagaaaaaactttggcacagtgacggattttttgatcttgttaggtggctttgatattgttaactcatttggcaagtgcaccaaagttgtcacaagcaaaagtggaatgagcaacaacaatggattcttcaagtgtgatcggtggtgggtgtcatcgttggagaaagtggtggtcaaagaagatggtggctga

SEQ ID NO: 63590 - DNA, 165 bp, Glycine max
  Peptide Sequence Number=SeqID_155275
atggctaatacctccatgggtgcgggtggagaaaactcagtggagcattatacaaagataggaaaaaatgaactgagtcgagaattaaggaagaatatggaaaggcaaaaagatatgggagaaggaggtgaaggttttggatggaaaaatttgctggagaagtaa

SEQ ID NO: 63591 - DNA, 1248 bp, Glycine max
  Peptide Sequence Number=SeqID_155276
atggtaagaacaaaaggtttacctcgtgccttaggtagtggtataggcagaggcatgggtcgggatgaacatgatgttaatgtttctcggtgtcgtaggcctaccgcttctgcccgtaggcaacgggttcaggttgatgtcgctgaggaagttcctcaggtgactgaggatgttcctcctcaggtgactaaggatattcctgatgtgacagaggatgttcctcatgggtcacctgctgatcatgacgagggattccctggtgggccacgtgacacatcggtgttgacattgtttgccgaccatgtgcatatagtatctggagtggcgagtaggaaagttgataaattagggagtccagtgcctgagattgaaggccttgttgccggcaccagattaagtccattgatcgggtgttctgtggtcaccggcgatcctagacttatatccgcatttgcggagaggtggcatagggataccaacaccttccaccttccagtgggggagttgacgatcacactggacgatgtggcgtgtctcctccatcttcctatcacaggggcattacccaggtatccgacgaagaggcttgagctgagatcgtacgtgctcatggggcttacatgcgactgtcatggctccgtgagacctgggttagtctgggggctatgcctagggagttgccgcgctggttcacattgcgtcactgatgatgcgtacgttgagactaccccacgtgcgtcgaggtggcttacgacgaaggtgcacatgaaggggatcaagggggtgtcgtacagggcacatttagatgctctgacgatcacgaacatttcctggttgccctacagtgagcaccaggcattcgggtacatccagaccatcccttcgccgctggttactgcttcgttgtcgtatgaggagatagacgagaggtggatgcatttcggggaccatttagcacctgtgggtgagatttgtgttgtctccgggcaggaaggcgatgagcccagacagctagctgccctagatgtagatgcatatgtcgagccacatgtccttgaggttccagtcgcagctgatctccccagacattcagtggttgcttgtgaaggttgcgaagcgatcgcagaaaggttgaagcgtgtgctcaaccttaggatggtgactgcaggaacagagttacatgacatcatggaagatttcctgcggatcactaagggtgaggcctctaatggaagtcttagggcgtga

SEQ ID NO: 63592 - DNA, 135 bp, Glycine max
  Peptide Sequence Number=SeqID_155277
atggcaaaaactcaagctacagggctccaaatgagaacaaggttgaagatgaaaggaaggaaaaaatcactctttccggcgagggcaacacacaaaggttgtgaaagtcctttgatacagtcagggtgttcttga

SEQ ID NO: 63593 - DNA, 336 bp, Glycine max
  Peptide Sequence Number=SeqID_155278
atggccgtcgtgagccacctttacttgccgttgaacccccacaccaagaagaacactttaatcggagtggaattctcagaatcctcctcgaagattcgatggagaaaatccctcaatcctccatttcatagtttctctaaggttgtttttgcggcatgcactgaaccccggtcacattggcgtgatcggaatttcaaaaagatgtttttttctgtagaacccgaaatacccctcagccctttatgttttgacagtgagacttgcgttggaccgacaagtgcgaatgagagagagacctctaagtacgcaaagaagactggcaaaggctcacgatag

SEQ ID NO: 63594 - DNA, 630 bp, Glycine max
  Peptide Sequence Number=SeqID_155279
atggcttccaattggacaagtatcaatttgtttagggagttgctaggtgcacccagcaatattgctggtgcacccagcaatttattgaaaggtcaattttgcccttcatttaaaaacacaaaaaactttatccctctttcggaagcattctgtcttctctcttccgcgaaaaagcttttctcctctcttctctcttccgcgaaaaagcattctgtcttcttctcttcttctccgcgaggcttctccggcttcatcttctccgcgaggcttgtcttccatttgcattcgagggtaaaggacgccggaaaaaatggcggaagcttggtgacggtgagccttccggaagacccgttaggggttctttcggaacttccggaagaagatcttccggaagatttccggaagaagggttcttccgtaggtaatgaaacgacttccggaagaacagatcttccgaaaaactctcggaacacctcttccggaatgtttccggaagatgtacttgttccggaaacattccggaagagggttcttccggatgacctttcagaggttccggaagcactttccggaagagccttcttccggaattgttccggaagaagtacttcttccggaagtagtttttaa

SEQ ID NO: 63595 - DNA, 693 bp, Glycine max
  Peptide Sequence Number=SeqID_155280
atggagataccgaatgtcaatggtcttaacatacaagatgatgatggagatctagagttcaacattgctctagcaccaaaggatgtcatagattggtcactattggaaattactgaagtcaaatatggaattttcctttttcgattcttcttccacttggttgtccaacgaatactcaaaggtagaccttggagttttgacaaacacctcctaatccttggagtcattaaggaaggagccaatccaacaaccatccctttattcttggtccccttttggattcagatgcacaatctgcctttagggttcatgtctcaagaagttgggcaaagcatagatgagttttgtgaccatttctttgccatgccaatggatgatggaaccagacactggagttctgagttgtatacaatgataaccgaagaaagcgctgtgaaataccttcatggtggtagacatggcccttctgtggcagtgaccaaaacaaaaactattgcgacaataaatgcaataatgaggatggggaacagacaacaaatggaaatgagcctcatcagttggaactaccgaggcctaaacaacccaaacatagttcctgtcctaaatgacctagttcaagcttaccacttggaaatccttttcttttgtgagacacttgttcactcaaatcgtatcgaagacatcaaagttaag

SEQ ID NO: 63596 - DNA, 321 bp, Glycine max
  Peptide Sequence Number=SeqID_155281
atggttatcccaatcgccatagaagaagagactcgtgggatcttaagatccattgctactggcttatcaaatctcccatggtgcatattcgatgattttagtgatcttctctcacaggaagataaaattggtatccatgatcacccgaattggctcatcagaggcttcagagctgttgttttcaattcaaaccttcatgattttccaatagaagggaagatagaggaagcttgggagatgcgtgatgaccagtcaacaacaatctttgaaacacttcataaggagatgggtagcctcattgcacaagaagagatttactga

SEQ ID NO: 63597 - DNA, 831 bp, Glycine max
  Peptide Sequence Number=SeqID_155282
atggggagcgctacaccgcctacaccagggcgtggtttcgttttaaacgctgaaggagcgccctggaagctcttgaggaaggatctcactactttgctgcagacctggagcgtcttatcatattctaacctcgcccccacctgtcacacgtccgatcttaatatggacagggcgagaggagtggtcccatattcacttaccttcgagtccctgagccctgccattaatttggcatacattaggaagaactgttggaacccggattatcccaagatcaccttttcggggacccgcaaagctagggctcggggaccttcagacgcttctgctccttcttcttcttctgctacacctgctccagccccaataccagcaccctttggcacctccatgcagagctcagaccagatagtgctgatgctgcagagcctccaccatggcttatgcctggtgatgcaaagtatacatgacttggctcagcatcggcccattatgagcatgaaggcctttatggcccaggtgacctggacaggagttcggccttctcctctgggggaaggtaaggctcctacagcccaagagccacagccaaagccggaggcaacacctgaggccactccagaggagacaccagaggtcacccctgctaccacaccatctgaggcacctgaggatggagacggcgttgcaaacacagattatgttgcaaacatggtagcagcaaagagctcctgggatccctggcccactccagcactagatacatccttgccagcccaggatgcccactccacacctcaggatgattctacaccagtacagaaggactga

SEQ ID NO: 63598 - DNA, 183 bp, Glycine max
  Peptide Sequence Number=SeqID_155283
atgagaaaaaaggatggaggaatgagattcagaaaccttcatgctttcaacttggcaatgctagggaaaagctcaattggggcacaatccaagttttgtttgcgtagtatccatgcttcacaggtgatgctcaatgaaggaagaacatggagaattggaaatggaagggacattctaatatag

SEQ ID NO: 63599 - DNA, 2046 bp, Glycine max
  Peptide Sequence Number=SeqID_155284
atgatgaattcattgtgtggaagctcactgtccctcaagagtgagaacaacaactctagaaccaaactccaacaacccacttcttcaaatgactcagttttgcaatccaagaaaaacaatgccactcaatcctctggtgatctagaccaaaccagcctaaccccaccaagcctaaaccttccatcactcaaatttgacttagatggagatgtggaagttcaatcaccagatagttcaatgtgggaatctttttttgctgaccatatagatggtgatttcatgatctcttccccagtgaggaccccacaagcagcctcttcctacaattgcaactacaactatgctcagggaatgcaaggccagagtctctcagggtgttccccacctcgtttttcatcatcacaaattggagccttcaacagcagcagcagcctcaacaaagggaaaggactcagccccctccacagggtgttcaactcacccaacaatcagtacatgcagcatgttgagaacctctcactgccagcaatagaagagttcttggaggactaccaaaccaaggtgtcttcttctgatcacaacattacaagttcatctgagtgctttgacttgtcatctcatcaaatcccttcgtccattttggatggcttggcactgcacaattcctcgaggtaccatcgtggatcggtcgtcgacgaagaatcgacggtgcacggtggtggcggtggtggtggtggctcttctcagttgtcacaagagagtgacatctatcaccagatggggtccatggctagtgcttctctttcacaggctctacaacaagaacgctaccaagagaaacagcaaaagcaacaagcacaacaactgcaacaacaacaacggcagcaccagcaagagaatctgatggtgcctattccgatcgaaatcgagcaggagcaagacagcgggcttcaactggtgcacctgctcctggcttgcgcagaagcagtagccaaagaggaatacatgctcgcaagaaggtacctccaccacctcaaccgcgtcgtcacccccttaggcgattccatgcagcgcgtcgccgtctgcttcaccgactccctaagcgccaggctcaactccaccctcacacccaaacccgcaacgccgtccaaacccctaaccccctccaactccctcgaggtcctcaagatctaccagatcgtctaccaggcctgcccctacgtcaagttcgcccacttcactgccaaccaggccatcttcgaggctgtcgagatcgaagaacgcgtgcacgtcatcgatctcgacatcctccagggctaccagtggcctgctttcatgcaggccctcgcggcgcgcccagcgggcgcaccattcttaaggattactggagtgggtcccttgttagacgccgtccgtgaaaccggacggtgtctcacagagctggcccactccctacgtattccttttgagttccacgcggtcggggaacaacttgaagatctcaagccacacatgttaaaccgccgtgtcggggaggcgctggcggttaacgcggttaaccacctccaccgcgtcccaggcaaccacttgggcaatttgctgaccatgctacgtgaccaggcacctagcatagtaactctggtggagcaagaagctagccacaatggaccttactttctagggcgttttcttgaggccttgcattactactccgccattttcgactcattggacgccacttttccggcggaatccgcgcagcgggcgaaggtggagcagtacatattcgcgccggagatacggaacatcgtggcgtgcgagggggcggagaggttcgagaggcacgagaggttggagaagtggcggaagataatggaggggaaggggttcaagggggtggcgctgagtccgaacgcggtgactcagtcgaagatattgttgggattgtattcgtgtgaggggtataggttgacggaggataagggttgcttgttgcttgggtggcaggatagggccatcattgctgcgtctgcatggcggtgttga

SEQ ID NO: 63600 - DNA, 519 bp, Glycine max
  Peptide Sequence Number=SeqID_155285
atggctccttgttgcgcttataagacaaccatatttcaaatcaagtgtgggaagaccaagaaagaatcatccgtccgagttaatattagccagcatttggttagtgcgttggttgaacgttggagaacggagatacacacatttcattttccacatggagagacaaccactactttacagaatgtggccctacagttgagcttgaagattgatggattgccagtaaccggtttcatcaccgatgatatacgtgttgtttgtcagacattactaggggaaactccacctgataagtatcaacttcccgatgatgctgatgatgttgtcattacacaggatgctagagctcatatcatgatgattataggctgttgtttgatgctagatacattaggtgcaagagttcattttagtattagtatccttttttcgagctctagatcgggccgtgaagtcggactaaacaaaaattggtggatgtttgttgttgctacagtcatgggcgtgggaccacattaa

SEQ ID NO: 63601 - DNA, 390 bp, Glycine max
  Peptide Sequence Number=SeqID_155286
atgaagatagaaacaggacattcaagctctgctccatcaccatcaaggttaagcaccctcaatgagaaactggaaatggttcttgcaactctgcctaaattaacaaatgaagagcacaaacaatgctgcgaaatggccaagatcatgctgaaggtcgcggttccaccagatactattttaaacaccgttaacgctaaggaccagatttacggtggagttagtacatcatttgctgtgaggtggaaagacatacttggccgcttatggaatttcattgacaaggatggaaatttccataccattgtctacaatcatgatttggacaaaccaaccattgtagcagggtggacagtactaagagatttttatcacctgaccggagatcattaa

SEQ ID NO: 63602 - DNA, 147 bp, Glycine max
  Peptide Sequence Number=SeqID_155287
atgacagaagatgaagagaaagtgatcctaattgagtggacttatgactgctacactcaaggtactcttcatgtcttggttgaggatgacaaagagacattgaatgacatgaagtccttggaaaaattggtaatgattgccctatga

SEQ ID NO: 63603 - DNA, 480 bp, Glycine max
  Peptide Sequence Number=SeqID_155288
atggatcatgctatctttttagcttggccatggttaaaggctaaagtgaaagactttaatactagtttcaaccattgggcagcactttggtgccttgtaacttctatctctggtaccactggtactgggcaattcggtggatctgcactagtggatgagctccaggggcataatgccatactgaaggactgcatcgagcaattaacagccatagagtcatctagaactagtcttgtgtcactcttgagagaagctctcgaggatcaggaattcaagctgggtcaagtccgtagccagattcaggctgcagtaaaggagttgaaaatgtttttgcaagctgatcatcaaggcttgttaaacaaccttgagaacttgtatgcggttctgcctatggaaaatctcattcctcgtattctgagggttccaccaccaaatgctctagattcctgctcctacatgattgacacatcagctaagtga

SEQ ID NO: 63604 - DNA, 444 bp, Glycine max
  Peptide Sequence Number=SeqID_155289
atggcaagagtagcaaaagtggtcaggatcttggcacaagagttagatcgagtgaaacaaaacaggaatggggtggtagggataccaaggcagcacttggaggaaagagcaggagctttggtagataagggagaatggacttcattcattgatgttttagcactgttggtgtttgggatcgtactcttcccaaatgtagacgggctagtggatttagcagtgatcgacgtttttcttgcttatcaccacagcaaggaaagctcggtcattgctgttttggccgatgcctatgacacactcgacctgagatgcgaaaagagcaatgcgggaattgtctgttgtacacccactctttatgtagacctgtctgttccttacaaggtcatcgcatgtgtgccaagaaagaaaaagcaaattgggaggaactcttggcagatatggtag

SEQ ID NO: 63605 - DNA, 591 bp, Glycine max
  Peptide Sequence Number=SeqID_155290
atgaactttgctagtttatggatcatgactggtgcttcgagaatcagggatttgcctccagagcagttctgttgtcatggatttgttcttggaaagactgccgaggcaggttttgggaatgaaatgtacaaggtcttaactgctgcagcactgagtataatgttaaaccgaggcaaatatccttttggggattacatttgttattccaactttacctttaccatgaatgaagtaaaacatctgtggagacaaaatgattgtgaaagcaaatatgggaggcaactggttatgaggactgatgattttgaaaagccagctcaaacaaatgtcctctgtagcaattggaaggaatggaagcaacctatcatatgctcagtttttcttgaaaatatacactctcagatgaggattgctgcttttgatttatttggtgatccacaagttctgggatctcaaccaaatgtatttggagagctcttgagagttctcatatctccttcaaaagaagttgaagcagctgtcaattgggttattggtgatgaggagaatcctgacatctcattgcatatgcagatacttatgaataggtaa

SEQ ID NO: 63606 - DNA, 234 bp, Glycine max
  Peptide Sequence Number=SeqID_155291
atgcaggagacaagactcaaggaactttttgattgtattcctaccttggacgagcttcatgctctgggtggagagggttttaaggctgatatcattcttatggattcagagaaagataaaaagctatccatgttaaagaaattaattatggcattagttagaggattaaactctaatccagctacctcatgggaaattgtgacaatcactggaaatgttattggacaattctag

SEQ ID NO: 63607 - DNA, 402 bp, Glycine max
  Peptide Sequence Number=SeqID_155292
atggtaattgttgtgatatatcaactttgtgactcaggtaccattatgcctaagaaaaagggacgaggacaaccaaaaggatcgcaggcgaagaattgtcaagagagtgcccttggcaacttgaatagttgcattaatccatcaaatatggttgaagttgatcctggctgtgaagaaccagaagatgaagattttcatttatattgtttgtcagtgaggattgtacatgtcgtctatggggagttgatggtaaacaactacaagttattaaggaccacatgctcaaggaaagtatttatcatgttggagataagaaaccccataaggggtagtattgccccagttactatggctgctagagtccctaggactaactctgggatttcaagcttgttaagataa

SEQ ID NO: 63608 - DNA, 261 bp, Glycine max
  Peptide Sequence Number=SeqID_155293
atgattttcgcaaacaaagagaaaggggtttcaacgaagcagaggctaatttcgaagaataagtgtattggagagaaaagaaagaagaaagataagaaaaaatacgtacctgagattgagactgagatattagtgtgcgtgaggttgaggaatggccgaggaacaagctttgaggttgagggacagaatgtgcgtgaggtggggagagaatggatgaggaacaacacaatggctcagagaatgggtgagggccgggagtag

SEQ ID NO: 63609 - DNA, 156 bp, Glycine max
  Peptide Sequence Number=SeqID_155294
atggcagtgactgagagtgaatggaaagacacacaggttgcagtgacaatcgcggtagagacgaagtcctttgcgctcaacttcaatggcagtggtagcaagaagaaagaggaaaaaggagaaaaggctaaggtctgcgtgcgaggggcaaaatga

SEQ ID NO: 63610 - DNA, 990 bp, Glycine max
  Peptide Sequence Number=SeqID_155295
atggtattgttgttgtctccagggggtggtggcaagtttggcggtgtcgccgatgagaacgagggcggagcggatggaggtggagatgaggtcggagacggcgatgatggcgtcaaagggatggatttggaatttgagttaggggaaggagttggagagggtgcggttgaggagggaggaggaggtggcgcaactatggatttgtattttacttctcagaatgtgatcacatctcttaagcctatgagcttagttcgttcatatgctttagttgtgtggttgaatggtgaaatttatgtttttggtggtggaaatggttatgtttggtatgacacagttgaatcatacaatccagttcatgacagctggaccttgtgccgctctttgaaccagaagaaaggacgcttgtcaggagctgctctgaatgacaaactatttgttgttggtggtggcaatggagttgacagcttttcagatgttgagatgcttgagttagatattgggcgacatgtttcacttaaaattcttgcattgcataggtatgcacttggtggctttgatggtgacaaaatagttccaagtattgaagtgtttgatcctcgtcttggggcatggacgataggggaaccaatgaatcatcgtagggggtattctgctgttgtagttgtcaaggaatccatttatatgattggaggagttaaagtgtgcgagaacattgtagatacggaggagtataggaggacggagaggatggcggccatggagccgtggaggtatgagcttatcaagatgaatcattttaggggattatcacttggtattgttaagctattctctaagcagtgccacctttcacaattttcagcacctcttggaaccagagatgaccttgtgactaatttctcaaagttcttgccatcaagaagaggcatgttggccgggaaagaactattagagcctagaactcttgtcattgtgaaattcaagtga

SEQ ID NO: 63611 - DNA, 345 bp, Glycine max
  Peptide Sequence Number=SeqID_155296
atggaagaacacaaactgaacacaccaccagctacctctctcaacacaagcaaccaccttcttttttaccttcaacacacaaattttacaagcgcgacttggtccctctgcacttggctacgacctgagcagctgcaggtgctgcagcctatgcctgcagctctacaaacccaagtgcaggtgctgaagtcgctggtcaaaccagcgcttccatgcacctttggacgcgccaataggagctgcgatatgcagtcctttgtcgccagtcgcagtggcgacatgccacgtggctcgtccctgtcgaaggcgccatcagcactggcgccttgcatggctgatacgtaa

SEQ ID NO: 63612 - DNA, 669 bp, Glycine max
  Peptide Sequence Number=SeqID_155297
atgaggcgtaaaacaaagatgtttgtcgacccaaacaatgcaaacacagctgcattgggtgaagttgtggagactttacagtatatggtgtcaccacaagggaggaacacatggacagttgatgatctcgtgccttacgtggataagttggcgattatatcagaagagcaagagagagtcactgagccagtgtcacatggttcagcatcagagcgtgaattcccagcacaagagtttcacattcttcagtcaagtgttgaaactcggggcttaggcagacgaagggagcctattgaagtggagcaatattctcaacaaatgatggagcgtggtcatggaatgtattacacgccagcaacattttccgaatatccttcacagatgtatcagtatccttttgaaggtcatcacactgatacttctgcgagcgaacattcattcggtggtgttgcggaaacacaagctcatttttcatggcccactatgactccttcgcagcagcacgatgcccccatggcaacacctaacgccccatttgctccgcaatggaatgtacccggagcaatacctgatatgggcgacttattaggtgttgatttgcgtcaggagttttctgttgagctgagcaagcagaagcggggagacaacgcggcagaagaaatcctgatc

SEQ ID NO: 63613 - DNA, 754 bp, Glycine max
  Peptide Sequence Number=SeqID_155298
atgggagacataatcaagaccaaagcaaaagttgtagaagatcttacacatgttaggcatgaccacaacaagttgaacgacaaagagatgtggcaaatttctcactttagtctgcttggaaatttcatgcaaagcgcctcactcaggcacgcgacacgtggctgtgtcgcctctgccaatggcgacagcactggtatcgccacctgcaatggcgctttggccatgcagggtggagtcgctggtcaaaccagcgctttacccctagcctgtagcagcagctttttgcagaaagtgaaagcgccattagtgttggcgaggtcacctgaaaacgccagatcctttggcgatttagggatgaattcggttataacaatgttgtatttcaatggaagggtatatgaagataatgatggtataatatttgaaggaagtaaaaaagcgattcagattaaacgtggaattagtttcaatgctttgaagaaaaaaattggagataaggatgtcgctggtggttcaatgtttcattctgcaaattcacttacatcatgtggaaattatttatctaatgatgagacacaaccggcaacaaatatgagcaatttacatattgatgaagacgatgatgattatcttgtgtctaactcatacgttgaagagtctgtagacgaagatgacagtgttgacggtatatctgaaacaaacgatgaagtcaccgacattcctcaaccagtaagaattgttcacccagcaaaag

SEQ ID NO: 63614 - DNA, 231 bp, Glycine max
  Peptide Sequence Number=SeqID_155299
atggcagcggaatggagaagcaaaagagagaggagacgccacttcaaggagaagatgagtctagaagaagctcaccatcataggaggccatggataagagcttggaggaagaaggagatgaatgaagggagaggaaaagaagagcacgaaattttgtgctctaaaagagctctgaaatctgaacccactaattcaagatcaagtccaacattctccgctaagtgtgcttag

SEQ ID NO: 63615 - DNA, 300 bp, Glycine max
  Peptide Sequence Number=SeqID_155300
atgcctctcttggagaacataacgaagatgccaaaagcaatcgaagcccttgaattgggagcagagaacgtggagcagcaagtccaattcgttgttgttgatccgaaccctgatccagctcgagcattgaggaggctatttcgcggaggcggctctcgttgtcacgaaatgacaacgaagtcgataggaaagtgtggggtgaggcggaggagggcagccgaggcggagagaggtggtggcggaggtgacccaggtgagggggcaagtgaagatgggcgaaggtttgggaatgttgagtga

SEQ ID NO: 63616 - DNA, 360 bp, Glycine max
  Peptide Sequence Number=SeqID_155301
atgaaggttcgtgttgctgaagcggagccatttgggggtgtcgatagtggcgtagaagggaaggaggaaggggtggtcgagctccgtgtgcttgaccttggcgatgaatgtgataggaggggaaaagccgagcggcgcctggggaagaacgcctggggcttgctattatcggggaggtgggcggcagcaatggtaagcggagccatcaagggtgcggggtgttgcggcatgagtgtggggcgtggtggcggagttggcatgggcgacggagttggcacgggaggtggagttggcatggatgtgtgtgtgaggagtgccttcgcagaggaagaagatggaggtgcgagtgagtggtgttga

SEQ ID NO: 63617 - DNA, 429 bp, Glycine max
  Peptide Sequence Number=SeqID_155302
atgtgtatgggttaccgtatagggcgtctccgcgtgccaacggactcttgggtcacggcgaggatgggcattttcaccctaggtcaaggtttatggcattcatcattatgggtgttcgggaaaattttcacagcattcacccttcaggtcgtgcggatgagggcacacacggcctacccatgtcaaaccacaaagcaaacggagaagattgcaatggtaagtcacaacaaaagcaatgacaaaataactgagagccgtaatgccaggtatcaaaccctaatttcgtccagggaccattgtttgatggcatgcaactttcgcttgaccacttcgaggaacttgacacccatcgttaagcaatccgtgaagttctgcgacatgtcgggagtcgaaaggaaacattattgcgcaatccgtaaagttccgtaa

SEQ ID NO: 63618 - DNA, 732 bp, Glycine max
  Peptide Sequence Number=SeqID_155303
atggctccaaaaaagctttccacgaagaggtctaggagagacgccgcggcggaagggtccagtgccgcccccgagtttgatagccactgtttccggagcaccgagcaccagcagcgcttcgaggccatcaaaggatggcattggacgtcactggtgactcccatggctaagtttgaccctgaggtagtcctggagttttatgctaatgcttggcccacaaaggagggagtgcgagacatgagttcatgggtaaggggtcagtggattccctttgacgcagacgccctcagccagttcctgggtgacccgctagtgttggaggaaggccaacagtgcgagtttagccagacgaggaaccgggctgacgggttcgacgaggaggtcattgcccagctgttatgcacaccggggcaggatttcgcccagaccactgcagggatgcgggtgattgctgacgccatctatttgtttgcaggtatgccacccaccaggcaccttctagacccggataagtctaacagggccctggggttttcggcattgatcacgggcctctgccaatcgttcaggggtgacgcacctcagggcacggccgcaccgccaccacctcatcaggccggtcccgctggatcactaggcatgaagcgttatctacagcacttggttcgccagcaggcagccaaccaccgtggactggtgcagatacacgagtgtctctaccattcagccgca

SEQ ID NO: 63619 - DNA, 258 bp, Glycine max
  Peptide Sequence Number=SeqID_155304
atggcagctacctatgctagaggcatttccaaaagggaactcaaagaattaacgcaacctaggcctagagccatcctctacaactccccatctcaacaaaacaatcacgaattcaaggataaaattgcttctcggatttttgcaatgcaaaatgggaagcaaaaaaccaacaattggaagttgggggctgctattcttgctgtttccatgagcaatgggggggtgctcacccaggcgagtgatcgaggccgtacctga

SEQ ID NO: 63620 - DNA, 135 bp, Glycine max
  Peptide Sequence Number=SeqID_155305
atggaagcagccaatggcggcggcacggaggaaaccaatgaagaggaaccaggaagacgaacgcgcagggtgaagaagaggaaccaagaagacaaaggcacaggcaataatgcggttaatttaataggaggatga

SEQ ID NO: 63621 - DNA, 291 bp, Glycine max
  Peptide Sequence Number=SeqID_155306
atgtctaaggccaatctctctcggttgagaagtgaccctgtaaggattgctgctttctgcttcaagaacctgaagagaactgaggtccttgatactgacatttcttcagctgttgaaagttcttgtttttctgctattggtgtgttttttatgcagaagaatggtgatggggggagatggtttgggaaattggtcggaaaaggggcagttttggctgggaatggtgttgaccctcttggcaagaaaaatatagctgttatggtaaaatacgatgaaacttctatggcttga

SEQ ID NO: 63622 - DNA, 891 bp, Glycine max
  Peptide Sequence Number=SeqID_155307
atggggtgcaagtggatcttcaagaagaaatctagattgtccactgaagaagtcatccattataaagcacgtttggtagctaagggctacattcggaaggaagaagtgatctacatcgagatattctctctaaaacatagtgagcaaagggaggtttggagtgtgcatgatgatgaaggtgatgaaaggtgggagattatcgttggaaggtatggaagactcaaagagatgttcattgtagaaaaaagaattattgagggcgtagatatgactttgtgcgcttttttggtgttgaaattcctagaagccttgagaaagaattgggatcgtatacatattggtgacagaaaaatctttgtcaatctgccaaagtataaaatagactgtgtctccaaacaaaatggtaacacgaaaggaaggggaaagcaagtgtcgcaaaatgcaaggatgcaggtgactgagactcgtcacaaacatgttcaagatcaaaacaggaaagtttttgtaagacaaagggataggtcaggcacaagaggagtgtggagagtaaagggtggacaaaagcatattgacagggaagatgagttgaaagggatgctttatgtcatggacgtgtgggaggaaatccaattgaagtatatggggggagttggtgctaatcttgggatgtggatgaagctaccaagtcctggtcgagggatggttgaagaaacgactcttgtcgtgaatcattgtggttgtaggtggggtgaagatatctcggaagaagatgagtcctcaaatggaaatgagataggccttgacattggattgcaaagatctgagttctcaacaggggatagtaatgaaggatggaaactaggggaggatggcggtctagggaagggttga

SEQ ID NO: 63623 - DNA, 165 bp, Glycine max
  Peptide Sequence Number=SeqID_155308
atgtccctagtggagtcgccaactgtcgcaacctaccatttggcgggagggcgatgcaagactcacgggtgcgtcttccaagaaaggaagatgtgcggagtcaccaccaacgtttatttgaggaaaacgtcggaaaaatcggaaaggtgtagtgtacgaacttga

SEQ ID NO: 63624 - DNA, 810 bp, Glycine max
  Peptide Sequence Number=SeqID_155309
atggctcttggtctatccttggtattttacgaatttgcatgtcatgcttgctctttgtccctcattttgcatgtgacaacatatgcacaccaggtgtttgatgaaatgccacaatggttagactatgttctcttgcagcctgggtttttcgctaaaggtcttgacttgggactttttgacccatttaaggatgtgaaggatggtgaactgcttgatgaggaagacattgctactggggaggaagatgctggcgaagaagaagatgatggggctaatgaaatagggaacaagataatatttgatcatctctggtttaatctcaacctggttaaaggtcttgctaatcaacttggcataccaagggcaggccttgggtttgacgagccttggaaattcttcgaggctcaccaagggcagaccttgggctcactaaaggcggaacttgggtttgacgagcctttggagattcttcgaggctcaccaagggtagaccttaggtttgacgagccttggagatttgtcgaggctcaccaagagcggaccttaggtttgatgaggccttggagattcgtcagggctcatcaagggtggaccttcggtttgacgagccttggagattcatcaaggatcaccgagggctcaccaagggcggaccatgggtttgacaagttcttggagattcgtcagggctcaccaagggcagacgatgggtttgacaagccttggagattcgtcaaggctcaccaagggcagaccttgggtttgacgagccttggagattcatcgacgcttaccaagggcaaaccttga

SEQ ID NO: 63625 - DNA, 318 bp, Glycine max
  Peptide Sequence Number=SeqID_155310
atggggttgaaccaagcgcagacttttaagaaaaggttttatcatgtcaaggttaaacgtcagttttttagcaaggtatatgaaatgatttgggatttggaaatgatagacatgttagttgaagccattgcatctcttacccgatactgtgaccaatcgctcagatgcttcacttttggggactttcagttagcaccaaccattgaggagttcgaggggatcttaggatgtccgataagaggaaggaagccatacctcttttttggatactacctttctatggcgagagtagcgggagtagtcaggatctcggaatga

SEQ ID NO: 63626 - DNA, 264 bp, Glycine max
  Peptide Sequence Number=SeqID_155311
atggcgtccaagcgaaaacaagcagcagccgggctcgcggggaagaagacgggcttgcggagaagagaagacgcagaggctcgcggaagaggaaagagaagcagcaacaagaagaggcgtgaatgtgaagaaactgaaatgggggtagtccacattggatcagtaaggagggagaagggaagaaactggaacggcagtagtccacattggatcaataaggaggaaggaaggaagaaagataaagaaaactgcaactttatttga

SEQ ID NO: 63627 - DNA, 1602 bp, Glycine max
  Peptide Sequence Number=SeqID_155312
atgccggaagaaacgacgtcgatcgactacgtgatggaggcggcatctgggccccacttctccggcctgagacttgacggccgtatgccgtcctccgccaccgccgccgccgcgtcctcctctgccgattctaccctaacccccgatttcctccccaatcaacccttcgtcataggtgtttcgggaggtactgcctcgggaaaaaccaccgtctgcgacatgataattcagcaacttcacgatcaccgcgttgttctcgtcaatcaggactcgttttatcgcgggttgaatcctgaagagttggaacgcgttcacgagtacaatttcgaccaccctgatgcttttgacacggagcagttgttagagtgcacgatgaagcttatcagtggccagggcgtgcatgttcccatttacgacttcaagaagcaccaacgctcttccgatagttttcgccaggtgaatgcttctgatgtgattatattggaggggattcttgtgttccacgatcagcgcgtgcgggatctgatgaacatgaagatctttgttgacacagatgctgatgtgagacttgctcgtagaattaggcgtgacacaatggagagaggcagggatataaactctgttcttgaacagtatgcaaaatttgttaagcctgcatttgatgattttgttctaccatcaaaaaagtacgctgacgtgatcattcctcgtggaggtgataatcatgttgccattgatttgattgtgcaacatatccgtacaaagctcggccaacatgatctatgcaaaatatatccaaatgcctatgttattcagtctacattccaggagttagaaactgagaataatccaatgttgttaatggcggatggcggatgtggggtcgtgtgcgtactgtatctccttcatggggtggtggtcgtgtgccggtgtgcgttgccttcgcggggtcgtgcaggtgcggggtcatcgctgctgggtgcggggtcgtcgccgctggtcgttgctgggtgcggggtggtgcgtgcgggttgtgctgctgtgttctgtgctgtgtgttctcccgctgtgcttttgcacttcaatttcaggggaatgcatacgttgattcgtgaccgagacatatcaaagcatgatttcgtattttattcagatcgacttatacgcctggttgttgagcatggtctaggtcatctgcctttcaccgaaaagcaagtggttactcccacagatttatgctttgtgaactgcaacatgtctgggaaagaagtgacagatcgacagtgggtcacaaatggaggatctgtttataccggtgttgatttctgcaaaaaattgtgtggtgtttcaattgttcgaagtggtgagagcatggaaaatgcacttcgtgcatgttgcaaaggtattaaaattggtaaaattttgattcaccgggatggagacaatggaaaacaggctcctgagggaatccactgcgtgtgtaaaaggtttccatcattgaagattgtcacgtctgagattgacattgaaataaacgaagagtatcgtgttatcccaggattgggggaatttggtgatcgatactttggtaccgatgattga

SEQ ID NO: 63628 - DNA, 378 bp, Glycine max
  Peptide Sequence Number=SeqID_155313
atggctccaaagaagcttttatgtaagaaagcaaggaaagaggctgttggagagggatccagtgcggccccacaagtggatatggagtttgacggacatcagttccaaagcgaggaacaccaacgtcattttgaagcaatcaagggttggtctttcctcaaggagagacaggtccaattgaaggaaggagaatatgtttatttccaggagaggaaagggtcagggataagcgctcctgggtgcgggaccaatggatcccctttgatgaagatgccattaatcagtttttggggcatccgttggtcctggaagagggacaatgttgtgagttcagtcagagaaggagctaggcctcgggatttgatgaggaggccatag

SEQ ID NO: 63629 - DNA, 123 bp, Glycine max
  Peptide Sequence Number=SeqID_155314
atggaaaataataagacatgccaatccatagtaggatcaaaggagatgaaagaaaatgcgaaaaatgaaagcaaaaatgcacaatggaggcttggggctgctgccaaagggtggctcccgtaa

SEQ ID NO: 63630 - DNA, 351 bp, Glycine max
  Peptide Sequence Number=SeqID_155315
atggctgctttcatcaagcaatatcaatacaacaccgacatggctcctgatagaacccaattacaaaacatgtgcaagaaggagcatgagtccttcaaagagtatgcccaaaggattgaggtgggcttgagaaggggaaagttagattatgccgctttcgcaagcacaagaaataggaggttcgaagcaggtggagccaaggagaaggagggagacacccatgctgtaacttcaactcccacatggcctaaatcccaacaaacccctcataaccccactaaccaatattccccgctgatcgaggccgtacccaaatcaaataaacatgaaaatgcaataactaggaagtga

SEQ ID NO: 63631 - DNA, 393 bp, Glycine max
  Peptide Sequence Number=SeqID_155316
atggggcagcaaccaggaactcaagcttcgaagggccgaaagggacgagtcaagagtggaaagtttaatgttagagcacaagttgaaggcttgtcaaaggtcgaagagaagtttgaccgagcagctgaactagaggaagagcatgcaaaggtatcatctctacaagtggaaagggaggcaagacagagagtgatagaatcgttgcacggtgaagctgtgaaatggatggatagattcactctcactctgaatgggagtcaagagcttccgaagctgctagccaaagccaaagtaatggcgggcgtatactcagcttccgaggaagttcatgggctttttgagtattgtcagcatatgatcgagttgatgtctcacataattaggaaccgctga

SEQ ID NO: 63632 - DNA, 261 bp, Glycine max
  Peptide Sequence Number=SeqID_155317
atgaaagtgtatgatgatgtcgtgatttatgcaaatgcaatgcatgaatatgatgcaggaatgatacacctattacaatgctataaagagatgcatgatgcaatcaaggaatatgccagaggactatcagcaacaatgcaacaccaaaagagaaaaactctagatgaggcttcactgttatcaagcgagtcggagactcatcatgaccacagatcgacctccactccttatggctcacatagacccgggtgtagggcctaa

SEQ ID NO: 63633 - DNA, 330 bp, Glycine max
  Peptide Sequence Number=SeqID_155318
atgagtttggatgctgcttatgggggtaacctcattttaaaaccccttattgatgccatcaaaatcattaaagatatgtgttctaacccctaccacaacttaagggatatgagcattataaagagaggcgtcaaccaggtggagatagatgaatcccatactaaattggaaaagaaattgggaaatattcattcacagcctaaaccaaatcctaagaagaaggatatcaatgttgtgatgacaagaagcaagaggatcaaagaaaactctgaggagaatgaaggttcttctccaaaagatgcagatgacatcctcactaaagagaactaa

SEQ ID NO: 63634 - DNA, 186 bp, Glycine max
  Peptide Sequence Number=SeqID_155319
atggattgtcatcataaaaaagggggagattgtggaagcaatgtcttccaagattattttgatgatgccaaagaatcaagagtcaaacaagtttcaagaatcaagatcaagattcaagattcaagaataatcaaaatcatgattcaagattcaagtaaagaatcaagacttaagattcaagaataa

SEQ ID NO: 63635 - DNA, 400 bp, Glycine max
  Peptide Sequence Number=SeqID_155320
atggacagagacaggttggtttatggcttggtaacccacatggatatgaacatcggcgccctgaccccaagtcaaatctcttctattgctcagagtaactcctctaggcttggatttccaaccttgatcactgccctctgtagagctagaggagttatctgtgacagtctgacttatgagagcctgagcctagccattaatttggcctacattaagaaaaactattggaatatggatgatctgacagttaacttcagaggggcaaggaaggcaagggctcgactagctgatgttccttcttcttctactccaccagctcctcccacatatgctactcctacaccagctcctccaggcccatctgcccaggactctcagtgctttgagtccatgcttctga

SEQ ID NO: 63636 - DNA, 108 bp, Glycine max
  Peptide Sequence Number=SeqID_155321
atgacagaacttgttaagttccataaagatgttgaatccgttcttgagaatctaactgatgattcacaaattggtagttgttggatcaagtggcctcagaataattaa

SEQ ID NO: 63637 - DNA, 924 bp, Glycine max
  Peptide Sequence Number=SeqID_155322
atgacatgtgctatacttgttgtagttgcaagggaattttctggttgttttgcaagtgaggttgaggaatggaggtcaatctgtggtcatgttgggtctccaactcgcttgataacagtgaagcctcatctagagttttcttcttttggtgatgcattgccgctggtagtccctattgtcacagtgttattacctaataggatgatatctctagagccagcttgtgaaagttggggcagcaaatggatcagattcaacgtcaatcttttagcaagtatatggaaagatctgggatctgacaatgatagaattggcaccgagcttaaaggagttcaaggggatctaaggatgcccgatagaaggaaggaagccatacctcttttctgggaatggagtagtgggtataccgaggaagtgcttggaggagaaggcaaaaaccatggcaagccaatgagagtggcgattgatgcctttcttgcttatcaccacaacaaggaaagcccagttgttgctgtgttggtagatatgtatgatgcattcgacctgagatgtgagaagagtagtcattgcatgtgtttgggaaaagacaaagtatattgggaagagttcctagcaagtgtgatggggttgtccattagttggttctcacggtggaaagaaggggtagtaggagtattgtgctcaggtgcgccattggaggaaaccatcatgcctttcattgcacgaggattcagtgaagctaatacggagatacttcaaaagatccgtcaggcatggaataaggtggaaagggaagataaagagcttagaggaagaagcaacagtgtcataggcgagacagaggagtccgaggaaagcgaagaggtgcgagtcttgaaggctgagctggaaaagacaaaagtggcaaaggagaagctaaaggtg

SEQ ID NO: 63638 - DNA, 552 bp, Glycine max
  Peptide Sequence Number=SeqID_155323
atgtatgatggggtaagagaaataggacaattaaacagtacacaaataacggctaggaaaccatcagatgttgccattgatggtcttgccttggatggaggcttagaagttgcaatggcatgcaatgctcggttatcaactccaactactcagctaggcttgcctaaacttcagcttggaataattcctggatttggaggaacacagcgacttcctcgtcttgttggtttgacaaagggacttgagatgatactggtacctggggttacagattgtggtctggttccaagacaagtcaagaagcttgccatcattggcggaggactaatgggctctggaatagcaactgctttaattcttagcaactatactgtcatcttgaatgaagtaaatgagaagttcttagatgttggtatgaataggattaaaggaaacctacaaaactgtgttaagaaaggtaaattgaccaaggaaaattttgaaaagaccatctctcttatcaaagcttctcttctggtttcctttgaagctgataaagagcaattgggataa

SEQ ID NO: 63639 - DNA, 363 bp, Glycine max
  Peptide Sequence Number=SeqID_155324
atgacatacaatttaaatagacttggcaaacattcgtacatagtggtcaaccgagtacaccccaccactgttcgtggagaatctcacaggggatgtcatcatgagaaggaatccaccgtaaagggcatacatgtcgtgggtgcctctgaaaaggggaaactagaaaacatgattcaagaggaccaaaacgcaaacacatttgtgacagtgacaacccaccaaacctatcaggctaggacagacgcgactgatacaacatggattatggaggcacaactcccacctggatggaagtcgctgaacatcgatcaatacgatggactcttggacccgaacaaacacgtggatgcatccgtcacatag

SEQ ID NO: 63640 - DNA, 366 bp, Glycine max
  Peptide Sequence Number=SeqID_155325
atgatgataacaaaagatgatgacaaaggtgatgacaaaaagctcaaagatcaatcaaagaacaattcaagtgaatcaagaacaattcaagagtttaagatagaatcaagaagaattcaagactcaagaagaaagttaagagtcaagaatcaagattcaaggttcaagatcccaagaatcaagatcaagattcaagaatcaagagaaggcttaatcaagataaggtacatcctttgtggtacaagtagaaggtacatctacttgggtttgactgagaacaagagagggtacatctcttgtggatcagttctagtggagggtacatccactatggtttcaaagagaacaagggatcttttcttgtaa

SEQ ID NO: 63641 - DNA, 195 bp, Glycine max
  Peptide Sequence Number=SeqID_155326
atgggcgaggaagagaaaaaaccagagcaaaacaaagtggaggagaaaaaagcaaatgaagaagaaaagaaagaagaagagaaaaaaccagaggaatcaaaagatgacaaggaatccaaggaggaatctacgccgccagaaatcgtccaaggcacaacctttgcaatgcatggacactttaagcatgatttctag

SEQ ID NO: 63642 - DNA, 204 bp, Glycine max
  Peptide Sequence Number=SeqID_155327
atgggtgaatccttgcacaaggttggcacgggtaagtatgccattgttgaccctagagcttgcaatttgcaacttcattttcatcctggccagctagagttttgcccctttctctctcctatgtcgtatattattctcaatgtgaaggtaactactctcaatgctatggcggctgaaccacctgatggcaaaggggttgggtag

SEQ ID NO: 63643 - DNA, 303 bp, Glycine max
  Peptide Sequence Number=SeqID_155328
atgtgttttatgtctcaaaacacttctcatgtatcacctatatcaatttttaatggacttaacttctctggatggaatgagcaagtccaattttacctcggtgtattggatcttgatgttgttatattggaagagaagcttgttactattactgatgctagtagcaataaagagaaatcctgttataaagcttgggaaaaatctaacagactcagcctgatgttcatgagaatgacttttgcagacaatattaaaacaactctccctaagactgataatgttaaagagtcaagaagtttgacg

SEQ ID NO: 63644 - DNA, 633 bp, Glycine max
  Peptide Sequence Number=SeqID_155329
atggcacgtattgctgacaagataaaaaccattgatggatctaaagaaactctaaaacttgttgtaaggataactgagctctggtttattgggacgtcgggcagctgttacttagatatttttattattcatagggtgatcaaatccatgtggtctacatcattggtgtggttgacgaggttgtctttcgtcatatttcacccagaagacgattattgtgtccaatttctggaatacttggatcaccatgagagtgaagggcctattattgtgttgttgagcaatgccagaattaaagagggtcagggatcctatccatgctcagttagcaattctttgaaggcttcaaaattgactattcatgagccagtggcaccaattgaagaattcaatcagaagctttcaaaattgggcattgagattcgctcagttttgacacatcgttcccagtggagttcgcagcctttaggttctgctcagttatcatcaagggaggcattcatttccaagtcagaggcaaagagcatttctgagataaacaacatttgtgaagagtttgtttgtgttactgttggcacaatcacgaggattgttatggacaatcattcatggtgttatgcatcttgcatttag

SEQ ID NO: 63645 - DNA, 303 bp, Glycine max
  Peptide Sequence Number=SeqID_155330
atggagataggagagaaattactgttttggaggtcgaccacaacgacggcacaaacgactgaaacgaggtggaagaggaaggtgctgctagatcaattttcacaattcacacttgtcgcaacctacccttcggtgggagggggacgccaggctcacgggtgcgccttccaagaaaggaaaatgcgcggagtcgccaccaacgtttatttgagaaaaacgtcggaaaaattgggaaaagacgtggtctacgaacttttaagtgaaaggttcgggagttgtatttacgcacggggaaggtattag

SEQ ID NO: 63646 - DNA, 276 bp, Glycine max
  Peptide Sequence Number=SeqID_155331
atggttaatgtgttgaaattaaggttgaatcctttggatactactcgagttcgatccttggtggaaataattcttgaccagacattacttatctcccggtcgaactctgaattagccaaagaagagaaggtaaaagttattgatgacttgcttagcgaggcagattggctaagcgagatgcatccacttagcgaggcatcctgctcgcttagcagatgggaaaccctaaaagaggttaagtcagagatctacatgcccagccagcccgcccagtga

SEQ ID NO: 63647 - DNA, 2865 bp, Glycine max
  Peptide Sequence Number=SeqID_155332
atggggaataagggattccaacttcagactcatgggagactaaaaagttttcttgtaccaaacgcctccttaaacttttgtcatcttcataattcttcgtttatggataatgctatggattcatttgagccagatggaaatgggaaggagtcactgccaccaccacctcctgttgttccctctgatattgtacctctcaaagcagaggaggtgctctgtacccctaccgagcataataagaaaaaggcttcccgacttccaatagccagatctggtctgggatcaaaaggaaataaaatacaattactaaccaatcacttcaaagttaatgttgctaaaaatgatgggcatttcttccattatagtgtggcttttacttatgaagatggacgccctgtagaaggtaagggtgtagggagaaagataatagatagggtgcaggagacatatcattctgacttaaatggtaaggactttgcatatgatggggagaaaagtctgtttactgttggctctcttcctcaaaacaagcttgagtttgaagttgttcttgaggatgtcacctctaacaggaataatggcaattgcagccctgatggtctaggggacaatgagagtgacagaaagaggatgcgacgtccttatcgttcgaagtcattcaaagtagagataagctttgctgcaaaaattccaatgcaggccattgccagtgccttacgcgggcaagagactgagaattttcaagaagccatcagagttcttgatatcattttgaggcagcatgctgctaagcaaggctgcttacttgtacgccaatcctttttccacaataatccaaataattttgctgatgtaggaggtggtgtcctaggctgtagaggattccactcaagctttagaactacacagagtggcctgtctcttaacatagatgtgtcaactacaatgataatttctcctgggcctgtggtggatttcttaatttccaatcaaaatgtgagagatccttttcaacttgactgggctaaggccaaaaggaccctaaaaaatctgaggattaaaactagcccatccaatcaagaattcaaaatttctgggctcagtgaactcccatgcagagagcagacttttactttgaaaggtaaaggtgggggggatggtgaagatggtaatgaggaaatcactgtatatgattattttgttaaggttcgtaagatagatctccgatactctgctgaccttccatgtatcaatgttggcaagcctaaacgaccaacatttttccccattgaggaggtttgtgaattggtatcattgcaacgatatacaaaagctctgtccacgcttcaaagggcttcattagtggagaagtcgaggcagaagccacaagagaggatgaaaattttgtctgatgcactgagaacaagcaactatggtgctgaacctatgctccggaattgtggaatttctataagcactggcttcactgaagtggagggccgggtgttgcctgcaccaaggttgaagtttggcaatggtgaggatctcaatcctaggaatgggagatggaatgtcagcagagtgaaatttgtggaaccatcaaagatagaaagatgggctgttgctaacttttctgcacgctgtgatgtacgaggacttgtacgggacctcattagaattggagatatgaaaggaattactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggtccatggaaaaagaagaatcttgctgattttggaatcataaatcagtgtatgtgtcctttaagggtcaatgaccagtacctgactaatgttatgttgaagatcaatgccaagcttggtgggttgaattcattgttaggcgttgaacattctccttctcttcctgttgtttccaaagctcccaccctcattctgggaatggacgtgtcacatggctcacctgggcagactgacattccttcaattgctgcggtggtcagctctagacactggcctctgatatcaaagtatagggcatgtgttcgtacgcaatctgcaaagatggaaatgattgataatttgttcaagctagtatctgaaaaggaagatgaaggcatcataagggaacttttgcttgatttctatacaacttctgggaggagaaaaccggaaaatataatcatattcagggatggggttagtgagtcacaattcaatcaagttttgaatattgaactcgatcgaatcattgaggcttgcaaatttctcgatgaaaattgggagccaaaatttgtggtaattgttgctcagaagaaccaccacactagatttttccagcctggctctcccgacaatgtcccacctggcaagtgttctgggtctttacagcatttagggagttgtgaaaaaggtgccccttcacctgccctcaattactgtggaactagtaggcctacccattatcatgtgctgcttgatcaggttggtttctctccggatcagctgcaggagcttgtccattcattatcatatgtgtatcagaggagcactactgccatttctgttgttgctccaatatgctatgcgcacttggctgctactcagttggggcagttcatgaaatttgaggacaaatctgaaacatcttcaagccatggtggattgagcggtgcaggtgctgttcccgtccctcagttgcctcccttgcaggagaatgtccgcaacacaatgttcttttgttga

SEQ ID NO: 63648 - DNA, 588 bp, Glycine max
  Peptide Sequence Number=SeqID_155333
atgaaagaacagaacttagagggtaacgaacaatcgtcgaagcactggtattgtgtgaagagacatcatgatgatagtcctgcaaatatgttggggcgtgtctcgttcgcgtggaacgtctgggttgtgaggaagaaggttccgttaggtgttcgttgtttgagggttcctgtattgtgggttgtgatgatgtgggttctacagatgagtcgtattggccactggaaaaagaagctgggaatggtgatagaggccatgtctcgcttcaactataccaatcttcatacgattgttcgtatcctgcaacatacacgaagtggaagaaaatatcaatgcacagttagtggacgacacaagtttggaaatggaaatgatactgaagaggttcacgattctggaatgggtggcatggacatggtggccgttaggaagctttattacgactgggctaatgtgttcataggaatgaagattatcgagggaggagttgcaaggggtagagacatacctgggcttgatggcttatcaatggtgcacgatgagatggaggctgtcgcggtgatttttggatatcaagctattgattag

SEQ ID NO: 63649 - DNA, 378 bp, Glycine max
  Peptide Sequence Number=SeqID_155334
atgcagttcttgcgtggcttgaatgagcaatatgccagcattcgatctcacgtgctcctcatggaccccatacctgctatatcaaaaatcttctcgggacagatgtcgtacaggatgtcacgacatcacgcttcagaacatgcagtttatgtgtgtctgtatgaacagattaaacaaggtaccatcaaggtggctcacaaaagactcaagtcccaaaactcacaaactaactcttcaatcccggacttggtacagaactcgtgcagcctccatgattatatagccgtgtatgattctgggctgcaactccttgatgctggaggagatctatcttcttctgaaaaatctgcagttaaagaactaaaagataacttttga

SEQ ID NO: 63650 - DNA, 258 bp, Glycine max
  Peptide Sequence Number=SeqID_155335
atgtctcctccacctctagaacctcacaatcactcacaaactcatctcaaactctcaggacaacttcctcttcaagctccattctctgcaggtggccttgttggtgcttgcgcgcttagcgcaactctggaccgcttagcacgaattagtgaatttcggcttagcacgcgtcttctcgctcagcggatggactcaagcgatgcgcttatcgggatgaaccctcgctcagtgaacatgcacagctcatccttcttctag

SEQ ID NO: 63651 - DNA, 441 bp, Glycine max
  Peptide Sequence Number=SeqID_155336
atgaacataaattgtgctataagaaaagacgaaccacctgtaatcattgatgaaagtagtcatgtcgttgttgcgctatatgagcggtgggagcgatccaaccggctcagtgtgatgttcattaagaccaaaatctcagctgggatacatggttatgttaaccagcatgaaaagctcatcacttcaaataaggctttagcaagcaccctgatcatgaagttctcctctcttcagctcaccagtgtgaaaggtgtgtgtgagtacataatgcaaatgaagaaaaaaggattgaagatgggtgagagtacattgttgacaactgtttgtaggaagaacaaagcaattaagtctcaagctaatcaaaagaggaatggtaaaataccacctcaagcttatattaagaagggtatgcaaaaacctatggaaaccagtgggaagtga

SEQ ID NO: 63652 - DNA, 252 bp, Glycine max
  Peptide Sequence Number=SeqID_155337
atggataagagcttgaaggtaggagaagatgagtggatggagaaggagagaacccatgggcccgaaatctaccctaaggctcatgagaaccctagggccttctgttgcatctctggtccaatctccttggagtcttctatccaatgcccttggagggtacgattacatcaagtatccttgtgggactttgacccggcgcaaacattgacaaaaacttatcgtctcctttctggacaaagtatgacaagctga

SEQ ID NO: 63653 - DNA, 402 bp, Glycine max
  Peptide Sequence Number=SeqID_155338
atgaaaaagtactcaagagagattttgaaatttgcacagcaagctccaaacctccagcatcctttggtttgcatagatgttattgaagcaagaatagtagttggtcctcgtgtaggactctggaaggaagttgaagcatttgaaggacttgtaaggtcagatacttgcaaaagcttagttcatatattttttgctcaaagagtaacatccaagacacctagggttacggatcgtggtctggttccaagacaagtcaagaaggttgccatcattggtggaggactactgggctctggagtagcaaccgctttaattcttagcaactatcatgtcatcttgaaagaagtaaatgagaagttcttagatgctggtatgaataggattaaagatgagaatagatag

SEQ ID NO: 63654 - DNA, 126 bp, Glycine max
  Peptide Sequence Number=SeqID_155339
atgtatttggtccttgagctcatcccttttttgaattcaataaatggaagcggaatggagaaggaagagagagaggagacgccacttcaaggagaagatgagtctagaagaagctcaccaccatag

SEQ ID NO: 63655 - DNA, 699 bp, Glycine max
  Peptide Sequence Number=SeqID_155340
atggaggtaataatttcgttaaaagatcaagtgaaggagttagcggtgaaaataaaagaaatcaccaacaaggttgattgcaatgctgtaacaacaagaagtgggttagcaactaaagagctagtaagaaaggacatggaggtagacaacagagtcaaggaagacatacatgaggaggacgtgataattgaagaaatagcacgagagccaattaagacaaagagcgaactaacacgagaagataaacaagcaattacacgtgagaagttgtatcctcataaaccaacaaagcaagacaagctcttaaaagacctcataactaagaacaagagtttgaaagactatggcgtagtgactcttggagaggattgtagtgccatcttggagaatccaaagaagctaggtagtgatgaaaccaacaggcatgcgatacaactagcagaccgttccattaaatttccttttagaatagtggagaacatgcctgtacaagttgggaggttcaccataccagtggactttgtcatcatggatatcaaagaagacgtcgttgagatcacatttgatgtgcgtgaagctatgaagcaccccaaggataaaggagcttgcttcaaggtggatataattgatgaaggcaaggatgagaaactagccatcattagtaacacattgcacaaagaggataagcaagccttatga

SEQ ID NO: 63656 - DNA, 429 bp, Glycine max
  Peptide Sequence Number=SeqID_155341
atgatgcatgcacttgaccttaactctcagatgcaatgcggtacataccgtatccaataccaaggaaatagccctaagcgtgtctacacaacacctcacttaggaaaccatacagtatttgtcgacgccacccagtcgtgcactgtaactccctcccctagggatgtccaacaaggtcaatgcacccccatggacatacacaacacacgacgtatgaacgtgggcaccatcaagtacaatgaccatggacaaattaaagcgcctaagcatccctgcagcgaatgcttagattctttaaccactctagtcccccacgaatgggccgtccgacaaagtcaatgcacctcccatgaacgtacacaacatgcacatgccaattgcatttccaacatcaatcaacattccatgttcacatcattctcaacatag

SEQ ID NO: 63657 - DNA, 1128 bp, Glycine max
  Peptide Sequence Number=SeqID_155342
atgttgattctagaacaactgaaacattattcttgggatgcaaaagtattgatagttcaagcagctttttccctagaatatgggaaaatcatgtaccttcccctgaccacacaatgccagcagcagattgaaaatttatttgcagatttgaatggacttctaatggttcctcaaaacacacagcatctcccttacttcaacagtgtggtgaagaaggcaatgcaaatgattgaatgcatcattgagtggaagaggctaattagtttagggcatgacataaaagatgtgcccaccttggcagaaacttttcaccagatccctgttgttgtctactgggcgatcttcacctttgtcagttgtacaggtcaaattgatgagttcacagattataaggttcagagacatgaattatcgaaaagctttgagcctaagcttgactccattctaggaaaatttaaggaatttctggaaaggtgtagcaaggagatagtgagaatagaagactacaccaggcgtgagaaaattgtgattcatactggtaaaaatattgtaaaggttttgaaagcactcataatctccagagagaacagggatttaagacagaatgtgtttaatgtccttactggagaacaggttaaaatcgaagagtttaagaagtatgtcttattattcatttcgggccttgataaaattgaagatgagattcggcttctaaaatcaatacacgagaagttgaaggaaaaaccgagagaagtagaaggctataggagtgaggatttcaagattttgtggatccccattgtggatgaatggaatgaggaacgtaggaaaaaattagaaagtcatttacagtgtaataagtttggatggtacgtagtcaaatatttcaatttcgaaacaggcatgaagcttattaaagaggtgttcaagtacaaggaaaagcctattattgcattaattaatcctcaaggtaaggtggaaaacatagacactaagcaaattatatctgtgtggggcatcgatgggtttcctttcagaacctctgatcactatcgacttactcagcaatggaactggttttggtctgaaatgaccaaactcaaccaaggaatagagagcttgatataa

SEQ ID NO: 63658 - DNA, 246 bp, Glycine max
  Peptide Sequence Number=SeqID_155343
atgttgtgccacttgaggatccttggacttgcacctctaactatttgccttggttttacaagatggtcaggagctatgcagagcatagaagacctcaaagttatgccaaaggggattcatcatcagctcatacaacaagctttgcaattattacataagggcttcatggctaggtgcatctcgggcatacagagacaaaagaagaggattgccaaggattgtggcaagggtgacaaaggtgactga

SEQ ID NO: 63659 - DNA, 1692 bp, Glycine max
  Peptide Sequence Number=SeqID_155344
atggagagggttgacaaagaaattttggagcagttgtcggcctcgctagatgcacgaaccattctggctcttccttcagcaagcaatcctctcgctaccttggatggtattgtgtgtgacttagcctggaggtcactcatgaagcaggtcggacctggaggtgggactgtgccaccgtctactgctacttcgtctgtcgaagaagggggtcaacctgctgatgaggttggccatattgttgttgctgctgagccgcaagatgtgcctccagctccaccagccattaaggctcctactgttaatactgctactgttgctccttcacctccttccattgttgcaattcaggaggttgctcctactgctattgaagttgttatgccaaccactcaggcgggttcagttgtggcgctatcgtccaccgttgtggcacctttgttaagtgttggtgtggcggccactagtgctcccacgatgctgtctccttcctctgcaactccagtgacttctccctttactgttttggtggcagtgggagcaacttataagtcggagcagaagaccccaattggctttgtgtcagccttcgacaagaaccttattaggtcgagtggggagaatggactgcggcaccaagaggctatgcagaaggaggcgtccttggaggtgaaggttgccaagtggagggttactgcttgtactctttggcgagtggagcaccctaaggtggccaatgccaccgttgcttttgttgaggtcgtaaggtcgaaccgccaattgtcttccaaagttagtggtgtgttgaccaagttattgcgtacccagttagatggtgatgagctatttggatactgcaaggacttgcaggcggagaagatgaacttgagtgacaaagtggagagcttggcgattgagagggacgggctagccaaagtagttgttgatttagaggcccggcttaaagagtcagagtccaagttagaggcatccgagctgcaggctgccaagacaagggaggccaccagggagcttgaggaagagttgtttctatacaagaaggaggctattaagcaagccggtttctttgatcccttcaaggatgtgaaggacggtgtcctacttaatgaggagaagattgctgcaaaagaggagactgctaatgaaggtcatcttaggtttgatttcaacctagttaaaggtcttgtcacccatctggtggggcttccttctgttttgtggaacttctcccctgatggttcttctcttctgatggttatgaggagttggtgtgagctgaaccagattgaaggtcttatcatgcaattggtggcagttcatcttgttgaactgggaccttggacgatgattgtcttagttactgcaagtaagcagaccaaggaggtccctttgggttttgtagaagtatgtaccaaaggtggaccttgggttttggagacctatattcctgcacagataaaagttaggaacaagaaagattgtcaaggaccagggacatgtttgccctgggttttgtcaagcctacgaagctttgctgagattaaccaaggatcttcttcatcaatggattcctttgcttcttggaagatgaatggcagtggaatggagaaggaagagagagaggagacaccacttcaaggagaagatgagtctagaagaagctcaccaccatag

SEQ ID NO: 63660 - DNA, 399 bp, Glycine max
  Peptide Sequence Number=SeqID_155345
atgtctctagtgcgtgccacccacggcgagtggcatgtatgcaagagcatgatgcccaaaacccaggttagacaattcccttgttcatactccaaagggctcgcaaaacccaagtgcgtgtcgtccacggcgagtggcatgtgtcgcaacctacccttcagcggggctcgcgggtgcatcttccatgggagcaaaatgcgcggagtcgccaccaacgtttattcaaggaaaacgttggaaaaactggaaaggtgtggtttacgaactttaatcgtgaaaggttcgggagttgtttttaagcacggggaagggtgtttccctcgcttctacatatcctcaattacgatgaagaaatcagacctacgtagttcttgcaaaagcggtaaagttatgtgttga

SEQ ID NO: 63661 - DNA, 225 bp, Glycine max
  Peptide Sequence Number=SeqID_155346
atgcagagagtgggtcttgctaagcgaggtggctcgcttagcgcaattctaaaaaatgcaattccagaaaggtttgtgtgcttagcgagcggctgcgctaagcccaattcgaaagaattgaaatccagagaagtttttaggcttagcgcggagcacgcactttgcgagaccactacagccaatgatcaggggttaaggcacctagcgcaagcacaaatcggttag

SEQ ID NO: 63662 - DNA, 516 bp, Glycine max
  Peptide Sequence Number=SeqID_155347
atggatgttacatttcatgagcatgaactattttttcccttgaaaacacttcattcttcacctcaaaggggaggtgatttgaaggtgcataatcacgatagacttgagcaagatatcatgttatttgatgttatgccaacaacaatagatgatggaattcaagataatggagatgagaacatggaggatcaaattcagaataatgtaaatgagaatatggtcaaagatgataaggtatcacctgaaactcttactccttttcattctgttgctgatacacaaaactatgtttccacttatatacaatgcaatgtctctactaccctaaattctgaccctatagtgagcccttacacttttccacctcatactaatataggacaacccccaactaagtatgaacctgtcgcaacctaccattcgacgggagggcgaaggcaaaaagccaaaggagcatcttccaaaaaggagaacgtgtgggaatcgctaccaacgtttattcgaggaaaacgttag

SEQ ID NO: 63663 - DNA, 627 bp, Glycine max
  Peptide Sequence Number=SeqID_155348
atggcttctcataagagaaaagcaccagcttcagtgtcccaagcacgatatgatagatcaagatttgtatcccaagatgcctgggaccgctatgcagataatgtccttggccggaagatccttccggaaaggaatgtgaagctgtatatcacaaaatttgatgaatttaggagagaaattgagaggatgaactggcataaggagcttactaacttctcaaagggaagcattgatgttgctattgttaaagaattttatgctaacctctatgaccctgaagacaaatcacctaagcaggtgagggtgcgagggcacctaattaaatttgatgctgacgccttcaacaccttcttgaagacaccagtggtcatagaggaaggggaaagcttgcctgcatactccaggcgagctgcctttgaagattttgaggaagaactagactactctggcccagacctggagtgttctatctattctaacttagccctgacatctcacacttcagatattactttggatagggctaagttaatctacgggcttgtaatgatgatggatatgaacttggggtccctcatcttaggtaagatttctctcatcgcacaacatgactcctcaaggctatag

SEQ ID NO: 63664 - DNA, 303 bp, Glycine max
  Peptide Sequence Number=SeqID_155349
atgcagtttagagccacgttccacaatgatagggacatcataaaagtcccgtttttttaccacattcagtgggcaccagaatatcccgaatatgtccgtttcaaatataatggagttgtatatcaaatccgagtcagactccataagggaaaaaatttctttactgaaggtctgaaacagtttagaaaagaattggccatttatgaatctaccatcatccatttctttgcaatcgaccacatctcaatattcgaccttcatttcagtccaccgctggaacagcagacttccggaagaccctag

SEQ ID NO: 63665 - DNA, 223 bp, Glycine max
  Peptide Sequence Number=SeqID_155350
atggtgacatataaaggaaggaggggaaaggtggtggcgcgacatcgtaaggagggtgcatgggtttgtgcggtggaggaaaaggttgctatcgcgggaaggccttgggcccagtggcatcaaggatcgtgcctcttccttggaggtgtctcttctttgttgctttgtcaaggtgttgctaatgcactttgggttttccaatctcattcctttttacttgcgg

SEQ ID NO: 63666 - DNA, 267 bp, Glycine max
  Peptide Sequence Number=SeqID_155351
atgaactctccattcaacaaagcatgcccattccaaatactcgatgctctagctaaatatgaaatagccaagttagtagcacttgcattatccattttgaattggcgtccaagtatctgtaggtcactctcactatcacttccaaaaacaattgtcttttgcttttatcaacatattcaggttgttgtccttgcccttgttggggtggagtttatgtgtccttgtggttatgaaggagcttttgtcccttgttgtgatggactttga

SEQ ID NO: 63667 - DNA, 333 bp, Glycine max
  Peptide Sequence Number=SeqID_155352
atgtggaagaattcttccttaaaggtgtttaaggagaagagtttcatcatatgctatgagtgcaagaaatctggacacttcaaatctgaatgtccatatcttgaaaaatccaaggacaagaagaatacttgggaggatctggatgatacctcgtctgatgaggaagaagaagaggaagccaacataagtctgatggcgaatacaacctctaaagaatctgaattagaccaagagtataagtccactcaagtctgtcatgttgatgaaactcttaagataaaagagaccaagctatgccttgagaatgagacaatatccaagaaccttggctaa

SEQ ID NO: 63668 - DNA, 588 bp, Glycine max
  Peptide Sequence Number=SeqID_155353
atggatatgaacctgggctatattatttcagctcaaacttctctgatcgcccaacatgactcttctaggcttgggtttccagccttaatcactgctctgtgcaaagccaggggagtcgtttctgattcattgacattggagagccttggtttagctattaatgtggcttatgtaaagaaaaattgttggaacctagatgaccacgcaaggccaagggaagagagccttcaaggcttgggcttgccatccatcatgagcatggaggagtttgatgcgcaggtggcctggtcaggagcccagccttctccttctggagggggtggggcctccgcagcccaggagcctgcttctgaggagccagcagcagcagagggggaggatgagctcacccctcctgagcccttttattttgatgcagatgcacacatggctcaagaagaggggacttccacagatcaaatacctgagccatctcctgcacctgttcctgaggagacccagccatctacaccggtcacagagccagagcagcctatccaggattcatcagtagctccaacactgaattttaatgaagatcagccatag

SEQ ID NO: 63669 - DNA, 378 bp, Glycine max
  Peptide Sequence Number=SeqID_155354
atgcccctctatgccaaatttttgaaggatatgctaactaagaagaaccggtacatccatagtgacagaattgttgtggaagatatagaagaggatgctgacattcctctcattcttggctgcccattcatgtctactgcaagctgcatggtggacatggggaagaagatactacagatgggtatagaagatcaaaagatcagctttgatttgttccaggaggacaaagatccacctagccaaaatgtctgctttaaagtgcatgtgatggaggaaaagagacctgagaagaaggaagcgctaagcatagcatgccgcactaagcctcagatgcttatgggattttacaacttcaagttgggcttagcgcgaggctag

SEQ ID NO: 63670 - DNA, 279 bp, Glycine max
  Peptide Sequence Number=SeqID_155355
atgaagacccctgacgaagttgcacgatatacaatttgtggtggagctcatgaatctggatgttgtatccctaatgaagagaaaattgcacatgaagtcaattatatggggaatcaacccagaggcaatatcaatacaagtggatttccaggatttcagaacaaccaacagtatcaacagcagagacagtggcaaaatcaccctggtaaccaattcaacaaagactggggtggttcatctacaagaccacaacaacagatgccaagtctctatgactga

SEQ ID NO: 63671 - DNA, 525 bp, Glycine max
  Peptide Sequence Number=SeqID_155356
atggttggtgttttgggcagagttttctgcctttgccctgttttcttggctgtgatagtttgtgctgatataggctacgtgggagtacgtgagctcaattggaggtgggcaacaggggatggtgggtttatgcgcgatttgtggatgtggaaaacttcttgtgcaccatcgcccgaccgccacctagtaccacatgtgatggtggtacctggagatatgtcgcgggggtcaggagaccttggggacgtcaggcgagctcctggtagtcaacagataaaaggaacaaagaccacaaagcaaggaggcttgtgtggtggctggccagctgaagctgtgagggcttctggtaatcgattaccaatggggtgtaatcgattaccaggcttagagatgaaggtatgtgcaatcgattacacagtgcctttttcaggttttcctgttctgaagctgtgtgattcgagtttggcctctagtaatcgattaccaaggctgtgtaatcgattaccagagatgaaaagcctatag

SEQ ID NO: 63672 - DNA, 309 bp, Glycine max
  Peptide Sequence Number=SeqID_155357
atgcagagtattcacgatttggctcagcagaggcctattatgagcatggaggcctttatggcccagccagaggcagaggtagaggcagaggagacgccaaatgacacacctacgaccacgcccatggaggtcacaggcaaggatggtgcaacagagaccggcgttgacacaaactacgtagcggacgtcattgcggcgcagggaacctgggatgcttggcccactccagcagcacaggacactccgatgccagctaaggatgcccccactacacctcatgatgacccagcaccagcccaagatgactga

SEQ ID NO: 63673 - DNA, 573 bp, Glycine max
  Peptide Sequence Number=SeqID_155358
atggaatttagaagatttcctcatctatgggataagctttccattttagagctacagaatgttaatgatgtcatggatgcaattcaagccaacctaaagaaaaaagaacagattgaggagcttgtcttggagtgggataatgacccacaagattcgcaaattgccaaagatccatttccattgttggagagcctccaatttgaagatatgccagagtgggaggagtggctaccatttgaaggccttccacagctagcattgttttccccaagctttttgccttctggtttagaagcacttgttgctgaagctgcaatgctatcatctatgtataaacatgagttaggtttgctattccaatgtctcactcctctgacacatcttgcactttgtggtttgggggaggaagatcttctcaacaccttgttgaaggagctgatactgcccacgtctctctgggaaaagggcttcaacatctcacttctctctgatggcttaacatctggaactatggaagcattgaatccttgccagaagatcagctgccatcctctcttgaattactggagataa

SEQ ID NO: 63674 - DNA, 894 bp, Glycine max
  Peptide Sequence Number=SeqID_155359
atggccagcaattcagctagagcacagaagaaagccaagtcttcaaagagaaagcaaggagagtgctctcaagcagctctcaacaagttggatatgtggttcacggatgagaataagaagacaaacttcaaaatgatctatgtcatgaagaacggattcaactttcctaacttgcttgaagcacagggtctgtcaacattggtgcagatgaagggaaccttctaccctgagttggtaaaggtcttctatacatgtgccaaagctgatatggaaggtaacgtgtactctactgtcaatagtgtagaaatggtgattgacactacagtttggaaagtagtagcaagaatagatatgggtggagtctgcaagtttgaggaatttgtggatggctacaataaaatggccacatacagaggtgtgcttcttgacccaacaagaattttaaggaacaaattgggtattggtgatattatgttgaaaagtcgtcgactagtggattatgaattttcatatgcagtcttgacctcaaaattcattgattatttcaatatcgatgtttctaatgagattgtagactttaccaaagcctctaatgagataaccaaaaggcatctcacgaagcttggcatgacatatgttgatcatgagtggatcatggcaggagaagaaccagcagcagcaaacattgatcaaatggaagaagaagctcaacaagagccaactcatcaatggaacccttttgagtcccttatgattcaaaagatggatgttagccttcatctccatcaagccaaagttcacagctccttagagaacattacaactaggcttgagaacatagaaactaggctatcccttagtaacctcctgaacccggatgaagatgaggcttag

SEQ ID NO: 63675 - DNA, 804 bp, Glycine max
  Peptide Sequence Number=SeqID_155360
atggcaaaatccttgaagaaacaaaagggatcttcctccaccaccaccattacaggccatcgccgtcacggaacatctggtgacccgccagcaccaaatcctccttccttttcatctcccaggtcattaactctgttctcttccgatgaccagcgtcagaggtattattcccaattctccaatcgtgtcattcttgaccttaagtactcagatgttgaattctttgatggtgaaacatttgactgctaccaagtgtttccaaattctgaattggttgaatttatgtctttgaaatttctttattatcctgaactatcattgactaaactgagctgtcaaggtgttccttttgagggcactctagttgatgactggaaacatgtttattcgagtcatgatgctcataaaatggtctgcaatgaccatgctgatatgaccaacagattgcttgcaatacaggtcaatgcacctcttccttatccacatctagttactttatttctccagcatttcaatgtccccttagaagatgaaccttttgtcaaggttaaaagatcttttgctattggtgttggtgttgtgggtgcgcaagacctgcgacctcccattcccgatgaacgtacatcgcctccaccaccgcaatgggataactcttcctccctcttgactaaagtcttcactgagctacaggatcttagagcttttgtcgccaatcgctttaatgcaatggactcccgtatcacacgtcttgaagacaatatgagtttcatccggcgttgctttgatccacctgtcgattcttag

SEQ ID NO: 63676 - DNA, 426 bp, Glycine max
  Peptide Sequence Number=SeqID_155361
atgttcattctaacctcaattgcgataaactcatctcttacctctaagcaggctcacgtgtgtatttctgcagtgatagcggcatctacagcggtttcctatgattactcaagcttttcctctggttgttctactggggtaggttctgagtctctgtggaaaaagagaaatctacaatgcgaaggacatttctctaagctccaacattttttcgcaatttccaacggtgaaaatgctcagaaattagtttccgaccaggtgctgagatatcacgacgatccaacgattaaagaatctgagatcatcatttttactaaaatagatttgagcgtatgcgggaaaaagagaaggtgttgggaggggaaaagagaaaacgaaattgagagaaggaggagacgtagagcctatcgtcagtctcaaaactga

SEQ ID NO: 63677 - DNA, 45 bp, Glycine max
  Peptide Sequence Number=SeqID_155362
atggaagacgcacccgtgagcttcgcctcgccctcccgtcgaagg

SEQ ID NO: 63678 - DNA, 462 bp, Glycine max
  Peptide Sequence Number=SeqID_155363
atgtcgcaacctacccttcggcgggagggcgaggcgaagctcacgggtgcgtcttccataggaggaaaatgcacggagtcgtcaccaatgtttattgaaaggaaaacgttagaaaaaccaaaggaaaccggtcatgaagaatattccagattcgggagttatctttacgtcgacaaaagcggggctcttgctcctacgtaccctccatcgaagaggaaatcagacctacgtagttctttcaaaaggggcgaatcaagtgattcttttttacttggaaggtggtcatttaaggcgttggaccttaaaatgatccattttacttggtgtgaaaatctgaggcgttggacctctaaccatctcatgaggtcgacaaaagcggggcttttgctcctacgtatcctccatcgaagaggaaatcaaacctacgtagttctcgcaaaagacagtaaagtgatgtgttga

SEQ ID NO: 63679 - DNA, 528 bp, Glycine max
  Peptide Sequence Number=SeqID_155364
atggctagtgaaggtattggaaatgaattaccaaaggagcttattgttattgatgatgtgctctccgccatggttggcattgaaggacgttacatcttaatcaaaacaatttgtggaaagagtgatgatattactttcctggttgatccgtcaatggatttggccctacagggtgttcaatctgtacagtatcctaacctattgcttcacatcaaggagttggcaaaacggatattccctctttgcaagagctttctgttgatcaaccagtttgtggagtcaaggtctgagttccagagtggcctggttaatcatgccttttctgctgcactaagggcacttcttctcgtaggtaaaacgcaatcgcgacagcgtcgcgttgtggactccacgaaaatcacaatggtaggtgccttacatgttgcagaatctcattgcaccacggctgttgcgttgtcgctttccgacaaggttgaatctggagagaaattgcatcaacagcatttagggttcattggttcattttga

SEQ ID NO: 63680 - DNA, 676 bp, Glycine max
  Peptide Sequence Number=SeqID_155365
atgactacttctggtcctgttttttcattttctggaaccccaaccattgcaactgccaagctcaactggaaaaattatttatcgtggtctgcttcagttgagttgtggtttcttggtcaagggtaccatgaccacctagagaaaaacgtcaatgttgttccaaacgacaagaaacctgaatgggagaaggtagattatcaactatgtgttgttctgtggcaatcggtcgagtcagatgttttggaaattctcagatcttttaaaacatgtcatcttttttggaagaaggcccaagagatcttcgccaacgatattcaaagcctatttgatgcgactgtgaaagttacagctctcaagcaatctaaccatgtcatgattgcacatatgggtaaagctcgggcagcagtagaagagctgagaaggtttcttgtggctgattcgttggaagaggtgaataggaaactggacaagttctacatggtcctagctggagatcaagtcccatcgatggattctctcattactaggcttctccgtgtacctcatgcgttgaaggatgaaaatctcactgatgctgtggaaacatcagccatggtggtacctcgtgggagagggggaggccgtaacagtagaggaggccgcaatggaagaagtggacgtccgcaatgcacatatt

SEQ ID NO: 63681 - DNA, 828 bp, Glycine max
  Peptide Sequence Number=SeqID_155366
acaccgcgatcggggactgtgtcctcgtttgtcgagcagtggtaccgggagacgtctagtttccatctccctgtgggagagctcacgatcacgctggacgacgtctcctcgattctacatatgcccgtggatgatgcggttcagatgctagtggacttattgatggcaggtcattggacagctgcggctcgcgcatatcttcttcatcttctgggttgcactccgtttgctaacaagagtgcaaccaatgtgcatgttgtgtatttggaggcccttcgtgacctcagtcagaccgggaggtacgcctggggagtggttgctctggtgcatatgtacgaccagctaaacgatgcctctatcaacagcagccgacaacttggcggttacatcacattgttgcaatgctggatttacgagcactttccctcagtcgcggagtccactactgatcaggactacgacgaggattcctcgcgtgcatgtaggtggattgtgacaaagaagaccgtgaagagcatacgtacgatggtgtacagagagcgcctggaccgactccgaattccggatgtcttttggatcccgtatggggagcaccgaccggccattctggctccgcctgtcgattcatgggtgtcgtatgatgatatacacgacaggtggatgcactactcggatcatatcgttccagcaggtgaggtgtacgttgtgccaggtcagtgtgccagtgactacatggactggttcttccgcatctcgcatcctttcatgacactaggccacgcatcagatcctccgcatctcccaattcaaaacgatcagtcattataa

SEQ ID NO: 63682 - DNA, 381 bp, Glycine max
  Peptide Sequence Number=SeqID_155367
atggctaaatatgaccctaaaatagtcatggagttctatgccaatgcatggcccacagaggagggagtcaaggataagcgctcctgggtgcggggccaatggatcccctttgatgaagatgccattaatcagttcctggggcatgcattagtcttagaggaggggcaacattgcgagttcagcgagagaaggagccaggcttcggggtttgatgaggaggccatcggccagctgctgtgtgtcctggggcaggacttcgcccaaagtgtgacagggagccgggtgcggatcatgcgcactagcatgaccaccctgacacagatctggatgatactgcttctcaggaacatcctgttagacaagtggcctcagacatcttaa

SEQ ID NO: 63683 - DNA, 2334 bp, Glycine max
  Peptide Sequence Number=SeqID_155368
atggatgatgatgataaggcactccagctttgccgtgaaaggaagaaatttgttaagcaagcacttgatgggcgttgctcttttgcagcttctcatgtttcatatgtccagtcacttaaaagtacaggaacagctttgagaaaattcttggaacctgaagccccaattgaatcttccttagacacttccaccaatgccacaccagagcagccacttgacaaaaccctgtcccagttctcactatcttcatctgtgtcccgacgcactgatgcagctgaaacattttctccaactccctctcctcctagctctagtaagttccaagcacatcatatgaaatttagcagtagttcttctaaaaaggttgaagaaaaaccacctgtacccattataggaaccgtaacatcatcaggtactccacataatgtcgttcctcatcccactgataagtcagcatttgaagtttctcctcttcccgttgaaactccaccatgggatttttttggtctctttcatcccattgatcatcaattttcttttcaagaagggaaggtcatgcaccaagatatggtggcgaatgctgatgatatatcacgacttagggaggaggaaggaattcctgaattagaagatgatgagaaggtttcttctcatgaaagggaagactctacggactctgaagatgaatttgatgatgagcctgccacagatactctagtccaaagatttgaaaattttaatagagttaatgatcatattaaacccaatgacttatctgccacagataaacatccgaagggggattctgcttctgaagttgaacttgggaatggggagaaagggaattctcctgttgtatcaccattaaagacagcttctacagaagtttcgcttctaactgtaatagataaatcgaaggagaaagaaaatcacagggaaaaagttgttcctaaggatttcttttcaagcatgaaagatatagaattcctctttgttaaagcctctgaatctggtaaagaggttccaaaaatgcttgaagcaaataagtcacactttcgtcctctatttccggccaaagaaaatcgtttggtggcaccctcatttttgaaggcatgtttctcatgtggggaagaccctagtaaacttcctgaagaacctgctcaaaactctgttaagtacttaacttggcataggacaatgtcatctcgatcctattcatccgcaaaccctccgggagcaaactcaaaagctgatgtagatgatgttacaaataatctctttgataatttctgcatgatctctggaagtcatgcatcaaccttggatagattatatgcatgggaaagaaagctctatgacgaagtgaaggctagtgatttgatcagaaaggaatatgacatgaagtgcaaattcttacggaatctggaatcaaaaggagaaaagacttctagaattgataaaatgcgtgctgtagtcaaggatctgcattcaagaattagaattgcaattcttaggatagactctatatctaagaggattgaggaattgcgggacaaagagcttacgcctcaacttgaggagttgattgacgggttaagtcggatgtgggaagtgatgtttgagtgccacaagctgcagtttcagacaatgtcaactgtgtataacaacagccatgctggaattgctgccacacactctgaattacgtaggcaaattacttcctatctcgaaagcgagctccattatctatcctctagttttaccaagtggattggagctcagaagttctatctggaggccataaatggatggctgcacaaatgtgtttctcttaaacaaaaaccaggaaagaaaaagagaccccaacgtccactcctaagaatgtatggtcctccaatatatgccacctgtgaaatctggttggaaaagcttggcgaattacccgtccaggatgttgtggattctatgaagagtttagcgggtgaaattgcccagttcttaccgcgtcaagagaagaaccagggtaaaggtgcaaatcactcccatttaacaacttggagtgctaataatatccgtagcgaatcgtcggataatctattgagagatgggacattagaggactgggattcaggttttgatcaatttcgtgcaagctttcttggatttctcgcccaattaaataattttgccgggtcttcgatcatgatgtacacagatcttagacaagccattcagattgccaagaagaattatcatcatagatctaattctcaggctcaagatggtcagtggaattctctgtctcaagatgataattccatgtctcaatcttga

SEQ ID NO: 63684 - DNA, 456 bp, Glycine max
  Peptide Sequence Number=SeqID_155369
atgcagctagtggcattgggaaaactgtatgacacttctagcaccatacacaatgtgccttatgccgatgatgtggttcgggtgagtgttgtgaaagtttaccacagtgatgctctcgtccctttcccgacatcagaaattaagtttgtgaaagaagttgttggcactttcgtgggatggccaacacatctggtgaaacccatatctgatgaggtttcacaaaatcctcttaccagaccggttaaatctattgaggcggacaaggtagtggccctagttgatccattgggagagttggtaaagaacttgttcgaaatttaccaaaagccaattcagttgttgtgggatggcgcacaatttgggattgataatgtcaaagatggatttttcatcacacacgcaaattttagtgaaataatactaggtgacaagtgtttgaacatctccataatatag

SEQ ID NO: 63685 - DNA, 402 bp, Glycine max
  Peptide Sequence Number=SeqID_155370
atggcagtgatgggtctttttcaaaacccatcttttgtcaaatcatacacatttgagactttgatgtggattgcaaagcttgtgctcatgggggctatctccactcttcttttgttgaaagtgatactggccaagagtcctattctactacactattctcaagttgatcatcatcaccatttcagcttccttcaacttccttcaccaacctctgatcctaagcacacaaccaccatcagtttagacactgccaaccacccaactaagtcagagaaccaaaccaatgaacctaaggaagaacaaaagaaggttgcagaagacgaagaacaactacaacaacaacaagtgaggatagcaacaataggtggttcagcaacacctagaacaacaaaagtggattga

SEQ ID NO: 63686 - DNA, 639 bp, Glycine max
  Peptide Sequence Number=SeqID_155371
atactacactttggtcaaatggagaaaaccaacttgaaaggtttctgtaatacaagcaaaattgtatttgcttctctaatcttaatcaatagtggtggaattaattcgacttttgcagtccagcagatgtttctattgcaaatcctaggcataatcctaacatattttggcattatttgccttggaggaatttggaaattgcaaaaccgagggggacatcatctaacagtaatcagctctgaaagattggtggattctgcttctggaaggtattgccagctcagtgtcacttggccacgtagtcctctagtttttttgttaaatgtggacattgggcttaggaaaggctctcctacctttaatgaggctcgtgcagttgattttattgaggaaaatggaattatggctgacatatgtgaaagtatctcaggcagtcatgctatgttgttgttcatttcaaatagagcagagttgttgaagtaccctgatgctaaagtaataagccttggaattggtgatacaactcaacctattcttgtagtcataactgatgcaatgtcaaagctttctcactttcagatggctatcgggaacctatacatgttcactgacatggcagcgcaaggggagcaaagttga

SEQ ID NO: 63687 - DNA, 121 bp, Glycine max
  Peptide Sequence Number=SeqID_155372
tcacggaagcgcaggcgactttgacacaaggagaaagaagaagaacgatagggttcaagcgcaaggagaaagaagaagaatgatagggttcaagcgcaaggagaaagaagaagaacgatag

SEQ ID NO: 63688 - DNA, 76 bp, Glycine max
  Peptide Sequence Number=SeqID_155373
aacttgtaaaaggaatctacaagatagtggaactctcaagcgggttgcttggggactgggacgtaaggcaccaaag

SEQ ID NO: 63689 - DNA, 120 bp, Glycine max
  Peptide Sequence Number=SeqID_155374
atggaggaaatggctccgaaaaagctttccacgaagaggtctaggagagacaccgcagtggaagggtccagtgctgcccctgagtttgatagccaccatttccggagcgccgagcactag

SEQ ID NO: 63690 - DNA, 294 bp, Glycine max
  Peptide Sequence Number=SeqID_155375
atgactggagatgcatcaaagtttacacatatctctcccaagaaaagcgggcatgtaacttatggtgacaacaacaaaggtagaatccttggagttggtaaaataggtcttaagcacaacctacttagtgttagtcaatatccagaggcgacgggcccgatgacatgcgggaaccatttggtcccgcactttttacttttgtcatctagaggcggcggacccgatgacatgcgaggaaccatttggtcctgcacttttttaccttttgtcatccagaggcagcgggtccgatga

SEQ ID NO: 63691 - DNA, 245 bp, Glycine max
  Peptide Sequence Number=SeqID_155376
caaaaagcaagagaagaactgaagaaaagaagaaaattggaagcaggcccagtccagtacgcgcgcttagtgcacatcacgcactaagcgggcaaggcagcataggcgctaagcaaggagttaagcacaaagacgcaggatccgttacccgcgctaagcgcggatcacaagctaagcgcgcgatccaacagaagcacacgctaagcacacgatctgaacgcgctaagcacggggtgtcgcgctaa

SEQ ID NO: 63692 - DNA, 99 bp, Glycine max
  Peptide Sequence Number=SeqID_155377
atgactaaagcacgtcaaaagggggtacggaaagggaaaagagggaggtggttgccacccagctcgcccaggcgacctcagctcgcccaagcgagttag

SEQ ID NO: 63693 - DNA, 552 bp, Glycine max
  Peptide Sequence Number=SeqID_155378
atgaaaagagaaaaacatgtctcctatagtagtcataactcttgcaagagcctaagtgaagaacttcgtgactattatgaaggatggcataggtcacatcttagacctcactcccataggagagaaaatgaaagaaagcctcaagaggttaacattaaactcccatatttccatgggaaggacaatgtagaggctaatttagattgggaaataagggcagagcaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctaaggacacattacttctcaatgcccccaccaagaaaaccatgattatgaggggccaagacatttatagtggccaagatgaggctactacttcaccttcctctagtgaaagtgaagaagcaaaaggggaagaatctagtgaagaaatatccccccaagaagaaggggaccttttaatggtttag

SEQ ID NO: 63694 - DNA, 762 bp, Glycine max
  Peptide Sequence Number=SeqID_155379
atgggtgatcaagaggagacgcaggaacagatgaaagccgacatgtcggctctgaaagaacaaatggcctccatgatggaggccatgttaggtatgaaacagctcatggagaagaacgcggccactgtcgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcatcagcagcccgacgaggtccataaagaccctcaagtttatgctcggagggatgtcgagttttatcccccgatccccgaagggccggcaccaggcacgttgccccaacccaacatcgcagcatcgccaatagttttgtctatggaagggccgcccccggcaactgaagaaaggaggaagctcgatctcctcgaggaaagattgagggctgtggaaggattttgccccccggactatccgtttgcagacatgacggatctaaaaaaaaaatacccgatgttgttattcccccgaagttcaaagtgccggacttcgataagtataaagggacgacttgtcccaaaaaccatctcaagatgtactgccgatagcttggccggagctgcggtaccccccgcacactaa

SEQ ID NO: 63695 - DNA, 719 bp, Glycine max
  Peptide Sequence Number=SeqID_155380
gcaaggtactcgtaaaaaaggcagggacaagttctgcaaaaactgatgatgtcgcacaccaagtgtttgataatttgtcggaatgcagtgttgaatctaaatcttcccaagagatttcttgcaccttaggggacaatgattcaaccactgatgatgattcatctcactcctgtggctctaagtcatcatcgcagctagacgacaataaggctcccactccttgggtcaatcttttcaaagataacagaagcccttccaaaggttttggaatgaagttctcccctccaccctctgatgatgaagtgctgttggaagaaattgatttgcaacccctggaagaggcttggggacatagccttattggctatgtggctggtcgattcccaggaaagaaagctctgctggattgttgccaaaaatggggagtcaagttttcatactcagctcatgaaagtggttggctggtgtttaaatttgagtctgaggacgatctgaaccaagtcctctctgcaggcccttacttcatatttcaaagacccctactgctgaaggttatgccagcattctttgactttggcaatgaggagttcagcaagatccctgtctgggttaaactcagaaatctacctctggagctttggaatcctcaagccttagggaaaatcctgtccaagattggttcgcccattcgatctgaccatcttactgcttctaagtag

SEQ ID NO: 63696 - DNA, 171 bp, Glycine max
  Peptide Sequence Number=SeqID_155381
atggaccctaagagaataaaggtcattcctgagtggcccactccaccaagtgttgaaggaaggagcccagagtatgaagaacctcgggatttgaggtcaaatcctttccaaggtggagggaaacttgatggaagcttgcttgtggagcttctatggaggctggatctttga

SEQ ID NO: 63697 - DNA, 512 bp, Glycine max
  Peptide Sequence Number=SeqID_155382
atgggatcaagtcaaatgccttcgcttaaaaagaggttctatcaagttaaggtcaagagcctagggaccaccagtctaaaggagttagggcagttaatgggtcagctccagcggcaagcttttcgcaaagattacggtaaaatttgggacttagccatgctatcacccatggtagaagaatttgaagagatcctagggtgtcctctaggggggaggaaaccatacctcttcacaaggttctatccctcattagctagaatttccaagatagtccaaatcttggcgcaggaattagaccacaggaagcaagtcgaaaatggggtggttggaatgccgagaaaatatttggaggcaaaagcaagaatcttggcaggtaaaggcgagtgggccccgttcatagatattctcgcactgctgattttcggaggattcctctttccgaatgtggatgggttggtggacctggcagcgatcgacgtttttctcgcctatcataaccacaaggaaagccc

SEQ ID NO: 63698 - DNA, 276 bp, Glycine max
  Peptide Sequence Number=SeqID_155383
atggtcattgaccaatcccttttccatgacttaacccaattgtccagtgacggtgtaccatttgaagggcgctcaacccctgatgaagaaggcaacctaccagttgaagataattccactcttcttcgaaggcttatggacaagtttaatgccatggaactgcaagtcgacatgcggttcgatgccatggaatcaaggatcaccaaagttgaagaagatgtctccttcattcgtacttgctttgatccaccaccaccgcctccatcatcatcttag

SEQ ID NO: 63699 - DNA, 201 bp, Glycine max
  Peptide Sequence Number=SeqID_155384
atggatgtgaagagcgcatttctgaatggatacctgaatgaagaagtctatgtggagcagccaaagggatttgtcagacccaactcatccagatcatgtatacaggctcaagaaggctctctatggattgaagcaagctccaagagcttgcggatgtcgaatgagagcttcgacattttgtccaacagctatgcaatctga

SEQ ID NO: 63700 - DNA, 198 bp, Glycine max
  Peptide Sequence Number=SeqID_155385
atgtctgcttacagtcgttttgttaatcgcgagcctcgcgctaagcgcacctttggtcatacgctaagccgcgagtctcaagcgcttagcgcccaacctttgcatctgaggctgatctggtccgctaagctggccaaggatgagctaagccaacttcaattcgatctgaattcggctaagcttcggcctgatcgctaa

SEQ ID NO: 63701 - DNA, 411 bp, Glycine max
  Peptide Sequence Number=SeqID_155386
atgtcgagagcactccttcttaaacaatctttctaccttctcctatcaagggaaacatcccttagcaccgccatacctcttgagcttgaggttatccctcaagtaaaggagttgttggatgagagtttggttcgtaagagcttaaatccttgtgctttgttggtgcccaaaataggtattatgaggcaccaaatccctatgataggtggtatgatgaatttgttgagtggtgcaaccctattttgtaaaatcactcatgcacccaacatcttcatgatttgtgtacatagggactcattagaaataatcagcatgaaaataaagaaaaagttcccatggaggcaggacatattctttaaggaatgccgtgccaatttgataaggaagatcatttacaatgacctaaagtaa

SEQ ID NO: 63702 - DNA, 216 bp, Glycine max
  Peptide Sequence Number=SeqID_155387
atgtcaagctcccctagcttggacgactattgtttaggcttcttctggcaagttgtctggggtggacatgcttttgatcttgcaagcaaagttagacgtgtcagatgcaatacatgggtgagtggagctgcatcatggtttaaaaaattaaggcaccattttagcttatgcgagttaccgaaaagtcacgcctccactaatggagtgaaagtctga

SEQ ID NO: 63703 - DNA, 405 bp, Glycine max
  Peptide Sequence Number=SeqID_155388
atggcagggtgtggagcaaattggatagagctttatacaaccaggcctggttcaattcctttggaaattctacttgcttcctctccgaatccagtgatcattgcctcttggaacatcagaggctttaatttgcctctgaagcatcatgcgatgcagagcttccttcgctgcaaggaaattaacgtcatggttgtgttggaaactaagttgaataaggctttagttgaggaaatcatgagaagaaagtttggtgactggcacttcacccataacttcgcttctcataatgctggcagaattcttatcctctggaagcaggataagatccatttttctgttttagagtcaaatgcccaattgattcattgtgctattgattgtaaaatcattgccaagcactttcag

SEQ ID NO: 63704 - DNA, 411 bp, Glycine max
  Peptide Sequence Number=SeqID_155389
atggaagggttagtggacctagcagcgattgacgctttcctcgcctttcatcatggcaaggaaagcccggtcgtcgccattttttccatgtatgacacgttcgaccgaggatgtgaaaagagcagcgcaagaattgtttgttgtgcactgactctctatgtgtggctggtttcacacctttttctccaagaaggtaggcctgtctatccgctacaaggatgtccaaatgttcccttgatgggaacaaggggttgtattaattataatcccgtcctctccataagacagcttgactaccccatgagagaagtgccatcagacgaaagcatcacgcctttcatcgcacggggtttcagtgaccacaacgcgagggtactccaaggagttcgcaaggcatgggatgcggcgtga

SEQ ID NO: 63705 - DNA, 531 bp, Glycine max
  Peptide Sequence Number=SeqID_155390
atgattatccacaccttttgtcagctagaggctagtgagcccattgacacgcagagactaacgtcatcatctgcacctttgtcatccagagacggcgagtcagatgacatacggagataccttatggttatcagcaccttttgtccgctagaggcaagcgtgcccgttgacacacaaagactaatgtcgtcatctgcaccttcgtcatccagagatggcgagtccgatgacatgcggagataccttatggttatccgcactttttttcaactagaggcaagcgagcccgttgacaggcagagactaatgtcgtcatctgcacctttgtcatctagagacggcgagtccgatgacatgcagagataccttatggttatccgtaccttttgtcagctagagctagaggcaagcaagcccgttgacacgcaaagactaacatcattatctgcacctttcccggagaggtcaacgtcttccagccgagactgcgaaaaagtctcgtttctaccgtcaggcccaagggtccggtag

SEQ ID NO: 63706 - DNA, 830 bp, Glycine max
  Peptide Sequence Number=SeqID_155391
atggcgatcccggttgtatggctccgcttcctccaaggaaatgtggaaattcatcatccctcggctgcctctgtctctcctgtgtcagcttgtggggccgcactgaaaccctcttcaatggtgcctttcccggacctcttcgcagggagcttcttcacagccaattctaggttacctcctagtagcacttctttaaagtctagagccgtgtcataccctaatttcgtccggggaccatttgggtgtacaaatagcaaccaagcccacttggaccttccagggtgttccaacagaaagcggtgccttctggtggtagcaacccagcttgcctgggcgagctgggcgacaaccacctccctcttttcccctataaataggggaaagagggcagagcaaattcgttcaaccctcctgtcctacggagttcccgtcacccccagtaaagtaatccgactaccgatcactcgtgccttcatcgagaagtactgcacgcctaggcaagcacagggtgatgcacatcaggccgcaaacgcaccgccaccaccttggcaggccgatccagctgggtcactgggtgtggccaaccaccatggacaggtgcagatacatgagtgtttctaccggtttagcctcagtcagcaggggcagggttccgccccttttgtatgccctactccgaagcagtttggggctgaggtcgcatggcctggagactggcccgacgctctggcaggggaggagcctgcaggatctcccggtgaggcagatgaatcacgtatggatgaagatatgactgacctgcttggtttcttgggagggagcggagccac

SEQ ID NO: 63707 - DNA, 834 bp, Glycine max
  Peptide Sequence Number=SeqID_155392
atggagaacgtgcgtacgcaggtagccgcctttctcaatgcccgctcgcccgaagaactggtgtttgtgcgcggcacaactgaggggattaaccttgtcgccaacagctggggcaacgcccaggtgcgcgcaggggataacatcatcattacccagatggagcaccacgcgaatatcgtgccgtggcagatgctctgcgagcgcgttggggcgcagctgcgggtgatcccgctcaatgttgacgggacgctgcagcttgagttgcttgacggcctgctggatgaccgcacgcggctggtggcggtcacccaggtttctaacgtgctggggaccgaaaacccggtcgcagagatcgtcgataaagcccatcaggcaggggcgaaggtgctgattgatggcgcccaggcggtgatgcaccacgcggttgacgtccaggcgctggactgcgatttctacgtattctctggccacaagctctacggtccaaccgggattggcgtgctgtatgtgaaagaggacatcctgcaggcgatgccgccgtgggaagggggcggatcaatgatcgccaccgtgagcctgacggaaggcaccacctacgcccgtgcgccgtggcgttttgaggcgggcacgcccaacaccgggggcattattgggctgggggcggcgatttcttatgtctcggcgatcggccttgaggccattcaggagtatgaacagctgctgatgcactatgcgcttgcggaacttgccagcgtaccggatctgaccctttacggcccggctgaccggcagggggtgatcgcgttcaatctcgggaaacaccatgcctatgac

SEQ ID NO: 63708 - DNA, 399 bp, Glycine max
  Peptide Sequence Number=SeqID_155393
aaccagaacttgttgattgtgacacaaagggtgtggaccaaggttgtgagggtggtcttacggatgatgctttcaaattcatcatccaaaatcatggactcaacactgaagccaattacccctatataagggtgttgatggaaatttccgtagctatcgatgccagtggctctgactttcagttttacaagagtggtgtcttcactggttcctgtggaactgagttggatcacggtgtcactgccgtggggtatggtgttagtgatgatgggactgaatattggttggtcaagaactcgcggggacccgagtggggtgaagaaggttacattaggatgcaaaggggtgtggattctgaggaagcactgtgtggcatagctgtgcaagcatcttacccta

SEQ ID NO: 63709 - DNA, 390 bp, Glycine max
  Peptide Sequence Number=SeqID_155394
atggacatgagcattggcgatttgatctctggaaagatgaccatgatggctcagtctaactcttctcgcttaggcttcctagctttaatcacaaccttgtgtagatcgaggggagttggatctgatgctcttacctcctacgagaacctaagaccggtcattgacttagcctatatcataaggaactgttggaatgcgaatgaccaaacaattaattttccagaggcaaggaagaccacgctcagagcagctgatgttccctcttcctttgcgccaatagctggcatcccaacatcttctacttcagccccacctccagctttagcagacccatctgcccaaagctcccagactacagatgccaaattgcaaagcctgtttgaaggatag

SEQ ID NO: 63710 - DNA, 318 bp, Glycine max
  Peptide Sequence Number=SeqID_155395
atgaccaaagtgaacaaagagccatttctaggagttttctgcctttgccctgttttctttggctgtgatggtttgtgttgtttgaatgttgagttacttggatgttggggaaagattgggaggattgatggggacccggtgtttgatagaaacgaggatatgggctacgtgggagtacgtgagctcagtttggaggtgggcaacaggggatggtgggtttatgcgcgatttgtggatgtggaaaacttgttgtgcaccattgcccgaccgccatctagtaccacatgtgatgggtaccccataatcctacaagcttga

SEQ ID NO: 63711 - DNA, 477 bp, Glycine max
  Peptide Sequence Number=SeqID_155396
atgaccatgattacgccaagctcgaaattaaccctcactaaagggaacaaaagctggtttaggctattcataagtatcttatatagtacggtgaagtatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 63712 - DNA, 201 bp, Glycine max
  Peptide Sequence Number=SeqID_155397
atggaaaaatctgacaagaaaaacttcaaagataagaaacgaaagaaagcttatatcacttgggaagataatgacatcgattcatcaggtgattcagtaaacaaagtcgtaaatcctagtctcatggccacaaactatgaaagcgaagaagagatgcattcaatgacttgcataaagaatctgtcaaacttgccaaattag

SEQ ID NO: 63713 - DNA, 654 bp, Glycine max
  Peptide Sequence Number=SeqID_155398
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggaagtgtttggaggaaaggggcaaaggccttggaaaatcaaggtgaatgggctttcttttattgacatcttggcgtttttgatctttggagttgtcctctttccgaatatggaagggttagtggacctagcagcgattgacgctttcctcgcctttcatcatggcaaggaaagcccggtcgtcgccattttggccatgtatgacacattcgaccggggatgcccgtctatccgctacaaggtcaccgctcgtgcgtcgaaaagggaaagggagtcaagaacttccccgattgctaaccaaggccaaagcagtggcggacacctactccgcccccgaggagatccatggacttctcagctattgtcagcatatgatagacttaatggaccatatgattag

SEQ ID NO: 63714 - DNA, 207 bp, Glycine max
  Peptide Sequence Number=SeqID_155399
atggataatgaagagggcgtgcaggaacagatgaaggccgatttatcggccttaaaagatcaaatggctttcatctcggaggtcatgttaaaactccagaaaactatagaggataaagccacggcaaccgcctctagtatagcccacaagcctacccctatggcttgcctccggacttcgctccctgtgccgccccagaagatttaa

SEQ ID NO: 63715 - DNA, 138 bp, Glycine max
  Peptide Sequence Number=SeqID_155400
atggtagaggcagagaaggagatattggaaacatttagaaaagtagagaagtgttactatcctgttggtttcatagaggatgcattagttagagctggtggtgaactgattttacctcttgttgattttatattttga

SEQ ID NO: 63716 - DNA, 234 bp, Glycine max
  Peptide Sequence Number=SeqID_155401
atgactgaagcacgtcaaaagggggtacgaaaagtaaatgaaacgaaaataaaagttcgcgaaacaaatggggaccacgaaggaccgaaaaacgaagaagaacgaacgacgaacgatgaagaacggttgaaaatcttcgcgaaatcacccacggaaacgttacgaaaacgttacgaaagcatctcggcttggattttcttcacggaaacaattttcctcactaatttcaagtga

SEQ ID NO: 63717 - DNA, 271 bp, Glycine max
  Peptide Sequence Number=SeqID_155402
agatttcagaagccgtgcgcgctcgaaaaccttgccctacctcttctctttgtcatcctcctgcctgaaatcgttgttctctttctcctcccgcccgaaatctgccggaaaccactccgtcgacacccacattgtcgttggtcgaacccacagaatcccctacaccgtcggaaaacccacattgtcctcgctggaacccacagaaccccctacactgtcgaaaaacccatattgtcgtcgctcgaaccccacagaacccacattgtcttag

SEQ ID NO: 63718 - DNA, 420 bp, Glycine max
  Peptide Sequence Number=SeqID_155403
atggagacacttcagaaggtccgtaaggcatgggaggtggtgcaaaagaaggacaaagaactcaggggcagtaacagtgggcccatcggtggctaccgaaggtggttgaaagcccacgtgcaaggtttggattggttcccgagtttgagaaccactaaaagggaggaagttgaggcaccggaggaaaacgaagaggaggagttagctgcttgcccaagatccaagaagagtttggcccaacacttagaagccacagagcaaagcatgctagctataatagggcagtacaaagaagagttcaaccagtctttgacccatgagcaaaagctagtagaggactttgcacaagcatacgccgagaaggaagcaagagggagggtgattgatgcattgcatcagaacgaccatgtggatggatag

SEQ ID NO: 63719 - DNA, 48 bp, Glycine max
  Peptide Sequence Number=SeqID_155404
ggttgatcccttttgttcagagagcaatctctggttgcacgggtagtg

SEQ ID NO: 63720 - DNA, 694 bp, Glycine max
  Peptide Sequence Number=SeqID_155405
ggccaggaatgtgagtatggccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacgttgctgctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcataggactctgccagtcgttcggagtccccgttgcacctaccaaggtgattcggccgcccatcacccgggcttttattgagaagtactgtacccagagacaggctcaggcagtgtttacggcatttggttcgccagcaggcggccaaccaccgagcacataccagttcagggcagaggtagcatggcccggagattgggggggaggccccaagcaggagaggcgcccccggacgctcccggcgatggagaagaagcccacgaggatgaggagatggccgatttgcttgacttctcaagagggagtggagacac

SEQ ID NO: 63721 - DNA, 639 bp, Glycine max
  Peptide Sequence Number=SeqID_155406
atggaagagagcctctcacctttccttgtgagagatttcggcgcgcaaagtctcaagattgtacaaagagtcaacaaggcgtgggaaagcccgttaaggaaagataaagaacttaggggcatccgcaatggcatcatccgtggttatcatgaatggctaagagttcatacacgagggttagattggctctccaatttgaaaattatcgacgaggagaacttcgaagctccggaagaggatgaagaggtccaagctctaaaattagagctaggaaaggcaagactcgccaaagaaaaattcaagtcagccgctacaaacatccgaaaagagtgtgccgagttacgagaggaaaatgcggctaccgcaagagccctagagcaagaaaccaagagggctcgcaaggaagagcatggccgagataaattccaaggagctttgtggggcagcaacaatgagctcaaactccggagagaggaaagagaacagtcacaagtacatggcatggtcttaaaggaagagttagttgcttgctcaagatccaaagaggagtttggcccaacacttaaaggccacagagcaaagcatgctagctataatagggcagtacaaagaagagttaaaccagtctttgacccatga

SEQ ID NO: 63722 - DNA, 384 bp, Glycine max
  Peptide Sequence Number=SeqID_155407
atggatgagtactttagggtatcaaattgtaaaagtgaaaaagatatgtgggataccctacaggatatgcaaaagaggttcacccacattgtaaatcatcttgcatctttaggaaaaatatttcaaaatgaagatcttgtcaataaagtgttaagatacttaagtagggaatggcaaccaaagaaacatgaaatggaattgatgagattgaattgtagaagcaagcttcatgatgatgaacctagcaattttgatgatgtcaaaagcccaagtgatagattcaatacttcaagatcaagcatcaagaatccaatccaagattcaagattcaagggaagaaatcaagaagaaacaagtcaagacttcatatggaataagtattaa

SEQ ID NO: 63723 - DNA, 351 bp, Glycine max
  Peptide Sequence Number=SeqID_155408
atggaagactcagacaaatgtggattgtatgttgatgacagtcctccccgactagttgctcttagaagagtttatgaggggtcgatgactatccataacgttcctttgggcaatgatcaagtgaaggttggtgttgaggaagtccgacatgctgatgctcgcgttcctgtacccactcaagaggttcagttaatggggcagacacttaacaccttccttatttggccgacacatcttgtaaagccttttttagaacagaataaacaagtagctaagggactgacaaaacctatagatatgttggatcctgacgttgatcccctgtacctgatgatattgaccatcccgtag

SEQ ID NO: 63724 - DNA, 204 bp, Glycine max
  Peptide Sequence Number=SeqID_155409
atgttgaatttcagtacacgccagtccaaccggttaaaccggaacccgggcatagcaccggttcgggtcacatatcaaatcggatatgcatctaacccggtgccatgtaatcaacccaacactgaaccagtaagaactgggaaactcggtctagtcggatacactcaatttcccggttgtactctctcactttgcaaattataa

SEQ ID NO: 63725 - DNA, 249 bp, Glycine max
  Peptide Sequence Number=SeqID_155410
atgtgggacactcttcaattaacacatgaaggaactacagatgtaaaagtaaatcatctagcagccttaggcaaagaatttcaaaatgaggatcttataaacaaggtgttaagatgtttaagtagagaatggcaacccaaagtaactgccatttatgaatcaagagatttgtctaacatgtctcttgccactttatttggaaagttgcaggaacacgagatggaactattgaagatggccccaaaatga

SEQ ID NO: 63726 - DNA, 612 bp, Glycine max
  Peptide Sequence Number=SeqID_155411
atgccgacgctatcggccaactcctgggatatccgttggtgttggaagagggccaggaatgtgagtatggccagaggaggaaccggtctgatgggttcgatgaggaggccatcgcccagctgctatgtatggcgcctaccaggcatcctttggatccagataagtccaacagagcctgggattttcctcgctgatcacaggactctgccagtcattcggagtccccgtgcactaccaagacaggctcagggtgatgctccacaggccgcaggcgcgccaccaccacctcatcaggctggccaggctggggtatttgacatggagcattatttacggcatttggttcgccagcaggcggccaaccaccgagcacatgtacagacccatgattgtctataccagatgagccttagcatgcagagccagggcttcgcttctttttcatgccctactccagaccagttcagggcagaggtcgcatggcccggagattggcccgaggcccaagcaggagaggcacccccagaagctcccggcggtggagaagaggcccacgaggacgaggagatggccgatttgcttgacttcttgggagggaatggagatacgtga

SEQ ID NO: 63727 - DNA, 354 bp, Glycine max
  Peptide Sequence Number=SeqID_155412
atggcatctagcaaagaaattgcatattctgaatggtcatttgcctcactaactgttctaaggaaggttgaagaggagcctcagttgcttgttgtctttgttgtgactgctgttgttgctgttgctatattgaaggaggaacatatggcttgcttggaccaacagcattctaaaaaggagggacaggttgttgttgttgttgtggaggacttgtccatctcagatttggatgattcctctaacctggattgtatatattgcttgaaaggtcataattattctgctattgttggttttgctactgaggaggtctattataaatgtttgcagcataagcttcaggttgctcattga

SEQ ID NO: 63728 - DNA, 546 bp, Glycine max
  Peptide Sequence Number=SeqID_155413
gattcctttgaggagcaggtgacacaaggattcttcgtccctcatggacgtcgggatgttctcaccactgctattggacgtctagagcaccctggacatgtccgtgctgctggagtcggtgtcaccatcaagcaatacttcggatcggctccacggatgtcccgcagctcttcctccctgcctcctgaagaattgcagcaactggcccagcaaatcaggaaccagccagaggagtcgatcacaaaaaaagtgactcggcagctcatgggacttgcactgcctccggagcctctggttggtccctcaagtcctcgagtaagcacaaaggagagttgtgttgatccctcaggaaacaatcctgagacggatgactcagataggtgcggcttgtacatcaaagcaaatccttcccgcctggttgccctggggagagtttatgagggatccactgttgttcataacactcctttgttgcccggccaagtaaaggtgggtgtagaggaggttaaagatccagatgctgcagttcctgtacccactaatgag

SEQ ID NO: 63729 - DNA, 621 bp, Glycine max
  Peptide Sequence Number=SeqID_155414
atgcgcaccagtatgaccaccttgacccagatgtggatgacattgctgctcagcaatgtcctgcctagtgatcataactccgaccttcctctaccgacgtgtcagctggtgtatgccatcctgacacggatgagcgtccatgtggctcagttgattgctgacgccatctatttatttgcaggtatgccacccaccaggcaccctctagacccggataagtctaacagggccctggggtttccagcattgatcacaagcctctgccagtcattcggggttcccatcacacctagtaaggcgcagggtgatgcaccgcaggccgcagacgcaccgccaccacctcatcaggctgatcccgctgggtcattagacatggagcggtatctacaacacttggttcgccagcaggtggccaaccaccgagggcagggccagggtttcgctccttttgcgtgccctactccagatcagtttagggctgaggttgcatggcccggagattggctcgaggccctggcaggggaggcacctgcaggagctcccggcgatgcagaggaggcccgcatggatgaggagatgacggacttgctcggtttcttgggaggaagcagagccatgtga

SEQ ID NO: 63730 - DNA, 309 bp, Glycine max
  Peptide Sequence Number=SeqID_155415
atgtaccctctcttgttctcagttacaaaaacccaagtagatgtaccctctacttataccacaaaggatgtaccctccaatgtggtaagacaaagttctcaggcggttagtccattgaaactttgtaaaggggaaacaaaagatatctcaggcgaagaacagggtttggaaaacaaaaaacttagaaagctttttggcaaaggaagaagaagaagaaagataagtaggaaaggtttcaagatttctcaaaagatgttcaaagaagttctaaaagttattcaaatgcaagtcgaggtcttgcttttataa

SEQ ID NO: 63731 - DNA, 267 bp, Glycine max
  Peptide Sequence Number=SeqID_155416
atggtggtggtggtagttttcggttatggtgaatcatgggttggcagggctataatggtggtgtgtcacgatgctaaggtgatggtggtttgtgtgccaatggggtttttgtttataagccttggtcgaatgatcttcaccaccaaaatgatccatattcttaagcttggaagggatgcttcaatggaggaaaagaaagatggggagaaagagagaggggggagcacgaaattgagggaagaaaaagggagaggagttgaactttga

SEQ ID NO: 63732 - DNA, 198 bp, Glycine max
  Peptide Sequence Number=SeqID_155417
atgacgagagatgcctcaaagttcacaactatctctcctaagaaaaacggacatgtaacctatggtgacaacaacaaagatgatgacaaaggtgatgacaaaaagctcaaagatcaatcaaagaacaactcaagtgactcaaagatcaatcaaagaacaactcaagtgaatcaacaacaattcaagagttcaagataa

SEQ ID NO: 63733 - DNA, 272 bp, Glycine max
  Peptide Sequence Number=SeqID_155418
atgactgtggcggataatattaagataactctccctaaaatcgaaagtgctaaaaagtttatggggttagtgggagagcgctctcaaacagctgataagtctgttgctgggacattaatgagtacattgaccaccatgaagtttgatggttcacgtactatgaatgaacttgtcattgagatgacaaacattgcaacaagactaaagaccttgggaatgactgtgaatgagaacttccttgttcagtttattttgaactcattaccgtctga

SEQ ID NO: 63734 - DNA, 479 bp, Glycine max
  Peptide Sequence Number=SeqID_155419
atgagtcatcattcatctagtgttaatggtgagagtactagtcataaggaccctctatctagaatcttagatgagttgagtttcctcaagttatggaaagaaaagaaaaaggaaaaaaagagggtagaaataaatcaagatgaaagagaacaaataagagaggaagaaagaagaaaaataatgaaagaaatgaaaagagaaaaccatgcctcctatagtagtcatgactcttgcaagagtttaagagaagaacttagctactattatagaaggcgccatagttcacatattaaacatcattcccaaagaagagaaaaggatataaggcctcaagaggttaacattagcctcccatatttccatggaaaagataatgttgaggcctacttagattgggaaatgaaggttgaacaactctttgcttgccatcatattagcgaagaaagaaaagttccattggctacccttagctttcaagg

SEQ ID NO: 63735 - DNA, 183 bp, Glycine max
  Peptide Sequence Number=SeqID_155420
atgaagagcgagtcaactgacttaatgatgcaagctccattggagcttgtaggcttaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 63736 - DNA, 291 bp, Glycine max
  Peptide Sequence Number=SeqID_155421
atgacaatagtttctgctttcgccccaccatgctcaaatcctttaatgcaatctcctgccttacaacttcctattgcatcttttggtcaactagaacaatcctcgttgcctgaacatgagaaccttgagtcacaaaactcaccaattgagtcaaaccttgagcttagacctcctacctcaatacaaccacttgaatctgcctcttctacccagactcaacttccacatgttgtacctactcatcccatggttactagctcacaacacggaattacaaaagcccaaccctaa

SEQ ID NO: 63737 - DNA, 129 bp, Glycine max
  Peptide Sequence Number=SeqID_155422
atgccacttcaaggagaatatgagtcaagaataagctcaccaccagaggaagccatggataagagcttgaaggtaggaaaagatgagtggagggagagaagaagcacgaaattttgtgcctcaaatgag

SEQ ID NO: 63738 - DNA, 258 bp, Glycine max
  Peptide Sequence Number=SeqID_155423
atgttggtgcgcatgacccacactcatctctttgcagcggcacgggtgaaatcttgccccggtatgcataatagctgtgtgatagcctccctctctggttgtgctcgcatagttggtcgccttccaatatcaggggggcagaggaccttaaattctcttaaggtgtccatatggagcccactgaaagtgaggacgtatagtcctctaagggcgagggcgtgcagccctctgaagttgagaatgtgttgccctttgaag

SEQ ID NO: 63739 - DNA, 643 bp, Glycine max
  Peptide Sequence Number=SeqID_155424
atggctggttacatttcactacttcagtgctggatttacgagcactttccatcagtccacaggtctgttgttgacgatggttatgctgaggctagcccacgtgcctgtaggtggcttacgggtaaggcccagatgaccggcattaagggagccccttacagagcacggattgatgccctgacagtcactgacttgatctcctcgtacatcgggcaagtcagatggggtccgatcatcgtctaccttcgaccaaagagggtggttcggcagatggggtacattcagacagttcctccgccaccagttcatgattcgttgacaggtactgataaagacgaccggtgggtacagtttgcagatcatgtagcgcctacaggggagctctgtgtagttcctgggcagacctgtgtctcccttcccactcctgatgatgacttcgtggagccacctgtcgcccaggttccagtcacgtcagatccccctgcgcattctgtggttgattgcacagcatgtgtcaggatgggaaggattgctgagcagttggagcgcgtcatcaacctcaggatggtgactgcagggactgacttatatgatatcatggatctttgcctgaggatagctagagatgacgacccagatgaca

SEQ ID NO: 63740 - DNA, 462 bp, Glycine max
  Peptide Sequence Number=SeqID_155425
atgaccatgattacgccaagctcgaaattaaccctcactaaagggaacaaaagctgcaaatcaccatggcacatgtatacctatgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 63741 - DNA, 357 bp, Glycine max
  Peptide Sequence Number=SeqID_155426
atgcataaggcattgcgattaaatgctccttttccctatcctcacttagttactttgttccttcaacattttaacatccctcttgattctgaaccttatgttccaatcaagagatctttcttgatcggtgctgttgtggttgcctcctttggttaccgcaaagagcgtgatggctcttggagtattttggacaggtttgatggacttcaaacctatgttggtgagaggtttgactccttggaacgtcaagtggacacacgattcgaggagatgaactcaaggattgcaaaggttgaagaagatgtcaccattattcgtgactactttgatttacctccactaccaccatcagtttag

SEQ ID NO: 63742 - DNA, 489 bp, Glycine max
  Peptide Sequence Number=SeqID_155427
atgtgggtctttaatacagggcgtcaacttgactgggcacacttagtccgatattgcatgcataaggcattgcgattaaatgctccactaccatatccacagcttgtcactctctttttccgccattttcaaattcctcttgattctgaaccttatgttccaatcaagcgatcttttttaattggtgctgctgtgattgcttcttttggttaccgcaaagagcgtgatggctcttgggtcaaaaagggtgttccacctgctgatgatgaaggccatataccagttgaagataattccactcttcttcaaaggcttatggacaagtttgatggacttcagacttttgttggtgacaagtttgatgccatggaattgcaagttgacatgcggttcgatgctatggaatcaaggatcactagggttgaagaagatgtctccttcatccgcacttgctttgatccaccaccaccgcctccttcatcctcttag

SEQ ID NO: 63743 - DNA, 333 bp, Glycine max
  Peptide Sequence Number=SeqID_155428
atggggagcttatccaatggtgttattaatgctagaaaaatccagaatttaaagagggagttgaacattttggaggcaggtattaatgatagaacattgtctcaagctgaagtggagctcaagaaataccttcaggataagctctggaatgcagcttatgcttttgaatccatgctgagacaaaaggccagactgaagtggttaaaagaaggggacaacaattgtaactattttcatagactgattaatcatagaaggaggcacaatgctattcaaggtttgatcatggatggtgtgtgggtccatgagcctagtagtgttaaaaaattgtaa

SEQ ID NO: 63744 - DNA, 264 bp, Glycine max
  Peptide Sequence Number=SeqID_155429
atggaggagaaagtaaagctgaaaattagtggaggtttaaggagcacctacttgaagctcttgtgctctgataccacttgttggaagcttgcttatgaagcttctatggaggctagatctttgagcttcaataaggagaagcttcaccaccaagagagtgacttggataagaagcttaaagaggaagcttcaatggaggaagagaataccagagagagagggggaggagggggggggcgaggtgtgggaattgaaggagattag

SEQ ID NO: 63745 - DNA, 150 bp, Glycine max
  Peptide Sequence Number=SeqID_155430
atgggtaaatctcactattgtttccttgatggtttttctggttatatgaaaatcactattgctcctgaggatcaggaaaagacctacatgactgcccctttggcacttttgcctaatatgcatgcttgtactcttcatgcattgatctaa

SEQ ID NO: 63746 - DNA, 207 bp, Glycine max
  Peptide Sequence Number=SeqID_155431
atgattacaaaggtgatgaacaaaaagctcaaaagatcaaagaaaaactcaagtgaatcaaagaacatctcaagtaaatcaagaacaagtcaagagttcaagaatcaaggagaattcaagactcaagaagaaagcctagaatcaagaatcaagactcaagatctaaagaatcaagatcaagattcaagactcaagattcaagaatga

SEQ ID NO: 63747 - DNA, 591 bp, Glycine max
  Peptide Sequence Number=SeqID_155432
atgacggagagggagatgatcacaattatggtagatacgttgcctacgttctactatgaaaagctgataggatacatgccagctaagtttgcggatctcgtctttgtcggagaaagaattgagtccggactgagaaaaggcaagtttgaatatgcctccaacgtggcccccaacaacaacagaagagccccagtgatgggcgcgaggaaaaaggaaggagatacccacgcagtcaccaccgccccaacgtggatgaaagcgtcccaaaatatccaaagctcataccagcccaaccccccgaacttttcaatccgagccgggagctccctccaaactcaagtgaaaggaccacccgcaacagaaagaacgccggcccaacacacagctccagccactccccggccagtcaatactccgtattgtggccttcattattggagaatcatttggtggtggccatacccgggaaggtcctccagccaccataccccaagtggtacaactcggatgccaagtgtgcataccatagtggagctcccggacacctcattgactcctgcctcccgttcatgtataaggtgtagcacctaa

SEQ ID NO: 63748 - DNA, 613 bp, Glycine max
  Peptide Sequence Number=SeqID_155433
ctggtgtatgccatcctgacacggatgagcgtccatgtggctcagttgatcctgacaccatttatttatttgcaggtatgccacctaccaggcactctctagacccagataagtctaacagggccctgggttttccagcattgatcatgggtctcttccaatcatttggggttcccgtcacacctagtaaggtgattcgaccgccgatcacctgggccttcattgagaagtattgcacgcctagacaggcacagggtgatgcaccgcaggccgcagacacaccaccaccacctcatcaggctgatccagctgggtcatttggcatggagcggtatttacagcacttgattcgccagcaggcggctaaccacaaggggcaggtgaagatacatgagtgtctctaccagctcagcatcagtcagaagagccaaggtttcgctccttttgtgtgccctactccagatcagttcagggctgaggtttcctggcccggagattggcctgaggcccaagtaggggaggcgcccgcagagggtcccggcggtgcagaagaggcccgcatggatgaggagatgacagatttactcggtttcttggaagggagtggagccac

SEQ ID NO: 63749 - DNA, 264 bp, Glycine max
  Peptide Sequence Number=SeqID_155434
atgtacgcctctcttgttctcagtataacaactcaagtagatgtaccctctacttgtgccacaaaggatgtacccaccaatgtgttaggacaaaggattcttaggcgggaagggaaggatcaaaagaattctcaggcggttagtcctttgaaatctttaggaagagagaagggagacacaaaagaattcaggcggttagtccttctattcttttggcaaagggagaagagaagaaaagataacacacttttgttttctgcataa

SEQ ID NO: 63750 - DNA, 249 bp, Glycine max
  Peptide Sequence Number=SeqID_155435
atgtgtgttcatcttttcaactttgatcgtttgagaattaaacttcaaagtttggacttcttcagaggcactaaatttcgcgctcttctcttcctctcctttcattcatctttttctatcttcaagctcttatccatggcttcctatggtgacctcaagaagcaaaggaatccattgatgaagaagatccaaggcctacaagctccacatggagctacatcatgtggtatcaagagcatcttcatctag

SEQ ID NO: 63751 - DNA, 165 bp, Glycine max
  Peptide Sequence Number=SeqID_155436
atggaaattgctctagcttcattggagcttgaaggccaaggatcttcttcatcaatgaattcctttgcttcttggaagatgaatggcaacgaaatggagaaggaagagagagaggagatgccacttcaaggagaagatgattctagaagaagctcaccaccatag

SEQ ID NO: 63752 - DNA, 567 bp, Glycine max
  Peptide Sequence Number=SeqID_155437
atggcaagccaagagaagtggggcctgtttgcggatatactagctttgctgatttttggggttgtcctctttccgaatgtggatggtttggtggacttagccacaattgatgttttccttgcatatcaccatagcaaggagagtctagtggtggctatcttggtggacttatttgatacctttgaccgaaggtgcgagaaaaacagtgaacggattgtctgttgcttacccgctctctatgtgtggttggtttcgcacctattccaacaagacataagacatccgtgtccacttcaaagttatcgcgcgtgcgtcgaaaaaagaaaagtcgattgggaccaacacttggttgggataggaggcagcgcaatcaatatgtttcctcgatggaaggaaggcaaggagggagttattttcacgggtgcatggcatgatcttaaaagaagagttacctgcttgcgcaagatccaagaggagtttggctcaacacttggaagccacggagcaaagcatgctagctatcatagggcagtacaaggaagagttgaaccagtctgtgacccatga

SEQ ID NO: 63753 - DNA, 351 bp, Glycine max
  Peptide Sequence Number=SeqID_155438
atgcataaggcattgcgattaaatgctccattgccatatccacacctagttactcttttccttcaacactttaacatccctcttgattttgaaccctatgttccaatcaagagatccttcttaatcggtgccgctatgattgcatcttttggttaccgtaaagagcatgatggctcttgggacaggttcgatggtcttcaaacctttgttggtgaaaggtttgatgctctggagttacaagtggacatgcgatttgatgagatggattcaaggatcaccaagattgaaggagatgtctcttacatctgcacatgctttgatctaccaccaccgctaccaccatcatcttag

SEQ ID NO: 63754 - DNA, 471 bp, Glycine max
  Peptide Sequence Number=SeqID_155439
atggtggaagaatttgaagagatcctaggatgtcctctagggggaaggaaaccatacctcttctcagggttctacccctcattggccagagtttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtagctctctatgtggggctggtttcacgcctttttctccaagaaggtag

SEQ ID NO: 63755 - DNA, 288 bp, Glycine max
  Peptide Sequence Number=SeqID_155440
atgtcggatacaatgtccaggacatcctgctcgaaaatactggaagttgctgtacaatgcacaaagctgcaggatccaagatgtcggatacaatgtccaggacatcctgcccgaaaatactggaagttgctgtacaatgcattgaagttgcaggatccacgatgtcggatacgatattttttcaggataatgatagatctcatccagcacaagccgttgcagcccagatacgcacactgctatataaccatggaggctgcacgagttctgaaccaagtccgggattga

SEQ ID NO: 63756 - DNA, 280 bp, Glycine max
  Peptide Sequence Number=SeqID_155441
atgaccaagagcaagggcaaggatccacttgaaggacttggaggacctattgatgaggacatgaccaagagcaagggcaaggatccacttgaaggacttggaggacctatgacaagggctagagcaaggaaagccaaggacgctcttcaacaagtgctgtccatactatttgaatacaagcccaagtttcaaggagaaaagtccaaggttggcccaattggcaacctaggcatcagccttttgggagaccaaatggtggctgacttgttggctgttgggg

SEQ ID NO: 63757 - DNA, 424 bp, Glycine max
  Peptide Sequence Number=SeqID_155442
tctattctaaaatggttgttggcagaggatattgggtgtgtgactccacgtgtaaacttgggtgaggatactgtttgttgggcttttacacccaatggcaaattttctaccaagttagtgtattgtatgcttaaaggggaggagcaaaatgatgacatggatttttggaggaagaattaccttcatgctcatttgatggaggttgatgaggagaggagatctttgtttgttgtcaggctgaatatcatatggttagctccaaaaaagcttgtgtttaggaatgaagattttgatgtggacaatattgcctacaccatcaaggcccaggcgaggctcatgggtgcgcttcccaaaggaggaaagatgcgcggagtcgccaccaacgcttatttgtggaaaacgttgggaaaaccgaaggaaaccg

SEQ ID NO: 63758 - DNA, 168 bp, Glycine max
  Peptide Sequence Number=SeqID_155443
atgtcatcttatgacaataaaaaaaatagaacaactgcttctacatccacatgccaagccagtaatccttattccaatataacacagtcaggcattcatacaggtggtacttacattgatattggagatcctgtatgggaatgcccacattgtaaagctatgatgtag

SEQ ID NO: 63759 - DNA, 288 bp, Glycine max
  Peptide Sequence Number=SeqID_155444
atgaaccggcaagaagccttctggtcatatccgcttggttggtgcagaccaatcggcaggcatcatgcacagaaaaatcaaacttccaatcatcgtccagtgcaccttcaaatgggttcaatgatagaacgaaaggagaagaggtttgtgtactgtatacattgttcttccgatgagaacaatgaggaggaggaaatggaggaaggaattggagtatctgaacctcggaatgtcgttggcttctacacgaagaacctttgcgtttcttttgatggttccaccatttga

SEQ ID NO: 63760 - DNA, 177 bp, Glycine max
  Peptide Sequence Number=SeqID_155445
atgaggtgcaggggtgcttgcccaggcgagctaacctacactttttttttaggggagacgatactaggctgcgttgcagcggcgctttccatttgtccagagctaggcaagggacgacgacccatcggtcgtgaccctagcctctacttgcgtccgtccctaagtacccgaaagtag

SEQ ID NO: 63761 - DNA, 503 bp, Glycine max
  Peptide Sequence Number=SeqID_155446
atttcaaagctcatttggagcacaaaatgtcgtgctcttctctccctctcccttcgttcatctccttcctcctccaagctcttatccatggcctcctatggtgaagcaaaggaatccattgatgaagaagatcctaggcctacaagctccaatggagcttgggagcatcacaagagtttttatactggttcggcaacaacccgtgcctacatccaggtccccaagcgacctgcggtccttgatatttctttcaaccttgtaaaaatccttttacaagcaaagatccacaagggattcaaacccaagtcctctacttgtaccacaaaggatgtatcctccaatgtgttaagacaaagatctcaggcggttaaacgtttgatactttgtgaatggggatacaaaagaattctcaggcgggagaagggagacacaaaagaattcagacgattagtccttcgttcttttggaaaagggagaagagagacacaaaaagaattcaagcg

SEQ ID NO: 63762 - DNA, 423 bp, Glycine max
  Peptide Sequence Number=SeqID_155447
atggattggggtatgaacccgggatgccgggaaggaggaatgcgccgtcaagattccgggcggataggggcatggcccggccatgttagccagtgtttcaccagtgctggaataatgtttgaggaagaggtggcagcaatcggagaggagttccctcaagacccgccaagtttggtgcgggcatggcgcatcccgattcccaagtggggaactggcgcatatgagggtcgattctttgaggatcctaacaacgagggtttgataatcgattttgaccgagaggtaagccaaacaataagcgaagaagaggaagaggacgtcctttcaccagagttagagaggttgatcgctcaggaagagcgcgaaatgaagcctcaccaagaggaaaccgaactgataaacttagggaccggagagggatag

SEQ ID NO: 63763 - DNA, 276 bp, Glycine max
  Peptide Sequence Number=SeqID_155448
atgtcgtaccggatgtcacgacatcacacttcagaacatgcaaattatattggactgtatgaacagattaaacaaagtaacatcaaggtggctcacaaaacactcaagtcccaaaactcacaaaataactcttcaatcccggacttggtacagaacccgtgcagccttcatgtttatatagcagtgtgcgtatctgggctgcaacaacttgtgctggatgagatctatcattctcctgaaaaatctgcacttaaagatctaaaagatacagtttga

SEQ ID NO: 63764 - DNA, 716 bp, Glycine max
  Peptide Sequence Number=SeqID_155449
cttgaggaaaaacttgatgccttggtccacctagtaactccgcttgccatgaatcagaaatttgcatctgcacctgtttcaagagcctgtggtctatgttcttctgcagatcaccatacagatctttgtccttctttgcagcaatctgaagcttatgctgcaaacatttataatagaccccctcagcatcaaaaccaacaacagcagaataattatgacctttcaagcaacagatacaatccaagttggaggaatcatccaaatctgatatggacaagtcctccacaacaacaacagcctgtccctcccttccagaatgttgctagtccaagaaatccatatgttcctccaatgcagcaacagcagcaacaacaacaaagacaacaagcaactgagccccctcgccccttaaccttccttagaagaatggggcatatggctactcagttgaaccaagctcagtcccaaaattctgacaaattgccttcacaaactgtgcagaatccaagaaatgtgagtgccatcaccttgaggtctggcaagcaatttgaagtgcctccaccaataacagcacctgcacctgaacctgtcaagcttcattctacacctgaaaaagaggatgagatggttgcacaaaagagaaagcttcctgatcatgagggagctaacaaaaattttcatgcagatggaccttcttctagtagctctgacttgca

SEQ ID NO: 63765 - DNA, 330 bp, Glycine max
  Peptide Sequence Number=SeqID_155450
atgggatcgagtcaggcgcctaggctcaaaaagaggttctatcaagtcaagatcaagagcctaggagtcgctagtttgaaagagttaggacaattgatgggtcaactccagcgacgagcctttcgcaagacctatggtaagatctgggacctaaccatggcgaagttaacacccacggtggaagagtttgaagagatcctgggatgccctatgggaggaaggaaaccgtatcttttctcaggcttctatccctcattggctagaatttccaaaatagtcaaaatctcgacacaggaattggaccgaggaaagcaagtcgaaaatggggag

SEQ ID NO: 63766 - DNA, 561 bp, Glycine max
  Peptide Sequence Number=SeqID_155451
atgagcaaaccactacaaaaacccaccattctgaaggttgaaacggtcgccaaatcgcgcctgtttaatgtcgaaagtgtggaccttgagttcagcaacggagtgcgtcgtgtttatgaacgtatgggcccctcttcgcgcgaagcggtgatgattgtgcctattgtcgacgatcatctgattttgatccgcgaatacgccgtgggaacagaatcttacgagcttgggttttccaaaggacttattgacccgggcgaaacggtctttgaagcggcaaaacgtgagctgaaagaagaggtgggttttggcgcgaatgagctgtcgttcctgaaaaaactgagcatggcgccgtcctatttttccagcaaaatgaacattatggttgcggaagatctctacctggaatcgctgccgggcgatgagccggaaccgctgccgcaggtgcgctggccgctgtcgcagctgatgtcgctactggaagaagaagacttcaatgaagcgcgtaacgtcagcgcgctgtttctggtgcgcgaatggctacaggcgcaggggcgtttgtaa

SEQ ID NO: 63767 - DNA, 509 bp, Glycine max
  Peptide Sequence Number=SeqID_155452
agcaccctggatgtgtccgtgctgctggagtcggtgtcaccatcaagcactactttggttcggctccacggacgtcctgtagctctttctccctgcctcctgaagaattgcagcaactgacccaacaaatcagggaccaactagaagagtccattacagaaaaagtgacgaggcatctcatggcattgttctgccagatgaagtcccagatgcaatctcagggacttgcactgcctcccgaacctctggttggtcccttaggtcctcgagtaagcacaaaggggagttgtgttgatccctcaggaaacgatcctgagataggtgactcagataggtgcggcttgtacatcgaagtagatcctgcccgcctggttgccctggggagagtttatgagggatccactattgttcataacactcctttgttgcctggccaagtaaaggtaagtgtggaggaggttatagatgcagatgcttcagttcctgtacccactcatgaggtttcctaa

SEQ ID NO: 63768 - DNA, 429 bp, Glycine max
  Peptide Sequence Number=SeqID_155453
atggctcttgggtcaaaaagggcgctcaacccgctgatgaagaaggcaacctaccagttgaagataattccactcttcttcaaaggattatggacaagtttgatggacttcagacttttgttggtgacaagtttgatgccatggaattgcaagtttacatgcagttcgatgccatggaatcaaggatcaccaaagttgaagaagatgtctccttcattcgtacttgctttgatccaccaccaccgcctccatcgtcgtcttagcttaagtattatgactaagtattgtcatcatcaaaaagggggagattgtagacaaaggatcaagctgaatgttttgatgatgccaaaggattacatgaatcacatgcttctcaaagatttattcaagacaaagatattcaagatgaatgatcaagacagtctttag

SEQ ID NO: 63769 - DNA, 1035 bp, Glycine max
  Peptide Sequence Number=SeqID_155454
atggaaggaagaaccggagttcttatttcatgcggaggatttccaaatgttcccttattggggacgaggggttgcatcagctacaatcccgttcttgctataagacaacttggctaccctatgagaggggcaccactagaggatgagctcgcgcctgtcatttcacgaggcttcaataagaccaacgtggagacacttcagaaggtccgcaaggcatgggaggtgttgcaaaagaaggacaaagaaatcaggggcagtaacaataggcccatcggtggctactgtaagtggttgaaagcccacgtgcaaggtttagattggctcccgagtttgagaaccgctaaaaggaaggaagttgaggcaccggaggaagacgaagaggtgcaggcccttaggacggaactcaagcaagctcaaacagtcaaagaaaggttcaaatcagcagctcttaaaatccgaaaggagaatgccgaactgagagatataaatatggctaccaccaaagccttggaacgagaaaccaagagggcttgtagggaagaacacggccggaacaagttccgaggggctctgtggggcagtaacaatgagcttaagctccggagagaggaaagggaccaatcacaagtagacagtttgatcttgaaagatgagttggaggtttgcttaaggtccaaaagaaacttgtctcagtggttatgcgagacagagaccaacatgttagctatcgtcagcaaataccaagaagagctaaatctagctacggcccatgagcataaagtggcgaacgagtatgcccgagtgcacgcggaaaaggaggctagaggaagggtgatcgactcgttacatcaagaggcaacaatgtggatggaacgatttgcttttaccttgaacgggagtcaagaacttccccgattgctagccaaggccaaagcaatggcggacacctactccgcccccgaggagatccacggacttctcggctattgtcagcatatgatagacttaatggcccatataattagaaaccgctag

SEQ ID NO: 63770 - DNA, 483 bp, Glycine max
  Peptide Sequence Number=SeqID_155455
atgggctacatgccttccaacttcgcagacttggtctacgccggagaaaggatcaaggtgggtttgatgagggtaaagtttgattacgtctccccgataggtgccagtagtaggaggactagaatagctggggcaaagaagaaagagggagatgcccataccgttacttcaacacctgcgtggcccaagccaccacaaaccccccacggtacccaccaatatgcacaacatcacctgagtttttcggctcgtgccgaggcctcttccgatacagcactcacccacaggggggagctcttcaggctccggctccgactcggcctcactcggccaacaacgctcactttgacgcaaacacggcgaggaacttttcacctcgatcccaatgacatatggggaactcttgccatctttcatcaccaaccaattggccgtggtggtcccgggaaagatcatctggtctccattcccaaaatggtataa

SEQ ID NO: 63771 - DNA, 453 bp, Glycine max
  Peptide Sequence Number=SeqID_155456
atgaggggtagaggttgcacagcagctcgcccaggtgagctggttacttcatccctatgctttctagtgggcccaggggctgaaaaatgtcccaaaagtgaccatttttcctttcttttgaatattttgcacatttccttccgaaacgtcacaaaaccctacggattgcacggagctcaattcagctggcaagaatccaaatgtttgcaaacgatcgtaccggacgaaattaggggaagtaaagataaagacactaatttcgttcgagcgatctcaccatccgaccgaccactagcgaaagcccaatcaacgaaacctgtcaaaagaaagggcataagaggcatcagggaaaaagagactgtaatagtcttgaaaacaacaaaagtggatgaccatgattgtctccgcatgccaacggacttgattgtctctggaaggcaaaggacactgtaa

SEQ ID NO: 63772 - DNA, 204 bp, Glycine max
  Peptide Sequence Number=SeqID_155457
atgttgaatttcagtacaagccaggccaaccggttaaaccggaacccgggcatagcaccggctcgggtcacatatcaaatcggatatgcatctaacccggtgccatgtaatcaacccaacattgaaccagtaagaactgggaaactcggtctagtcggatacactcaatttcctagttgtactctctcactttgcaaattataa

SEQ ID NO: 63773 - DNA, 291 bp, Glycine max
  Peptide Sequence Number=SeqID_155458
atgtcaggatttacacgcgatcctcctcaaatttcagccagcccgcatcaattagaccttgcaccttacgctttagggccgtacaatgctcaatggaatgtcccggggcttctccatgacaagcacacgttgcgttcgagtcgtattctcggagaaatggaggttgatgaaccttggctggggttatggctaccattaaattatcaagtagatatgggagcaagtcagcataggacacaaggaagttttctcaagaaagcttctcaaggaagctacctagtctataaatag

SEQ ID NO: 63774 - DNA, 234 bp, Glycine max
  Peptide Sequence Number=SeqID_155459
atgatgatgacaaaaggtgatgacaaaggtgatgacaaaaagctcaaagatcaatcaaagaacaactcaagagaatccaagataatcaagaacaattcaagagttcaagataagaatcaagaagaattcaagactcaagaagaaagtctagagacaaggatcaagattcaaggttcaagatctcaagaatcaagatcaagattcaagaatgaagagaagacccaatcaagataa

SEQ ID NO: 63775 - DNA, 633 bp, Glycine max
  Peptide Sequence Number=SeqID_155460
atggtcaacctttacagccttctgttttgcaggttacaagttgtaccatatgcggtggtactcttgaatctggcctttgcattccttttgaagagcaaacgcaagaggttagctacatggggaatcaacaaaggtttccagcagggtccttacaaccaacaaggacagtggagatcacaccttggtaatcaattcaacaaagaccagggtggaccttccaacaggccgcctcaacaagggcctaacatttttcagaggacaaccaacctgaaggagactctgactcaattcatgcaggtgaccatgtcaaatcacaaaagcactgagtcagcattgaagaaccttgagatccagttgggccaactagccaaacaattagctgaaaagtcatccaataactttggggcgaacacaaaaaagaatcccaaagaggaatgtaatgctgtgatgacaagaaacaagaagcgtttggtagttgacgataaggataaggtggctttggagaaacaaattgttgtaaaggatgacactgagaaaaataaagaggaggtaacagatgtgacaagtcaggagagtgaaaaaccattaatggtcaaggagaaagaaataaacgaccaagaaaaagaaatagag

SEQ ID NO: 63776 - DNA, 466 bp, Glycine max
  Peptide Sequence Number=SeqID_155461
atggccaccgctgctgctgttagttcggctgccgaagcagacccaactctcctagctaccacgcaccatcctcccccaaacgcggtaggacgagaaaggagcacactggggcacaacagcaacccctatttgggatacaaccgggtggcttacccttatggattaccgcctaatttcacgccgccattcatgcatgatgatacgggtcatgtcacttcccccatccttgaaggggagcctcctcgacagctcgacgaggtctatgaagatcatcgagagtatgcccaaagggatgtcgatttctacccctcgatccccgtcgaggggctggcgcccaatacattgcctcagcccaacctcacatcacattcaatattcttgtccacagaaggaccaccccaggcggtcgaagaaagaaggaaactcgatctcctcgaggagagattgagggctgtcgaaggctttg

SEQ ID NO: 63777 - DNA, 174 bp, Glycine max
  Peptide Sequence Number=SeqID_155462
atgctgagaggaacgtggataagggctacgtgggggtacgtgagctcagttgaagagtggtacctggagatatgttgcgggggtcaggagaccttggggatgtcaggtggggtgctatttcccaaaaccaagcttgatcaatcccgacccaacccgggcatagtcagtcagtga

SEQ ID NO: 63778 - DNA, 534 bp, Glycine max
  Peptide Sequence Number=SeqID_155463
atggcttctaggaaaagaaaggcaccctctactcctacccaagtcagatttgacagatccagattcacttcccaagaggcttgggaaagatacacagatgttattgtgcctaggaagcttttgcctgagaggaatgtggtggtctactatacagaatttgatgagttcaaggaggaactcaaaagacaccactgggatgaggagttgacttatttcattgacagcaacattgatgttgccattgtgaaggaattctatgccaacctctatgatcccgaggacaaatcacctaagcaggtgagggtgagaggtcatttgattaagtttgatgaggatactcttaacactttcttgaagacacctgttattttggaagagggggaatcactctgtgcttattctagatttgcactccagaggcctgatcctcaggagttagctgctaaactctgtatcccagggaggggattcgagcttaatgttaatggttatccgttgaagatattgaggaagaacatgaccaccctagcttag

SEQ ID NO: 63779 - DNA, 399 bp, Glycine max
  Peptide Sequence Number=SeqID_155464
atgccgcatgttgatttaaatgaggacaacaattacatggatgcttctactagtgcagaatatgtggctaaacatgaacaatttatgttaatgcaagacatggtgtgcgatgctctgagacaacctcaaacatttaaagctccaaactcaagtaatatggaagaacctccaaatgaagatactcaaagattttacaatttattggtggaggcgaatgaaccattgtacgaaggggcaacaaactcaaaattatcaatatctgtgaggcttttaggttcgttaaccgaatacaaattttgtaacaagcccaggtattgtgccaagactgttggaacaagcaacagaaaaccagttctagtaaaggtgatgttttatttgcctataataccaaggtcgtag

SEQ ID NO: 63780 - DNA, 357 bp, Glycine max
  Peptide Sequence Number=SeqID_155465
atgtcgcgggggtcaggagaccttggggacgtcaggtggggtgctattgcccaaaaccaagcttggccaatcccgacccaacccgggcatagtcaatcagtgagaacctgtgacatacctaagcagatcgcgatggcagcgcagttgatccatgatcgtgtcgtgatggagtgcctaaagggtgtttgggagaccctcgaaggcaatgagaggtgtcgattccgtggcacaattcgactcactgctacttcgctagtacatccggagcaacccgcacgcacacttcagcaacctgtggagtggatactaccaacacctactccatatcgactagttgaaccagttcaagtgatagag

SEQ ID NO: 63781 - DNA, 411 bp, Glycine max
  Peptide Sequence Number=SeqID_155466
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaacggctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 63782 - DNA, 99 bp, Glycine max
  Peptide Sequence Number=SeqID_155467
atggctggtacattcttccttttgaaacagcaaaatggtttagagattatgagcggggacgtcacaattggtggtatcagagcaaaagttggattctag

SEQ ID NO: 63783 - DNA, 267 bp, Glycine max
  Peptide Sequence Number=SeqID_155468
atgggtaaagctcgggcagcagtagaagagctgagaaggtttcttgtggctgatttgttggaagaggtcctagctggagatcaagtcccattgatggattctctcattactaggcttctccgtgtacctcatgcattgaaggatgaaaatctcactgatgctgtggaaacatcagccatggtggcacctcgtgggagagggggaggccgtaacagtagaggaggccgcaatggaagaagtggacgtcccgcaatgcacatattgtaa

SEQ ID NO: 63784 - DNA, 252 bp, Glycine max
  Peptide Sequence Number=SeqID_155469
atggcctttttagattctttgtctttcaaaagtaatttcaagaacaggatattccaagatgatgatgaagaccgagtcaacttatgtctcatgacaaaatctgatgagaataacaaagaagattctgtaaggaagaaatggtacatagacagtggatgttccaagcacatgacgggtgatgtatccaaattcacaactatttcccccaagaaaagtggacatgttacatacggagacaacaacaagggctaa

SEQ ID NO: 63785 - DNA, 147 bp, Glycine max
  Peptide Sequence Number=SeqID_155470
atgaagttcgcctctttggcatctacgcatcataggagggtcatgtcgtggtttcgtttgtacaggatggtaccacttacaaagaaactagtagccaatctcctcaacgtcattttgtcattgtcagaaatcccaggcgggaattaa

SEQ ID NO: 63786 - DNA, 663 bp, Glycine max
  Peptide Sequence Number=SeqID_155471
cgaccgccgcgccctcctactcatcggggcttggtccttgccccgacggccggcgcgcagttgggcaccgtaacccagcttccggttcatcccgcatcgccagttctgcttaccaaaaatggcccacttggagctctcgattccatggcgcggctcaacagagcagccgcaccctatcctgagggaaacttcggagggaaccagctactagacggttcgattagtctttcgcccctataccccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 63787 - DNA, 336 bp, Glycine max
  Peptide Sequence Number=SeqID_155472
atggggagagcctcagcttttattgatcaaattgctgcaattagtccaattgcaagtttgaaagactcttgggtttggggagctgaccctaaaggaattttctctaccaattctgcctatctttgtgtcaaagctgagcatcttgatgaagatcaatgtctaggtttccagcacttttgggacatcaaaattcctcctagagctctagtttttgcctggagacttctgtgggacagacttcccacactctaccatggcaggattgaaggataccaacagaaggtggaaaatttggtggatagcagctacaagatcaatatggaagctcagaaatga

SEQ ID NO: 63788 - DNA, 426 bp, Glycine max
  Peptide Sequence Number=SeqID_155473
atgacatcatggcagtcgctccattgtggattcaaatttacaaagcaaccattttgttgggaactataccccaatccatggggattccttcagagctgcagtctttacacaattcgtaacaacacactctcagaaaacctcttaaatgtgaaaatcctccgccttcgatcaaacagatttgccggacacattccaagtgaaatatgtcagatgagtcatcttcaggttttagaccttgcacaaaacaatctgtctggcaatataccgagctgtttcagtaacttgagtgccatgacactaatgaaccaaagtacagatcctcgtatctattctcaaggaaaacatggtacgtcgatggaaagtatagttagtgtgctactatggctgaaaggaagaggagatgagtacagaaacattctgggtttg

SEQ ID NO: 63789 - DNA, 510 bp, Glycine max
  Peptide Sequence Number=SeqID_155474
atggcttctcgtaagagaaaagcaccagcttcagtgtcccaggctaggagagaaattgatgggaataattggcataaggagctcactaacttctctgaagggagcattgatgtggcattagtgaaggaattctatgccaacctttatgaccttgaagaaaaatcaccaaagcaggtgagggtgcgagggaacctaattaaatttgatgatgacgccctcgacacctttttaaacacactagtggtcatcgaggaaggggagagctcaccctcttacttcaagttctgtaggttaaggccagatcctcaagagcttgcacctcgtctatgtatccctgggaggggatttgagctgaatgcaaatgagctacttcttaagattttgaggaagaatcttactactctggcccagacctggagtgttatatctttttctaacttagccccgacatctcatacttcatatattactttggatagggctaagttaatctacgggcttgtactgtag

SEQ ID NO: 63790 - DNA, 336 bp, Glycine max
  Peptide Sequence Number=SeqID_155475
atggaatcgagagctcctagtgggccatttttggtaaatggaactggtatgccggatgaagtggaggctgggttacggtggccagctgcgcgctaccctagaccccacaaggggtgttggtcgattaagacagcaggacggtggtcatggaagtcgaaatccgctaaggacctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 63791 - DNA, 486 bp, Glycine max
  Peptide Sequence Number=SeqID_155476
atgcatagatctcccacaagtaatttagttcctctggatttagaaattgaagctacatttcaaaggaacagggccaagaagagaaggaaacttatgcaagacagaacagttgcatccattcttgaggaggagacttatttctctgacttattatcacctgattcaccatcatcaagggaactcgccactcaatttcccaaagccatcaccatggcaaaagagcatgaccagaggattacccttgaggattactcaattagttcagtactacaatttttcaccagcattgcacatcttgaagtgggaacttatttcaaggattacctaatgaagatcacgatgcacactagacaacgttcattgaaatatgtaacactgttaagattgccagtgtaccaaacgaagctattaggctcagccttttctcattctcattggcaggagaagccaagaggtggctccactcattcaagggcaacagtctga

SEQ ID NO: 63792 - DNA, 406 bp, Glycine max
  Peptide Sequence Number=SeqID_155477
atgactaatgctgcggctagaaaagaggaagagcgtacagagattgaaacacatcaagaaagcaattgtcaagttacctcaatccatcatcaattgaccaatgaagaggaaacgcctgaagtctccagtactccagaatatccctacttggatattggtggctatgttggagggaaagataaaggtaggttggaactcagcatagaggatcaaaagatctcttttgacctctttgaggccatgaaacactcagatatgggtgatgcctattttgaagaagaagaggtggagcaggaaatagcattatcagtcgcaaccatggtactacagtctcccttggaaaaagaaccttgctatgggagagattgcatagcttgtgatgaagagcttgatgattcgaaagaca

SEQ ID NO: 63793 - DNA, 467 bp, Glycine max
  Peptide Sequence Number=SeqID_155478
gactttgccagtcgtacggagtccccgttgcacctaccaaggtaattcggccgcccatcactcgggcttttattgagaagtactgcacccagagacaggctcagggggatgctccacaggccgcgggcgcgccaccaccacctcatcaagctggcccggctgggtcatttgacatggagcaatatttatggcatttggttcgccagcaggcagccaaccaccgggcacatgtgcagacccatgattgtctataccagatgagcctcagcatgcaaagccagggcttcgcttctttttcatgccctactccagaccagttcagggcagaggtcgcatggcccggggattggcccgaggcccaagcaggagaggcgcccccggaagttcccggggatggagaggaggcccacgaggacgaggagatggccgatttgcttgacttcttgggagggagtggagcttcatga

SEQ ID NO: 63794 - DNA, 204 bp, Glycine max
  Peptide Sequence Number=SeqID_155479
agggtacatcgacttggggattgttatactgagaacaagatagggtacatctcttgtggatcagttcaagtggagggtacatccacttgtgttttcaaagagaacaagggaggggtcatcccttgtggatctttggattataaaggattttacaaggttgaaacaaatctcaagaacagcaggttgcttggggactggatgtag

SEQ ID NO: 63795 - DNA, 429 bp, Glycine max
  Peptide Sequence Number=SeqID_155480
atggccccgaggaaacttgcctcaaagagatccaggaaggataaagtggccgaaggaactagttccgctcctgagtatgatagtcaccgctttaggagcgctgaacaccaatgctatcggccagctcctggatatcctttagtgctggaagagggtcaagagtgtgagtatggccagaggaggaaccggtccgatgggttcgatgaggaggccatcgcccatttgctatgtataccggggcaggattttgcccggactgctgccgggagacgggtgcggatcatgcgcaccaacatgaccaccctaactcagatctggatgactttgctgctcagcagcatccagcccagcgaccataattccgacctccccctaccgaagtgtcagctggtgtatggcacctaccaagcaccctctggacccggataa

SEQ ID NO: 63796 - DNA, 390 bp, Glycine max
  Peptide Sequence Number=SeqID_155481
atgtatgaatatcctaggagaacccgcgcgttaacgcgtaagcattcctttcaaaattcgtgtggatattcgtgttttgttggaaaaagggaaatggttccaaagaaactctccacgaagaggtctagaagagatgccacaggagaaggatccagtgctgcctcagagtttgatagtcattgtttccggagtgccgagcaccagcagcgcttcgaggacatcaggggatggtcgttccacagggagaggcgtgtccaactcagggaggatgagtatacggacttccaggaggagatagctcgcagacattggacaccgctagagactcccatggccaagttcgaccctgagatagtcctagaattatatgctaatggtgggatcctctag

SEQ ID NO: 63797 - DNA, 225 bp, Glycine max
  Peptide Sequence Number=SeqID_155482
atgtatggttctgtaacaatgaaaggaagggcagaaagaacactggacaaggaagaggatgaagagcacgtgatggaagaagcaagggaattaaggagaggggcccggcccaaaataccaaattccaaattaaaggatttctattggcataaggaacaacacacgcatgaaggagcttacaggggatgtcaaaaggatcctggagatgatggaaaaccgcaataa

SEQ ID NO: 63798 - DNA, 195 bp, Glycine max
  Peptide Sequence Number=SeqID_155483
atgggtctgggcaaggacagccacgggaatgccgatgtggttgacattaggggtaacccgcacaaatatgggttggggtatgagcccgggaaacctaaaagaaggaaagcaccgccaagactccgggcagatagggcatggcccgatcatgttagccagtgtttcacaagtgccgggataatgttcgaggaaaag

SEQ ID NO: 63799 - DNA, 462 bp, Glycine max
  Peptide Sequence Number=SeqID_155484
ggtgcagaagacgatgttagtctctacgggctatcagagctttttgtcttacagacagcaaaaaagaatgtttatacggataaccactcgggtatctccgcccgtcagcgtgtctcaaatgtcagtatgacagatcttgtgagcgcgaaagatgacgcttttcgtcttacagatagcaagaagaatgtttatacggctaaccactcgggtatttccgccggtcagcgtgactcaaatgtgagtatgacagatcttgtgagtacggaagatgacacagcaaaaaagaatgtttatacggataaccactcgggtatctccgcccgtcagcgtgtctcaaatgtcagtatgacagatcttgtgagcgcgaaagatgaccgtgactcaaatgtcagtatgacagatcttgtgagcgcggaagatgacaaatctccacgtgtgaacgggcttgtcggccgcgattga

SEQ ID NO: 63800 - DNA, 410 bp, Glycine max
  Peptide Sequence Number=SeqID_155485
atgaacaagagcaagagcggctcgcacgccgctgcagtatggctgccgaagcagacccgagctccttggcaactacgcaccatcctcccaaacatagtaggacggggaagggacgcactggggcacgatgcagccctcacctgggatacaaccgagcggcttacccttatggattgccgcccaactattcaccacccagctctcagcagcccgacgaagtccataaagaccctcaagattatacgcggagggaggaagggtgatcgagtctttatccccgaccccgaagggccggcaccaggcacggtttgccccaacccaacgggatcgcagacttcgccaatagttgttagccatggaagggccaagcccccggcaactcgaagaaaggaggaagcttctcggctatt

SEQ ID NO: 63801 - DNA, 912 bp, Glycine max
  Peptide Sequence Number=SeqID_155486
atggctccgaaaaagctttccacaaagaggtctaggagagacgccgtggcggaagggtccagtgccgcccccgagtttgatagccaccgtttccggagcgccgagcaccagcaacgcttcgaggccatcaaaggatggtcgttccacagagagaggcttgtccagctcagggaggatgagtatacagattttcaggaggagatagctcgcaggcattggacgtcgctggtgactcccatggccaagtttgaccctgagattccttttgacgcaaatgccctcagccagttcctgggtgacccgctagttatggacgaaggccaacagtgcgagttcagccagaggaggaacagggccgacgggttcgacaaggaggccattgcccagctgttatgcacaccgtggcaggatttcgcccggactgctgtagggaggcgggtgcagatcatgcgcaccagcatgaccaccttgacccagacgtggatgacactgctgctcagcaatgtcctgcctagcgatcataaatccgatctccttctgcctaagtgccagttggtgtatgccatcctgacgcggatgagcgtccacgtggcccaggtgattgctgatgccctctatttgtttgcaggtatgccacccaccaggcaccctctagacccggataagtctaacagggccctggggtttccggcgttgattacgggcctctgccagtcattcggggttcctgttgcccccagtaaggcggccaaccaccgggggcaggtgcagatacatgagtgtctctaccggttcaacctcagtcagcaggggcagggcttcactccttttgcatgccctactccagagcagtttggggctgaggttgcatggcccggagactggcccgaggcccaggcaggggaggagcct

SEQ ID NO: 63802 - DNA, 126 bp, Glycine max
  Peptide Sequence Number=SeqID_155487
atggagaacaatgatggtttgtggtggctaatggtggatgtgggtgatggagaaaaaagaaagaaagaagaagaaatggcatttttcctaagctacaagaaagcaaaggctgaaatgcttaaataa

SEQ ID NO: 63803 - DNA, 330 bp, Glycine max
  Peptide Sequence Number=SeqID_155488
atgggtgaagtagaggaagtgcaggaaaaaatgaagtccgacatgtcgactctgaaagatcaaatggcttccctgatggaagccatgctaagcatgaaaagattaatagaaagtaacgcagccatggttgtcgccgccagcactgtcgttgaggcagatccggctctttcatctgtagtaaatctagcacataagcttgccccgcatatgatgggacgaggaggagagatattggggaataccaacagcccgcgtcagagtgaagggaacaaggaagaaggaagaaccgcacgtgtgtatgcagtcggtggacaaagaaagcctcgctaa

SEQ ID NO: 63804 - DNA, 863 bp, Glycine max
  Peptide Sequence Number=SeqID_155489
atggggtggttaggaataccgagaaaatgtttggaggcaaaagcaagaatcttggcaggtaaaggcgagtgggccccgttcatagatattctcgcactgttgatttttgggggagtcctctttccgaatgtggatgggttggtggacctggcagcgatcgacgcttttctcgcctatcataaccacaaggaaagcccggttgttgctatgctagctgaactatatgacaccttcgaccgaagattgaggcatgcttgcccattagaaagccaccgttcatgcacagagaaaggaagggcgacttgggatcaactcttagcaagcaaagaaggagcatctgtcaacctgattccctcgatggaaggaaggaagaaccgcagttcttatttcatgcagaggatttccaaatgttcccttgatggggacgagaagttgcatcagctaaaatcccaccaacgtggagacacttcagaaggtccgcaaggcatgagaggtgttgcaaaagaaggacaaggaactcaggggcaaaccgctaagagggaggaagatgaggcaccggaggaagacgaagaggtgcaggcccttaggatggaactcaagcaagctcaaacagtcaaagaaaggttcaaatcagcagctcttaaaatccgaaaggagaatgccgaactgagagatataaatatagctaccactaaggctttggaacaagagaccaagagggctcgtagggaagaacacggccggaacaagttccgaggggctctgtggggcagtaacagcgagcttaaactcggaaaagaggaaagggaccaatcacaagtagacagtttgatcttgaaagatgaattgaaggcttgctcgag

SEQ ID NO: 63805 - DNA, 180 bp, Glycine max
  Peptide Sequence Number=SeqID_155490
atgggcaaggatgggcattctcaccctgggtcaaggctaatgggtgttggtttggccagcggttcaaagataaaggggatgccccacatttatttccatgacacacatacaacaatgatgatttggaaattttatgcaaaactggtcatggatgcacctatgtggacactcaggcattaa

SEQ ID NO: 63806 - DNA, 379 bp, Glycine max
  Peptide Sequence Number=SeqID_155491
atggccctgtttgaagagaagcggacgcacgaggacatagataaatggattgtttgcttcgatggggcgtcaaatgctttgggccacggagtaggggcagtccttgtatccccggatgatcagtgtattcctttcacggccaggctaggtttttgggcagttgctttcgagaagatcaaactaggtctcgcgaatcccccggtgctcatgacccgagcaagccatcgaattatctcaaggcaggccggcatattgttatgcaatgatggaagagcaggatggaaaaccgtggtatttcacatcaagcagtatgtcgagaacaaggccataccagggatttctgacaatgaaaaaccggccctcacgggagatggctacg

SEQ ID NO: 63807 - DNA, 222 bp, Glycine max
  Peptide Sequence Number=SeqID_155492
atgacatcctattctaatatgtacaaagagaattggacccaaacttggcccatgggctcagaaatctaccctgaggttcatgagaaccctagggccttcttcagcaactctagtccaatcctcttagagcctcttgctcatggctctagtgactggtcccttcctagggaggattgcatcacagcatctccagcacttctcccttattctgattccccatag

SEQ ID NO: 63808 - DNA, 294 bp, Glycine max
  Peptide Sequence Number=SeqID_155493
atgcaacttgcagttaacatgaatggccttcccaatattacaggaatgtcattatcttcacatatatccattactacaaactatgtcgggaagataaaatgttttactctaaccaacacatattcaattactccatatggtttggtaaaggagtggatccacgatgtcggatacaatgtccaagacatcctgcccgaaaatactggagttgctgcacaatgcacaaaagctgcaggatccacgatgtcggatacgatgtccaggacatctggcccgaaaatactggacacataa

SEQ ID NO: 63809 - DNA, 748 bp, Glycine max
  Peptide Sequence Number=SeqID_155494
atgataaccctctacctggcttccggctcaccgcgtcggcgcgagctgttaacgcagcttggcctgcagtttgagcgcctgattaccgatgttgaagaacagcgtcagccgggcgaagcggcggagtcttacgtgcggcgtctggccagcgataaggcgcgggccggcgtgcggatagcaccgcaggatctgccggtgctgggcgctgataccattgtggtgctgaatggcgaagtgctggagaaaccgcgcgatgcggcgcatgccgcgcagatgctgggtaaactggccgggcaaacccatcaggtcatgacggccgtggcgctggccgatgcgcagggcgagttggattgcctggtgaccacagacgtgacattccgcactatcacggcagaggaaatttcgcactatatcgccagcggcgagccgatggataaagccggcgcgtacggtattcagggcctgggcggcaactttgtgcgccgcatcaatggaagggacaagatgacggctgaactgctggtaaatgtgacaccttctgaaacccgtgttgcctatattgacggcggcattctgcaggaaatccatattgagcgcgaagcgcggcgcggtattgtcggcaatatctacaaagggcgcgtcagccgggtactgccgggcatgcaggcggcgtttgtcgatatcgggatggacaaagcggcctttctgcacgcctcggacatcatgccgcacaccgaatgcgtggcgg

SEQ ID NO: 63810 - DNA, 795 bp, Glycine max
  Peptide Sequence Number=SeqID_155495
atggtattggaagagggccaggggtgcgagtatggccagaggaggaaccggtctgatgggttcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtaatggtgccccctaggcaccctttggacccatggataagtccaacaggggccctgggattccccgcattgatcacaggactctgtcagtcattcagagtccccgtcgcatctagcaaggtgattcggccaccatcacccggggcttttattgagaagtattgcacgcagagaccggcccagggtaatgcaccacaggccgcagacgcgccgccacctcatcaggctggcccagctgggtcatttgattcggagcagtatttacggcatgtggttcgccagcaggcggccaaccaccgggcgcacgtgcagacccatgactgtctttaccagctgagcctcaacctgcagagccagggttttacttcttttccatgccctactccggatcaattcagggcagaggtcgcatggcccggagattggcctgaggcccaggcaggggaggcacccgtagaggctcccggcgaggcaggtgaggcccgcgaggacgaggaaatgaccgatttgcttgatttcttgggggggagcggagccacatga

SEQ ID NO: 63811 - DNA, 159 bp, Glycine max
  Peptide Sequence Number=SeqID_155496
atggataagagcttgaaggtaggagaagatgagtggagggagagggagagaaggagcacgaaattttgtgcctcaaatgagttcagcccactaatccaagatcaagtccaagattctccactaagtgtgcttagttgtcatgaggcatgtaaagcatga

SEQ ID NO: 63812 - DNA, 833 bp, Glycine max
  Peptide Sequence Number=SeqID_155497
gggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagagggacgaggaagtccaagctctcaaaagcgagttaggaaaggcaaaactcgccaaggagaagttcaagttgggtgctacacacgttcggaaggagtggtggcgggttacgggaagagaatgcaattaccgcaggagccccttgaacgagagaccaagagggctcgcaaggaagagtatggccgggaacaaatttcggcgggagctctatgggggtccaaaagaagctggtctcagcgtttatgcgagacagagaccaacatgttagctatcatcgccaagtaccaagaagagttaggtctagccacggcccacgagcatagaatcgcggatgagtatgctcaagtatatgcggaaaaagaggctagaggaagggtaatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 63813 - DNA, 867 bp, Glycine max
  Peptide Sequence Number=SeqID_155498
atggacatggacattggtagtttgatctctggacaaatgaccatgatggctcagtctaactcttctcgcttaggcttcccagctttaatcacagccttgtgtagatcgaggggagttggatctgatgctcttacctcctacaaaaacctaagaccagtcattgaattagcctatatcataaggaactattggaatgcaaatgaccaaacagttaattttccaaaggcaaggaagaccaagctcagagcaattgatgtttcctcttcctttgcaccaatagttggcatccctgcatcttttacttcagccccacttccagctttagcagacttacctgcccagagctgccagacttcagatgccaaattgcaaagattgtttgaaggacaaattctcattatgaaaagcttgcatgaactagctcagcaaaggccaattatgagtgtagagcagttcattgagaaggtggcttggcctagagcccgaccttcttttgtgggggataaggaaagttttatagcccaggcacctcaacagcatgagctagagccagaaaacgatcactcattcgaagccatcatccctggagctgttgattttccaaaaagaagattagagacgagatccaatgaggctgctcatcctagaccagtgccagtatcagctaatgtaccatttccaggggtggatccatcttcacctcagcacacagcagactcttccactcctgtcttacagatacctgagggccagaccataccagtcctggctttggacatttctcctccaactactccagtattgcatctgacagataaggaggatgttcaggcacaggatatccaggaccagtcacaggaattttga

SEQ ID NO: 63814 - DNA, 204 bp, Glycine max
  Peptide Sequence Number=SeqID_155499
atgataacaatgatgacaacaaaagatgatgaacaaaaagctcaagagaatcaagaacaagtcaagagttcaagaatcaagaagaattcaagattcaagaagaaagcctacaaacaagaagattcaagattcaagatctcaagaatcaagatcaagattcaagactcaagattcaagaatgaagaaaagactcaatcaagataa

SEQ ID NO: 63815 - DNA, 534 bp, Glycine max
  Peptide Sequence Number=SeqID_155500
atgactcctgctgaagccagaaatttaattgagaagatggcttccaactcgcagcagtttagcgccagaaatgatgctatagtcattagaagagtgcatgaggtagctacaaactcagctgcatcatctgaaactaagaagcttgaaggcaaactggatgcattggttaacttggtaacccagctggccttgaaccagaaatctgtacctgtcgcaagggtctgtggtttgtgctcctctgttgacaaccattcagacctttgcccttccatgcagcaacctggagcaattgagcagcccgaagcctatgctgcaaacatttacaatagacctcctcaacctcagcagcaaaatcaaccacaacagaacaattatgacctctccagcaacagatacaaccctggatggaggaatcaccctaatctcagatggtctagccctcagcaacaacaacagctgcctgctccttccttccaaaatgttgctggcccaagcagaccatacattcctccaccaatccaacaacaacaatag

SEQ ID NO: 63816 - DNA, 330 bp, Glycine max
  Peptide Sequence Number=SeqID_155501
atggctccgttgccacttccccgctttcatacgaccaaccgccacttccagctcaatcgttaccgccatgaccattgccgcaaaatcccttatgacaatgacaccatcttgctctgcaatgatgccgtcaagcatcagattcctccgcgcttggtttggattcttttcgccgtcaagacttggccttgctccgtttgtcatcagcgacgacacccgccaccacatccaccaccaccacccccgaagccaccgcctcaaccacaatcatggctggcacaagctgagcttccattttactcatgttctgtttttctgcacccaacaccttga

SEQ ID NO: 63817 - DNA, 228 bp, Glycine max
  Peptide Sequence Number=SeqID_155502
atgtaccttctcttattctcagttacaacaacccaagtagatgtaccctctacttgtacgacaaaggatgtaccctccaatgtgttaagacaaagttctcaggcgggagaagggagacacaaaagaattcaggcggttagtccttctcttggaaagggagaagagagacacaaaagaattcaggcggttagtccttcgattctttttggcaaagggagaagagaatga

SEQ ID NO: 63818 - DNA, 161 bp, Glycine max
  Peptide Sequence Number=SeqID_155503
cattctaagggcttctaatctagctacgggtgtgtcgcaacgtgcccttttgtgggcgagcgaggcgaggctcacgggtgtgctttccaaaggaggaaagatgcgcggagtcaccaccaacgtttatttgtggaaaacgtcggaaaaaccaaaggaaaccg

SEQ ID NO: 63819 - DNA, 1710 bp, Glycine max
  Peptide Sequence Number=SeqID_155504
gccgccgtgctcacgctcgctggctgctccactctggtgccgaagaacaccgctgtcgctccggcgattccggcgcagtggccggccgaagccgcgcagggccaagtggccgatgtcgccgccgtcggctggcgcgacttcttcaccgatccacgcctgcagcaggtgatcgaccagtctctgcagaacaaccgcgacctgcgcgtggccgtgctcaatgtagagcgcgcgcgcggccagtaccgcgtacaacgcgccgaccgcgtgcccggcgtggctgtcaccgggcagatggatcgccgaggcaccgacgccggcgtcaccgagcagttcacggctggtgtcggcgtggccgagttcgagctggatctgttcggccgcgtgcgcaatctcagtgaagcggcgttgcagcagtacttcgccgtggccgccaaccgccgcaacgcgcagctgagcctggtggccgagaccgcgactgcgtggctgacctatggtgccgatgcgcagcagctgaagatcgccgaggccacgttgaagacctacgaggattcgctgcgcctggccgaggcccgccacgaacgtggtggcagttcggcgctggagctgacccagacccgtaccctggtcgagaccgcacgtacggatgctgcacgcctgcgtggccagctggcccaggaccgcaatgcgctggcgctgctggccggtggccagctggatccggcactgctgccggacagcatcgaaccgcagctgcttgcactggccccgccgccggccggcctgcccagcgacgtgctgctgcagcgcccggacatcatggccgccgaacaccagctgctggccgcaaacgccaacatcggtgcggcacgcgcagcgttcttcccgagcatctcgctgaccggcagcatcggcagtggttcgaacgaactgtccaacctgttcgacagtggcacccgtgtatggagtttcctgccgaagatcaccctgccgatcttccagggcggcaagctgcgcgccaacctggccatcgccaacgcagatcgtgatatcgctctggcgcagtacgagaagtcgatccaggtgggcttccgcgaaaccgccgatgcgctggcattgaatgtcagcctggacgagcaggtgagttcacagcagcgcctggtggacgcggccgaacaggccaaccgcctgtcgcaggcccgctacgacgcggggctggacagcttcgtcaccctgcttgatgcgcggcgtaccgcctacaacgcgcagcagacccagctgcaggcccagctggcgcaacaggccaaccgcatcaccctgtacaagctgagcagcaattcgataccggtagcgccgggccacgcccgccggcctttcgttcctgcatgcctgacgtctgggcggaccgcacttcgtgctcgccgggcatggccaggcgctaccgcatgggccaacggcaccatgcaaacggatattcatcgagatgcagggtcaatcctgctcggatggggttgcccaggatgtacaacgcatggcgcctcaaggcttcctcgctgcgtaccgcgtgatcgaaatagctcggctgccacaaaggcgtctgtatgccgaactgctgccccagcaaccggctgctgcgggatttcaccgttcccatcatgcgcgccagtgatccgtcgcgcagctgcatcagccaatgcagatggtcaggcatga

SEQ ID NO: 63820 - DNA, 327 bp, Glycine max
  Peptide Sequence Number=SeqID_155505
atggcggcgcagctaattcgtgatcgaaggaacctgcacggatgctttaggcgcacggtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagcggaggctcttcatcatag

SEQ ID NO: 63821 - DNA, 138 bp, Glycine max
  Peptide Sequence Number=SeqID_155506
atgagtttgtcaggtttaaaggagcactcaaacccggtgacccccaaggcctacactccgaagagtccgtcaaggcctctccctcctgattcaggtccaacccctaaaattattttagcacacagactctatctatga

SEQ ID NO: 63822 - DNA, 510 bp, Glycine max
  Peptide Sequence Number=SeqID_155507
atggataagagcttgaaggtaggagaagatgagtggagggagagggagagaatgggcacaaaatttatgcctcaaatgagtccactaatccaagtgtgcttaggtgttataaggcatgtaaagcatgaaggacaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 63823 - DNA, 513 bp, Glycine max
  Peptide Sequence Number=SeqID_155508
atgtcaggacatcgtgtccgacatcgtggatcctgcagcttcacttctgcacttgacttttatcttgcattgtacagcaattccagtattctcgggcaggatgtcaggacattgtatccgacatcgtggatcctgcaacttcaattcttcatttgccattttatcttgccttgtacattgtgcagcccgatctcattccttgacataacgttggacatcatgtataggcttgaggtgatgatcaaccacggagatgaaagcacaaaattcctgctttgggaccgtgaatgtagtgaattaattggtcaatcagctaatgcagttaataagcttaaaattgaagatggtgatgttgatttaactgcttcaccccaagcacttgataagctgctgggttatgaacttgcttttaagataaaggtgcaacccaagttcaggaattctgctgttttgaaatgttcaactgactcaagcttaataaatgttgtgatggatatgctagctgatgctgag

SEQ ID NO: 63824 - DNA, 480 bp, Glycine max
  Peptide Sequence Number=SeqID_155509
gattttgcccggactgctgcagggaggcgagtgcgaatcatgcgtaccaacatgaccaccctgacccagatatggatgacgttgctcctcagcaacatcctgcccaccgatcataattccgacctccccatgccgaagtgtcagctggtgtacgccatcctgacgcggatgagcatccatgtggctcagttaatcgctaatgccatttatatttttgcaggtatggcgcctaccaggcaccctttggacccagataagtccaacagggccctgggatttccccgcactgatcacaggactctgccagtcgttccggagtccccgttgcacctacctaaagtgattcggccgccccatcacccaaggcttttaattgagaaagtactgtacccagaagacaaggctcagggtgatgctccaccaggccgcaggcgtgcccacccccacctcatcaggctggcccaggctgggggcatttga

SEQ ID NO: 63825 - DNA, 512 bp, Glycine max
  Peptide Sequence Number=SeqID_155510
atgggatgcaagagtcaatgttgtgtctgggagctccactatggtatgcacacttggcacccgggccgtaccacttggggtagggtggctggaagacctttccggctcgcgccgggggctgtactattgactggccggggaacgactggagctgtgtgttgggccggtgctctttctgctgcgggcgggtgctttcatccatgttggggcggtggtgaccgcgtgggtatctccttcttttttcctcatgcccaccactggggctcttctgttgttattgggggccgtgttggaggcatattcgaacttgccttttctcagtccagattcaattctttctccggcgaagatgagattcgcaaagttagctggcatatagcctatcagcttttcatagtagaacgtaggcaacgtatctaccatgattgtgatcatctccctctccgtcatcggcgggacgacttgggctgcgagatccttccacctttgggcatattccttaatggactcat

SEQ ID NO: 63826 - DNA, 483 bp, Glycine max
  Peptide Sequence Number=SeqID_155511
atgaccatgattacgccaagctcgaaattaaccctcactaaagggaacaaaagctggtaccgggccccccctcgagagggacccacagtagcacagaccacccttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 63827 - DNA, 453 bp, Glycine max
  Peptide Sequence Number=SeqID_155512
atggtctcccgaggtggagatgaaagggatgaatgtttgtttcaccttggggagtcgcatgacatggaaacctgtcccgtggtggaagaattgcttcagcggctcatggattgcgggcagcttgaagtgttcataggagggaaggaagaaccacaaatatgcatgaaagggaccggctccacacccatatacccgcgggcggcacccaagccaacgccatttgcatatcaaagtgataaggccgttccgtggaagtatacccctcccgcgtccagcgaaagagttgcaaccgaagttgactccctatcaactaaggtaaccaacatcaccggcctcagtagcgtaacccgcagtggtcgagtgtttgcttcccctcacccagcggaattgccctctaaagggaaggctcccatggtccaagagcccacagacatagccacccccttgaaggaa

SEQ ID NO: 63828 - DNA, 110 bp, Glycine max
  Peptide Sequence Number=SeqID_155513
atggctggtactttcttccttttgaaacagcaaaatcagttagagcatatgggcggtaagaaagacatgactccgaatagagttgtgaactggccattcaggactctata

SEQ ID NO: 63829 - DNA, 672 bp, Glycine max
  Peptide Sequence Number=SeqID_155514
atgggtgatcaagaggagacgcaggaacagatgaaagccgacatgtcggctctgaaagaacaaatggcctccatgatgaaggccatgttaagtatgaagcagctcatagagaagaacgcggccaccgccgccgctgtcagttcggctgccgaagcagacccgactctcttggcaactgcgcaccatcctccctcaaacatagtaggacagggaagggacacactggggcacgatggcagccctcacctgggatacaaccgagcggcttacccttatggattgccgcccaactattcaccacccatcttgcaagaagatgcgggccacattgcttctcccgtccttgaaagagagcctcctcaacagcccgacgaagtccacaaagaccctcaagactatgctcgaagggatgtcgagttctatcccccgatccccgaagggccggcaccaagcacgttgcctcaacccaacatcgcagcaccaccaatagttttgtccacggaagggccgcctccagcaactgaagaaaggaggaagctcgatctccttgaggaaagattgagggccgtggaaggatttggggattatccgttcgcagacatgacggatctttgcttagtacccgatgttgttattcccccgaagttcaatgccggacttcgacaagtataa

SEQ ID NO: 63830 - DNA, 422 bp, Glycine max
  Peptide Sequence Number=SeqID_155515
atggcacgtagagacaagagccttgcttttgtcgattcgccccacaatctctgtcatactgaggcggcgggtcatgtgacatgcggagacaaaattatggtcattctgcacccctttgccattcagacacagtcgtgtccgatggtatgcagagacaaaattatggtcattctacaccctttgtcatccagaggcggcgggcccgatgacatgcggagacacaattatggtcattccgcacccctttgccattcagacacagtcgtgtccgatggtatgcagagacaaaatttggtcattctgcaccctttgtcatccagaggcggcgggcccgatgacatgcggagacaaaatttggttattccgcacccctttgccattcagacacagtcgtgtccgatggcacgcagagacaaattatg

SEQ ID NO: 63831 - DNA, 602 bp, Glycine max
  Peptide Sequence Number=SeqID_155516
ggacgggggaagcccgtctgatagcgctctgtgcgcgtactccgaaagggaatcggcctgcccaccctggaaacggctcagccggaggtagggtcccagcggctggaagagcaccgcacgtcgcgtggtgtccggtgcgcccccggcggcccttgaaaatccggaggaccgagtgcctcccacgcccggtcgtactcataaccgcatcaggtctccaaggtgaacagcctcctggtcgatggaacaatgtaggcaagggaagtcggcaaaatggatccgtaacctcgggaaaaggattggctctgagggctgggcacgggggtcccagtcccgaacccgttggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 63832 - DNA, 180 bp, Glycine max
  Peptide Sequence Number=SeqID_155517
aaagttttattgtataactctaggcccggactcatgagtgttgagatcaaaagtgaattcacagataagggctttaagttcaatggacaccggctgaaaccattccccacaaatccctcctcagtggatgtagtggtggaggagacctctttacttcaccatacttctcttctgccatga

SEQ ID NO: 63833 - DNA, 306 bp, Glycine max
  Peptide Sequence Number=SeqID_155518
atggcaagggacaaattgcaatctgctgcacttccagacctaaagataaaactgattagtcaaagacaaacagacgaaaggttatataacttaccaactaccactgaagttgctactttgattgttggtgatgaacactcagctgataaaagagatatcataatagaaaaacaattcggacttctgaagagaatacatgaacttcatcttgcatatttgcctttgcaatatccacttttatacccaaaaggagaagatggctacagtcaagaaccaacgaaactcagactatacttcattccataa

SEQ ID NO: 63834 - DNA, 285 bp, Glycine max
  Peptide Sequence Number=SeqID_155519
atgattgtaggacaactgtttaagaacactggtgaggtagacacaattgagcgctatctggcagccttaggatacaacgatgtagattggaacactcttttagattattccaaagcaaccaacggctatatatttagcatagcttcggggctgtttcttggaagtcagaaacagactatctcagctcagtccactatggaatctgagatgatagcactagcaactgcagtagagagcaagttggctaagattacttggtccagagattatatggcttataaatga

SEQ ID NO: 63835 - DNA, 156 bp, Glycine max
  Peptide Sequence Number=SeqID_155520
atggcttctggtaatcgattaccaaggatcgcgatggtagcgcaattaatccatggccgagtggagatggagtgcctagaaggagtttgggagaccctcgaaggcaatgcgaggtgtcgattctgtggaacgattcgattcacggctacttccctg

SEQ ID NO: 63836 - DNA, 345 bp, Glycine max
  Peptide Sequence Number=SeqID_155521
atgtcagatcataagagtactgagtcagcactaaaaaaccttgaggtccaggtgggacaactggccaagcagatagctgataagtcatccaacagttttggagcaaatacagaaaataatcctaaggagcaatgcaaggctgtgatgactaggagtaaaaagtttgtggaagctgaggatgaagagagtgtggtgtacaaagagcaaatgggtgaaaagacaggtgctgaggttaaggaaaacgatgtgaagggtaaagagaatcaggaaataggaaagaaaataatggtccagaataaagagatggagaaccaagaaaaagaaaaagaagaaaaaaaattctga

SEQ ID NO: 63837 - DNA, 242 bp, Glycine max
  Peptide Sequence Number=SeqID_155522
acttatcttccttcattggaagtggcgtctaccctgacttatcttccttcaccggaagtggcgtcatccaaaccttcgtagcctgtatcaaacgatccgctcctactcaggcccaagtggagaaggacaaagcccccgagtggagaaggataaaggcccaagtggagaaggacgaaaacccaagtggagaaggacaaagcccccaagtggagaaggatgaaggcccaagtggagaaggatga

SEQ ID NO: 63838 - DNA, 240 bp, Glycine max
  Peptide Sequence Number=SeqID_155523
atagccaagattcatcataaagtttgcatgtgtgcaacttttggtagccaagaggctttgagcatgcatgaaatggccccgaggaagcttgcctcaaagaggtccaggaaggataaggcggccgaagggactagttccgctcctgagtatgacagtcaccgctttaggagcgctgtacaccagcagcgcttcgaggccatcaagggatggtcgtttctccgggaacgacgtgtatactga

SEQ ID NO: 63839 - DNA, 444 bp, Glycine max
  Peptide Sequence Number=SeqID_155524
atggcacctccagactctattccttcagtcgagcagtttaatgagatggtagcctggcctgggacccaaccttctcttcatagggaagatgaaggtcccatagcccagttacctcagcatatggaggatgagtcatctgaggccaccatcccagagccatttgttataagagaagaggtagaggagacacaggtgagacaggtagctgctgccacaccggagcgatcccttgaggctacttcagagccttctgcacaaggggaggatataccctcacctcagcacgcaacagacccctccactcctcttctagagatgccagaggacccgactacatcagtcctggctatggacacttctcctccagctactccagtattacatctgacagatgaggaggatgttcagactcaggacccccaggaccagtcacaggaatcttga

SEQ ID NO: 63840 - DNA, 699 bp, Glycine max
  Peptide Sequence Number=SeqID_155525
atggatatgaatcttggatccttcatttccagtcagattacactcatagctcaacatgactcctcgaggcttggctttccagccctaatcactgctttatgtaaagcctggggagtccactctgattccttgacccatgagagcctaagtcctgccattaatttggcttatattaagaagaactgttggaatcttaatgatccaacagtaactttcagaggactgaggaaggccagagggaagagatctgaggccccttccacttcaacatcagaggcaccagcaccctcttcttctacactccctcattcttcctccacagatattccagtgattcttctagcaccttcacagataccactatcagcccctctttctgcaggcccagcagattttatttttactcctcaaatacttcactccatgctccagagcatccatagagggcagtccatcattatgcagagccttcaaggcttgggcttgccctccatcatgagcatggaggagtttaacgcacagctggcctggctaggagaccagccttcttcctctggaggggcagcagaggaggaggagaccactctagctcagacccctcaaccatctccaccatctgcagctgctcctgaggagactcaagcatcatcagcactggatcttaatgaagaccagccacaggaggagcaggacgtttaa

SEQ ID NO: 63841 - DNA, 50 bp, Glycine max
  Peptide Sequence Number=SeqID_155526
atgggtcttcagcaaccttcagcaaccttcaaaatgcaacaaaaaatgct

SEQ ID NO: 63842 - DNA, 507 bp, Glycine max
  Peptide Sequence Number=SeqID_155527
atggctgccaaggacattgctattttgagagatagaactcacattcctactgaaaagagtttattggagctaacctcccaagatgcattgttgccacaaaataagccacaacaacaagggcctagtctctatgatcagacaacgaagctggaagagactctagctcagttcatgcaggtttctatgtccaaccaaaagagcacagagtctgccataaagaatctggaggtccaagtgagacaacttgcaatgcaattggtagatagatcatcaagcagttttacagctaatacagagaaaaatcccaaggaggagtgtaaagttgtgatgactagaagaaaaagggaaatccatgtggatgagagtgaaactgagaagaagatggaggaacataaacaacagctggcacctaagccagcacttgaacccgtttctgattttgtagaacttgaagagattaatgaggagactgaagatgataaggaagaagagacacccattaaatag

SEQ ID NO: 63843 - DNA, 228 bp, Glycine max
  Peptide Sequence Number=SeqID_155528
atgaagatgctcttgataccacatggtgtaagctccattggagcttcggaatggagaaggatgagagagaggagaggccacttcaaggagaagatgagtctagaagaagctcaccaccataggaggccatggataagaacttggaggaagaaggagatgaatcaagagagagggagagaagagcacaaaattttgtgctctaaaagagctctgaaatctgaaatttaa

SEQ ID NO: 63844 - DNA, 144 bp, Glycine max
  Peptide Sequence Number=SeqID_155529
atggagaataagatgaagaacaaggagttaaaatcaatggaagcagaatggagatggaagaaagatgattggagatgccacttcaaggagaatatgagtcaagaagaagctcaccaccataggaagtcaaggataagagcttga

SEQ ID NO: 63845 - DNA, 255 bp, Glycine max
  Peptide Sequence Number=SeqID_155530
atggagaagaacgtggccaccgctgccgctgtcagttcggctgccgaagcagatccgactctcctagccatcgtgcaccatcctcccccaaatacccggcttacccttggattgccgcctaattactcgccaccagtcatgcaagatgatgcgggtcatatctcttctcctatccttgaaggggagcctcctcaacaacccaaagaggtccacgaagatcctcaagactatgcccgaagggatgtcgagttctaa

SEQ ID NO: 63846 - DNA, 741 bp, Glycine max
  Peptide Sequence Number=SeqID_155531
atgatgatgaaaagcaaacacacactgatcgctctgctgctggcagcagcgccttttgctcacgttcaggctgccgcctgggattatgctcagccacagcagtggggcgacctgtcccctgattttcacgtctgcaagcagggcgtgaatcagtcgccgattgatattcgccaggcgctgcatgccagtctgccggcgctgacgctgacgctggaactgcaggcgcgccaggccgccattgttaacaacggccacaccgtgcagatcaacctgcagcagggcgatacgctgacgctggacggcgagaccttcacgctgaagcagtttcacttccacaccccgagcgaaaacctgatcgacggcaaacgctatccgcttgagggccactttgtattcagtgacgagcaacagcagctggcggtaatcggggtaatgttcgaagccggtgcggcaaatccggtgctgacgacgctgctggatacgctgccggcgcaggtcaatcagccggctacgctgcagcaggatgtcgatattacgccactgctacccgccgatcgccgttactaccgcttcagcggttcactcaccacgccaccgtgcagtgaaggcgtgcgctggctggtgatgaagcaaccggtaacggcttccgcacagcagctgcaggccttcagcgcggtgctgggtgaacacggtaacagccgcccggtgcagccgctcaatggccggctggtggttgagtaa

SEQ ID NO: 63847 - DNA, 1233 bp, Glycine max
  Peptide Sequence Number=SeqID_155532
atgacttgtggctggggcactgtttcggctagggggccatcccggcttaccaacccgatgcaaactgcgaataccggagaatgttatcacgggagacacacggcgggtgctaacgtccgtcgtgaagagggaaacaacccagaccgccagctaagaaagcgtaatagctcactggtcgagtcggcctgcgcggaagatgtaacggggctaaaccatgcaccgaagctgcggcagcgacactatgtgttgttgggtaggggagcgttctgtaagccgctgaagggtgagtcgacccctaaggcgaggctgaaaagcgtagtcgatgggaaacaggttaatattcctgtacttggtgttactgcgaaggggggacggagaaggctaggttatccgggcgacggttgtcccggcgtgatgacgagccgccacggcggtgaagtaactgatgccctgcttccaggaaaagcctctaagctccagggacttgctcccggagccgaggccagtcgaagataccagctggctgcaactgagaagctcttgatcgaagccccggtaaacggcggccgtaactataacggtcctaaggtagcgaaattccttgtcggtgtacccgcggcaagacggaaagaccccgtgggaggctttgaagcgctggacgccagtctgcgtggagccaaccttgaaataccaccctttaattttgactggggcggtctcctcccaaagcgtaacggaggagcacgaaggttggctaatcctggtcggacatcaggaggtgcgaaagcaggtcatagtgatccggtggttctgaatggaagggccatcgctcaacggataaaaggtcccaagggtacggctgttcgccgtttaaagtggtacgcgagctggtacgagaggaccggagtgaacgcaccgctggtgttcgggttgtcatgccaatggcactgcccgggtcctgaagggacgttgaagacgacgacgttgataggccgggccgaagggaaaggaaggagcatacacgagtatgtgactgactttacgagggcggccaacgcggcatcagtgaaaaagattcgtttcgtgcaccagaatttgcctggcggcaacagcgcggtggtcccacctgaccccatgccgaactcagaagtgaaacgccgtagcgccgatggtagtgtggggcctccccatgcgagagtagggaactgccaggcatcaaatttagtgtgctga

SEQ ID NO: 63848 - DNA, 405 bp, Glycine max
  Peptide Sequence Number=SeqID_155533
atggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtgaaaggtgtctccacagaatatctcaaaactgacggtaacgtcgtgtttgagatattgctctttaacaatccggaacaagctgaaaatttgaaacgacgcgtcgtgttcattctccgtaataagaatgaaatcacgatgcgttcgagtctctcaaatgcttgcagtccgcagcgttgcaaaacgcctgtgggttgtgaggttaagcgactaagcgtacacggtggatgccctggcagtcagaggcgatga

SEQ ID NO: 63849 - DNA, 228 bp, Glycine max
  Peptide Sequence Number=SeqID_155534
atgaatgttttgagtggtgcaaccctcttttgtaaaatcactcgtacacctaacctcatggtgatgtgttacaaggaaagacccatcctagaagtaggtgttgagggaaggagcccaaagtatgaagatgaggctactacttcccctttccctagtgaggaagtgaaaaagaaaaaggggaagaatctagtgaagaaatctaccctcaagaagaaggacaaccattag

SEQ ID NO: 63850 - DNA, 129 bp, Glycine max
  Peptide Sequence Number=SeqID_155535
atggataagagcttgaaggaagaagaagatgagtggaaggagaggaagagaaggagcaggaaattttgtgcctcaatagagcccactaatccaaaatcaagtccaagattctccactaagtgtgcttag

SEQ ID NO: 63851 - DNA, 165 bp, Glycine max
  Peptide Sequence Number=SeqID_155536
atgccgagtcatgagttatcagactggtcacttggagtgatggctggacaaaatgatcgtgcgatagctgatgcccttcaagccttagctcaggctatagggaatccaaatatgggagaagctggtggagctattaagtaccaggggttggatcgcttccaatga

SEQ ID NO: 63852 - DNA, 414 bp, Glycine max
  Peptide Sequence Number=SeqID_155537
atgatcaagccgcagaggagactctgcaccaagggcaccagaacctgctccaggttggcaccgggcattgcagaaaggttacaaagcagaaagggaaaaactccccttaagaggtctggacgaatcaagactatggcccagaagaagagtactccaatcactcctgccacatccagaagaagcaaggttgctatcccctccaagaagaggaaagaaatttcctcatccgattctgatgaggatgtcgaactagatgtctcgacatctaagaaggccaagacttcagggaagaagatttcccagccttctgtgattacgaaatattccagacgctctgcttttcatggctacctcatcaagatgagcttctggttcaccatctgtcccatcatcttcacaccaggaacaacctga

SEQ ID NO: 63853 - DNA, 195 bp, Glycine max
  Peptide Sequence Number=SeqID_155538
atgaagaaacaacaatggaagagaagatgcagcggaagacaaaggagaagaggtaataggcggcgccatccactagggaataagccatggaagaaggagcttcacccccaagatgagccttggataggaagcttggagaggatgcttcaatggaggaaaagaaagagggagagaaagagagaggggggagcatga

SEQ ID NO: 63854 - DNA, 270 bp, Glycine max
  Peptide Sequence Number=SeqID_155539
atggatttcaaaatctgccctattatgcagaaaattgctgtcaaatttgtgcagcagaatttttgttcatgtgcagaaaatgcttgtgcattgctggctattggaaagcttggaggggttgatggggacccggtgctgagaggaacgaagataagggctacgtgggagtacgtgagctcagttgaaggtgggcaactggggatggtgggttcatgtgtgatttgtggatgtgggagagttgatttgcaccatcgaccaatcgccacctag

SEQ ID NO: 63855 - DNA, 240 bp, Glycine max
  Peptide Sequence Number=SeqID_155540
atggcacgcagcgtgtctgctccatgcccctatttaagggacctatatgggagagagctaaaaaggtttttagcgataatccccaaggtggtcatatctctcttgatggtctctagaggtatcatcctcttcgaagaacatactgcagcagtagggactactagcaacaatatgttttcaaagagaaaaactctagatgagggttcactattgttagtgtttagctctactgagctttaa

SEQ ID NO: 63856 - DNA, 894 bp, Glycine max
  Peptide Sequence Number=SeqID_155541
atgtacaaagataattggacccatccttggcccatgggctcagaaatctaccatgaggttcatgagaatcctagggccttcttcagcagctctagcccaatcctcttggagcttcttgctcatgactctagtgactggtcccttcttagggaggattgcatcactagtgatggtgtaccatttgagggcaccattgatgaggactggaagtttgatttctccagtcatgatgcccgtaggatggtttgcaccaatcaagcggatatgaccggtagattacttgtcggatcattggcattcgaatgtcgcatcatgcactatctgattgtgcgtatccttcttcctcgatcatctaaccttgcacaggtctctgaggaagacctgatagttatatgggttttctttatcggttgtcagatcgaccgggcccacattgtcagatatcgcgtgcataaggcattgcaatcaaacactcatcttccttgtccctatttgatcactctatttttatgtgattttaatgttcctcttgaatctgagccctttgttcaagtcaagagatctttttctatcggtgctggtgtggtttcctccattggataccgcaaagagagggatggttcctgggtgaagaaagacgctcagccacaggcagcagatgatcgctctccttctcctcctcctcagagggatgactcttcatcctttatgcaaaacgttctagacaagttggatggtctcctcacctttgtcggtgagcgttttgactccttggacagccgcattgatgtcattgatgcacggtttgcaggaatggatacacgcatcactcagcttgaggaggatatgagtttcatttgccagtgcttcgaccttccaccaccgtcttcatag

SEQ ID NO: 63857 - DNA, 236 bp, Glycine max
  Peptide Sequence Number=SeqID_155542
atgatgacaaaggtgatgaacaaaaagcttataagatcaaagaacaactcaagtgaatcaaagaacaactcaagtgaatcaaagaacatctcaagtgaatcaagaacaagtcaagagttcaagaatcaagaagaattcaagactcaagaagaaagcctacaatcaagaatcaagattcaagatctcaagaatcaagatcaagattcaagaatgaagaaaagactcaatcaagataa

SEQ ID NO: 63858 - DNA, 592 bp, Glycine max
  Peptide Sequence Number=SeqID_155543
ggccccaatgttaaaaccaacccactagccagtcatggagggggtagcataaacgccatcgaagaagatgggccatcacgagcaaagagattagaagaggtggctacttccagacgcttcatctaccaatcgttgcaagcggcatgcatggtctcccatggcggagacgaaagggacgaatgtttgtttcacctcggggagtcacatgacatggaaacctgtcccgcggtggaagaattgcttcagcggctcatggactgggggcagcttgaagtgtgcaaaggagggaccgactccacgcccatatacccccggacagcgcccaagccgatgccgtttgcatatcaaagcaataaggtcgttccgtggaagtatacccctcctgcatttggagaaagagttgcaaccgaagttgactccctgtcagccaaggtgaccaacatcaccggcctcagtggcgtaacccgcagtggccgggtgttcgctccccctcactcggtggaattgccctccaaggggaaagcgccgatggtccaagagccgacagacgtagccaccccctcaaaagaagtggatcctccggtggtaaagg

SEQ ID NO: 63859 - DNA, 494 bp, Glycine max
  Peptide Sequence Number=SeqID_155544
ctttattcaaggttgcactagaacgatcaccaccaatctgtgcttcttcctcgtctatcagtgtagtttacaaaaacaaaggtgaaacgaaagatattgagctggtagcggaggaacaggcacggattggtgctgatccttctagtgagacctccaataaatatgagaattataaggaggaagcacggaagaaaacacagaagcataaaccaaagagtgtggagagtgtcaatgctgatgcagaagcctttgctgaagcagtagaacatacgaagaaaagagatacaggccatcaaagtgtgtcattggagaataagacaggagattcaactatgttgaagatgggagattcagctaaagttgtgataaaacaagacatgaagggaagaaggcataaatatgggtttaacaacaatgaacgtgagaaggcacggaagaaaagggtggtggatgatgaaactgacgacaaacatcagctggatgaagtcctatga

SEQ ID NO: 63860 - DNA, 251 bp, Glycine max
  Peptide Sequence Number=SeqID_155545
gctccgcacctgatggtggaggacgcatgaacagcactaggcaatcaattcatgggtctccgaacaagatttcgagggtggagaataagcgaacagtgctcgacaatcaatttgcgggactcattggtggaggatacatgaatgacaataatttcatggggctccgaataaaagtggagaatggagaattagcgaacagcgctaggcaatcaattcgcggggctccagactcgttggtggaggatacatga

SEQ ID NO: 63861 - DNA, 138 bp, Glycine max
  Peptide Sequence Number=SeqID_155546
atggagcttgcatcaataacccctgctaggtttcctcaacctccatttttccgaggatacgacttgaatgcaacatgtgcatatcatggaggagccctggggcattccattgagcactgtatgaccctaaagcataag

SEQ ID NO: 63862 - DNA, 306 bp, Glycine max
  Peptide Sequence Number=SeqID_155547
atgttggggaatggttacgagcccggaatgggtttaggcaaggacaacggcggcataactagcctgataagtgccaaaggaaatcgtgggaagtttgggttagactataaacccacacaggcagatataaggaaaagcattgcgggaaggaaaaacggaagtcaaggctcgcgattaagacatgaagacgaaggaggcccgccctaccacataagtaggagctttataagcgcgggactaggggatgaaggccaagtcgttgcaatctgcgaagatggtgctccgagtgggtcggatttggcatga

SEQ ID NO: 63863 - DNA, 711 bp, Glycine max
  Peptide Sequence Number=SeqID_155548
atgaggggcaccgtgcatgagcctcaataccctggtcttcagaggactacactcctcaccaacagagggctgcacgccctcaccttaagaggactgtgtgtcctcactttcagaggactgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgccttgagaggactacacgtcctcgccttgagaggactacatgtcctcaccatcagagggctgcacgccctcacctccagaggactacatgtcctcgccttgagagggctacctgccctcgccttgggtactagttaccctcaccttcagaggactacatgtcctcaccttcgtagggctacatgccctcacctttag

SEQ ID NO: 63864 - DNA, 296 bp, Glycine max
  Peptide Sequence Number=SeqID_155549
ttgtgatttggttggtgttttggcagaggtttctgcctttgctctgttttgcttggctgtgatagctgtgctgggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcacgggggtcaggagaccttggggacgtcaggcgagctcctggcagtcaacagataaaaggaacaaagaccacaaagcaaggag

SEQ ID NO: 63865 - DNA, 535 bp, Glycine max
  Peptide Sequence Number=SeqID_155550
atggcagaatcgtcaaagaagcgaaagggatcatcctccaccatcgctgctgctggccatcgccgccacggaccatctgaagcacccacagcaccaattcatccttccttatcatctccaagatcatctactctattttcttcagatgatcaacgtctatggtacaattctcaattttcttctaggatcattctagaccctaagtatctagacacagatttctttaatgatgagacaattgattgttatcaaatgtttcaaaactctggattggttgattttatgtccttgaaattgccttactatcctgaacttgttaaagtcttttatagcaatttaaaaattcaggatggtattatttcttctgaggtgaatggtatttctatgatcattgatcaatctctgttcttttcattgactaaattacccagtcaaggtgcaccttttgagggcaccattgttgatgactggaaattcgattattctagtcatgatgctcgccgtatggtttgcaatgaccaggctgaaatgaccg

SEQ ID NO: 63866 - DNA, 456 bp, Glycine max
  Peptide Sequence Number=SeqID_155551
atgggatgcggcgtgaaagaaaggacagagagcttagggggaagcagtaatgggatcatcggcggttatcataagtggctgagagttcggacacaaggattggattggctcccaaatctaaagactgtgagagacaatgaggttaaagcttcggaagaaagtgatgaggtacaagccctaaaggcaaagcttgaaagagcccgggtagtcaaagagaagttcaagtccatagccatcaaagaatcatcacgggtcaaaggcatgatctggaaggacgagctaaaggcttgccttaggtcgaaaagaaatttgtcccaacagttaagcgagactaaagggaatatgtgggccatcatcgatgagtgcaaagagaagctaaatctagcggcgactcacgagcaaaggctagaggatgagtacgccaagatatcagcagaaagggaagcaagggaaagg

SEQ ID NO: 63867 - DNA, 357 bp, Glycine max
  Peptide Sequence Number=SeqID_155552
atggcactcgtcacagcatgggtttctccctcatccttaccctctttatttgccccagttttctcaggtctaagcaggatgattaaatttgcctcttttcagatccacttcgatcctttcattggcgaagaccaaatccgcaaagctttgagggtgcgtagcccaccatcttttcatagtggagtatcgataatgtgtctaccatcacgattatcgtctccctttccattattgggggtaccacctgggccgccagatccctccaccttttgggcgtgttctttgaaagatccgtccccctttttgcacatgttccgtagttgcatcctatccggaaccatatcaaaattgtactga

SEQ ID NO: 63868 - DNA, 174 bp, Glycine max
  Peptide Sequence Number=SeqID_155553
atggcgatatgtagtagcatagggaaccgccagccagctagggtgcaggagcttgcaagagctttttcagaaaggggagttgcaactgccattggcgagttgcctgcaagttgcaactcccattggcgatttacacagaaaaatagccatcaacatggcgattttgtgttataa

SEQ ID NO: 63869 - DNA, 714 bp, Glycine max
  Peptide Sequence Number=SeqID_155554
atgactaggagtaggaccaaacaatcaatggatatcctccaacaaatggtagcagacatacttaacaaggcccgagtggagaaggatgaaggtccagaggcagagagagaaattcctctaggatcttcaatttttatcatccactctaaaggagagaaatctttatgttcatctcaaaaagtcagttgtaatcaagagaccgattgtctcttggattgtgagaattgtgatcaagagacgggttatctcttggagaatcttgaacacaagggtgaggatcctaagaagcacttttggcatttgataaaattttgtgagaacttctctctgggttcctcactgaaccaatctcgaacttatcaaggtaatccttatggtgtctaccctgacttatcttccctctctggaagtggcatcatccaaaactctataacttgtatcagtgatcttctcctagtaaggatcacatcaaaatgtttgtccctagatgagctcataatttgccgtaagaagggcttgcgctttaattgtgacaaaaaattcagtcatggccacaagtgttcctcaaaattgcttcttctaatttccgaagaggatgacaacccctcggacaacctggttccacttgatgaggttggcgatgacggggaggcagttgggctatttccaacccaaattagtttgcatgtgctttcgggccatatggccccataa

SEQ ID NO: 63870 - DNA, 354 bp, Glycine max
  Peptide Sequence Number=SeqID_155555
atggcgacgacgatcgcgccatctcctcggcctcggtcgagccactggttctcgaccggagccaagacccacaccctggtccgtgcccggttcgtggtcgcccacaggctgttccttagaggtgtggtcaagggaatcaccgagcagcatcacggcgattcgcttgagtgttacccgttgaaggttgtgttatctcccagcaataacggtaccggaagattggttgctccttttctatcagctggtatcagtgcagttgatgtgggagttgagggtgcatttgcagcagattcttggagctttcttggtcgaaactcgtggagggttcatcatgatatccaactgagagcttga

SEQ ID NO: 63871 - DNA, 258 bp, Glycine max
  Peptide Sequence Number=SeqID_155556
atgcggcagtttggatacacccagatcattcctgctccgcctgtcgattcatgggtgtcgtatgatgatatacacgacaggtggatgcactactcggatcatatggttctagcaggtgaggtgtgcgctgtgccacgtcagtgtgccaacgactacatggactggttcttccacatctcgcatcctttcatgacaccaggccaggcatcatatcctctgccaaatggtcatgctccgcagccccgagtcgtcccttag

SEQ ID NO: 63872 - DNA, 357 bp, Glycine max
  Peptide Sequence Number=SeqID_155557
atgaaaagagaaaaacatgtcgcctatagtagtcatggctcttgcaagagtttaagtgaagaaattaacgactattatggagggcggcataggttacatactaaacatcactcccaaagaagagaaaatgatagaagacctcaagaggttaacattagtctcccatatttctatggaaaagataatgttgaggcctacctagattgggaaatgaaggttgaacaactctttgcttgccatcatattagtgaagagagaaaagtttcattggctacccttaacttccaagggtatgcactctctattggtggacttcccttgttagggaaagaaggattcatgggaatcctccagtag

SEQ ID NO: 63873 - DNA, 387 bp, Glycine max
  Peptide Sequence Number=SeqID_155558
atgaggcaccatgaacaacaacagaatcaggatatgacttactctctagtgaggcaccatgaacaaaaacagaatcaggataggacttactctctagtgaggcaccatgaacaacaacaaaataaggataaaaaccatttagaattcaaatttggaagaaatgatgtatttatcaattatgattcggagcatgaacaacataattcccttttggagcatcacagtgatccttcctttgatgagcatgctagtggtcatcatcacaatgacattgcttgttcaaaaaggacaaagttgcttcaaaggctaaagagatgggttgatggtagtgaaaaacctagagttaggcattctatttccaaaggggcagaggaacattgcacctga

SEQ ID NO: 63874 - DNA, 372 bp, Glycine max
  Peptide Sequence Number=SeqID_155559
atggaatttggagatggaacgtgtattggcgctgatgtactcatgtacggagagatcaaaggaatttgggcaccaagggcgacaaagtcacataaatcggctaaaccgtttcgattcaaagtgcttcaaaactgggatgatatagtggatttgtgcgctaaagatagagccactggtcatggagctaaaactgctatggatatttatgaagcgatgagtagagaaacaaatgaaccaaaattcatgggtttaagtgttattgccactatagacttagaagaacaagctctaatactaaaggaaaaggacaatgttcaacttcttctggcacatattctcacaagagaaagattggagaaaaagaaggaataa

SEQ ID NO: 63875 - DNA, 387 bp, Glycine max
  Peptide Sequence Number=SeqID_155560
atgaagaacacaagttaccggaagaacgttcttccagagaagctaccggaagaatttcttccggagaagctaccggaagaaggttcttccgaaaaaactaattgttctaccggaagaaggttcttcctgagaaactactggaagaagttcttccggagaagctaccggaagaaagttcttccggaagaactaattgttctaccggaagaaccttcttctggtagcttcttcggaagaacttttgttctatcggaagaaccttcttctgaagaagctaccggaagaagttcttccgacagtttcggaatgattgatctttgccattttcagacgatttccatgtcttctaccctaaagccatcatctcctaaaccaactaaacagtga

SEQ ID NO: 63876 - DNA, 1215 bp, Glycine max
  Peptide Sequence Number=SeqID_155561
atggcctctaggaagaggaaagctaccgcttccagaccccgggagccctatgacaccaccagattcattttcgagggcgcctgggagagatatgaccagaacgttcactcccagaacattcttccagagaggaacatcatattatacatttctgagtatgatgagttccgccgagagctcgagaggcatagttggcataaagccttgaccaggcagcctgatggtcacattggtgtggccttggtcaaggagttttatgccaacctctatgatccagaggataagtccctgcgacaaacctctgtggttttggagacaggggagcgctacaccacctacactaggttctgcgacaaccctcagcagcttccctccaagctctgtattccagggcacagttttgttctaaatgctgagggagcactctggaagctcctgaggaaggacctcgccacccttgcccagacctggagtatgttatcatactccaacctcacccccacctctcatacgtccgatcttaatatggacaaggcgaggttagtgtatggattagttatgaagatggatatggacttgggctcactcatctcaggccagatcttgcagatggcccagtccaactcctccaggcttggattttcgacgcttatcactgccttatgcatcgctaggggagtcgtgcctgattctctcacctttgagtcccttagccctgccattaatttggcggacccgcaagacttaggctcgaggacccgaggcttcttcttctgctccccttgctccagctccaccaccaccaacttcagctcccgcaccagcaccctccgacacctccgcttagaacataaagattttagtgccgatgctgcagagcctgcaccatggcttatgcctggggatgcagagtggcctggccaggagtccagccttcttctttggggggaaggtgaggctcctacaacccaggagccgcagccagaggttgatccagagccgaaggcgtcaccaaaggccgaggccactcttgaggagacaccgaaggacactcatgctgccacacccgctaaggacacaaattatgttgcagatatggcggcggcacagagtacttgggatccctggtccactccagcactaaatacatctttgctagcccaggatgccccctccatacctcagaatgagcccacaccggcacaggatgactga

SEQ ID NO: 63877 - DNA, 426 bp, Glycine max
  Peptide Sequence Number=SeqID_155562
atgccttccaaggttattttgatgatgccaaagaatcaaaagtcaagcaaaatccaaagattcaagaatcaagcttcaagtttcaagattcaagactcaagaaatcaagaagaatcaagactcaagagaagaaatcaagaagacttcacaagggaaattcaaaggactaaccgcctaagaattctttgtcttaacacattggagggtacatcctgtgtggtacaagtagagggtacatctacttgggttgttgtaaatgagaacaagagagggtacatctcttgtggatcagttcaagtggagggtacatccacttggttgttcaaagagaacaagggagggtgcatcccttgtggatctttgcttgtaaaggattttacaaggttgaaaagaaatctcaagaaccggtggttgcttggggactag

SEQ ID NO: 63878 - DNA, 156 bp, Glycine max
  Peptide Sequence Number=SeqID_155563
atggagactggctttgcccaagaatcggctgtggagtacataattatgctagcaggacagagtgcttcaaatgcaaagtgccaagggattttgaatgagaagaaatttcagaagacctggaagatgaagaatgcttatagccttcatatattttaa

SEQ ID NO: 63879 - DNA, 663 bp, Glycine max
  Peptide Sequence Number=SeqID_155564
atgtctaatcaacctgcacctcgatgggttgaaccaaagagtcatgtccaaactggagcatacgagtgcggatattatgtgatgcattggatatggtgcatagtgactggtggattgaaggatgactggaacaagtggttttctgatggatcaccgttagacgtggaggccatcaccacacttcgccagaaatgggcaacattctttttaaacttggatggcctcgtcgttcttggtggtgatgacttaaacactaatgtgtgccttcttgctgagaatttcagtggggattatggtgatgctatcacggtggaaattcggagaagagttcaaattttagcaaattcaagtgctcacctacttgcattcgaaacagtgcccaataagcttgaagctgaggtgactacaaaaccaattgttatatatccaaacagtggggaaacttacgatgctgacctaaaggagtgggtgcagacagaagtgcataaattgctaaagcaattagcttatgagaggttttgtgaggcttcaaatcatagttccaatgtcaatcttgctgataaatcaagaaaagtaaaggacaacattccttccattccattaattgcttttataaatgaaaggctcaagaaagtacaaaatatgattttagggagtttttaa

SEQ ID NO: 63880 - DNA, 141 bp, Glycine max
  Peptide Sequence Number=SeqID_155565
atgtcctcgggagatcagttcacacaggccaaattcaagaactcaaacagagcaagacacctaaggacaactcgggttagtcaagtcaataaccctccaaccttggttgacaaggcgaggtgggggcgagacaaatattaa

SEQ ID NO: 63881 - DNA, 165 bp, Glycine max
  Peptide Sequence Number=SeqID_155566
atgggtgacctttgtgtagttcctgggcaggaaggtgaccagcccagacatgcacctgccctagaccatgaggacaacatgcagctgggcatcccacaggttccagtggcatttgacccccccccccccccccacatgcagggggaaaaatgtttgcccctttaa

SEQ ID NO: 63882 - DNA, 736 bp, Glycine max
  Peptide Sequence Number=SeqID_155567
gaacttgtcaataccttcaaggttcatgaacaagaacttcatcaggatgaaggactcaaatagagaaaagtctctggctctcagtagtcagaagaataagaaggcatcatcgtctagagaacaagtcttgagaaattcgtccaaagctcttaaagtcgatgagtcatctgatgatgaatctgaggaagactcggatgaagatgaactcgcctttatttctcaaaagatccaaaagatgtggagaaaaaaaggagcgtacaagcctgaacatttcaagtctgaatgtccagatctgaagaagagtcaagataagaaaaaattcttgaagactaaagaaaagaaggacaaatctagaaatggatatgattgggaggtatatgttcatgatgaggacaccgttttctgttatttctatggaaaaattggacacatgacgtccagatgcagggatcatcctaagaagtatgtccttgatagcacgaagcaaatgcctatcatggtacttggacagtggttgctcatggcacatgacgggagaaaaatgtatgttccaatgactggctccctatcatggtggaatagtcataagcataatctattgagcataagccaaatatgtgacagtggatatggtgtctccttcaacaaggatgagtgtgctgttctatgtcatgatgggtctcctttattctatgctaagagaaaagacaatctctacaaaattagattgggataa

SEQ ID NO: 63883 - DNA, 903 bp, Glycine max
  Peptide Sequence Number=SeqID_155568
atgaagcaagaggggaagatgagaatcctagaattatctcattgggataatgctactacattgcatacaagaacaaacacaagttatttctacaccaaacttcccaatctggaaaattgggatgtcacaaaatgcaacattttgccccaactcatctacctaaagctcataaggatgttctggagaaactctgagttcttgaacaacaaagctattgtgtccaaagttcttaggatgaagaagtttaacaaatccaatctgaaggttataaaggttatgattgatgttgctaagaaagaagttcctcagatggataaggaagctattaacagaaagaagaagaggaagtcaaatgctcagaagcaagcatcaccggctcctaagaaagtcaaagctccttcaaaggcagttgacaaggaatggactcctccctttcctccttcatcatcaagtagtaaaaccacacatgatgctcctatctcaccacaacgaatgcatctattatctatagagcaacatccacctttatcaattatcaatctaaagaagttcaaatccacccagaagatgaaggtacctctaacggatgatcaaagagaatccattcctacttcatctcctgagtggatgagatatgaatatgtgcatacacctgtagaggcctacgaagctctatcttcagatgccatggttcatattaagactcctaaatggacgtgtggtctacatgctctgatgtatactcgcaactgggtcattgcatattcacctggtttgcacatctctaaggccattgagattaagattgttgtagatagagtctgccctcgtttgcccacatgggatgtagcaaagaagaaagacttcaaactctatcattatgctaagatgcctagtaggtag

SEQ ID NO: 63884 - DNA, 231 bp, Glycine max
  Peptide Sequence Number=SeqID_155569
atgtctgcaacgcttcctttgacgcacgttggcgacatctgttgtgagacttgcgatggctatttcatgaactatgacaaccctgacatggcgaccatgctcaagaaatgtcggtcctctatcgggaaaaaccttgaagccattggcagctccgacagcatacgcggaagaggcgccatttcaatcgacgatgacagaggtaaggagaataagccaataacggcgccatag

SEQ ID NO: 63885 - DNA, 366 bp, Glycine max
  Peptide Sequence Number=SeqID_155570
atgtactctcccttgttctctttgaacaacctagtagatgtaccttctactagaactgatccacaagagatgtaccctctcttgttctcagtcacaacaacccaagtagatgtaccctctacttgtaccacaaaggatgtaccctccaatgtgttaagacaaagttctcaggcggttagtcttttgaaactttgtgaagggggatacaaaagatatctcagggaaagggaagaatcaaaagaattctcagactgtgtcgttttgaattctttgacatgggagaagggagacacaaaagaatttaggcggttagtccttggcgaattctttttgacaaagggagaaaggaatgaaaaagatgaatag

SEQ ID NO: 63886 - DNA, 621 bp, Glycine max
  Peptide Sequence Number=SeqID_155571
atgcaactgggactgacaaatattctcatagctaggttccctaaccctaactatggtgtcaaaatgggtttttcaaaggaagcgcaaaacatacaatggtggttccaaagaacaagcatagaatcacggttacctcaaggaaaatcacgaaggtcagactggggcttcattctcaatcgaaactgcgaggcaagtttggaaccgcttcggttgaaggttcctctcggtgtggggtttcaacggagaacaacggtggtccgtggtggccaccgatggttgtgggtggtggagaagaagcttaggacgttggaattggttttggaagaaagaaggagaaaggaatggctgttttccaaggctacacgaaatataaaggttgaaacactcaagtgcttctgctctcgggaaaagaagcttttctcacacaaaagaagacatatcgtagatcacaacggtcagatcgtggacatctgtcctatgaatctgaagaccaaatttcgacaagatccaacggttaacgaatttaggaggacgcgtttaccaagacatcttcagacagcttccttgaaaagcttttctcaagaggcttctttgagaagcttcctcttaaggtttctttga

SEQ ID NO: 63887 - DNA, 453 bp, Glycine max
  Peptide Sequence Number=SeqID_155572
atgcaatcgcaggggcttgcactgcctcctgaacctctggttggtccttccggtcctcgagtaagcacaaaggggagttgtgttgatccctcaggaaacaatcctgagacgggtgactcagataggtgcgacttgtacatcgaagcagatcctgcccgcctagctgccctggggagagtttatgagggatccactgttgttcataacacccctttgttgcctagccaagtaaaggtgggtgtggaggaggttatagatgtagatgctccagttcctgtacccactgatgaggtttccttagtgggacagacaattcacaccttccttgcttggccgacacatctggtagctgtgtctccggcaaaaccaccaccaaagcccgatccgcaagtcgatgatccgctttatctgatgacattgaccatcccagagcttttcttgaggccttatcag

SEQ ID NO: 63888 - DNA, 879 bp, Glycine max
  Peptide Sequence Number=SeqID_155573
atggaaattaccgaagtgaaggtcgagaaattcggtgcagcgcaattggagaaaagaggggagaatggaagattggagagtgagaagaatattgatgcggcatggggagtcgcagaagaaccaggacacgacgcgacgacggctcccttgactggcgggtggagttctacgtgtccccctacacccgcacctgatcgacgcttcgcaagctcagacgacactaacggagcaccgctggattatctggaacttgatggcgttttctccgacgacgattccattgctgcgggggccaaaggagatgaaggcagggcagcggacgtagaagtggtagcgaccggagatgaaggcgccgaccttccaacgaacccttccgtcggctcggatggtgacgaggacattaccgtcactctggtcctggctgaggcggaggaaattgaacggcgcgacggggatgttggtaccataaacaaacggagaccaaacattgatctcattgtggccctggtaggtcggagggatggcggttcggtacgtgatctgctggctccggtagattacgtagatttcgaggcggtcgtagtaaacaccgatgttgtcgttcgggttgcgcgagatgagcgtgacctgaaaattcgaagtgaggaagttcggtatggtggcgttgaaggcgtagaccgtgacgtcttggagggtgaaggtgggtttggtgggtctaaggattgcccatatcaaaagaattgtgagcagcacgaggaagaggaacaccactatgcaccagaacacttgccggaagatcttcctcttcttccccttgtggtgctcgcactccgacatggaattgggaggttcggtgtggtggacgcttctgagaaataa

SEQ ID NO: 63889 - DNA, 639 bp, Glycine max
  Peptide Sequence Number=SeqID_155574
atggctgaacatagttatagacatgaaggttggagcagtgttgccaaatctctaactgaagatgtccctcgacttctaaagtcagaggatctaaaagacattcaggaagtactctctcttgcttttaaatctcctcccagtgaattgagagggttaataacatggattgttgaagttcgcagacaagaagatgggaatctcacactaagtgaggaggagaaaggaaggctagctatcaaggctgacatactggaacagattcgaacaactagactcttcaaacacgtgacaaggctaggtttgtcaggtggaaaatgttgtagtcaaatagatgtaaaacatatgaatgctgatagtgaaaatccagtaacattagtttcaggaactgttacaactggtggtggtagtgaacaaggagttgatgtgttggtccctttgtgtcaaagggaaccaagtaggttgtgtctttctaatgaaggtcactgcattggcatgcacccgtctactgcagatgtcttaacaatgtttttattggccttacccttgcatacgtggtctggcattaaagaagaaaagctgcgtgtggaagctttgaaccctctagcaacagaagatctccctcccctacttcaggaagag

SEQ ID NO: 63890 - DNA, 252 bp, Glycine max
  Peptide Sequence Number=SeqID_155575
atgaatgcaggaacctgtggaattgaagcacgtgaaagagaagagaacgaaaagaagaatgcatggagggggtatgaagaaggatcggatcgtgaaggggaagttgaaacggaaaagcatttttgtttggaacaaagggaatgtttgggggagagagaacagagtgaagaaaaagagtctgtgtgtgacgcggcggaagctgctgactgttttgttgtgtccaggcaagtgttgtgtgtcagagtgagatag

SEQ ID NO: 63891 - DNA, 192 bp, Glycine max
  Peptide Sequence Number=SeqID_155576
atgcatccatggtcttgccacatgggagctcatcaggggagaggaaaatgcggagttgggaattggctaatgcttggatgcaagtggcaacgacgatgtgggttccaagataaggtttttctggcggtggcttacgagggattttggatattttattcaaaatttaacaccgttagtaactatgatggttga

SEQ ID NO: 63892 - DNA, 444 bp, Glycine max
  Peptide Sequence Number=SeqID_155577
atgggtctcccgttttggggtaggtcccttgtggctagggaagtgagaggtatagaggagtttgggagtgaggatgagttttatgcttcatccctttcatctatatttgattcgaatagaatggaagattacttggtgagggagggggttgggatgtctaaggagatgatgaggacgaagggggatgatgttgtaggggtgtgggttttcatggaaggcaactcataccttgctcagttccaaacccttgagtccatagaggagttaaaaaggaaaatcgacatgatgaacctggatgatgccaagctgttgattgttgaaccttgtggcgccgaggagcatgtgttcatgaaggcatcgaagggtgaggctgactttgtgtacttgtatgaagatgtctttaaggagttgaatattcaatttccatttctgaatcttgaatga

SEQ ID NO: 63893 - DNA, 201 bp, Glycine max
  Peptide Sequence Number=SeqID_155578
atggagctacatcactgcccttgtgcaaaatcaaaccattgttcaagtgaaaatctgggtacgtcgtggggttggaggagattaattgcagcatgtcctaaaaatccgagctcgcagttagtgatgcaatccttccctccaagggaattggatatgatgcaatccgaccctccaaggacattggatagaagactccaataa

SEQ ID NO: 63894 - DNA, 1257 bp, Glycine max
  Peptide Sequence Number=SeqID_155579
atggacgagatcgacgtgcctccgttcttcgtgtgccctatttcattagagctcatgaaggaccccgtgacggtctccaccggcatcacctacgaccgcgacagcatcgagaagtggctcttcgccgaggtgaagaacgacacgtgtcccgtcacgaagcagcccctcctcccggacctcactccgaaccacacgctccgcagactcatccaagcctggtgcaccgtcaacgcctcccacggcgtccagagaatccccacaccaaaaccaccggtcgacaaaaccctcatcgagaaactcctccgcaacacctcggcttcggactccccgagcctccagctccggtccctccgaaccctcaagtccattgcctcggaatcccaatcaaacaaacgctgcatcgaatctgcagaaggcgcagttaatttcctagcaacaattataaccaccaccaccaccaccaccaccaacctactcgatgatgacatcgagttggaaataaaaacaagtacagcccacgaagcattgagccttttacacagcattcagctgtcagagtccggtttgaaggctctgttgaaccatccagaatttataaactctctaaccaagatgatgcaaagagggatctacgagtcacgcgcctacgctgttttcttgctgaattccttgtccgaggtggcggatccggcgcagttgattaacctaaaaactgatttgttcactgaattggttcaggttcttaaggatcaggtttcggagaaggtctcgaaggcgaccctgcaggcattgattcaggtgtgttcgtggggcagaaatagggtgaaggctgtggaggctggagctgtgccggttctggtggagcttcttctcgaatgcaacgagagaaaaccgatagaaatggtgctggttttgttggagattttatgtcagagtgctgacgggagggcggggctgttggcccacgcggcgggggtggtgatcgtggcgaagaagattctgagggtttcaacgatggcgaacgatagggcggcgaagattctgctttcggtgtgcagattttcccccacgccgggcttggtgcaggagatggtgcagcttggggtggtggcaaagctttgtctggtgctgcaggtggatagtgggaacaaagcaaaagagaaagctagggagattctcaaattgcatgctagggcttggaggaattcgccttgcatacctcacaatttgcttgcttcgtttccaatgagttcgtga

SEQ ID NO: 63895 - DNA, 519 bp, Glycine max
  Peptide Sequence Number=SeqID_155580
atgaatcaagcaattacgaaagttagtcaaccaaacccacgctctcacgaagcttctcatagtagccctccatgtcattcccgaacactaacgcgagccccatcccatgataatcacgcgcttctttgggtccttctgccgctgcgcggtggacacctttggcgccaccgtggcggacacgaagaacacgcgcttcgcagaggtggtgcgtcgcttggcggcggcattgttggggccctaaagagggtccaagggagaaccgtggagggtgatgatcacgggaggacaggaggcgcagtagagagagaatattctcgcgccggcattgttcgtcggagtctcgatggcgccgccacctacactggaggttctcgcggtggtttgggggttggagatggggaggacaggaggcgcgggaagacaataacttattcaaagacggtcaaaataaaaagaccgtctttgtattacaaatacaactactacgggcaacgcgggacccgtcctagtacttcttag

SEQ ID NO: 63896 - DNA, 123 bp, Glycine max
  Peptide Sequence Number=SeqID_155581
atggtaatgacttcaggtgttgattttaagatcaaaacgctcaaagtcggtgccaagagattgaaattgacgatttgggatactggtaatatagagtcaaaatcttgtgctttcagttcttaa

SEQ ID NO: 63897 - DNA, 156 bp, Glycine max
  Peptide Sequence Number=SeqID_155582
atggatgacccagtctgggttggtgaccctgattttgaaggagaactcttttttatggttggctctggtagagccaatttgaatccttttctagtgctccttcctccccgaagggaggtgcccgatgccttaggtggcatgagaatttttctctga

SEQ ID NO: 63898 - DNA, 704 bp, Glycine max
  Peptide Sequence Number=SeqID_155583
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggcctttaagctgatttcatcattcaaagcatccctctgttgcctgtggatgtatttcgcggaccacgtactagctgtgggtgagctttgtctagtgcctgggcaggtaggtgaccatcccagagatgcacctgccgcagaccctaaggagtacatgcagccgcccatcccccaggttctagtggcatttgacccccctccacatgcagtggatgattatgacggctatgaggcgatcgcacagaggttggagcgtgtgctcaaccttaggatggccactgcaggcatagagttatatgatattatgcaggattgtctcacgatcgccagaggaggtgccagtgcagatggaagtgtcaggcctcgacagagacg

SEQ ID NO: 63899 - DNA, 216 bp, Glycine max
  Peptide Sequence Number=SeqID_155584
atggcattagactcatcaaaggaaacatatcgggctgcacaatgcacaaggcaagataaaatgtcaaatgaagaattgaagttgcaggatccacgatgtcggatacaatgtcctgacatcctgctcgagaatactggagttgctgtgcaatgcaagataaaagtcaagtgcagaagtgaagctgcaggatccacgatgtcggacacgatgtcctga

SEQ ID NO: 63900 - DNA, 370 bp, Glycine max
  Peptide Sequence Number=SeqID_155585
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcgagcaagatcttcttgtctttacgttccatcttgacatcaagattggtttcaccattcagagcatcttcaagaccttgatgcacaagaagagccctcatccttaa

SEQ ID NO: 63901 - DNA, 640 bp, Glycine max
  Peptide Sequence Number=SeqID_155586
ggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggcttgaaaacgaggcctctggtaatcgattaccagcctgtgtaatcgattacacagagatcgtgatggcggcgcagctaatccgtgatcgagtagagatggagtgcctagagggagtttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgtccaagtgatcgaggtaacgtcatccgaggaagaccccgaggaggatctggaggagctacctcctgagcctgctgtggatgcccttgactttctagagggtgatgaggatccacttcttgaggtggattctcccgaggaagtcatgttggcatctgaggcagactctacggaggatggtggtccgggggagatggcgatcagcggaggctcttcatcctag

SEQ ID NO: 63902 - DNA, 153 bp, Glycine max
  Peptide Sequence Number=SeqID_155587
atgaagtcgttgagaggaaaggagatcgcgttggtgaaggtgcaatggggaaccgatgagggtgattctacatgggagttggaggataggatgagagaattgtacccaaaagtaggaatagtgggggcaagatacgcgggtttgactaattaa

SEQ ID NO: 63903 - DNA, 138 bp, Glycine max
  Peptide Sequence Number=SeqID_155588
atgccacatcctatcagagcgttgggtctcaacgtccttcagcacatggttcctcaaagcaattcacctagtcatctgctcccccgaacacaaagttcaagatcatcacaggatccaaacacaaacaacacacgggaa

SEQ ID NO: 63904 - DNA, 279 bp, Glycine max
  Peptide Sequence Number=SeqID_155589
atgagtctgaaatggaggcaatttaaatatgaactgaaatcaaaaggatatgctgagagcaaaactaaggaggaaatggttgcttacatcccagatccaagggttgatccttctcaatatcatgatttaaaaataagcaacatcaacaaaatgagccgctcaaaatatgaggacttgcattgcatgggaaccaataatcttccaagacggatttatgagatgacaacaaaggctaagggagtgcaaccttctagggcagaaatttatattgacacttga

SEQ ID NO: 63905 - DNA, 399 bp, Glycine max
  Peptide Sequence Number=SeqID_155590
atggaactactccttttaagagctggacttagggaggaggaaagaacaagcatagctaggttccttagtgggcttaatatggaagtgagcaacaaggaccaagcccaaggaattttgggggctgcacattcaaaaccaaaggaagataaggagactactttttccccttcttctagtgtaagtgaagatgaagtaaggggtgaagagcctagtgaggaagtctacccccatgaagaaggtgacctcctaatggttagaaggctccttggaggtcaatcttgtgatctatctcaatcccaaagaaagaacatccttcatacatgtagaagcaagcttcatgatgatgaatcaagtagttttgatgatgacaaagatgatgacaaaaagcccaaagaatga

SEQ ID NO: 63906 - DNA, 372 bp, Glycine max
  Peptide Sequence Number=SeqID_155591
atgtcaaatcataaaagcatcgagtcaacactgaaaaatcttgaggtccaagtgggacaactggccaagcagatagctgacaaggcatccaacaattttgtggcgaatacagaaaagaatcccaaggaggaatgtaaagttgtgatgacaaggagtaagaggtttatggaggcggaggatgaggatagtgttgtatccaagaagaaagctgctgaaaagaaaggtactgatgaaaagaaagatgatgtgggagagaggagtagaagtgaacaagctagagagaagaaaagagaaaaagctgtgaatgaaggtgcgaaagtaccataccctgtggaaccttccaagaaggagaaggaccgccatttggcgtga

SEQ ID NO: 63907 - DNA, 103 bp, Glycine max
  Peptide Sequence Number=SeqID_155592
tcgaattgcttctgtaacgcttccgtaagcgattctgtggatattcttcatcgttcttcaccgttcttcatccgttcttcgttcattcttcgttcttcaacgg

SEQ ID NO: 63908 - DNA, 312 bp, Glycine max
  Peptide Sequence Number=SeqID_155593
atgctacaaacatttacaatagacctcctcaacctcagctgcaaaattaaccacaatagaagaattacgacctctccagcaacagatacaatcccgggtggaggaatcgtcccaaccttagatggtcgagtccttcacaatagcagcaacaacaacaaccttattttcagaatgctgctggcccaagtagaccctacgttcctccaccaatccagcaacagcaacaacaacaacaacaacagcaacagcaacaaccctagaaacaacaaacagttgaggcccctccgcaaccttcccttgaagaacttgtga

SEQ ID NO: 63909 - DNA, 72 bp, Glycine max
  Peptide Sequence Number=SeqID_155594
atgatgttgggcttgcctcagatcaagcctcctagtgaaaatttcaagaattttgtgatcaggaaggcataa

SEQ ID NO: 63910 - DNA, 165 bp, Glycine max
  Peptide Sequence Number=SeqID_155595
atggcttgctttgaccagcaacattctggaaaggagggacatgttgtcgttgttgttgtagaggacttgcctatctcagatttggatgattcctccaacctggattgtatctgttgcttgaaagatcataattattctgatcataagcttcagattgctcattga

SEQ ID NO: 63911 - DNA, 276 bp, Glycine max
  Peptide Sequence Number=SeqID_155596
atggcctctggtaatcgattaccaagggtgggtaatcgattacaaggcttaaaaagtgaagacaggaagctaagatggcctctggggaacatgccactggtaatcgattaccagatcgtgatggcggcgcagctaatccatgatcgagtggagatggagtgcctagagggagcttgggagaccctcgaaggcaacacgaggtgtcgattttggggcacgattcgatttacagctacttcattggtgcatccagatgaacccgcgcgcacgctttag

SEQ ID NO: 63912 - DNA, 357 bp, Glycine max
  Peptide Sequence Number=SeqID_155597
atgaagcaagaagaatggaacttgctagatcaactggctcttggcgtgatcagattagcattagccaagaacatcgcattcaacatcatgaacaagaagactactgcaggcttaatgaaggcgttatcagatatgtatgagaagccgtcggcagctaacaaagaatcaatgcagattaaatttgaggatgaggtgaaggcattgattctattgtcatcactaccagatagttgggctgcaactattactatagttagtagttctacaagggagaacacattaaagcttagtgacatccgtgacttgatcttaagcgaagatattcgcaagagagattcaggagaatcttccagtcat

SEQ ID NO: 63913 - DNA, 312 bp, Glycine max
  Peptide Sequence Number=SeqID_155598
atggtagagcaatttaatgaatgggtagcttggccagggactcaacctcctcttcacaaagaagacgaagatcccgccactcaggaagctgcagcaacctctgaaaagtctcttgaagctactccagagcttccggcaccagtggcaaataccacttctccacagcaggcagtagacccttccacgcctgaggatcaaaccaccccagtcttgtctccgaacacctctcctatagctactcctgtacttcacttgtcggaagaggaggagggtcagacactggacacccaggaccaatcacaggatatttaa

SEQ ID NO: 63914 - DNA, 93 bp, Glycine max
  Peptide Sequence Number=SeqID_155599
atggtgcctgatgctaaacggatattttctatcttacaatgctcatctgctcctatggtgtctcctgagatgctaaaccccgattcctcatga

SEQ ID NO: 63915 - DNA, 228 bp, Glycine max
  Peptide Sequence Number=SeqID_155600
atggggtcgaaccaagcacatgcttttaagaaaaggttttcatcaagtcaaggtcaagtatggaggaaagaacacgctttatggtgcccttaccgatcgtgtgccagagctagagtaatgagtgaaatagaggaagtgcaagagcaaatgaaggctagcatggaggccatgaaagagcaaatgaccacaatgatggaagccatgatgagtatgagaaggatgatggag

SEQ ID NO: 63916 - DNA, 222 bp, Glycine max
  Peptide Sequence Number=SeqID_155601
atgttcaagtcgatccaacggttaacgaatcggaacgaagagaatgctactgggtttggaggggttgatggggaccccggtgctgagaggaacgaggataagggctacgtaggaagtgatacctggagatatgtcgcgggggtcaggagagcttggggacgtcaggtggggtgctattgcccaaaaccaagcttgaccaatcccgacccaacccgggcatag

SEQ ID NO: 63917 - DNA, 303 bp, Glycine max
  Peptide Sequence Number=SeqID_155602
atggcgcctaccaggcaccctttggatccagataagtctaacagggccctgggatttcccacgctgatgacaggactctgccagtcgtttggagtccccgttacacctaccaaggtgattcggctgcccatcacccgggcttttattgagaagtactgcacccagagacaggctcaggggaatgctccacaggccgcgggcgcgccaccaccacctcatcaggctggcccggctgggtcatttgacatggagcagtatttacggcatttggtttgccagcaggcggccaaccaccaggcacat

SEQ ID NO: 63918 - DNA, 413 bp, Glycine max
  Peptide Sequence Number=SeqID_155603
atgactagggtcaatccaggtgatttaaaaccctttgatcctaaaattgatagaacctttcatagattagttaggcatagtgtgcattctggtcattctgtgcattttgagcattctgagcattctgttgagggtgattttgaatattctgattttgagcattccactactaattttcatactgagaacatcgctcaacctccacctcgtgagaggactcttagggagatggttgcacctgatttcacttatgaaagcttgtgtgaagatcctcataagcatcttaaggagttccatattgtttgttccaccatgaagcctcctgatgtccaagaagatcatatctttctaaaggcttttcctcattctctagatggagtggcaaaagattggctatactaccttgctctcag

SEQ ID NO: 63919 - DNA, 195 bp, Glycine max
  Peptide Sequence Number=SeqID_155604
atggcttatggacatgaagaaccaggaaagtctgaaggacaagtagttaagaaagttgttcattatctgcaaacatccttccctcctcaagtgcaagcttcttgcgtagccgctcttggtgctcagaaaatcccaaaaatcactccagaacaagtggagccccctggctgcaggaatttgatcaatcacgaatga

SEQ ID NO: 63920 - DNA, 393 bp, Glycine max
  Peptide Sequence Number=SeqID_155605
atggcattcttaggagagacaagtagtcagatagttgtgaactccacatttgattttatttttccaaatggatccattgttcacaacgacagtggtgtttcctttcaagcttccactctagttcacattcgagtacctaatgggtgtgattttcaaacgttaaaaactagaatacacaatacccttaagctaaccgacaagcaatttttggatgaaatttactaccggcggtctttcacatatgcagatgttaacacaatgttaatgtgtaatcatgaattttcgtttgttggtccgattgagttattatgtagcattgctagaaccccatatggtattttaaacttacttcaagctactatgacccctactcatgatgccctgctttattaa

SEQ ID NO: 63921 - DNA, 297 bp, Glycine max
  Peptide Sequence Number=SeqID_155606
atgcttgtgtgtggttgggctgtggaaagtctagtgcagaatgagttctggatgtttgctagtagatcccaacggtcaaaatgtaggcctatacactatagacttccacttgggaggattgatggggacccggtgttgagagaaacgaggatatgggctacgtgggagtacgtgagctcagttggaggtgggcaacaggggatggtgggtttatgcgcgcattgtggatgtggaaaaacttgttgtgcaccatcgcccgaccgccacctagtaccacatgtgatgggtaccccataa

SEQ ID NO: 63922 - DNA, 675 bp, Glycine max
  Peptide Sequence Number=SeqID_155607
atgaacaaacttggaggatttgtttgcacaaggtgtgacgccgaaaaagaagcaagagggaggattgtctgttgtttacccgctgcatcaagaagtgtgtggttgatttcgccattccgaccaagaagtcaatacccgtgtccgcttcaaagctatcgctcatgcgccgaaaaaggaagagtcgattgggaccaacatttggctgggatagggggcagcgcaatcaattggtttcctcgttggaaggaaggcaaggaaggagttcttttctcgtgtggggactaccctaatgttccattgatagggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccgttgaggaaagacaaggagcttagaggcatccgaaatgacgccatcggaggttatcatagatggctaagaattcatacgcgagggttggattggctctccaaattgaaagttatcgatgaggagaacttcaaagctccggaggaagatgaagaagtccgagctctaaaattagagttagggaaaggcgagactcgccaaggagaa

SEQ ID NO: 63923 - DNA, 450 bp, Glycine max
  Peptide Sequence Number=SeqID_155608
tgcataactagggtcaatccaagtgatttacaaccctttgatcctgaaatagatagaacctttcatagattagttaggcatagtgtgcatcctggtcattctgtgcattttgagcattctgagcattctgttgagggtgattctaaatattctgattttgagcatccactactaatttttatactgagaacatggctcaacctccacctcgtgagaggactcttagggagatggctgcacctgatttcacttattaaagcttgtgcattcaatatcctgatgaggggagtggcaaaagattggctataccttgctcctaggtccattttcagctgggatgaccttaagagggtgttcttggagaaattcttccctgtatctaggaccactgccatcagaaaagacatttcaggcatcaggaaaattagtggagaaagcttgtatgagtag

SEQ ID NO: 63924 - DNA, 396 bp, Glycine max
  Peptide Sequence Number=SeqID_155609
ctcagttggaggtgggcaacaggggatggtgggtttatgcgcgatttgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtgtggtggctggccagctgtgaactttgaatttatatgggatgtggcctctggcttgaaaacgaggtcaggaagctatgagggcttctggcagcaggttgtggaggcctctggtaatcgattaccagtctgtgtaatcgattacatagaggaatgggtcactggtaatcgattaccag

SEQ ID NO: 63925 - DNA, 173 bp, Glycine max
  Peptide Sequence Number=SeqID_155610
gccagactcaggcctcaaaaattaatagtaggctaggctcaggccttttaaaacctggcctggcctggcctattaccacccctacctaccccgcaagggcattggatagaagactccaagtcgattgtgccagagatccaagggaaggccctagggttctcatgagccttagg

SEQ ID NO: 63926 - DNA, 483 bp, Glycine max
  Peptide Sequence Number=SeqID_155611
atgaatcaaaaatctgcacctgtcgtcagactctatggtttatgctcctctactgaccaccacacagacctttgcccttctgtgcagcaatctgaagcaattgaacagcctaaagcttatgttgcaaacatctacaatagacctcctctacctcagcagcaaaatcagccacaacagaacaattatgacctctccagcaacaggtacaatcccgggtggaggaatcatcccaaccttagatggtcaaatccttcacaacagcagcaacaacaacaacaaccttattttcaaaatgttgctggcccaagcagaccatacgttcctccaccaatccagcaacaacaacaacaacaacaaccccagaaacaacaaacagttgaggctcctccacaaccttcccttgaagaacttgtgaggcaaatgactatgcaaaacatgcagttttcaaaaagataccatagcctccattcagagcttaactaa

SEQ ID NO: 63927 - DNA, 309 bp, Glycine max
  Peptide Sequence Number=SeqID_155612
atgtcattgcctagcgctgttcatgtgttctccattatcaagtgcgaagcttctggtgactgggaagcacgttattctgttgttttccagatcggttccttcgccaaaagaaaaaaagaagaagtagagatgagagtcgtcatcgcgaaaagggcaggacggacgaaatcagtgtcctatctttgctttcctcttatctccgatgagaggcccacttgggccttccagaagattcctccagaaggctgttgcttctggaggaagcaacctggctcgcctgggcgagctgagctcgcctgggcgagctga

SEQ ID NO: 63928 - DNA, 237 bp, Glycine max
  Peptide Sequence Number=SeqID_155613
atgaagccttgcttgaagctttgcttctacagaaacaagtgtagaaccatggttacctcgaaagaaaacgaaagaccaaattttgagacgatccaacggttaacaaagactgcgcagcatttttaccgaggcagctccatgttgcttcctcaagaagcttcattaagaggcttcctcaagaagctttcccgtggcttctttgagaagctttctcaagaggcttctttgagaagctag

SEQ ID NO: 63929 - DNA, 177 bp, Glycine max
  Peptide Sequence Number=SeqID_155614
atgacggattcaccttgcgtgatcttgtttcatataatttcaagcataatgaagccaatggggaaggtggaaatgacggaagcaatgataatttcagttggaattgtggtttcaaagttaggggaaactgatgatgctagtataagagcttttcgatcatggcaaatgaaaaattga

SEQ ID NO: 63930 - DNA, 225 bp, Glycine max
  Peptide Sequence Number=SeqID_155615
atggggagagttaacctagggttaaatgtgacaatggtagtgataaaatgcttgtgcattgttggttatgggaaaggtagtagatattgggttctggacattttctggcagatcccaacggtcaaaatgtatacttatgtactagggacctccagtaaaattttcgagtcgatccaacggttaacgtatcggaacgaagagaatgttactggggtatttgagtag

SEQ ID NO: 63931 - DNA, 331 bp, Glycine max
  Peptide Sequence Number=SeqID_155616
gggttgcgcgcacaagacacacagtggactcggaggagcccaacaggtccctgagtgtccagctctggttacgagcctctgtcagtcccctccagcaaggtcataccatcatgacatagggatcgcgcccgtaagacaaccagtggatccgaagaagtccaacagggtcttgaggtttccagctttgattacgagcctttgtcagttctacgaagcacctgtcacccccaacaaggtcattaggccccccattaaccgggctttcatcaagaagtactacgcccccgggcaggcgcggggcgagataccacagctacctggggatggctga

SEQ ID NO: 63932 - DNA, 507 bp, Glycine max
  Peptide Sequence Number=SeqID_155617
atggatgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggacgaccccatgatgtgcaaattcaaaacgagcacgccttcccatcctatggcttgcctcccaactatacaccacccaatgtggcatacactctcaatgaaaatctcaataactccactccgatactcattgagaaccaataaacctcatcaggcacatatctctcaaaccatgggggagacacatgaaattccccaccacaatctagctgacttcgagccttggctcggatatgccactgaagggcaagcagttggtgggtataccctttga

SEQ ID NO: 63933 - DNA, 201 bp, Glycine max
  Peptide Sequence Number=SeqID_155618
atgactttgagcttagctcatcaatgggctaagcacgcatccaccgctaagcgcagcttcaacgcgacagaagaatctggcagggcatcatcatcaaggccatgtgctaagcgcgagatcaatgcgctaagcgcagcaattgtctttagccaggctcagcgcacgactgacactaagctcaaatccacttactcgcgctaa

SEQ ID NO: 63934 - DNA, 390 bp, Glycine max
  Peptide Sequence Number=SeqID_155619
atggccataatgatggaggccaagataagcataaagaagatcatggaagtcaatgcagttgcaattgccgctaccagcactattgcaaaggtaaacctgactcccccatctggcctcaaccaaatgaatcatccaacctcagatatggtaggcaaagatttgggaagtacgggcaacccccattttgtacaagtccaaaacaaacatgctttcctgtcatatggtttgcctctgaactatactccacccaatgaaaatgtcaataactccactcccatactcattgagagccaacaacctcaatttgatcatgcacgtgtctctcaacccatggggggttgttcgaacccaacaagtgcatcggattgcgcaagtagtataaaatggtaa

SEQ ID NO: 63935 - DNA, 194 bp, Glycine max
  Peptide Sequence Number=SeqID_155620
atgtcgcttcatgttctttatctttatgcgttttctggatttcccccagggatttcctgtctgttgtatctctcgttacaatctttcaaagaaatgaacatggattcaaggcttttagtcctcacggggcaggatcaccttgggctaccttctggagtagagacaaaacatgaacgggcagaaaaccaatcaag

SEQ ID NO: 63936 - DNA, 80 bp, Glycine max
  Peptide Sequence Number=SeqID_155621
atggcggtgcagcaaatccgtgatcgagtagagatagagtgcctagagggagcttggaagaccctcgaaggcaacacgag

SEQ ID NO: 63937 - DNA, 352 bp, Glycine max
  Peptide Sequence Number=SeqID_155622
atgactagaggcaatccatctgacttacaaccctttgatcctgagatagataggacatttcatagattagttagacatcattttgtaccttttgagcatcctaagcattctattattggtgagtttgagcattttgtggtttataattttgaacatcctgactttgagcattatagctttgaacattctgagaacatggcacaccctccaccccgtgagaggactctaagggaaatggttgcacctgatttcacctatgaaagcttgtgcatccaataccctgatgaggatgtcccatatgttcttaaaattggactgatccatttgcttccaaagtttcatggccttgcag

SEQ ID NO: 63938 - DNA, 940 bp, Glycine max
  Peptide Sequence Number=SeqID_155623
gatccccaagaaagaaggtaaggatgtaactctggtttcttttggtaagatcatgaaagtagcgattcaggctgctgaagatttggctaaagaaggaatttctgtagaggtgatcgaccttagaacaatccgtcctttggattatgatgctattttaaattctgttaagaaaacaaatagactggttattttggaagaagcatggccgtttgcgtctatctcttctgaaattgcatatatggttcagcaaaaagctttcgattatctggatgcaccaatcaagagaattacgactcctgatgctcctgctccatattcagcagctttatttgcagaatggttccctaaacttgaaaaagtgaaagaggagattaaaaatgcgttatttgcgcttttaaaattagctgatatgtcagaagttacagagggtggtcatcattttgacttaaagaaactttcatttgtaggggttattgtgtccctcggaattgtttttggggatattgggacgtcaccattgtacgtaatgaaagcaattgtgaatgcccgaaaagatggtgcggcaatgccattcgatgaatatattgaaggtgcattatcatgtattatctggacattgacccttcaaactactatcaagtatgtaattattgctctaagagcagataataaaggagaggggggaattcttgcactttattcactagtaaagaaactcaagaagaaatggctctatgtggttgccattataggagcagcaacacttgttgcagatagtgtaatcactccttcactaacggttatgtctgctattgaaggtttaaaaatatataatcccgagacaccggtagttctcattaccctggtcatcctgtttgtagtttttgtggtacaacagtttggaacggcttctattgggaaattctttggacccgttatg

SEQ ID NO: 63939 - DNA, 579 bp, Glycine max
  Peptide Sequence Number=SeqID_155624
atggagagaagtatgatagatgctgccagtggtggaacccttggagacatgacccctgttgaagccaggaatttaattgagaagatagcttccaactcccagcaatttagtgccagaaatgatgctattgtcgttagaggagcgcatgaggtagccacgaattcatcttcatcatctgaaactaagaagcttgagggtaaactagatgccttggttaacctgcaatctggagcaattgaacaacctaaagcttatgctgcaaacatctacaatagacctcctcaacttcagcagcaaaataaaccacaacaaaacaattatgacctctccagcaacagatacaatcccagatggaggaatcaccctaatctcagatggtctagccctcaacaacaacaacagcagcctgcttcttccttccaaaatgctgctggtccaagtagagcatatgttcctcctccagtgcaacaacaacaacaacaacatcaactgagacaacaatccactgttgaggccccttctcaaccttcattagaagaattagtgaggcaaatgacaatacagaacatgcagttttag

SEQ ID NO: 63940 - DNA, 300 bp, Glycine max
  Peptide Sequence Number=SeqID_155625
ctcagatggaggtgggcaacaggggatggagggtttatgcgcgctttgtggatgtgaaaaacttgttgtgcaccatcgaccgaaccgccaacctagtaccacctgtgatggagtggtacctggagatatgtcgcgggggtcaggagaccttggggacgtcaggtggggtgctattgcccaaaaccaagcttgaccaatcccgacccaacccgggcatagtcgggaactgggagttgatggaagcctctggtaatcgattaccagcctgtgtaatcgattacacagaggaatgggtcactg

SEQ ID NO: 63941 - DNA, 321 bp, Glycine max
  Peptide Sequence Number=SeqID_155626
atggcaacccaagaagaagaagaagaagaagaatatgatgataaagaggacttctcagtctttgtgaagaagtttcataaattcgtcaaaaatagaagaatggagagacgtcataacttcaacaatgggaagagatctcaagaaggttccccaacacttaaatgctataagtgtaatcaacccggtcacataaatgcacactaccccacaaatgagtcatggcccgagaagaatgagaagaaaagtcatgaagagagaagatccaagaaggcgtatattgcatgggatgacaatgactcatccaatgattcggagaagtag

SEQ ID NO: 63942 - DNA, 906 bp, Glycine max
  Peptide Sequence Number=SeqID_155627
atggagtttgacaatcaccggttccggagtgccgaacaccagcagcgcttcgacaccatcaagggatggtcgttccacagggagaggtgtgtccagcttagggaggacaagtaccctgacttccaggaagagatagctcgcaggcgttgggaacgactagtgacccctatggctaaattcgacctggagatagtcatagaattctatgccaatgcttggcccactgaggagggggttcgggacatgcactcgcgggtgaggggtcactggatcccctttgatgcagatgccctcagccagttcttgggtgacccgctgattttggaggagaaccagcagtgtgagttcagccagaggaggaaccaggcagacggcttcgatgaggaggccatcgcttggctgctgtgcatattggggcaggatttcacccggacccctgcgtggaggcgagtatggatcatgcgcaccagcatgactaccctgacccagatatggatgacattgctgctcagcaatgtcttgcctagtgaccacaactccgacctccctctgcctaagtgccagttggtgtatgccatcctgacacggatgagcgttcacgtggcccaggtaattgctgacgccatttatttgtttgcagggatggcgcctactaggcaccctttggacccggagaagtttaatatggccctggggtttccgactttgatcacgggcctctgccaattctacggtgtgcatgtcgcccccaacaaggtaatccaaccaccgatcacccgcgccttcatcgagaagtactgcacgcctagacaagtgcagggtgacgcacatcaggctgcgagcgcaccgccaccacctcggcaggccaattcggctggaccattgagcgtggagcattatctatag

SEQ ID NO: 63943 - DNA, 135 bp, Glycine max
  Peptide Sequence Number=SeqID_155628
atgagggagtgcgggttctatgtaatgtattggatctcaagaataatcctaggaggtttcaaggataactgggaaacgattttgatgatgtcaagaagaattaagaatttgcttgagaaagggggagagatgtaa

SEQ ID NO: 63944 - DNA, 578 bp, Glycine max
  Peptide Sequence Number=SeqID_155629
ggaactgggagttgatggaagcctctggtaatcgattaccagcctgtgtaatcgattacacagaggaatgggtcactggctgtgtaatcgattaccagagatggaaagccttaaaataccccttttacttgcctgtagtgatcgtgatggcggcgcagctaatccgtgatcgagtagaggtggagtgcctagagggagcttgggagaccctcgaaggcaacacgaggtgccaatttcggggcaccattcgattcacgactacttctttggtgcatccagatgaacctgcacggacgcttcagtgcacgatggagtggatactacccacgcctacgccatatcgtctagtggagcccgtccaagtgatcgaggtaacgtcatccgaggaagaccctgaggaggatcttgaggagctacctcctgagcctgctgtggatgctcttgactttctagagggtgatgaggatccatttcttgaggtgtattctcccgaggaagtcatgtcggcatctgaggcagattctacggaggatggtggtccgggggagatggcgatcagcggaggctcttcatcctag

SEQ ID NO: 63945 - DNA, 505 bp, Glycine max
  Peptide Sequence Number=SeqID_155630
ggtgaaacttcctgcttttattgttgaccacagagtggtacctggagatatgtcgcgggggtcaggagaccttggggacgtcaggtggggtgctattgcccaaaaccaagcttggccaatcccgacccaacccgggcatagtcggtcagtgagaacctgtgatgtacctaaacaggcgagctcctggcagtcaacagataaaaggaacaaagaccacaaagcaaggaggcttaaaaatgaagacaggagggttaagatggtctctggtaatcgatttacccaaagggggtgtaatcgattaccaggctttgaaaacgagattcaggaagccatgaggggcttctcgcagcaggttgtagagacctctggtaatcgattcccagtctgtgtaatcgattacacagaggaatgggtcattggtaatcgattaccagagatgaaaagcctaaagatacccctcttgcttgaatgtaatggttatgagaagcattgtgttgcggcatag

SEQ ID NO: 63946 - DNA, 135 bp, Glycine max
  Peptide Sequence Number=SeqID_155631
atgccgatgttgaatcaattccatccgttcattcacgatttcattgaaaacattatcgatgtcaaagctaacaataattgtggatattgtgcaattgttgccttattaggtatgggtgaggattcatggtcgttg

SEQ ID NO: 63947 - DNA, 664 bp, Glycine max
  Peptide Sequence Number=SeqID_155632
gttgagagccactaaagaggtggaggttgaagctttagaagaaggcgaagaggtacaagccctccgaaaaaagcttgagaaagcccaagcagtcaaggaaaagttcaagtcagcaatcgttaggatccgaaaggagaacgccgaactgagaggcgttaacatagccaccaccaaggccttggagcaagagaccaaaagggcccgcaaggaagaacatggccggaacaagttccgaggggctctgtggggcagtaacagcaaacttaagctccaaagagaggaaagggaccagtcgcgaatagatggcatgattctgaaagacgaattgaagactttcctaaagtcaaaaaggagtttgtctcaacggctaagcgagactgaaacaaacatgttggccatcatcagcaagtacaaagaagaattagatttggccaccgcccacgagcacggggtggcggacgaatatgcccgagtatacgcggaaaaggaggctaggggaagggtgattgactcgttacatctagaagcgacaatgtggatggatcggtttgctcttactttgaatgggagtcaagatcttacccgactactggcaaaggccaaagcaatggcggacgcatactccgcccctgaggaaatccacgggctccttagctattgttag

SEQ ID NO: 63948 - DNA, 903 bp, Glycine max
  Peptide Sequence Number=SeqID_155633
atggcttcaaagaagctctccataaagtggtccaggagggatgcccatggggaaggctccaacgcccccgtggagtttgatagtcaccggttccggagtgtcgagcaccagcagcattttgaggccatcaagggatggtcgttccatagggagaggcgcgtccagctcagagaggatgagtactcggacttccaggaggagatagctcgcaagcattggacacctctagtgactcccatggccaagttcgaccctgagatagtcctagagttttacgctaatgcctggcccacggaggagggagttcgggacatgcgctcgtgggtaaggaggaggaccagcagtgtgagttcagtcagaggagggactaggcctctggctttgacgaggaggccatcgcccagctgttatgcataccggggaagcactttgcccggaccgctgcggggagcaatatcctgcctagcgaccataattctgacctccctctgcctaagtgccagctggtggacgacgcccactaggtaccctttggacccggagaagtccaacagggccctgggatttccggccttgatcacgggcctctgccagttctacagagtacctgtcacccctagcaaacaagtgaccaaccaccacgggcaggtgcagttgcatgagtgcttctaccgtttcagccttagccagcgagggcaacgctccattccttttgtatgccctaccccagagcagtttggggctgaggtcgcgtggcctagagactggcccattgaggagggaactggacccgcaggatccccgggcgaagcggcggaagcccacatggatgaggatatgaccgacctgctcagttacctgggagagggcggagctacacgaccaaggtcgctgcacttgtga

SEQ ID NO: 63949 - DNA, 762 bp, Glycine max
  Peptide Sequence Number=SeqID_155634
atggagagaagtatgatagatgctgccagtggtggagcccttggagacatgactcctgctgaagccagaaatttaattgagaagatggcttccaactcccagcattttagcgccagaaatgatgctatagtcattagaggagtgcatgaggtagctacaaactcagctgcatcatctgaaactaagaagcttgaaggcaaactggatgcattggttaacttggtaacccagctggccttgaaccagaaatttgtacctgtcgtaagggtctgtggtttgtgctcctctgctgaccaccatacagacctttgcccttccatgcagcaacctggagcaattgagcagcccgaagcttatgctgcaaacatttacaatagacctcctcaacctcagcagcaaaatcaaccacaacagaacaattatgacctctccagcaacaaatacaaccctggatggaggaatcaccctaatctcagatggtctagccctcagcaacaacaacagcagcctgctccttccttccaaaatgttgttggcccaagcagaccatacattcctccaccaatccaacaacaacaacagccccagaaacagccaacagttgaggctcctccgcaaccttccctcgaagaacttgtgaggcaaaatgaccatgcagaacatgcagtttcaacaagagaccagagcctccatttagagcttaaccaatcagatgggacaattggctacacaattaaatcaacaacagtcccagaattctga

SEQ ID NO: 63950 - DNA, 699 bp, Glycine max
  Peptide Sequence Number=SeqID_155635
atggagagaagtatgatagatgcttccagtggtggagcccttggagacatgacccctgctaaagccagaaatttaattgagatgatggcttcaaactcccagcaatttagtgccaaaagtgatgctattgtcattagaggagtgcatgaagtagccacaaattcatcttcatcagccgagactaagaagcttgaaggtaaactagatgccttggttaacctggtaacccaactggtcgtgattcaaaaatctgcacctatcgccagactctgtggtttatgctcctctgttgaccaccacacaggcctttgcccttctgtgcaacaatctgaagcaattgaacaggctgaagcttatgctgcaaacatctacaatagaccttctcaacctcagcaacaaaatcagccacaacagaataattatgacctctccaacaacaggtacaatcccgggtggaggaatcatcccaaccttagatggttgaatccttcacaacagcagcaacaacaaccttattttcaaaatgctgctggcccaagcagaccatacgttcctccaccaatccagttgcaacaacagcaacagccccagaaacaacaaacagttgaggcccctctgcaaccttcccttgaagaacttgtgaggcaaatcactatgcaaaacatgcagtttcaacaagagaccagagccttcatttag

SEQ ID NO: 63951 - DNA, 258 bp, Glycine max
  Peptide Sequence Number=SeqID_155636
atgagaaatgctcttgggaacggaagcttcgtgcatactccagacatcgtctccaagatcccaacggtcagatcgtggacaaggaataatcaatatgaaaatacaggaaaagtgatcaagggggttcccatgaaccctaaaaagaataaaggtgttgaggaaaggagcccagagtatgaagaacctcaagatttgaggtcaaatcctttccaaggtggagggaatgatgcaatcctaccccgcaagggcattggatag

SEQ ID NO: 63952 - DNA, 348 bp, Glycine max
  Peptide Sequence Number=SeqID_155637
atggaggtgggcaacaggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggaagtcaacagataaaaggaacaaagaccacaaagcaagggggcttgtggtggctggccagctgtgaattttgtgtgatatatgattatggcctctggcttgaaaacgaggtcaggaagctaaggaagcctctggtaatcgattaccaagggaggaataggtcactggtaatcgattaccag

SEQ ID NO: 63953 - DNA, 105 bp, Glycine max
  Peptide Sequence Number=SeqID_155638
atgaaaggtcagattagggtttcttctctaccgaaaccgcaagccaagatggaagattccgcttcggttgaagggttcctctcgaaagtgcttggaactttataa

SEQ ID NO: 63954 - DNA, 183 bp, Glycine max
  Peptide Sequence Number=SeqID_155639
atgccaaaagatagggggacttgtcttgatttcagggattgtcatcatcaaaaagggggagattgtagacaaaggatcaagctgaatgttttgatgatgccaaaggatcacatgcttctcaaagctttattcaagacaaagaaattaaagatattcaagatggatgatcaagacagtctctag

SEQ ID NO: 63955 - DNA, 180 bp, Glycine max
  Peptide Sequence Number=SeqID_155640
atggtccatgacatctttgtcaaggtgaaactagaagtaacaaggacatcaacaatcctaaatgtgtttggcagtagacgaagcagtgataggaaaatgcaaggatcatgcatgagcaaacgtgaaaacaaaaggtatgcagtttgtagaacaaaaagtatgttgaatgcatatgcatga

SEQ ID NO: 63956 - DNA, 432 bp, Glycine max
  Peptide Sequence Number=SeqID_155641
atggtacatgagtccttctccattagagggtttagcacacctttttggaaatggccccgaggaaactcacctcaaagagatccaggaaggataaggcggccgaatggaactagttccgctcccgagtatgatagtcaccattttaggagtgttgaacaccagcagcgcttcgaggccatcaaaggatggtcatttctccgggagcgacgcgtccagctcagggacgacgagtatactgatttccaggaagagataagtcgccggcggtgggcatcactggttacccccatggccaagttcgatccagaaatagtcctcgaattttatgccaatgcttggccaacagaggagggcgtgcgtgatatggggtcctgggtgaggggtcagtggatcccgtttgatgcaggtgctatcggccagctcctgggataa

SEQ ID NO: 63957 - DNA, 186 bp, Glycine max
  Peptide Sequence Number=SeqID_155642
atgaggtggtggcggtgtgcctgttgcccgttgtcagccatccccaagctactgtggtgtctcgccctgcgcctgcctgggggtgcagtacttcttgatgaaagcccggttaatagggggcctaatgaccttgttggggctgaagggcgcttcgtagaactgacaaaggcccgtaatcagagctag

SEQ ID NO: 63958 - DNA, 531 bp, Glycine max
  Peptide Sequence Number=SeqID_155643
atgaatcagaaatctgcacctgttgcaagagtttgtggtttatgttcttctgcagatcaccatacaggtctttgtccttctttgcagcaatctggagtcaatgagcaacatgaagcttatgctgcaaacatttataatagaccccctcagcagcaaaaccaacaacaccagaataattatgatctttcaagcaacagatacaatccaggttggagaaatcatccaaatctgacatgggcaagtcctccacaacaacaacagcctatccctcctttccagaatgttgctggtccaagcaagccatatgttccttctccaatacagcagcagcagtcacaacaaagacaacaagcagctgaggccccttctcaaccttccttagaggagttagtaaggcaaatgaccatccagaatatgcaatttcagcaagagacaagagcctccattcagagtgtgacaaatcaaatggggcagatggctactcagttgaaccaagctcagtaccaaaattctgacaaaattccttcatag

SEQ ID NO: 63959 - DNA, 554 bp, Glycine max
  Peptide Sequence Number=SeqID_155644
atggaggtgatcggtcagctccagcggcaagcttttcgcaaagctgacggtaaaatctgggacctagccatggtagaagtctccacagaggccattgcctcccttgcccagtattatgataagccgttgaggtgcttcacctttggggacttccagctatcacccatggtagaagaatttgaagagatcctaggatgtcctctagggggaaggagaccatacttcttctcagggttctatccctcattagctagaatttctaagatagtccaaatctcggcgcaggaattagaccacagaaagcaagttgaaaatggggtggttggaataccgagaaaatatttgaaggcaaaagcaagaatcttggcaggtaaaggcaaatgggccccgttcatagacattctcacactattgatcttcagaggagtgctctttctgaacgtggataggttggtggacctagcagcgatcgacgcttttctcgcctatcatgaccacaaggaaagcccggttgtcgctatgctagccaacctatatgacaccttcgaccgaag

SEQ ID NO: 63960 - DNA, 279 bp, Glycine max
  Peptide Sequence Number=SeqID_155645
atggggatcgcacccacaaagatacccagtggacctgaagaagtccaacatggccctggggtttcccaatctggttacgggcctctgtcggccctacagggcgcccgttcccccccagcaagttcatgtcgtcgtggcatagggatcgtgcccgcaagacacctagtggacccgaagaaggccaatagggtcttggagttgcaagctctaattacgggtctcagtcagttctacggagtacctgtcacctccagcaatggcatcaggcccccctactaa

SEQ ID NO: 63961 - DNA, 315 bp, Glycine max
  Peptide Sequence Number=SeqID_155646
cttgggaggattgatggggatccggtgttgagagaaacgaggatatgggctacatgggagtacgtgaactcagttggaggtgggcaacaggggatgggtgaacttcctgcttttattgttgaccacaaagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctagggaagcctctggtaatcgattaccagcctgtgtaa

SEQ ID NO: 63962 - DNA, 54 bp, Glycine max
  Peptide Sequence Number=SeqID_155647
atggccgaccagcaggctaccaaatccaaagccaaaggtagcaagataccttag

SEQ ID NO: 63963 - DNA, 273 bp, Glycine max
  Peptide Sequence Number=SeqID_155648
atgttgctaagtagcaacgtcatccatatctgtgtaagagtggtcatgttggtgcggatgatccgcactcgtctctttgcagcggcacgggtgaaatcttgcctcggtatgcatagtagctgcgtgatagcctccctctctggttgtattcgcacagttggcgccttccaatatcagggggtggctcaggaaaaagaactgataaagggaaactactggccccttaactgggagcgcaagtctcggttaagcattaagggtagaggaccttaa

SEQ ID NO: 63964 - DNA, 875 bp, Glycine max
  Peptide Sequence Number=SeqID_155649
atggctacctcaccaaaagagacttcagctcctggttcaccctctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccagatgttgctgttcctgaagctgatgaagatgtcccaacatcttccaccccgaatgtttctgtgcctgatgttgagaaagatgttccaacatcctccactccaaatgctgaagtccttccttcacccagtgaagaggaatcaacagaagaagaggatcaagcctcagaggagacccctgcaccaagggcaccagaacctgctccaggtgacctcattgacctagaagaagttgaatctgatgaggaacccattgccaacaggttggcacctggcattgcagaaaggttacaaagcagaaaagggaagacccccattaagaggtctggacgaatcaaaactatggcccagaagaagagcactccaatcactcctaccacattcagaaggagcaaggttgcaatcccttccaagaagaggaaagaaatttcctcatctgattctgatgatgatgtcgaactagatgtctcgacatcaaagagggccaagaaatcagggaaaaaggtgcctgaaaatgtccctgatgcaccattggacaacatctcattccactccattggaaatgttgaaag

SEQ ID NO: 63965 - DNA, 390 bp, Glycine max
  Peptide Sequence Number=SeqID_155650
atgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggaatgcaattacagaacatttgcaaaaagggggacggatctttcaaagaacacgcccaaaaggtggagggatctggcggcccaggtggtacccccaatgatggaaagggagacgatgatcgtgatggtagacacattatcgatactctactatga

SEQ ID NO: 63966 - DNA, 198 bp, Glycine max
  Peptide Sequence Number=SeqID_155651
atggatggacaggcaaaagttgagtatgtgaaaagattgtatgaccaagcgaagaccaagtggagaaggatgaaggcccaagtggagaaggacaaagcccctgagtggagatggatgaaggcccaagtggagaaggatgaaggcctagaggcagagacactaccaagactattaattgttgctgaaggcccagattaa

SEQ ID NO: 63967 - DNA, 359 bp, Glycine max
  Peptide Sequence Number=SeqID_155652
atggcagaagctggtgatggtggtggtgattatcatcaattggacagatctcagcgcttattactagatgtgatgactacacaaatgcaacaattgttgaactgtaacaatgaagagctctacagacgaataaaaggactagagcaccaaatgaacccaaatgctgagagaccttatggtaggaacagaagggtcaataatggaccgaaccgaatagaagggcaggatagaattgagggagtaaaactcagtgttcccccttttaaaggcaggagtgacccaaacgcctaccttgattgggagatgaagattcaacatgcattctcctacaatgattatcctgaagagcataagatgaa

SEQ ID NO: 63968 - DNA, 654 bp, Glycine max
  Peptide Sequence Number=SeqID_155653
atgggtcaacttcaatggcaagccttccgcaaagcctatggtaagatttgggacctagctagggacttccagctagtgccgactgtgaaagagtttgaagaaatccagggatgcccactgggaggatggaagtcatatcttttctctgggttctatccctccacgacaagagttgccaagcgtgttgacgctttcctcgcctttcatcatggcaaggaaagcccggtcgtcgccattttggccatgtatgacacgttcgaccggggaggtgaaaagagtggcgcaagaattgtttgttgtgcactggctctctatgtgtggctggtttcacacctttttctccaagaaggaaggaagaatcaggattctatcttcatacgaaggatgtctaaatgttcccttgatggaacaaggggttgtattaattataatctcgtcctcgccataagacagcttggctaccccatgagaggagtgccatcagacgaaagcatcacgcccttcatcgcacggggttttagtgaccacaacgcgagggacagagagcttaggggaagcagtaatgggatcatcgacggctatcataagtggctgagagtccggacacaaggattggattggctcccaaatctaaagactgtgagagacgatgag

SEQ ID NO: 63969 - DNA, 351 bp, Glycine max
  Peptide Sequence Number=SeqID_155654
atgaatccttctttccttaacaagggaagtccaccaataaagggcatacccttgaaagctaaaggtagccaaaggaaccttccttttctcacttgtatggtgacaaactgtcgcaacgtgcccttcgcgggcgagcgagggcgaggctcacgggtgcgattttcaaaggaggaaagatgcgcggagttgccaccaacgtttatttgtggaaaacgtcggaaaaaccgaaggaaatcggtcaaaataaaaattctaagttcgggagttgtatttacgtttgagaaaggtcgacaaaagcgagacttttgctcctacgtaccctcatttggagaggaaatcagacctgcgtaa

SEQ ID NO: 63970 - DNA, 279 bp, Glycine max
  Peptide Sequence Number=SeqID_155655
atggcttcaaggaaaagaaaggcaccctctacacttacccaagccagatttgatagatccagattcacttcccaagaggcttatgagagatacactgacattgtggtgcctcgcaagcttttaccagagaggaatgtggtagtttactatacagagtttgatgagctcaaggaggaactcgagagacgccatttggatgaggagttgactgactttgtggacaacaatattgatgttgccattgtaaaagaattctatgcaaacctctatgacccctag

SEQ ID NO: 63971 - DNA, 723 bp, Glycine max
  Peptide Sequence Number=SeqID_155656
atgtttgccttcgcagaaaatggccccgaggaacttgcctcaaagaggtccagtaaggataaggcggccgaaggaactagttccgctcctgagtatgacagtcaccgctttaggagcgttgtacaccagcagcgcttcgaggccatcaagggatggtcgtttctccgggagcgacacgtccagctcagggacgacgagtatactgatttccaggaggaaatagggcgccggcggtggacatcactggttactcccatggccaagttcgatccagaaatagtccttgagttttatgccaatgcttggccaacagaggagggcgtgcgtgacatgagatcctgggtaaggggtcagtggatcccgtttgatgccgacgctatcagccagctcctgggatatccgttggtgttggaagagggccaggaatgcgagtatggccagaggaggaaccggtctgatgggttcgatgaggaggccatcgcccagctgctatgtataccggggcaggattttgcccggacagctgcagggaggcgagtgcgaatcatgcgcaccaacatgaccaccctgacccagatatggatgacgttgctgctcagcaacatcctgcccagcgaccataattccgacctccccctgccgaagtgtcagctggtatggcgcctaccaggcaccctttggacccagataagtccaacagggccctgggatttccctcgctga

SEQ ID NO: 63972 - DNA, 162 bp, Glycine max
  Peptide Sequence Number=SeqID_155657
atgacaaaaagatcaaagatgttcaagattgaatcaagaacacttcaaggttcaagaggaaatttgatttcaagaatcaagaatcaagattcaaggttcaagcttccaagaatcaagatcaagattcaagactcaagattcaagaatcaagagaagacttaa

SEQ ID NO: 63973 - DNA, 78 bp, Glycine max
  Peptide Sequence Number=SeqID_155658
gcttacgtggaatcaacgagcaaggacgaaaaggaatcttcaagtgacgcgatgagaaatccacggggtagctcatga

SEQ ID NO: 63974 - DNA, 960 bp, Glycine max
  Peptide Sequence Number=SeqID_155659
ttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggtgcaagaattgtttgttgtgcactggctctctatgtgtggctggtttcacacctttttctccaagaaggtaggcccgtctatccgctacaaggaaggaagaatcaggattctatcttcatgcgaaggatgtccaaatgttcccttgatggaacaaggggttgtattaattataatcccatcctcgccataagacagcttggctaccccatgagaggagtgccatcagacgaaagcatcacgcctttcatcgcacggggtttcagtgaccccaatgcgagggacagagagcttaggggaagcagtaatgggatcattggcggctatcataagtggctgagagtccgaacacaaggattggattggctcccaaatctaaagactgtgagagacgatgaggttaaagcttcggaagaaagtgatgaggtacaagccctaaggcaaagcttgaaagagcccggggcagcaatagtgggctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtgatcgactctttacaccaagaggcaaccatgtggatggatcggtttgctcttaccttgaacgggagtcaagaacttccccgattgttagccaaggccaaggcgatggcagacacctactccgcccccgaagagattcacgggcttctcggctatt

SEQ ID NO: 63975 - DNA, 201 bp, Glycine max
  misc_feature (189)..(189): n is a, c, g, or t
  Peptide Sequence Number=SeqID_155660
atggcctttggtaatcgattaccaagggtgggcttcaaagggaactggagcactgtggaggcctctggtaatcgattaccagtctgtgtaatcgattacacagaggaatgggtcactggtaatcgattaccaggttttcctatcctgaagctgtgtgattcgagtttggcctctagtaatcgattaccnaaggctgtgtaa

SEQ ID NO: 63976 - DNA, 224 bp, Glycine max
  Peptide Sequence Number=SeqID_155661
gccatcgcttagccgaattcagatcaaatttgatgcaatcctactccgcaagggcattgggtagaagactccaagtagattgggctagagatccaaggaaaggccttagggttctcatgagccttagggtgagcttagctattagagagcttctcaaggaagttttctcaaagaagcttctcaaggaagttttctcaagaaagcttctcaaggaagctacctag

SEQ ID NO: 63977 - DNA, 563 bp, Glycine max
  Peptide Sequence Number=SeqID_155662
atgggctacgtgggagtacgtgagctcagttggaggtgggcaacaggggatggtgggtttatgcgcgatttgtggatgtggaaaaacttgttgtgcaccatcgcccgaccgccacctagtaccacatgtgatggagtggtacctggagatatttcgcgggggtcaggagaccttggggacgtcaggcgagctcctggcagtcaacagataaagggaactaagaccacaaagccaaggaagcttatgtggtggctgggcagctgtgaatcttgtgtgatatatgggttatggcctctggtaatcgattaccaagggtgggaagctaggggagcttctggtaatcgattaccaggggatgtaatcgattaccaggcttcaaaagggaactggaagactgtggaggcctctggtaatcgattaccagtctatgtaattgattacacagaggaatgggtcactgagatgaaaagcctaaagatcgtgatggcagcgcagctaatccatgatcgagtggagatggagtgcctagagggagcttgggagaccctcgaaggcaacgcgag

SEQ ID NO: 63978 - DNA, 330 bp, Glycine max
  Peptide Sequence Number=SeqID_155663
atgttgctaagtagcaatgtcatctatatctgtgtaagagtggtcatgttggtgcgcatgatccgcactcgtctctttgcagcggcacgggtgaaatcttgccccggtatgcatagtagccgtgtgatagcctccctctctggttgtgctcgcatagttggccctcctccaatatcagggggtgccccaggaaccgttaaaaggaaactactgaggaccttaaactctcttaaggtgcggatgtggagcacactgaaaatgaggacacgtagccctctaaaggtgagggcgtggagccctctcaaggcgaggatgtgtagtcctctgttg

SEQ ID NO: 63979 - DNA, 357 bp, Glycine max
  Peptide Sequence Number=SeqID_155664
tccatgatgattggaggtggaattacctggatgttttggaagcttgggaggattgatggggacccgacgttgagaggaacgaggataagggctacgtgggagtacgtgagctcagttggaggtgagcaacaggggatggtgggttatacagtggtacctagagatatgtcacgggggttaggagaccttggggacgtcaggcgagctcctagcagtcaacagataaaaggaactaagaccacaaagcaaggaggcttgtgtggtggctggccagctgaagctaagatggtctttggtaatcgattaccaagggagtgtaatcgattactaggcttgaaaacgaggtcaggaagctag

SEQ ID NO: 63980 - DNA, 213 bp, Glycine max
  Peptide Sequence Number=SeqID_155665
atggcacgcaacccgaggcaggattttagcgtttcaaagctccacacaaagcttcaacctttggccatcattttgccccaaatcgtgaaaggagagcattttcggggtcgtgaagtgcgtggctacgagtgggacttcgaaatttcaggtttgggtggacttctttccctcttgattttcgtgggtatggggtttgggagatatgatgggtag

SEQ ID NO: 63981 - DNA, 264 bp, Glycine max
  Peptide Sequence Number=SeqID_155666
atgagggtgcaaatagcaaccaggcccacttgggccctccagaaggctgttgcttctggaggaagcaaccctgctcgcctaggcgagctgggcggcaaccatctcccctattttgctataaataggggaggaagtgaagaagaaaaggctgaggcgcttccaaaacgtttccgtaacgtttccgtgaggaatttcgcaaaggtttcgaccgttcttcgacgttcttcattcgttcttcatcgttcttcgatcttcaacgagtaa

SEQ ID NO: 63982 - DNA, 198 bp, Glycine max
  Peptide Sequence Number=SeqID_155667
atgaacgaaaccaccaacctgacaaaaagcgcgaaccctcacaatcacgagaatgcaggggagggaagagcaaaccgcaaacagttaaaaaaccctacaagcaggactaaattgcctattcactccaaggattaccttgataagtcagagattggttcaacaaggaacccagagagaagctctcaccaaattttatga

SEQ ID NO: 63983 - DNA, 558 bp, Glycine max
  Peptide Sequence Number=SeqID_155668
atgggtcactggtttcatgtcctgaggctatgtaattcgagtttagcctctggtaatcgattaccaaggctgtgtaatcgattaccagagatcaaaagcctaaggatatcccttttacttatcgtgatggcggcgcagctaatccatgatcgagtagagatggagtgcctagagggagcttgggagaccctcgaaggcaacacgaggtgccgatttcggggcactattcgatttacggccacttcattggtgcatctagatgaacccgtgcgcacgcttcagcgtactatggagtggatactacccacgcctacaccataccgtctagtggagccagtccaagtgatcgaggcgacgtcatccgaggaagaccctgaggaggatcccgaggagctacctcctgagcctgctgtggatgctcttgactttctagagggtgatgaggacccacttcctgaggtggattctcccgaggaagtcatgtcggcatctgaggcagactctacggaggatagtggcccgggggagatggcgatcagcagaggctcttcatcctag

SEQ ID NO: 63984 - DNA, 105 bp, Glycine max
  Peptide Sequence Number=SeqID_155669
atgtctcagcatctctattatatagttgtggattcttgctttgaaaggattgacgagggtccacaaactaaatccaaggctgctactaggttgattgttgttaaa

SEQ ID NO: 63985 - DNA, 882 bp, Glycine max
  Peptide Sequence Number=SeqID_155670
atgcggtcatgggtaaggggccagtggattccttttgatgcagacgccctcagccagttcctgggagacccgctagtgttagaggagggccaagagtgcgagtatagtcagagaaggaaccgggccgatggatttgacgaggaggccattgcccagctgttatgcataccgggtcaggattttgcccggaccgctgccgggagatgggtgcggatcatgcgcaccggcatgactaccttgacccagacgtggatgacgttgctgctcagcaacatcctacccagcaatcataactctgacctccctctgccgaagtgtcagctggtgtatgccatcctgacacggatgagcgtccatgtggctcagttgatcgctgacgccatttatttatttgcagtcacacctagcaaggtgattcgaccgccgatcacccgggccttcattgagaagtattgcacgcctagacaggcgcagggtgatgatgcaccgcaggccgctgacgcaccgccaccacctcatcaggctgatccagctgggtcattcggcatggagcggtatttccagcacttggttcgccagcaggcggccaaccacagggggcaggtgcagatccatgagtgtctctaccagctcagcctcagtcagcagagccagggtttcgctccttttgcatgccctactccagatcagtttagggctgaggtcgcatggcccggagattggcccgaggaccagacagaggaggcacttgcaggagctcccgacggtgcagaggatgcccgcatggatgaggagatgactcgatttcttgggaggaagcggagccacgtgaccgaggtcaccgcattttttgacatatctgttttttttcgttttgtttag

SEQ ID NO: 63986 - DNA, 306 bp, Glycine max
  Peptide Sequence Number=SeqID_155671
atgcgagaggaacccgcatgcacgcttcaacgaactgtggagtggatattacctacacctactccatatcgactagtggagccagtccaagtgatagaggtgtcatcatctaaagaagaccctgaggaggacccagaggagttacctcctgagcctgttgtggatgctcttgactttcccgagggtgatgaggacgcactccctaatgtggattctccaaaggacgtcatgtcagcatttgaggcagactctatggaggagagtggccctagagggatagcgactagtggagactcttcatcatag

SEQ ID NO: 63987 - DNA, 138 bp, Glycine max
  Peptide Sequence Number=SeqID_155672
atggaggagaacgtaaagctgaaagttaatggagggaataagccatggaatgaagagcttcaccaccaagagagtgccttggataagaagcttagagagaaagcttcaatggaggaaaagaatgagagaggggcatga

SEQ ID NO: 63988 - DNA, 519 bp, Glycine max
  Peptide Sequence Number=SeqID_155673
atgccatatgtggaagccgtggaggagtccttagagacatcctttcaagctttggaagtggtaagcaacgcttatgtcgagtcttccccggtgcaaccgtgctcatccgatgccgctttgatggtagctcgtgtgatgttaaggcatgggtacgagcccaaaaggggtttgggtcgaaacggaaatggcgtggtgagcttggtagtgttcaaagggaaccacggaaggttcgagctaggatataagactacacgtgccgacgtgagaagaagtgccctagaaaggaggggtagaagcatgggccagctgcatggaccacaagtgaaagggatttccttatgtcacatcagcgaaagcttcatcagcgtgggctggatgtgtgaagggtgggtcgccatgatccacgatgaagtccctcaagagcaatcaaattgggtacgaccgtgtcccccagagtttgagttagggaactggcaaattgtcgagcaacctggaattttcgtggcgaacataatgtaa

SEQ ID NO: 63989 - DNA, 366 bp, Glycine max
  Peptide Sequence Number=SeqID_155674
caatctggagcaattgaacagcctgaagcttatgctgcaaacatctacaatagacctcctcaacctcaacagcaaaatcaaccacaacagaacaattatgacctctccagcaacaaatacaatcccgaatggaggaatcaccctaatctcagatggtctagccctcggccacaacaacagcagcctgctccttccttccaaaatgctactggtccaagtagaccatacgttcctcctccagtgcaacaacaacaacagcaacagcagcatcaacagagacaacaatccactactaaggcccctcctcaaccttcattggaagaattagttaggcaaatgacaatacagaacatgcagtttcagtag

SEQ ID NO: 63990 - DNA, 345 bp, Glycine max
  Peptide Sequence Number=SeqID_155675
atggataacgaagatggagtgcaagaacagatgaaggctgacctatcggccttaaaagatcagatggcttatatcatggaggccatgctaaagattcaaaaaactatagaagataatgctacggcggccgcttccactacaattagggaagcggaaccggtgctacagcctgcaataaacttaggccaagacagaaacacgatagttttcaatcggaggtatagtcctcaagcctacccttatggtttgtctccggacttcactccccgttcccctccagacgatttgagccaagcccctaccttcgaggggcagctccctcctcatgccgactatcctctgtaa

SEQ ID NO: 63991 - DNA, 369 bp, Glycine max
  Peptide Sequence Number=SeqID_155676
atgtcgcgggggtcaggagaccttggggatgtcaggtggggtgctattgcccaaaaccaagcttggccaatcccgacccaacccgagcatagtcagtcaatgagaacctatgatgtacctaaacaggcgagctcctggcagtcaaccaataaaagaacaaagtccacgaagcaaggaggcttgtgtggcggctggctagctatgtatcttgggtggtatctgaaaattagcctctgggcactggtaatcgattaccagttgtgtgtaattgattacatagtgctacctgctactggtaatcgattaccatttatgtgtaatcgattacacagtgtaacttgtagattccaatgtgcaaaggctgagtaa

SEQ ID NO: 63992 - DNA, 336 bp, Glycine max
  Peptide Sequence Number=SeqID_155677
atgtggatggataggttcgcccttgaccttgaatggaagtcaagacctcccgcgtctattagccaaagcaaaagccatggccgaagtgtgaatttcatcataactaagaaagcacaaaagcacccctataacactcgatccagaaaaatggataacgaagagggcgtgcaggaacagatgaaggccgatctatcggccttaaaagatcaaatggcttccatctcggaggtcatgctaaaacttcagaaaactatagaggataaagccacggcaaccgcctccaatacagctagggaagcggagccgatgctacagcccgccttaaatctgggctga

SEQ ID NO: 63993 - DNA, 234 bp, Glycine max
  Peptide Sequence Number=SeqID_155678
atgtctgaagaagttgatatgaattttgaagatgaacaacattttggtgtgaatgaaggacatgtcgattgttcagacacttttaatacttctcagtgggctcgaacggttgtccatgaaaatggagcggttagtacaagtgtaggaagaaataatttgtttgaagagacactggcactaggaaatgtggttgtcccttcaagattcatgggaaaccagtgcatagaggagaag

SEQ ID NO: 63994 - DNA, 468 bp, Glycine max
  Peptide Sequence Number=SeqID_155679
atgggatgtattaattataatcccatattggccataagacaactaggctaccctatgagaggggtgccatcggaagagattatcgcgcctttcatcgcacaggatttcagtgaaggcaatgcaaaaatgcttcagagagtccgaaaagcgtggaatgcagtggaaagaaaagataagaagcttaaaggaagcggaaatggtgttatcagtggctgtcataaatggttgaaggctcggacgcaagggataacttggatcccgaagctaaagatttcaagtggcaaagaagctgaagtccctaaagagagcaaagaagtgcaagccttgaaagaaaaacttgaaagaacacgagtggtcaaggaaaagttcaagatgacagccaccagggtcaggaaagagtatgacgagctgagggatgtcaacatggccatggccgaagctttggagcgagaaacaaagagagcctga

SEQ ID NO: 63995 - DNA, 421 bp, Glycine max
  Peptide Sequence Number=SeqID_155680
aattttctgccttgccctgttttgcttgactgtgatagcttgtgctgtttgaatgttgttttgcttggatgttgtggtagcttgggaggattgatggggacccggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtggtggctggccagctatgaattttgtgtgatatgtgtagtatggcctctggtaatcgattaccaagggcttgaaaacgaggtcaggaagctagggaagcctctggtaatcgattaccagg

SEQ ID NO: 63996 - DNA, 231 bp, Glycine max
  Peptide Sequence Number=SeqID_155681
atgggctgctctagctccattgctggtagtgatggcatagtgtactcagatataggtgcaagggatggctctggcatgggatctggtgaagtgtcgcaacgtgcccttttgcgggcgagcgaaggcgaggctcacgggtgcgctttccaaaggaggaaaggtgcgcggagtcgccaccaacgtttatttgtggaaaacgtcgaaaaaaccgaaggaaaccggtcaaaatga

SEQ ID NO: 63997 - DNA, 49 bp, Glycine max
  Peptide Sequence Number=SeqID_155682
atggcgtctcctctcacctcttctcctttgtcttccattgcatctcatg

SEQ ID NO: 63998 - DNA, 243 bp, Glycine max
  Peptide Sequence Number=SeqID_155683
atgacggaacacattcttagttttaagagagttgtcgaaagaaaaagaagttgctatcagatcgctattaggagatacgagattacggaatccctcttatcacttgactcggcgaggtatagcccatcagttgatgaagtggtgagctttttggctgtgaatgtgcctccaattctgatggcacattattggaggagttcacagcttgttcgtctgtttccactggagctttacttgtactaa

SEQ ID NO: 63999 - DNA, 582 bp, Glycine max
  Peptide Sequence Number=SeqID_155684
atgggtgatcaagaggagacacaagaacagatgaaagccgacatgtcggctctgaaagaacagatggcttccatgatgaaggccatgttaggaatgaggcagctcatggagaaaaacgtggccaccgctgccgctttcagttcagctgccgaagcagacccaactctcttggcaactgcgcaccatcctccctcaaacatagtaggacggggaagggacacactgcggcacgatggcaaccctcatctgggatacaaccgagcggcttacccttatggattgccgcccaactactcaccacccgtcctgcaagacgatgcgggccatattgcttctcccgtccttgaaagagaacctcctcaacagcccgacgaggtccataaagaccctcaagactatgctcgaagggatgaccgcccccggacaactgaagaaaggaggaagctcgatctcctcgaggagagattgagagccgtggaaggatttggggactatccgttcgcagacatgacggatctttgcttagtacccgatgttgttatcccccccaaagttcaaagtaccggacttcgacaagtataa

SEQ ID NO: 64000 - DNA, 318 bp, Glycine max
  Peptide Sequence Number=SeqID_155685
atgtttccagtcatcaaccaaagtgcccttaaaagagttaatgaacatggtgaggaaagagaggaattaggtggtgctggtgggtcaccagaagtgtcgtggcggcattgtcctgcagcggtggtggtggaggtggagctttttctcttcttagatgattctgccatttggagtattttctgtagattttattcagtgggatttagggatgaagggtgccgtaaaggagagagggaggaagaaggtgctgtgcaaggaaagagaaaaagcagtatttgtaggcatggacgagctgtaatcgattacagctcatggtaa

SEQ ID NO: 64001 - DNA, 262 bp, Glycine max
  Peptide Sequence Number=SeqID_155686
agttttctgcctttgccctgttttgcttggtttgttagtttgtgatgatttggatgttgaattacctggatgttggggaaagcttgggaggattgatggggacccggtgttgagagaaacgaagatatgggctacgtgggagtacgtgagctcagttggaggtgggcaacaggggatggagaccttggggacgtcaggtggggtgctattgcccaaaaccaagcttgaccaatctcgacccaacccgggcatagtcagttag

SEQ ID NO: 64002 - DNA, 153 bp, Glycine max
  Peptide Sequence Number=SeqID_155687
atggaggctctggggcctcaactgttggctgtttctggggttgttgctgttgttggatttggtggaggaatgctgctgttgttgttgctgagggctggaccatctgaggttagggtgattcctccatccagggttgtatctgttgctggaaag

SEQ ID NO: 64003 - DNA, 657 bp, Glycine max
  Peptide Sequence Number=SeqID_155688
atggttagaggaactatatgtggagcaattagacataaattgataccgactcctcagaatttgcaacaggaaattcttttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctg

SEQ ID NO: 64004 - DNA, 270 bp, Glycine max
  Peptide Sequence Number=SeqID_155689
atgttgtggaagcttggatggattgatgcggacccggtgttgagaggaacgaggataagggctacgtgggagtacgtgagctcagttgaaggtgggcaactagggatggtggatttatgtgtgatttgtggatgtggagagtcgacttgcaccattgcccgatcgacacctagtaccacatatgacggagtggtacctggagatatgtcgcgggggtcaggagaccttggggacgtcaggtggggtgctattgcccaaaaccaagcttga

SEQ ID NO: 64005 - DNA, 527 bp, Glycine max
  Peptide Sequence Number=SeqID_155690
ggtgaaacttcctgcttttattgttgaccacagagtggtacctggagatatgtcgcgggggtcaggagaccttggggacgtcaggcgagctcctggcagtcaacagataaaagaaacaaagaccacaaagcaaggaggcttgtggtggctggccagctgtgaattttgtgtgatatgtggattatggcctctggtaatcgattaccaagggcttgaaaaacgaagtcaggaaactatgggagcccctggtaatcgattaccagcctgtgtaatcgattacacagagggatgggtcactggtaatcgattaccagagattgtgatggcggcgcagctaatccgtgatcgagtcgagatggagtgcctagagggagtttgggagaccctcgaaggcaacacgaggtgccgatttcggggcaccattcgattcacggctacttctttggtgcatccagatgaacctgcacggacgcttcagcgcacggtggagtggacagctccttggattagttttgtatactttgagg

SEQ ID NO: 64006 - DNA, 812 bp, Glycine max
  Peptide Sequence Number=SeqID_155691
atggtcttaaaggaggagttagctgcttgctcaagatccaagaagagtttggcccaacacttagaagccacggagcaaagcattctagctataatagggcggtacaaagaagagttaaaccagtctttgacccatgagcaaaagctagtagaggacttcgcacaagcatatgccgagaaggaagcaagagggagggtgattgatgcattgcatcaagaagcgaccatgtggatggataggttcgccttgaccttaaatggaagtcaagacctcccgcgactactagccaaagcaagggccatggccgaaggagtgcaagaacagatgaaggccgacatgtcgactttaaaagatcagatggcttctatcatgaaagccatgctaaaaattcaaaaatcaatagaagacaatgctgcggcggcctcttccaatacaattagggaagcggaaccggtgctacagcccgcattgaacttgggccgggacagaagcgcaacgagtttcaatcggaggtatagtcctcaagcctacccttatggtttgcctctagacttcacttaccgtaccgatccagacgatttgagccaagcccctaccttcgagaggcaactccttcctcatgccaactatcctctgcagaaagatgatgaaggagatgcccatttaggccctctacttcccccaagggaaccgaccccccatgagtttccccaaccaaacataatccgccatgccccgtctcaatccgcacccgttaaggaactcattcccatttcaaaagacaagggaaagatcgatctgcttgaagagag

SEQ ID NO: 64007 - DNA, 288 bp, Glycine max
  Peptide Sequence Number=SeqID_155692
atggagaatgagtcatctgaggccactatcccagagccatttgatatagaagaagaggcagaagaggcacaggtgagacatgtagctgcaaccactcctgagcgatcccttgaggctactttagagccttctacactagtggtaaatctaccctcacctcatcctacagcagaactcttcactcctcttctacagatgccagaggacccaactacaccagtcctaactgtggacacttctcctcccgctactccagtgcttcaattgacagatgaggaggatggttag

SEQ ID NO: 64008 - DNA, 343 bp, Glycine max
  Peptide Sequence Number=SeqID_155693
atggtggggtacacaccttcaagttttacagatttggtcttcgccagtgaaaggatcgatgtgggtccgaaaagaggcaaatttgatcatcctactaggacgactgagaaagctggggcaaatgaagaggcgagaaagcctgtagaattcaccccaattccagtgtcctatgctgacttgctcccatatctacttgataattcaatggtagccataaccctagccaaggttcatcaacctccatttctcggagaatacgactcgaacgcaatgtgtgcttgtcacggagaagccccggggcgttccattgagcattgtagggctctgaagcgtaaggtgcaag

SEQ ID NO: 64009 - DNA, 444 bp, Glycine max
  Peptide Sequence Number=SeqID_155694
atgtcgggatttacatgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttgggactttgtggttgatttagggatggcctttgtggataactgggtggtgggtcacagcatgggtttctccctctttctcaccctcttcatttgccccagttttctcagtcgtcctagtaggatgatcaaatttgcctcttttcggacccacatcgatcctttcactggcgaagaccaaatccgcaaagctttgagg

SEQ ID NO: 64010 - DNA, 183 bp, Glycine max
  Peptide Sequence Number=SeqID_155695
atgtcaggaaaagctataagagaaatcttagttaggtggttggatgaccttaggcagaacaacaaggaggaggtgaagcaaaagctaaggagaatgaaacccgagacgtcgctgaagatcaaggaggaggtgaaaaagaagttcgacattgatttcttggcggtggctcgataccccgagtga

SEQ ID NO: 64011 - DNA, 318 bp, Glycine max
  Peptide Sequence Number=SeqID_155696
atggattgcctagagggagcttgggagaccctcgaaggcaacgtgaggtgccgatttcggggcacgattcgattcacggctacttcgttggtgcatccagatgaatcggcgtgtacgcttcagcgcactgtggagtggatactacccacgcctacaccatatcgtctagtggagccagtccaagtgatcgaggtaacgtcatccgaggaagacccaaaggaggatctcgaggagctacctcccgagcctgctgtggatgctcttgactttctagagggtgatgaggacccacttcctgaggtggattctcccgaggaa

SEQ ID NO: 64012 - DNA, 70 bp, Glycine max
  Peptide Sequence Number=SeqID_155697
cgtctctattctcttcttcaagacatttaaatctgtatctatgttggtgaatgtccctgttgattattga

SEQ ID NO: 64013 - DNA, 153 bp, Glycine max
  Peptide Sequence Number=SeqID_155698
atgactaatttcttgggtcttaataaggtgggtcttggcataaaatggatgaatgggatggtaaaaacgaacaaggttgaagatgaaatggtggaaggaaagaatcattctttccagcgagggcaacacacaaaggatgtgaaagacctttga

SEQ ID NO: 64014 - DNA, 545 bp, Glycine max
  Peptide Sequence Number=SeqID_155699
atgggtcagctccaacgacaagcttttcgtaaagcttacggtaaaatctgggacctagccatggtagaagtctccacagaggccattgcctccctcgcccaatattatgatcagtcattaaggtgcttcacctttggggacttccagctatcacccatggtagaagaatttgaagagatcctaggatgtcctctagggggaaagagaccatacctcttctcaaggttctatctctcattagctagaatttctaagatagtccaaatctcggcgcaggaattagaccacagaaagcaagtcgaaaatggggtggttggaataccaagaaaatatttggaggcaaaagcgagaatcttggcaggcaaaggagaatgggccccgttcatagacattctcacaccattgatctttggaggagtcctctttccaaatgtggatgagttggtggacctagcagcaatcaatgcttttctcgcctatgataaccacaaggaaagcccggttgtcgctatgctagccgacctatatgacaccttcgaccgaag

SEQ ID NO: 64015 - DNA, 389 bp, Glycine max
  Peptide Sequence Number=SeqID_155700
gaagcttgggaggattgatggggacccggtgttgagagaaacgaggatatgggctacgtggaagtacgtgagctcagttggaggtgggcaacaggggatggtgggtttatgcacgctttgtggatgtggaaacttgttgtgcaccatcgcccgaccgccacctagtaccacattggtacctggagatatgtcgcgggggtcaggagaccttggggacgtcaggcgagctcctggcagtcaacagataaaaggaactaagaccataaagcaaggaggcttgtgtggtggctggcaaactgtgaatcttgttgtggaggcctctggtaatcgattaccagtctgtgtaattgattacacagaggaatgggtcactggtaatcgattaccag

SEQ ID NO: 64016 - DNA, 375 bp, Glycine max
  Peptide Sequence Number=SeqID_155701
ggcaatggcttgcacccaattccggggaaagttgaaaatcctggtgagtcattagagacatctgacagcagctttcaaaattgccccattgctcaatggaatgccccagggctcctccacgatatgcacatggttgcgttcgagtggtatcctcagaaaactggggatttgagggaacctagcaggggctttgtggttgatttagggatggcctttgtggataactgggcggtgggtaaggaggtttgttattggctgagtaatgacattgttgggtttggtgggaaacttggccgtataggaatggcagtcacagcatgggtttctccctctttctcaccctcttcatttgccccagttttctcagtcgtccta

SEQ ID NO: 64017 - DNA, 255 bp, Glycine max
  Peptide Sequence Number=SeqID_155702
atgcaagacaaaattgattgcaataacataaatgagataagggaagagagaaatgcaaactcgatttatactggttcggccatgtctcgtgcctacatccaatcctcaagcaacccacttgagattttccactatctctgtaaatcctttacagactttgaatacaccttaggatccttgacccttgtgttcaaagattctccaagagataacctgtctcttgattacaattctcacaattcaagagacaactag

SEQ ID NO: 64018 - DNA, 132 bp, Glycine max
  Peptide Sequence Number=SeqID_155703
atgagcaagaggctccaagaagattgggctagagctgttgaagaaggccctagggttctcatgaaccttagggtagggtaccctagaaatataggatttttcagcccttgtatttttgggcacctagactag

SEQ ID NO: 64019 - DNA, 258 bp, Glycine max
  Peptide Sequence Number=SeqID_155704
gcaagggatatggtgaatcaagaggagtgggtcccgtttatggacgtattagcattgctaatctttggggttgtcctatttccaaatgtagacggtttggtggacctagctgcaattgatgctttccttgcatatcaccatagcaaagagaactcggggggcggaaaggagggaagttctcttctcatgtgggggactaccccaaacatcccgtacatagggtcataccctaatttcgtccgggggacctttgcttga

SEQ ID NO: 64020 - DNA, 429 bp, Glycine max
  Peptide Sequence Number=SeqID_155705
atggacagaggcatgacactaactgatgctcctagatctagcatgacattctcaaatttattgttcctaataatgcaaggtgggaatggaagagggataggaggctgtgactctgaatggaggctcttgtctcttactgaaattgcatattctggatggtcatttgcctcactaactcttctaaggaaggttgaggaggagcctcagttgcttgttatctttgttgtgactgctgttgttgctgctgctgtattggaggaggaacatatggcttggttggaccagcaacattctgaaaaggagggacaagctattgttgttatggaggacttgtccatctcagatttggatgattcctccaacctggattgtatctattgcttgaaaggtcattattattctgctgttgttggttttgctgctgaggag

SEQ ID NO: 64021 - DNA, 174 bp, Glycine max
  Peptide Sequence Number=SeqID_155706
atggaggttaaacttgggaggattgatggggacccggtgttgagagaaacgaggatatgggatacgtgggagtacgtgagctcagatggaggtgggcaacaggggatggtgggtttatgcgcgctttgtggatgtggaaaacttgttgtgcaccatcgcccgaccgccacctag

SEQ ID NO: 64022 - DNA, 213 bp, Glycine max
  Peptide Sequence Number=SeqID_155707
atgatgacaaaagagatgacaaaaagctcaaagatcaatcaaagaacaactcaagtgaatcaaagatcaatcaagaacaattcaagagttcaaaataagaatcaaggctcaagaagaaagtttcgagtcaagaatcaagattcaaggctcaagatctcaagaatcaagatcaagattcacgactcaagattcaaaaatcaagagaaggcttaa

SEQ ID NO: 64023 - DNA, 423 bp, Glycine max
  Peptide Sequence Number=SeqID_155708
atgagtcatcattcatctagtgttaatggtgagggtactagtcataaggaccctctatctagaatattagatgagttaatttgcctcaagttatggaaagaaaaactagaaagaaaagaaaaaggaaaagagaaggtagaaataagtcaagatgagagggaacaaataagggaagaagaaagaacgaaaatactaaaagaaagacataggtcacatcctagacctcactcccataggagagaaaaggaaagaaagcctcaagaggctaacattaatcttccatacttccatgggaaggacagtgtagaagcttatttagattgggaaacgaaggttgagcaactctttgtttgccattatacaagtgaggaaaggatggttcctttggctacccttagcttccaagggtatgcactctattag

SEQ ID NO: 64024 - DNA, 153 bp, Glycine max
  Peptide Sequence Number=SeqID_155709
gttgtcatcatcaaaaagggggagattgtagaagcaagcttcacgatgatgaatcaagttgattcaagaagttttgatgatgacaaagatgatgacaaaaagctcaaaagaatgatttcaagattgagtcaacaagttcaagatcaagattaa

SEQ ID NO: 64025 - DNA, 153 bp, Glycine max
  Peptide Sequence Number=SeqID_155710
atgggctcaaaagtctatcctaaggttcatgagaaccctaaggccttctttatcaactctagcccaatcctcttggagcctcttgctcatggctctgaaagggaatgtactggcatgagacctcttccaaaggtgaaccatttatgtacttaa

SEQ ID NO: 64026 - DNA, 111 bp, Glycine max
  Peptide Sequence Number=SeqID_155711
atggtggaggcctctggtaatcgattaccagtctgtgtaatcgattacccagaggaatgggtcactggtaatcgattaccagatcgtgatggtggcaccactaatccatga

SEQ ID NO: 64027 - DNA, 813 bp, Glycine max
  Peptide Sequence Number=SeqID_155712
atgtcatttaccctcattttcagagggctgctcgccctcgccttcagagggctactcgccctcgcctttgtagcgctacacgccctcgcctttgtaggactacacgtcctcaccttcagaggactacacgtcctcgccttcaaagggtcatgtaccttcaccttcagaggactacacgtcctcgcctccagaggactacatgtcctcgccttcagaggactacacgtcctcgccttcagagggctacacgccctcaccctcagaggactacacgtcctcaccttcagaggactgcgtgtcctcgcctttagaggactacacgtcctcaccttcagagggctgcacaccctcgccttcagagggctacatgccctcaccttcaaagggtcatgtaccttcacctttagaggactacacgtcctcgcctccagaggactacatgtcctcgccttcagaggactacacatccttgccttcagaggaccacacgccctcgccttcagtggactacatgtcctcaccttcaaaggactacacgtcctcgccttcaaagggtcatgtacctttgcctttgtaaggctacacgcccttaccttcagaggactacacgtcctcgcctttagaggactacacgtcctcgccgtcagaggactatacgtcctcaccttcagaggacaacacgtcctcaccttcagagggcttcacgccctcgccttcagaggactacacgtcctccacttcagaggactacacatcctcaccttcagagggctatatactctcgccttcagtggactccacatccgcacctga

SEQ ID NO: 64028 - DNA, 270 bp, Glycine max
  Peptide Sequence Number=SeqID_155713
atgttgtggaagcttggagggattgatggggacccggtgttgagaggaatcaggataagggctacgtgggactacgtgagctcagttgaaggtgggcaacttgggatggtggatttatgtgtgatttgtggatgtggagagtcgacttgcaccatcgcccgatcgccacctagtaccacatatgacggagtggtacctggagatatgtcacgggggtcaggagaccttggggacgtcaggtggggtgctattgcccaaaaccaagcttga

SEQ ID NO: 64029 - DNA, 216 bp, Glycine max
  Peptide Sequence Number=SeqID_155714
atgtccaatcaaaagagcactgagtcatgcatcaagaatctagaagtccaggtgggacaattagcaaaacaactggaagaccgaccgtcaagcagctttggagccaacatagagaagaatcctaaggaggagtccaaggctattatgactagaagcaaaatggtgagcatgaatgaaggagagaagaggataggtgcagaaaaacaacaaatttaa

SEQ ID NO: 64030 - DNA, 250 bp, Glycine max
  Peptide Sequence Number=SeqID_155715
atggataagaagcttgaagaggatgctttaatggaggaaaagaaagagagaaggggggagcaggaaattgaaggaataaaagaaggagagaagtggaactttgaacctaagcctcttgcgctttccaaaggaggaaagatgcacggagtcgccaccaacatttatttgtggaaaacatcggaaaaacctaaggaaaccggtcaaagaatgaaaattctaagttcgggagttgtatttacgcttgaggaag

SEQ ID NO: 64031 - DNA, 198 bp, Glycine max
  Peptide Sequence Number=SeqID_155716
atgtgtgtgtgtgtgtgtctgtgtgtgtgtgtgtttctgtgtgtgtgtgtgtgtgtgtggttgtgtgtgggtgtgggtgtgtcgctgtatgcagcaagatctcagctgcagcaaggacttaaaataaattatgggaagagcagctttggggtgttgggccaactgaacaatggaaattgcaggctaccagttatctga

SEQ ID NO: 64032 - DNA, 453 bp, Glycine max
  Peptide Sequence Number=SeqID_155717
atgccagccagtgatcatgccattctacgagacagaacccatcaacccacgaagaaaagcttgatagagctatcatcacatgacccgttattggcacagaaaaagttgctttctaagcaactggaaattttaacccaaacacttggttaccggttgtaccatctgtgcgacaatggtatactcaaggaggattttcaggcttccagcagggtccatataatcaacaaggacagtggaggagaccttgactcagtttatgtgggacaattggccaagcagatagctgacaagtcatccaatagttttgtggaaaataaggaacagaatcccaaggaggaatgcaaaactgtgatgacaaggagtaaaaggtttgtggaagttaaggatgatgatagtgttgtgcataagaagaaaactactgacaagaaaagtactgatgacaagaaaaatgag

SEQ ID NO: 64033 - DNA, 395 bp, Glycine max
  misc_feature (94)..(94): n is a, c, g, or t
  Peptide Sequence Number=SeqID_155718
gattgatggggacccggcgttaagaggaacgaggataagggctacgtgggagtacgtgagctcagttggaggtgggcaacaggggatggtggtnttatacgtgatttgtggatgtggagaattgttgtgcaccatcgcccgatcgccacctagtaccacatgtgatggagtggtacctggagatatgtcgcgggggtcaggagaccttggggacgtcaggcgagctcctggcagtcaacagataaaggaacaaagaccacaaagcaaggaagcttgtgtggtggctagccagctgcttagaaatgggactggaagattggaggcctatggtaatcgattaccagtctgtgtaatcgattacacagaggaatgggtcactggtaatcgattaccag

SEQ ID NO: 64034 - DNA, 213 bp, Glycine max
  Peptide Sequence Number=SeqID_155719
atggattcctttgcttcttggaagatgaatggcagcagaatggagaaggaagagaggagatgccacttcaaggagaagattagtctagaagaagctcaccaccataggaggccatggataagagcttggaggaagaaggagatgaatgaagggagagggagacaagagcacggaattttgtgcttagaaagagctctgaaatctgaagtctaa

SEQ ID NO: 64035 - DNA, 135 bp, Glycine max
  Peptide Sequence Number=SeqID_155720
atggcctctggtaatcgattaccaagggtgggtaatcaattacaaggcttaaaagggtgtaatcgattaccaggcttagaaatgaaggcagcatgttttggaggcctctgggtaatcgattaccaggctgtgtaa

SEQ ID NO: 64036 - DNA, 111 bp, Glycine max
  Peptide Sequence Number=SeqID_155721
gcttttggcatcatcaaaattgcttggttcatcttcatgaagcttgcttctacattgaattgtgagtttcatgaacacaagggaaagggattccttgggtgctcagaagtt

SEQ ID NO: 64037 - DNA, 409 bp, Glycine max
  Peptide Sequence Number=SeqID_155722
atggacaacaacttacatgggactatttctgatgccctgggaaatttgacttctcttgttgaacttgatttgtcatataatctacttgaaggaaccattccaacttctttggctaatctctgcaacttaagggagataggtttatcatatctcaaactcaaccaacaggttaatgaacttttagaaattcttgctccttgtatatcccatggactcacaacacttgcagatcagagttcacaactttcaggcaatctgacagatcaaattggggcttttaaaaatattgacatgctagatttttccaacaacttaattggtggtgctcttccaagatcatttggaaaactttcatcattaagatatctctatctgtctattaataaattcagtggaaatccatttgaaa

SEQ ID NO: 64038 - DNA, 964 bp, Glycine max
  Peptide Sequence Number=SeqID_155723
tttgtactgcagaggttgtctgcacggaagacgacgtaaatcttcgtgtgtcaacggacttgttggccgcgattgacaaaggggataaccacttgggtattaccgccggccccctaacttcacgagttagtactgcagaggttgtctgcgcggaacacgataatgtttatacggataaccacttgggtatttccgctggccccctaacttcacgagttagtattgcagaggttgtctgcgcggaagacgaccaaaagaatgtttatacggataaccatatgggtatttccgccggccccctaaattcacgagttagtactgacagagtttgtcgcggaggacgacgtaaatctccgcaagtgaatgggcttaatgtttatacggataaccacttgggtatttccgccggccccctaacatcacgagtttgtattggagaggttgtttgcgcgaaagacgacgttgtaagcacggaagacgatgtaaatctccgcttggatacgggcttgttggccgtgattgacaaagggtgcagaagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64039 - DNA, 288 bp, Glycine max
  misc_feature (287)..(287): n is a, c, g, or t
  Peptide Sequence Number=SeqID_155724
atggcggcgcaactaatccatgatcgagtggagatggagtgcctagagggagcttgggagaccctcgaaggcaacacgaggtgccgatttcggggcacgattcgatttacagctacttcattggtgcatccaaatgaacccgcgcgcacgcttcagcgcactgtggagtggatactacccacgcctacaccataccgtcaagtggagccagtccaagtgatcgagagggtgatgaggacccactccctgaggtggattctcccgaggacgtcatgttggcatccgang

SEQ ID NO: 64040 - DNA, 321 bp, Glycine max
  Peptide Sequence Number=SeqID_155725
atggcccgaaagggtatgaaggctgatttgggcctgaagcgggtcagtgggatcgggcggttgaaacaaaagccacgttcgcgccacaatgtcagctcctccggagataggcgcttgatgagaactgcgagccgagacggaatcgaaggtgacgctagcggcaccgaagaaagtgccacagccaccgggggcgcgggaggtgttggtgaagaaaagaaagatgatcgagggcgtggtggccgacgaccgtcaaacaatttctcctcctggagacgggccaaccccgctgcctggaccaaggtgaggggctgcaaagcctga

SEQ ID NO: 64041 - DNA, 900 bp, Glycine max
  Peptide Sequence Number=SeqID_155726
atggccaagtttgatccagaaatagtccttgagttttacgccaatgcttggccaacagaggaaggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaggatttcgcccggactgctgcagggaggcgagtgcgaatcatgcgcaccaatatgaccaccctgacccagatatggatgacgttgctcctcagcaacatcctgcccaccgatcataattccgacctccccatgcctaagtgccaactggtatggcgcccactaggcaccctttggacccagataagtccaacaggggcctgggattcccgcactaatcacaggactctgccagtcgttcggagtccccattgcacctaccaagtactgtaccaaagacaggctcagggtgatgctccacaggccgcaggcgcgccaccaccacctcatcaggctggccaggctggggcatttgacatagagcagtatttacggcatttggttcgccagcaggcggctaaccaccgagcacatgtacggacccatgactgtctgtaccagatgagccttagcatgcagagccagggcttcgcctctttttcatgccctactccagaccagtttagggcagaggtagcatggcccggagattggcccgaggcccaagcaggagaggcacccccggaagctcccggcgatggagaagaagcccatgaggatgaggagatggccgatttgcttgacttcttgggagggagtggagacacgtga

SEQ ID NO: 64042 - DNA, 451 bp, Glycine max
  Peptide Sequence Number=SeqID_155727
ctgaacggtctggttataggtacattgagcaactgactgaaatgcctcaaaatgttctttacgatgccattgggatatatcaacgttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 64043 - DNA, 144 bp, Glycine max
  Peptide Sequence Number=SeqID_155728
atgaagaaacaacaatggaagagaatcggaaggcaaaggagaagaggagaggggaggcaccatccaccagggaataagccaaggaagaaggagcttcaccaccaagaattgccttggataagaagcttgaagaggatgctttaa

SEQ ID NO: 64044 - DNA, 156 bp, Glycine max
  Peptide Sequence Number=SeqID_155729
atggaagttggaaagttggaagtggaagttactggaagttggaagttggaaatgaaagttattggaagtgaaaagttgaaaatggaggtggttgtcatcatcaaaaaggggaagaatgtaaatcatgaagattttgatgatatcaagaagaattaa

SEQ ID NO: 64045 - DNA, 488 bp, Glycine max
  Peptide Sequence Number=SeqID_155730
atgggctcaaaaatctaccctaaggttcatgagaaccctagggccttctttagtagctctagcccaagcctcttggagtcttctatccaatacccttgtggggtaggattgcatcaccatgggcctgaaatttgccctaaggctcatgagaatcctagggccttctcttgcatctctggcccaatctacttggagtcttctatccaatgcccttgtaggggatacaatgtccagattcatgagctccaccacaaattgtacatcctgcaacctgcaaaatggaagaatgtgaagtttatgcagaatgaagctgagttggcaacttacttagtgtttctattagtgtctctagttgcttggacaacaacttgttttgtgccaacagagcatcttgtgaggaacccttcaaccgaagcagaatttccaacttggcttgcggtttcggtagagaacgaaaaccctaatctgatctttcgttttctttcgag

SEQ ID NO: 64046 - DNA, 294 bp, Glycine max
  Peptide Sequence Number=SeqID_155731
atgagtgaaattgaagaagtgcaggaacaaatgaagatcgatatggaagccatgaaggaacaaatgacaacaatgatggaagaaatgatgagcatgaggaagaagatggaggataacattgctacagttgttgctacgagtactgctactgagatggacccaattcacctggccagtttaaatcaagtgaatcgtccagtctcagatatagtcggtcaaggaggcgaggcaacgaaaaatgcatgtgggccttatcatgttcaggttcatagcaagcattccttcccacaataa

SEQ ID NO: 64047 - DNA, 159 bp, Glycine max
  Peptide Sequence Number=SeqID_155732
atgggcgagtttgtttataacctgagccctcttcgctcggttcatggggtgccccaaacgcttatgggcagaattatcttagatcatggtcagaagtcgagacaagttgacggtagaaatcaaccaaggtacaaagggacggatgcaagtgggggatag

SEQ ID NO: 64048 - DNA, 741 bp, Glycine max
  Peptide Sequence Number=SeqID_155733
atgacgagtatactgatttccaggaggagacaggtcgccggcgatgctatcgcccagctcctgggatatcctttagtgttggaagagggccaggagtgcgagtatggccagaggaggaaccggtctgatgggttcgatgaggaggccatcgcccagatgttgtgtataccggggcaagattttgcccggactgctgccgggagacgggtgcggatcatgcgcaccaacatgaccaccctgactcagatatggatgactttgctgctcagcagcatcctgcccagcgatcataattccgacctccacctgccgaagtgtcagctggtctacgccatcctgacgcggatgagcattcatgtggctcagttaatcgctaatgccatctatatatttgcaggtatggcgcctaccaggcaccctctggacccggataagtccaatagggccctgggatttcccgccttaatcacaggactctgccagtcgttcggcgtccccgtcacacctagcaaggtgattcgcccgcccatcacccgagcttttattgagaagtactgcacgcagagacaggtccagggtgatgcaccacaggccgcggacccgccgccacctcatcaggctggtccagccggatcatttgacacggagcagtatttgcggcatttggttcgccagcaggcggccaaccatcgggcacatgtacagacccatgattgtctttatcagatgagtctcagctag

SEQ ID NO: 64049 - DNA, 668 bp, Glycine max
  Peptide Sequence Number=SeqID_155734
ccgccattgatgctttcctcgcatatcaacatagcaaggagagtccagtggtggctatcttggcagatttgtttgacacctttgaccggaggtgtgagaaaaacaatgcacggattgtctgttgtttacccgctctctgtgtgtggttggtttcacacctattccaacaagacacaagacacccgtgtccgcttcaaagttatcgctcatgcgctgaaaaaggaagagtcgattgggaccaacatttggctgggataggaggcaacgcaatcaattggtttcctcgttggaaggaaggcaaggaaggtgttcttttctcgtgtggggactaccctaatgttccattgatagggactaggggttgtattaattataatcctgcactcgccataagacagctagggtaccccatgaggggagcgccaacagaagaaagtctctcgcctttccttgtgagggatctaggcgcgcaaagtcacgaggtgatacaaagagtccataaggcgtggagaagtcctttgaggaaagacaaggatcttagaggcatccgaaatggcgtcattggaggttatcatggatggctaagagttcacacgcgagggttagattggctctccaagttgaaagttatcaatgaggacaacttcgaagctcccggaggaagatga

SEQ ID NO: 64050 - DNA, 483 bp, Glycine max
  Peptide Sequence Number=SeqID_155735
atgtgggcctttcataaaggtttacaaattgattgggcacatcttgttagatatcgcatgcataaggcattgcgattgaatgctcctttgccttaccctcatctagtcacccttttccttcaacatttcaacatccctcttgattctgaaccctatgttccaatcaagagatccttccttataggcgtttcagtcatagcatcctttggttatcaaaaagagcatgatggctcttcggtgaagaagggtgctcgacatgttggtgaagaaggacatgatggagaagattcatctcttctttcaaagattttggacaggtatgatggtcttcaaacctttgttggtgaaaggtttgacactttggaattacaagtggatatgcacttcaatgagatggagtcaagaatcaccaaagttgaagaagatatgtcttacattcgttcaagctttgatctaccaccaccgccaccaccatcatcttag

SEQ ID NO: 64051 - DNA, 393 bp, Glycine max
  Peptide Sequence Number=SeqID_155736
atggatgaattgcgctgccatcacgatctacaagaaataaaagaaaggggtagactctttcacgagagatctaactacagtagcaacacaatgtgtcccataaccactacatgcaataaaaagaggcctccacaacataatgtctccatttctaagcctggtaatcgattacacagcattggccatcttaacttcctgtcttcatttttaagccttgtaatcgattacacacccttggtaatcgattaccagaggccatattccaaatattactcaagatccttagctggccagccatcacacaagcctccttgctttgtggtctttgttcttttgtcggttgactgccaggagctcgcctgtttaggtacgtcacaggttctcactgactga

SEQ ID NO: 64052 - DNA, 381 bp, Glycine max
  Peptide Sequence Number=SeqID_155737
atgacgcctagtggacccggagaagtccaacagggccctagggttttcagctctggttacgggcctctgtcagtcctacagggtgcccgtccccccggcaagggatcgcgcccgcaagacacccagtggacccaaagaagtccaacagggtcttggagttgtcaatctctaattacgggtctctgtcagttctacggagtgcctgtcacctccagcaagggcatcaggccccccactaatcgagctttcatcaagaagtactgcgtccccaggcaggcgcagggcgaaacaccacagcagcctagggatggccggcagcgggcaatagacgcaccgccatcacctctagagttcacctcagctcatccacaaaaaggttag

SEQ ID NO: 64053 - DNA, 165 bp, Glycine max
  Peptide Sequence Number=SeqID_155738
atggacccaaaatctaccgctcatgagaaccctatgacttctcctgcatctctagcccaatcttcttggagtcttctatccaaggcccttgggggggtaaggtctgaaaacccctttcttgggcatcttcccatgagggaacatggttcctcaccaacacaatga

SEQ ID NO: 64054 - DNA, 1185 bp, Glycine max
  Peptide Sequence Number=SeqID_155739
atggcggtcagcacattctgtatcggcctgatcccgtcctatgcgtcgatcggtatctgggcaccgatcctgctgctgctggccaagctggcgcagggcttctccgtcggcggtgaatattccggtgcggcgatcttcgtcgccgaatactcgccggaccgcaaacgcggctttatgggcagctggctggacttcggctccatcgccggctttgtgatgggcgcaggcgtggtggtgctgatctccagcatcgtcggcgaagccaacttcctcgactggggctggcgtatcccgttcttcatcgccgcaccgctgggcctgatcggtctctatctgcgccatgcgctggaagaaaccccggcgttccagcagcacgtggacaagatggaaaaagatgaccgcaacgccatcgaaaatccgccgaaaacctcgttcaaagagatcgcggccaaacactggaaaagtttgctggtgtgcgtcggtatcgtcatctccaccaacgtgacctattacatgctgctgacctacatgccgagctacctgtcgcataacctgcactactcggaagatcacggcgttctgatcatcatcgccatcatgatcggcatgctgttcgtacagccggtaatcggcctgaccagcgaccgcatcggccgtaagccgttcattatcggcggcagcatcggcctgttggcgctggcgatcccgtgcttcattctgatcaacagcaacgtgattggcctgatcttcgtcggtctgctggtgctggcggtgctgctcaactccttcaccggggtgatggcctcgattttgccggcgatgttcccgacgcacatccgttacagcgcgctggcgatttcgttcaacatttcggtgctgatcgccggtgcgacgccgaccgccgccgcctggctggtcgaagcgaccggcaacctgtacatgccggcctactacctgatggttgtggcggtgatcggtcttatcacaggtctgtacatgaaagaaaccgccaacaagccgctgcgcggcgcgacgccggccgcttcggaccgctcagaagcgaaagagctgctgcaggagacctacgacaacatcgaacagaaagtcgaggacatcaacgcgcagatcgccgaattggaaaagaaaaagcagatcctgatcgaccagcatcccaagctggattga

SEQ ID NO: 64055 - DNA, 300 bp, Glycine max
  Peptide Sequence Number=SeqID_155740
atgacatcatcagtctttcaaggtggtttcaacttcagttcaaaacttcaaaatcttgatttgcaaaattgtagtcttacggatggaagttttcttatgtcatcttctttcattatgcgttcttcatcttctcttgtttcccttgatctctcctcaaatctgttgaaatcatcaactatattttactggctctttaactccaccaccaatcttcataaccttgtccttgattataacatgttagaaggtaccattccagatggatttgggaaaggttacggctctcaaataacaagttga

SEQ ID NO: 64056 - DNA, 456 bp, Glycine max
  Peptide Sequence Number=SeqID_155741
atgattgatgtttccagtggtggagcccttggtgataagacccctactgaagctaggaatttgattgagaagatggcttccaactcccaacaattcagtgcaagaaatgatgctattgttcttagaggagtccatgaggtggccatggattcatcttcatttactgaaaataaaaagcttgaaggaaaacttgatgccttggtcaacctagtaacccaacttgccatgaataagaaatctacacctattgcaagagtttgtggtctatgttcttctacagatcaccatacagatctttgtccttctttgcaacaatctggagtcaatgagcaacctgaagcttatgctgcaaacatttataatagacctctcaacagcaaaaccaacaacaacagaataattatgacctttcaagcaatagatacaatccaggttggaggaatcatccaaatctga

SEQ ID NO: 64057 - DNA, 387 bp, Glycine max
  Peptide Sequence Number=SeqID_155742
atggccccgaggaagcttgcctcaaagagatccaggaaggataaagcggctgaaggaaccagttccgctcccgaatatgacaaccaccgttttaggagcgctgagcaccagcagcgcttcgaggccatcaagggatggtcatttctccgggagcgacgtgtccagctcagggacgatgagtataccgacttccaggaggagatagttcgccggcggtgggcatcactggttacccccatggccaaattcgacccagacatagtcctcgagttttatgccaatgcttggcctacagaggagggcgtgcgagatatgcgatcctgggtgaggggtcagtggatcccgttcgccggtggtgggcatcactggtacccgagcttttattga

SEQ ID NO: 64058 - DNA, 108 bp, Glycine max
  Peptide Sequence Number=SeqID_155743
atggcgtacattcacattccacataaacctgaaaatcctaatgagtcattggaaacatctaacaacaaccttcaaatttccccaaacatcatgcatagtatcacttga

SEQ ID NO: 64059 - DNA, 1051 bp, Glycine max
  Peptide Sequence Number=SeqID_155744
ggagtgaagattgctgaaaaccctagccttgcaacaagtcctagggaagtagacacggagatggacaagaaaatccgcagtattgtgagtagcattttaaaagacgcctctgttcctgaagctgccgaagatgttccaacatcttccaccccgaatgtttctgtgcctgatgttgagaaagatgttccaacatcttccggcccaaatgctgaagtactctcttcccccagcaaagagagatcaacagaggaagatgatcaagcgacaaaggagacccctgcaccaagggcaccagaacctgctccaggtgacctcattgacctggaagaagtagaatctgatgaggaacccattgccaacaggttggcacctggcgttgcagaacgattacaaagccgaaaaggaaaaacccccatcaagaggtctggacgaatcaaaactatggcccagaagaagagtactccaatcactcctgccacatccagaagaagcaaggcccaagaaatctggaagaaggtgcctgaaaaggttcctgatgcaccattggacaacatctctttccactccattggcaatgttgaaaagtggaaatatgtgtatcaacgcagacttgcggttgaaagagaactgggaagaactgccttggattgcaaggagatcatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtgttagattctcccctgctgtgatcaacaaatatctgggcagacctactaatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 64060 - DNA, 306 bp, Glycine max
  Peptide Sequence Number=SeqID_155745
atgtatggacacatatttttgcaacagatctacttggcatttttcgaagcctgccagaccctaactaaagggggattagcctttcattgtcatgagagacttttacactttagggggttgatgtggatggaagaagatggatggatagaggaggaaaagaggataatggacatagaaagagggtttcccaagttggagatactcaggcttaggatgtattcattagagaactctaagtcttcgggcgtggtgttatctcggtgtatgggttatggccttcccttctacttcctaatctttttatag

SEQ ID NO: 64061 - DNA, 267 bp, Glycine max
  Peptide Sequence Number=SeqID_155746
atgaaaatagtattcccggatactacgaacttgttgtgtcggtttcacattgacaagaatgtgaagacaaagtgcaaaaccctagttgctcaaaagaatgcatgggattatgtgatggaggcttgggggagtttggttgattgtccacgtgagagatatttcgataaggttgagagtgctcattggtcattaaacaagcttctacaaaactctattggtgacatatgcagtgtttgggaagcaatgaacaacatgatgacactttaa

SEQ ID NO: 64062 - DNA, 327 bp, Glycine max
  Peptide Sequence Number=SeqID_155747
atggcccaagccaccgcaaaccctccacggtacccaccaatatacgcaacatcacccaagtttttcggctcacgccgaggtctcttccgatacggcactcacccaaccaagggcacccacacccccacaggggggagctctccggaatccagctctgactcggcctcactcagccaacaatgctcacttaggcgcaaacacgacaaggaactttttgccaaggcaggcacagatctttgccccgatcccgatgacatatggggaactcttgccgtctctcatcgccaaccaattggtcgtggtggtcccgggaaagatcttccatag

SEQ ID NO: 64063 - DNA, 111 bp, Glycine max
  Peptide Sequence Number=SeqID_155748
atggagcttggtttcaggtgggaggcattgataagcagtttctctaagatacatgcaaggccctattatgtcatcgtccctcgacaggaatctcctcctcagcgaaggtaa

SEQ ID NO: 64064 - DNA, 459 bp, Glycine max
  Peptide Sequence Number=SeqID_155749
atggtggctagaaatgcaacaataaaaaaacctagagaagagtggactgaagatgaaagaagattagtgcagtacaatttaaaggctaaaaacatcattacttctacccaaggaatggatgaatattttagggtttcaaattgtaagaatgctaaggatatgatgaagacaaatgaaagtatacaagatatgcagaaaagattcacacatgtagttaatcatcttgcatcattaggaagcatatttccaaacgaggatctcataaataaagtgttaagatgtctaagtagagagtggcaaccaaaggaacatgagatggagttgcaaagactaaatcaacatgaagaaaatgataagaagaagaagggaatttctcttaaagcctcatcttcaatccaagaagaaagtgatatggaagattcaattgacttggatgaagatgaagatcttagtctcttt

SEQ ID NO: 64065 - DNA, 225 bp, Glycine max
  Peptide Sequence Number=SeqID_155750
atgacaatgcccataggttggaactcccagaagagtagagctaacgctaagagggaggaaccaacatatttgaggtcaaatcctcttcaagggggaggggatgatgcaatcctccctatgaaaggacaagtcaccaaagccatgagtaggaggctacaagtggattgggctagagctgctgaagacggccctaaggttcttatgaacatgagggtagatttctga

SEQ ID NO: 64066 - DNA, 759 bp, Glycine max
  Peptide Sequence Number=SeqID_155751
gcaaaggcattggcggatcaaggtgaatgggcttctttcacggatgtcttggcattattgatattcggagtcatcctttttccaaatgtggatgggctagtagacctagcggcgatggatgccttccttgcttatcaccatagcaaggaaagtccgatcgctgctattttggctgctgtctatgacacgttcgaccgaagatgcgaaaagagcaacgcgataattgtctgttgtacacctgctctctatgaagggaaagttggggttttgtcctcatgcaaaggattcccaaacattcccttgttgggaatgaggggttgtatcaattataatcctgtccttgccataagacaacttggctaccccatgagaggagcatcatcgaaggaaagtatcacgcctttcatcgcacggggtttcagtgaccccaatgcgaggatacttcaaggagtccgcaaagcatgggagttggattggctcccaaagctaaaggtttcaagcgaggaagaggctgaaacccctgaggagggtgaggaggtgcaagccttaaaagagaaacttgaaaaggcacaattagtcaaggaaaagttcaaaataatggccatcaaggtcaagaaaaagtgcgataaactgagggacatcaatatagccacgaccaaagctttagaacgggaaacaaagagggcccgaaaggaagaacacggccgaaacaagtttcgaggggctttatggggtagaaacaacgaccttaagctttga

SEQ ID NO: 64067 - DNA, 183 bp, Glycine max
  Peptide Sequence Number=SeqID_155752
ctccttcttccatggcttattccctagtggatggcgcctcctctcacctcttcgactttgtcttccgcttcatctccatggtggaaaatcaccattaaaggacctcattgaagctcaagatccagcctccatagtagctctagcccaagcctcttggagtcttctatccaatacccttggggg

SEQ ID NO: 64068 - DNA, 321 bp, Glycine max
  Peptide Sequence Number=SeqID_155753
atgtcaggatttacacgcgattctcctcaaatttcagccagcccgcatcaattagaccttgcaccttacgcttcaagcccctacaatgctcaatggaatgcctcggggcttctccatgacaaacacacgttgcgttcgagtcgtattctcagagaaaaggaggttgacgaaccttggttggggctttctcgctgcaaaattcatttcttggttgatgtttctgggatggcctttgtggataactgggcggtgggtaaggagaaggtttgttattggctgagtaatgacattgttgggttggtgggaaacttggctgtatag

SEQ ID NO: 64069 - DNA, 1241 bp, Glycine max
  Peptide Sequence Number=SeqID_155754
tccagatgggcgatgcggcgggttttgaaatactgaaaaggcgtgaaaatcacgtcttcatagcgcctgccgtcttcgaacgctacgggctgcgccgcgcggttatccggcgtcggcggatgctcggtgaacttctgataattaaagtcgatcaggtcatcttcaccggcggtaagcaggggccgcaggattgccagatagtcgtcgctcagcagatcgtcgccgtcgaggaaggtgagatagcggccggtggccagccggggctgtttcgggacggaaagaacggcggcgatcagcgccaggcagaatatgacggtgccttccgtgctgaagaagatgacgtcgctcaggccgtaaacgaacaggctgacgctaacgctcagcagcagcgcgttgcgctgcggccggaaggaagagaagaacaggctgatatagagcgccagcagcagcagtacgccccagatgcccttgagcgagtaggtttccagcagctcgttgtgcaggtggacgttgatgtagggcatgacgccagacaggcgaggttgctgtgcgaccatcgcacggatctcttcaccgcgctgctcggcggattggccccaaggggctttctgtggctgatccatcagacgcatatcggtctcaaaggcctgaatgcgttcttctatctgcggtttaaacaccaagccgcaggctacgagcagcagcggtaccgaggccaccaacgcgagtttgtgtttcctggaaaccagctgcttggtcgccagcagcgacaggcagaccgctaccgggtagaccaacatggccgcgcgcgtgccggtgagcaccagtgcagagaaggacagcaggaacgcagcgatgtacaacgccaggcggtagcgggtgcgcagcatcaggatggcttgcatcatcaccagatcgatggcggtcatcaggtaggcggcgaccgtggcgcgatcgaagttgagctctacgcgcgggatatccagccgcaatccctgatagagggaatagccgttgaccgccaagccggtggcgagagccacgacgatcagcatgcgctgcacgcacaaccgctcattgagcgcgatcagcaagatgaaagcggtcgcgagctgcagtttgccggtcgacatataagaacgataaatattgatgtactcacccggctgtttgaagtgatgcatccagagatggttcccatgcccacgctgacatcagcgcggcagcagcagatttctcgc

SEQ ID NO: 64070 - DNA, 327 bp, Glycine max
  Peptide Sequence Number=SeqID_155755
atgttgataattgttgatcaacataaggagaaggtgaacctagctgttagtcatggacatatgctggaagatgaacaagtaaaggtatcagctctgcaaattgaaagggaagtgggagagagggtgatagagttattgcatggggaatccatgaaatggatgaatagattcgctctcactctgaatgagagtcaagagcttccaaggttgttagccagagccaaggcagtggctaacacctactcaactcctgacgaagtccatggccttttcaattactgccagcacatggttgaactaacgacccacataattaggagtcgttga

SEQ ID NO: 64071 - DNA, 234 bp, Glycine max
  Peptide Sequence Number=SeqID_155756
atgtcctgctcctcctatggctggtcttcattaagatccagtgctggagctgctgatgaatcctatataggctactctggctccacaactggtgtagatggctgggtctcctcaggagtagtctcctcctctgctggtgctggtgctggtggctcctcaatatcaggctcctgggctgcagaggctccaccccctccagaagaagagagttggtctcctggccaggccacctga

SEQ ID NO: 64072 - DNA, 327 bp, Glycine max
  Peptide Sequence Number=SeqID_155757
atgatgcatgcacctgacctcaactctcagatgcaatgtggtacgtaccgtatccaataccaaggaaatagccctaagcgtgtctacacgacacctcacttagaaaaccatgcagtatttgtcgaggccacccagtcgtgcaccgtaactccccccctaggtgctcaacctggggccacaaggagttccctaccaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 64073 - DNA, 159 bp, Glycine max
  Peptide Sequence Number=SeqID_155758
atggcctccatcattgtggccatttgctttttcatggcctccatgtcggccttcatctgctcttgcgcctcctctacttcacccattactttagctctagcacaggaaagaatgcaaagagcaatgcaaccaatgaaaagcatggatgtatgtgaatga

SEQ ID NO: 64074 - DNA, 819 bp, Glycine max
  Peptide Sequence Number=SeqID_155759
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagttggaagaaatcctgggatgccaactgggaggaaggaagccatatcttttctttgggttctatccctccacgaaaagagctgccaagtaccaaggaagtgtttggaggaaagggcaaaggccttggcaaatcaaggcgaatgggctctcttttattgacatcttggcgcttttgatctttggagttgtcctctttccgaatatggaagggttagtggacctagcagcgattgacgctttccttgcctttcatcatggcaaggaaagcccggtcgtcgccattttggccatgtatgacacgttcgaccggggatgcccgtctatccgctacaaggtctctgctcgtgcgtcgaaaaaggaaaggcgaattgggaccaactcttggctagcatggagggacacgaaagcatcacgcctttcatcgcacggggtttcagtgaccacaacgcgaggttactccaaggagttcgcaaggcatgggatgcggcgtgaagaaaggacagagagcttaggggaagcagtaatgggatcatcggcggctatcataagtggctga

SEQ ID NO: 64075 - DNA, 297 bp, Glycine max
  Peptide Sequence Number=SeqID_155760
atgtggagcccactgaaagtgaggatgcgtagccctctaaaggcgaaggcgtgcagccctctgaagtcgaggacgtgtctccctttgaaggcgagggcgtgcaaccctctaaaggcgagggcgtgtagcccattggagtcctctaaaggcgagggcgtgatgatggaagcttgcttgtggggcttctatggaggctggatctttgagcttcaatggggtcctttaatggtgattttccaccatggagatgcagcggaagacaaaggaaaggaggtgagaggaggtgccatccattaa

SEQ ID NO: 64076 - DNA, 96 bp, Glycine max
  Peptide Sequence Number=SeqID_155761
atgggtgagatatggcagaagggagaattggggacgaggggacacattgtaattgattacactaatatgataatcgattaccagagagcattttag

SEQ ID NO: 64077 - DNA, 198 bp, Glycine max
  Peptide Sequence Number=SeqID_155762
atgtctgcttatagtcctttcgttaagcgtaagcctcgtgctaagcgcatctttgttcatgcgctaagccgcgagtctcaagcgcttagcgcccaacccttgaatctgaggctgatttggtgcgctgagctggccaaggctgagctaagccaacttcaatttgatctggatttggctaagcgaaagcctaaccactaa

SEQ ID NO: 64078 - DNA, 445 bp, Glycine max
  Peptide Sequence Number=SeqID_155763
cttgggaggattgatggggacccggtgttgagagaaatgaggatatgggctacgtgggagtacgtgagctcagttggaggtgggcaacaggggatggtgggtttatgcgcgcattgtggatgtggaaaaaacttgttgtgcaccatcgcccgaccgccacctagtaccacatgtgatggagaggtacctagagatatgtcgcgggggtcaggagaccttggggacgtcaggcgagctcctggcagtcaacagataaaaggaacaaagaccacaaagcaaggaggcttgtggtggctggccagctgtgaattttgtgtgatatatgggttgtggtctctggtaatcgattaccaagggtgggaagctaagggagcctctggtaatcgattaccagtctgtgtaatcgattacacagaggaatgggtcactggtaatcgattaccag

SEQ ID NO: 64079 - DNA, 165 bp, Glycine max
  Peptide Sequence Number=SeqID_155764
gaagcaggcttctgggctgcggaggccccccccccttcagaaggagaaggctgggctcctggccaggccacctgcacatcaaactcatccatgctcaaaatggatgacaagcccaagccctgcaggctctgcaggatgatggactgccccctgtgtaggctctag

SEQ ID NO: 64080 - DNA, 408 bp, Glycine max
  Peptide Sequence Number=SeqID_155765
gatttacacgcgattctcctcaaatttcagccagcccgcatcaatttgaccttgcaccttacgcttcagagccctacaatgctcaatggaacgccccggggcttctccgtgacaagcacacgttgcgtttcgagtcgtattctcgaagaaatggagggatggcctttgtggataactgggcggtgggtaaggagaaggtttgttattggctgagtaaagacattgttgggttggtgggaaacttggccgtacaggaatggcagccacaacatgggtttctccctcatcctcaccctctttcatttgccccagttttctcattcatccaagcaggattattaaatttgcctcttttcaaatccacttcgacctttttgctggcgaagaccaaatctgtaaaacttgaag

SEQ ID NO: 64081 - DNA, 360 bp, Glycine max
  Peptide Sequence Number=SeqID_155766
atggcatgcggagatgccctatacggtaatctgcacacacacttgtgctatcccgaccctccggtagcatgcggagacaccttacagttatctgtacctcgtcattcggagaccccaagtccgattgacaagcagagaccaatgtggtcatttgcaccctttctagagatgtcagaatcttccagccaagactattttagtctcaaaacatctgttgatcctgacccaagagtcaagtggcaggcggaaatacccaagtggttatccgtacaaagacaacatctgttaatcctgacccaagagtcaggtggcaggcggaaatacccaagtggttatctgtacaaagacaacatctgttga

SEQ ID NO: 64082 - DNA, 250 bp, Glycine max
  Peptide Sequence Number=SeqID_155767
tgatcaaggggttcccatgaaccctaagagaataaaggtcattcctgagtggcccaccccaccaacaccactcattgagttggtgagaaaccatgttccttcatgggaagatgcccaggaaatgggtgttgaggggaaggatcccagaggaatgatgcaatcctatcccgcaaaggcattgggtagaagactccaagtagactgggctagagatccaagggaaggccctagggttctcatgagccttagg

SEQ ID NO: 64083 - DNA, 360 bp, Glycine max
  Peptide Sequence Number=SeqID_155768
atggctaagtatgatccaaaaatagtcatggagttctacaccaatgcgtggcccatgaaggagggagtcagagacaagctctcttacagaccttccttatttcacttcaattttaggaaaaaaggagaaattttggaaggtactgaagttgttgtctcgctaagcctgatccatgcgcttagcgagattcatccgctaagcgagacatcagccctcttagcgagtaagaggaatcttagagagaatctgcctcgtcagcacgcgctcagcgcgtcacctgctcgcccaatgagatttttgtctcttcttgtgctaagcgtgcctggctcgctgagccaaaattcacttactcgtgcttag

SEQ ID NO: 64084 - DNA, 435 bp, Glycine max
  Peptide Sequence Number=SeqID_155769
atggacccagagaagtccaatagagcactggggtttccagctttgatcacaggcctttgccaattctatggggaccttaatagaaaaatattgcatgccaaggcaagcacaacagcagtaggaggagttccagcagcagctgactcaggatgcaccgccaccacctctacggcagccaccacctctggattccatctcttctcacctgtagaagatagagctccagatgcacacgcagctaatcataggggtcaggtgcaactgaatgagaccttctaccggtacaccctgcaccaacagagccaagaccccagtcctttcctgtggcctacccccgagcagttcggggccacagttgcatggcctggagatgagcccgattttcagacaggggtaggacccataggggcccctggagacaaggatggagcttag

SEQ ID NO: 64085 - DNA, 492 bp, Glycine max
  Peptide Sequence Number=SeqID_155770
atggcacgagaatgcttcccaaatgaatatatgatgtggaattgctcctcaagtgtagatagatggcatgaaagttccttttcaaatgcaagtatgtgcgtgacgaaatggctccgagaaaagtattgcacgtctagacaggcacagggagacgcaccgtcgccacctcatcaggctgatccagctgggtcattcgacacggagcggtatttatggcatttggttcgccaacaggcgaccaaccacagggggcacgtgcagacccatgagtgcctctaccagctcagcctcagtctgcagaggcagggtttcgctccttttctgtgccctactccagaacagttcagggcagaggttgcatggcctggagattggcctgagacccaggcaggggaggcgcccgcagaggctctcgacgatggagaggaggcccgcatggatgaggagatgacggatttgctcgatttcttgggaggaagcggagccacgtga

SEQ ID NO: 64086 - DNA, 396 bp, Glycine max
  Peptide Sequence Number=SeqID_155771
atgcctgttgcagtcatgtgcactattaatgatttccctgcatatgcaaatatgtcaagatggagtactaaagttgatgtccatgttgtgactttgaagtgccctctaagtggttgggttatagtagaaaattttactatatgtgtcatcgtcattgggaaatcaaaggatcatgacaaggcacattatgacattgtggacttgaatataaggagtcaacttcatccaaagatgcatccaactacagtaatccatttggcatatgaggtaaaggttgcaagcctaatacattataggtggatgtgtcccattgagagatgtcgtacaggatgtcacgacatcgcgcttcagaacatgcagaatgtatatgaccgtatgaacagattaaacaagtga

SEQ ID NO: 64087 - DNA, 195 bp, Glycine max
  Peptide Sequence Number=SeqID_155772
atggataaacaacattacatagaatctttgaacttgaaaccaatagcagtatcgatgagaggtgagggctcaagagggtttgcccacaaagagaggcaccgagaggtttggggcatcgaaactgagcatacgatgattggcatgatgacaatgggcacaacaaaaccagcaatagtggtgagaggcaagatctaa

SEQ ID NO: 64088 - DNA, 375 bp, Glycine max
  Peptide Sequence Number=SeqID_155773
atggagggaagaaatgactctcaattcttgtttctctttcttttagcgtttaccttccataagaaattatattttattggaattggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 64089 - DNA, 300 bp, Glycine max
  Peptide Sequence Number=SeqID_155774
gtgaaaaagaggctaagtcatgaagtgctaaaagtgacagttgggcttgactcatcagttgggctaagcgcacatccaccactaagcgcagcttcaattgattcaaggatttttgatgataacaaagatgatgacaaaaagctcaaaagtcaatatcacttcatgataacaaagatgatgacattcaagaatgagttcaagattgagtcaagaacacttcaaggatcaagagcaaaatttgatttcaagaatcaagaatcaagattcaaagattcaagaataatcaagatcaagatttaa

SEQ ID NO: 64090 - DNA, 282 bp, Glycine max
  Peptide Sequence Number=SeqID_155775
atgtgtagccaagctctagcttctctaggaagcttctcaaggaagtttttcaaggaagtttctcaaggagcttcttatccaaggcactctcttggtggtgaagctctttcttccatggcttattccctagtggatgatgcctcctctcatctcttctcctttatcttccgctgcatctccatggtggaaaatcaccatcgaaggacctcattgaagctcaaagatccagcctccatagaagctttacaagcaagcttccatcatgctccatcacaagactag

SEQ ID NO: 64091 - DNA, 648 bp, Glycine max
  Peptide Sequence Number=SeqID_155776
atgttcattctaaccccaaatgcgataaactcatcccttacctctaagcgggctcacatgtcttccgatagcgatagtggcatctctagcaagttcttgagattcctcaatttttcctctgattgctctgataggattcccaaacaggaagctgctcaatctggaagaactgacaccgtgattaatccttcatttcccatcagacgacatgtgaagtggaagattgcccgcaccaagaaaactgggcaaatgacatctgaggcaacaaaggaaattgctgacaagattgattcgttggaggagcagtcctcgcagggttcctttgtcgcccatggacgttatgttgtactaactactgccattgggcgactagaataccctcgtcatgtaaaaaggagagttgtgttaatctctcagggaacgattaagacatgggtgactcagagaaatgcgggaaaactttatgaggggtcggcaactgttcacaacatccctttgtgccattatcaagtcaaggttggtgttgaggaagttacagatgcagatgctcccattcctgtacccactgaagaggttcagttagtgggacaaacacttaataccttcgttgcttgggagacacatcttgtaaagcatttatcaaaatag

SEQ ID NO: 64092 - DNA, 597 bp, Glycine max
  Peptide Sequence Number=SeqID_155777
atggcggaaccatcaaaaaagcgcaagggttcttcgagtcgaagccaatggcactccgaggctcaggaaacacagattccctcctccatttcctcttccttgttgttctcatcagaagaacaacggatacggtacacaaaaattttctcctctcgttccattattgatcctaagttcatagacatggatttcttttccaataatagttttgaatgcattcaggcatttcagaactcaaatcttattccttttatgtctttgaaatttcctatttattctgaattagttaaagctttttattctaacctcgaaattcaagaaaacactttgatttatgaggtttttgggataaaaatggtcattgaccaatccctattctatgacttgacccaattatctagtgaaggtgtaccatttgaagcggatatgaccggaaggctttttgccggatcattggctcttgaaagccgtatccttcactatcttattgtgcgtattttacttccaagatcttcaaacattgcacaagtttctaaagaagatcttattgtcatgtgggctttcatactggccaacaaattgattgggcacacttag

SEQ ID NO: 64093 - DNA, 555 bp, Glycine max
  Peptide Sequence Number=SeqID_155778
atgagtggtttagcctctcatgacaatgagtggcttactaatacaaaaatgaaacaagaggtgtggaagaaaatggaggaaatcatccccaaaatgcagaaaatacccaaaagggtcattttgaggctttttcagacccctggctcgcctaggccaccagaagacttaggggtgaataatgggtttagactttcaaacattgaaagatttagtgaaattaaggagaagaaggagattgaagaagaaaaaacgaggccaaggcacttccgaatcgcatccgtgaccgattcctacatcgttcttcgtctgttcttcattcatcaattgggtacatcctctgtggtacaagtagagggtacatctacttggtttgttgtgactgagaacaagagagagtacatctcttgtagatcagttcaagtggagggtacatctacttggttgttcaaagagaacaagggagggtacatcccttgtggatctttgcttgtaaaggattttacaaggttgaaaagaaatctcaaggaccgcaggtcgcttggggattggatgtag

SEQ ID NO: 64094 - DNA, 603 bp, Glycine max
  Peptide Sequence Number=SeqID_155779
atgtctaatttgacttctacatttgctgaagctagggcttcctcagacaacagaaccgaaattggcactgattactcacagcaatactttactccaccacaaactcaaacacaacctccactaaagaaaaagagaaacctttctgccaacccagaccctaaagctgaagttgtcagcttgtctccaaagactctcttggcaagtaataggttcatttgtgagatttgcaacaaaggatttcaaagagaccagaatctccaacttcacagaagaggacacaatttaccatggaagctgaaccaaagatcaagcaaagagattataaggaagaaggggacctcactggcatcaagaagcacttctgcagaaagcatggccagaagaagtggaaatatgacaaatgatccaagaagtatgttgttcaatcagactggaaagctcactccaacacctgtggcactagagagtacaactgtgactgtggaaccctattgtcaagaggagactgcaagatcagtgacaggcatagtagccaactcaacaactcaaccaactaaagtagctggaattgtgatctcttcatcctcttgggaagtttcttga

SEQ ID NO: 64095 - DNA, 318 bp, Glycine max
  Peptide Sequence Number=SeqID_155780
atggcttctccacctgcctcccctcctcctcctcctcctcctcctcctcctcctgcttcttcggatgcatcggcttcgccgtctcccgtgaagcggacacgcaaaacctcacgtctacgatcgttgtctactagaccacctggtgctgagagaccagtggtccatgttgatcctgctaccggcaaggccgacgatccccataggaagaaattaagaacatatttggggattgtggcgcatgataaggtggacgtcacctacgagaactggaaggaggtccctactgctcagaaggacctgatttgggaggatattcag

SEQ ID NO: 64096 - DNA, 237 bp, Glycine max
  Peptide Sequence Number=SeqID_155781
atggatattttggctcaaatggagatgctagcacctgaccatggccatactgacttgattgtggtcgtgttgattgtgctttacgtggttttcaagtttgacgagagttacacgccgagcaaagtttccatccgtgccggtgatggttttcacaacttgaaggagattaagatcgtggaactcgtgaaaccagctgggtgggtttatctatccttgtatggagttgatcttaggtaa

SEQ ID NO: 64097 - DNA, 876 bp, Glycine max
  Peptide Sequence Number=SeqID_155782
atgatttcacgcctttctctctctcaaaactctgtccaaaccaccatagaaactcctcctccaccacccacgaccactggtggccaccatgagtcgttgttgcttgccgtcgaaccaccacaccgagaggaacattttaatcggagcagaatccttagaatccacctcaaggatttggtggagaacaatccctcaaatcctttcttacgtagcttctctgagggtgacctcgacacttgctgcctagttttcctaagtgagagtgtcgtgtggacacgcttaggctatttcatgacgaatggtaccacattgcatttaagagttgaggggaccagtcatgaatgcacaatgatgataaatgtcattgctagtggtaacttcttgaacaaaaccattgctaagacaatctacttgtcattgaatagaggatgcaaatccaattggacactatcacaaagcaaatgcaacaactacctaagcaacttcaatccatgcacaacacctcacatcaagttttcagctatgaacaatgcgagggagaacatcatttttcccacgacgagacaagctatgggtagtaagagggagttcactacaactgctaagctcaagaagcacaacaataagttagaggaagctattgctaaactcattgacctatccattgcctccatggccaaccagaagaacataaatgtgtccatcatgaacttagtgatgcaagtgggtcaattggctaagcaacttcagaacagtttcgttgcattttcaacaaaagtgaattgcaatgctatcacaacttggagtaggttggtcattcctaataaagtggcagaaaaaaagaaagatgaggccgcaaagaaagagaaggactag

SEQ ID NO: 64098 - DNA, 1074 bp, Glycine max
  Peptide Sequence Number=SeqID_155783
atgaccaaacatcaaagatcaacaaagcgtgatctatcttactgggagtatgttgatgcattacattctgtgcaaaatagtaattttttagtcaaacatagtgcatcatcatctgaccaaggaattccaagaaggacaatgccgatgttggatcaatttcatctgtgcattcatgattccattgaaaacattgttgatatcaaagctgacggtaactgtggatatcgtgcaattgatgccttattagatatgggtgaagattcatggtctttggttacgatggataagtggatgaatataaccgacatgggatatgtcattgcatcaagagcacatgcaaatcgcaggagggaatggcgcgttccttctcgacgcgccacctggcagtggtgtcgccatcttcaatggcattttgcaggagcttggactcgccagtcaaactggcgagttgagggtgcagagttcctagggtgcaggcagcagaggttgtttccaagggggttgcagtctgcaacgctgcaggaagtcgccagcttcaatggcgttttggttggccaaaagcgccagcaccagcagcgatttgcgttgcctgagttgcttaaatcccccctccccgtagaccattcacgcgagaaaaaaaaaagaaaagagaagcttattggtgctgtgtttgagcaaaaacgaagaaggagtgttgctgtggtgtttgtgtttgagcaaaaacgaagaaggagtgttgctgtggtgtttgtgtttgagcaaacttcttcatttctttttatcttaagatcaatgacatcttcgtcatcatgcgcatcaagtatacaaacgaggtctggtccaattaagggtgacgttttgtggatgcaacccaagcatgtttcagaacatgtttggaatggagaagcagacagaaaactacacattagacgagcagtgccgacgtatcaaggtgaagaacaaataccagaggaaattgttcctctgcttcggcaatgtgggttttattggataattaagatgggatacctaaagataaatgcgaccttaattagtgcgttcattgaaagatag

SEQ ID NO: 64099 - DNA, 390 bp, Glycine max
  Peptide Sequence Number=SeqID_155784
atgaacaaaatgatgacacttcaacacacccaaattaaagcatcttttgagacaagtacgcacggagttgggcatgtgtttaaagttaccttgtacaaaaaactgcttgacatggtatcaaagtacgctttaaatgaaattgttgctgagtatgagtgtgtaccttatgcaggcaaaaacccttcatgttgtggatgtgtcatgaggactactcatggtcttccatgtgcatatcaaggattatgtgaggctaaggtgaccataactaaagagatggaaaccatatcaaaacgatttgagcagctcaatgtttgtggcaaagtacatttgaagaaaaagcttcaggaaactatttatcttgatctaaactctatgtgtcctcctccataa

SEQ ID NO: 64100 - DNA, 390 bp, Glycine max
  Peptide Sequence Number=SeqID_155785
atgaccctttcatcatggcagaagaagctaaacatgtattttatgttcaagacccttgtgatgaaaggtggtcagtggcccatggctactccacctggcacgcctcctcctccttttcctccttctcctcctcctcctcctcctacagtagcatcacagtcgtcatctaccttgaagcggacacaaaaagccacacggctacgatacttggcgactagagcacctggggaagacagaccggtggtccacgtcgatcctgcgatcgggaaggccgacggtccccacaagaagaaattaagaacatatttggggattgtcgctcgtgataatgtcgacgtgacatacgagacttggaaggaagtccctgttgctcagaaggatttgatatga

SEQ ID NO: 64101 - DNA, 144 bp, Glycine max
  Peptide Sequence Number=SeqID_155786
atgtggaccaccacgggggagaagcttgccgcccagctcgcccaggcgagcaaggttgcttcctccagaagcaacagccttctggaggaagggtctggaaggcccaagtgggctagattgctatttgcaccccccttttactaa

SEQ ID NO: 64102 - DNA, 235 bp, Glycine max
  Peptide Sequence Number=SeqID_155787
atggctgagaagactaagaaaaaactggaggaagctgctcagtctggaagcactgagggcgtctttgacccttcatctcccatcagacgacacgtgaagtggaagatggcccgcaccaagaaaactgggcagatgacgtctgaggcagcgaaggaaattgctaagaagattgatgtcctgactgttgccattgggctgccagaacaccatggctgtgtccgtgctgctggagccg

SEQ ID NO: 64103 - DNA, 63 bp, Glycine max
  Peptide Sequence Number=SeqID_155788
atggcattagaagaactcagagccaaacctagttcaactacaacaaagcaaagagagctgtaa

SEQ ID NO: 64104 - DNA, 357 bp, Glycine max
  Peptide Sequence Number=SeqID_155789
atggatatgcatgaattgcataacatgttagttcaggaagaaatgagacttaagaatcaaggaagtcactcagtccattatgtaagccaccaagggaatcaaggagttgaaaagaaatttatgaagaagcatgataaaggtaaagggccattaaagattaatgacgactctttgcaaatccagaagaagggattccttacaatccaaatcgtaagcccaaataagaagttcatcttcatggggaatagagtgaaacctccagtggaagcagttgagacttattgtttaaaacttgacactggacatcatttagatttactaaaaactccttatgtcaaatttctagagaaaagatga

SEQ ID NO: 64105 - DNA, 849 bp, Glycine max
  Peptide Sequence Number=SeqID_155790
atggaaagtatgatagatgctaccagtggtggagcccttggagacatgacccctgctgaagccataaatttaattgagaagatggcttcaaactcccaacaatttagtgccagaagtgatgctattgtcattagaggagtgcatcaagtagccacgaattcatcttcatcagccgagactaagaagcttgaaggtaaactagatgccttggttaacctggtaacccaactggccatgaataaaaaatctgtacttgtcgccagactctgtggtttatgctcctctgccgaccaccacacgaacctttgcccttctatgcaacaatctgaagcaattgaacagcctgaagcttatgctgcaaacatctacaacagacctcctcaacctcaacagcaaaatcagccccaacaaaacaattatgacctctccggcaacagaatgctgctggcccaagcagaccatacgttcctccaccaatccaacaataacaacaacaacaacaacaaccctagaaacaacaaacagttgaggctcctccgcaaccttcccttgaagaacttattaccttctcaatctgtccagaatccaaaaaatgtgagtgccattgcattgaggtcgggaaagcagtgtcaagaacctcaaccagtagcatcttcctcatttgcaaatgaacctgcccaacttcactctactccagaaaaagatgatgacaaaaatttaaagagtaagttacctaacaatttctatgcaagtgaatctaaagagaagcaacatatccctcttccattccctccaagagcaatttccaacaaaaaaatggagttgtgcactaattccaagatatgctaa

SEQ ID NO: 64106 - DNA, 1032 bp, Glycine max
  Peptide Sequence Number=SeqID_155791
atgggggagcggtggagacagtttaagtctgatttgacgtcgaaatgggaacttgcagccgacaaggacaatgtcaatgatactgatgtgcgaaaaaaggcacatgccatccaaaaacaaaacattgcccctcacatgttgtctcatgggggttatgaatatctagaaaacaagttaatggaggagaagaaaaagaaacaactggaggaagcttctcaatctagaagcactgacaccgtgattgatcctccatctcctatcagacgacacgtgaagtggaagatggcctacaccaagaaaactggccaaatgacgtttgaagcagcaaaggaaattgctaacaagaatggaaaacaccctggtcgtgtgtgtgttgctagagctgatgtcatgttcaagcaatactttggactggctccaaggacctcccacacatctttgtccatggctcccgaagacatggagcaattgatgcaaaaaatcaaggaccagttggaggagtctatcacagaaaaaggactcacactacctcctgagcctgaggttggtccttctactactcgtgtcaacacaaaggagagttgtgttgatccctcagggaacgatccagacacgggtgattcaaacaagtgcgggttgtacatcgaagaaaatcctccccgcctggttgccctaggaagactttatgaggggtccacaaccattcacaacattcctttgctccatgatcaagtcaaggttggtgttgaggaggttacagaagcagatgctccaattctcgtacctactgaagaagctaagttagtggggtgggcacttaacaccttccttgcttggccgatgcatcttgtcaagtgtttatcaaaacaagtaaagcatgaagatctatctgaaatagcacagagtggtcaatgtctcaacatctttgttatacatttgtggattctgcatatgattgagacaattatgcgagtggggaatgccaatgtgtatggattccttgagccacagtccatactgagatctgggtaa

SEQ ID NO: 64107 - DNA, 264 bp, Glycine max
  Peptide Sequence Number=SeqID_155792
atgagtcataggggacacctaacaacagctttcaaaattgccccatgtgtggcatctcttgtcaatgtcaggatttacacgcaattctccttaaatttcagccagcccgcatcaattagaccttacgcttcagagccctaccatgctcaatggaacgccccggggcttctccatgacaagcacacgttgcgtttgagtcgtattctcggagaaatggaggtggtgttcgtcattggaagtgcggtagacaggctgtgtggttga

SEQ ID NO: 64108 - DNA, 304 bp, Glycine max
  Peptide Sequence Number=SeqID_155793
atgcgcttacacagcaatctagaatcagttgatgaacaagaaactgccacatttgctaaatggattctggacattggagatggaattataagtcatgaaaatgatggttatgctacaattgaaattcctgcccacctactcattactgaatatgatgattcaattagtgctatagtcaaatcaacattcccagacttagatcagcaccacaataatcctcaattctttaaatccaaggcaatactagcttcaacaaatgaaatagtagaacagattaatcattatgtactatccttcattccag

SEQ ID NO: 64109 - DNA, 216 bp, Glycine max
  Peptide Sequence Number=SeqID_155794
atgttggctactggtaatcgattattgccttatggtaatcgattaccagagagtaaaactctttgtaagaatccccaactgagggttttagcctttcatggcaaggaatctccttttacactgaagaagaggaatcaagggaaattgcttgcttacaaaggagtggggatgactcctccacctcttggatctcacaatctctcaaaaactcactaa

SEQ ID NO: 64110 - DNA, 705 bp, Glycine max
  Peptide Sequence Number=SeqID_155795
atgacaaaaagatattggaacataatcttggaagagatgatggaagcaggagttcattttggccacggtactagaaaatggaatcctaaaatgtcaccttatatatctgcaaagcgtaagggtattcatattacaaatcttattagaactgctcggtttttatcagaagcttgtgatttagtttttgatgcagcaagtgagggaaaacaattcttaattgttggtacaaaaaaaaaagcagcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattattggaggggttcatagatttagggaatcgattactatactag

SEQ ID NO: 64111 - DNA, 561 bp, Glycine max
  Peptide Sequence Number=SeqID_155796
atgggtgatcaagaggagacacaggaacagatgaaagccgacatgtcggctctgaaagaacaaatggcctccatgatggaggccatgttaggtatgaggcagctcatggagaagaacgcggccactgctgccgctgccagttcggctgccgaagcagacctgactctcttggcaactgcgcaccatcctccctcaaacatagtaggacggggaagggacacattggggcacgatggcagccctcacctgggatacaaccgagcggcttacccttatggattgccgcccaactactcaccacccgtcttgcaagacgatgcgggccatattgcttctcccgtccttgaaagagaaccccctcaacagcccgacgaggcccacaaagaccctcaagactatgctcgaagggatgtcgagttctatcccccgatccccgaagggccggcacccagcacgttgcctcagcccaacatcgcaacacaaccaatagttttgtccacggaaggaccatccccggcaactgaagaaaggaggaagctcgatctcctgaggaaagattga

SEQ ID NO: 64112 - DNA, 307 bp, Glycine max
  Peptide Sequence Number=SeqID_155797
caagattgcaattgtggtcagggattcggcaagagagttggatcatgtaaagcaaactcgaaacggcgtagtgggcgtaccatggaagtacttagaaggcaaggcaagggatatggcgaatcaagaggagtgggtcccgtttatggacgtattagtattgctaaactttggggttgtcctctttccaaacatggacggtgcaagaagagtagcgcacggatcatctgctgcttgcccgctctttgtgtatggtcctttaatggtgattttccaccatggagatgcagcagaagacaaaggagaagag

SEQ ID NO: 64113 - DNA, 171 bp, Glycine max
  Peptide Sequence Number=SeqID_155798
atgggggtgcaaatagcacccaggcccatttgggccctccagaagattcctccagaaggcgccgaggcgcttccgaaacgtttccgtaacgttttccgtgaggaatctcgcaaagatttcaaccgttcttcgatgttcttcattcgttcttcatcgtctcggtctcaaccg

SEQ ID NO: 64114 - DNA, 822 bp, Glycine max
  Peptide Sequence Number=SeqID_155799
gcgtggaggagttcgttgaggaaagacaaggagcttagaggcatccgaaacggcgtcatcggaggttatcatggatggcaaaaaattcacgcgcggggcttagattggctctccaagttgaaagttatcgatgaggaggacttcgaagctccggaggaagatgaagaagtccgagctctaaaattagagttagtgaaggcaagactcgccaaggagaagttcaaatcagctgctacacacatccggaaggagtgcaccgatttacaagaggaaaacgcggccactgcaagagcccttgaacaagaaaccaaaagggcccgcaaggaggaatatggccgagagaaatttcgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctagctatcatagggcaatacaaggaagagttgaaccagtctgtggcccatgaacaaaagctagtggaggattttgcacaagtgtatgccgaaaaagaagcaagagggagggtgattgatgcattgcatcaagaagcgactatgtggatggataggttcgccttgaccttgaatggaagtcaagacctcccgcgtctattagccaaagcaaaagccatggctgaagtgtgtacgccccccgaggagattcatgggctaatcaattactgtcaacacatgatagacttgatggcccatataattagaaatcgttag

SEQ ID NO: 64115 - DNA, 954 bp, Glycine max
  Peptide Sequence Number=SeqID_155800
atggccaagttcgatccagaaatagtccttgatttttatgccaatgcttggccaacagaggagggcgtgcgtgacatgagatcctgggtaaggggtcagtggatctcgtttgatgccgacgctatcggccagctcctgggatatccgttggtgttggaagagggccaggaatgtgagtatggccagaggaggaaccggtctgatgggttcgatgaggaggccatcgcccagctgctatgtataccggggcaggatttcgcccggactgctgcagggaggcgagtgcgaatcatgcgcaccaagatgaccaccctaacccagatatggatgacgttgctcctcagcaacatcctgcccagcaatcataattccgacctccccctgccgaagtgtcagctggtgtacgccatcctgacgtggatgagcgtccatgtggctcagttaatcgctgatgccatttatatttttgcaggtatggcgcctaccaggcatcctttggatccagataagtccaacagggccctgggatttccctcgctgatcacaggactctgccagtcattcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttgatgagcctcagcatgcagagccagggcttcgcttctttttcatgccctactccagaccagttcagggcagaggtcgcatggcccggagattggcccgaggcccaagcaggagaggcacccccagaagctcccgacggtggagaagaggcccacgaggacgaggagatggccgatttgcttgacttcttgggagggagtggagatacgtga

SEQ ID NO: 64116 - DNA, 156 bp, Glycine max
  Peptide Sequence Number=SeqID_155801
ctccactcattgagttggtgaggaaccatgttccctcatgggaagatgtccatgaaaggggtttcgagggaaggatcctagagtatgaagaaccacgggatttgaggtcaaatcctttccaaggtggaggggatgatgcaatcctaccccccaagg

SEQ ID NO: 64117 - DNA, 420 bp, Glycine max
  Peptide Sequence Number=SeqID_155802
atggagagacttggcagctcaagtagcgcccccaataatagagaaagagattatcacaatgatagtagacacgttaccagtgttctattatggaaatggtgggttacgcaccttcaaagctttgtggatttggtctttgccagtgaaaggatcgatgtgggtctgaaaagaggcaaatttagtcatcctgcttggacgaatgagaaaactggggcaaatgaagagggtgaggatgaagtagaagcccatgctgtgactgccattccaatacagccaagtttcccaccaacccaacaatgtcattactcagccaataacaaaccttctccttacccaccgcccagttatccacaaaggccatccctaaaatcaaccacaaagcctacctaccgcacttccaatgacaaacaccacctttag

SEQ ID NO: 64118 - DNA, 242 bp, Glycine max
  Peptide Sequence Number=SeqID_155803
atgtcattgcctaacgctgttcatgtgtctccattatcaagtgcgaagcttctggtgactgggaagcacaagaaaaagagaaggagtagagacgagagtcgtcatcacggaaagggcaggacggacgaaatcagtgtcctatctttgctttctcttatctccgacgagaggcccacttgggccctccagaagattcctccagaaggctgttgcttctggaggaagcaaccttgctcgcctgg

SEQ ID NO: 64119 - DNA, 543 bp, Glycine max
  Peptide Sequence Number=SeqID_155804
atggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggtcaagaatgtgagtatggccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatattttttgcagggccctggggatccccccactgatcacaggactctgccagtcgttcggagtccccgttgcacctaccaag

SEQ ID NO: 64120 - DNA, 201 bp, Glycine max
  Peptide Sequence Number=SeqID_155805
atggaagctttgatggtgtcgagaagaaatcacatgtttgtcatcatcaaaaagggggagaatgtgaatgtatgtatacatgatattgatgatgccaaagaagaatcaaacaaggttgcttcaaaggataagcatttgcttcaagatttatacaagattgcttcaacaaacaaagtcttgcttcaagattctttaagatga

SEQ ID NO: 64121 - DNA, 147 bp, Glycine max
  Peptide Sequence Number=SeqID_155806
atgtgggacatcccctttatcactgaaccaaaccaaaccctgacatatgtgatgcaatcctaccccgcaagggcattggatagaagactccaagtagattgggccagagatccaagggaaggccctagggttctcatgagccttagg

SEQ ID NO: 64122 - DNA, 630 bp, Glycine max
  Peptide Sequence Number=SeqID_155807
atgatcgacgcttttcttgcttatcatcatagcaaggaaaacccggtcattgctgttttggccgatgcctatgacacattcgacctaagatgcaaaaagagcagtgcgagaatagtctattgtacacctactctttatgtatggttggtctcccatgtttttcgtcatgaaagtagacctgtctgtcccttacaaggtcatcacatgtgcgctgaaaagggaaaagtgaattgggaagaactcttggcagccttaagacaactaggctaccctatgagaggggcgtcatcgaaagagatcattgcgcctttcgttgcacggggtttcagtggaggcaatgcaaaaatggttgaaggctatcataaatggttgaaggcttggacgcaatggataacttggcttctaaagctaaagagtccaagtgaggaagaagttgaagtccctgaggagggcgaagaagtgcaagccttgaaagtagagcttgaaagaatgagagtggtcaaggaaaagctaaagacgacagtcagcagagtcgggaaagagtgtgataagttgagggatgtcaacataactacggccgaagcattagagcgggaaacaaagagagcccaaaaggaaaaatggggctga

SEQ ID NO: 64123 - DNA, 564 bp, Glycine max
  Peptide Sequence Number=SeqID_155808
atggtcattgaccaattcctattctatgacttgacccaattatctagtgaaagtgtaccatttgaaggtacactgaatgatgattggaaatttgatttctctgtgcatgatatccgccagttggtttgcaccaaccaagcggatatgaccggaaggcttcttgttggatcattggcttttgaaagccgcatccttcactatctcattatgcgtattttacttccaagatcttcaaacgttgcacaggcacacttagtccgatatcgcatgcataaggcattgcgattaaatgttccattgccatatccacacctagtcactctcttcatccaacactttaacatccctcttgattctgaaccttatgttctaatcaagagatccttcttaatcggtgccattgtgattgcatcatttggttaccataaagtgcatgatggctcttgggtaaaaaaggatgctcaacccattgatgaagaaggacacttaccagttggagaagattcctctcttcttcaaaaggattttggacaggttcgatggtcttcaaacctatgttggtga

SEQ ID NO: 64124 - DNA, 994 bp, Glycine max
  Peptide Sequence Number=SeqID_155809
atgacggtgcagtttatcggtggagcacgtctgctggaaacggcagccgggatcccctacgagacagggttgattatcttcggggtaagcattgcgctgtatactgcgtttggcggattccgcgccagcgtgctgaacgatacgctgcagggaatggtcatgctgattggcacgatcgttctgctggtgggcatcgttcatgctgcgggtggacttacgcatgcggtggaaaccctggaagccatagatccgaaactggtctcgccgcaaggcgcggatgatattctttctccggcatttatgacgtcgttctgggtgttagtctgctttggggtgattggtctgccccataccgccgtgcgctgtatctcctataaagacagcaaagccgttcacaaaggcattattatcgggacgattgtcgtcgcgatcctgatgttcggtatgcatctggcgggtgcattaggacgtgcagtcatccctgaccttaccgtgccggatctggtgatcccgacactgatggttaaagtgctgccgccatttgccgccgggattttccttgctgcgccaatggccgctattatgtccactatcaacgcccagctactgcaaagctccgcgacgatcattaaagatctctatctcaacctgcgtcctgagcaggtagaaaatgaacgtcgcctgaagcgtatgtcagccattattacgctggtgttaggggcattgctgctgttagccgcatggcgcccgccggagatgatcatctggctgaacctgctggcgttcggcggccttgaagccgttttcctctggccgctggtgttgggtctctactgggaacgtgccaatgctgcaggcgcgctgggcgcgatgattgttggcggggtgctgtatgccctcctcgcaacgtttaagattcagtacctgggcttccatcctattgtgccttcgttactgctaagtttactggcgtttgtggtggggaaccgtttcg

SEQ ID NO: 64125 - DNA, 240 bp, Glycine max
  Peptide Sequence Number=SeqID_155810
gagggagaggccttgacggactcttcagagtgtaggccttggggatcaccggcattctcgcaaaacatcgtgaccctgactggtctccctatgatcttacttagtgagagtgacctgacaaacccatggtgtggtgtgtcttgttatgtactcctaagcgccccagggtggtttttcactgacatggtggatgactatgaagaacctcatgctagaggacacgggaacacaacgctttga

SEQ ID NO: 64126 - DNA, 291 bp, Glycine max
  Peptide Sequence Number=SeqID_155811
atgtcttcttcacctctaggatctcataatcactcacaaactcatctcaagctctcaaacggcttctgcttcgaaactcgcatctctacagatcttcacacagacaaatctctcagaactctttggaacttggacctttctctctctagaacttccttaacatgcaaaagcttcaagccagggccagattctggtgcatgcagaggtttcttcaagaaaaactccaaactctctttttcaaatctgaattcaggcttaaataggtggccttgttcgtgctcgtgcgcttaa

SEQ ID NO: 64127 - DNA, 318 bp, Glycine max
  Peptide Sequence Number=SeqID_155812
accaatggcttgcacccaattccggtgaaagttgaaaatcctggatttacacgcaattctcctcaaatttcagccagcccgcatcaattagaccttgcaccttacgcttcagagccctacaatgctcaatggaacgccccggggcttctccgtgacaaacacacgttgcgttcgagtcgtattctcggagaaatggaggttgatgaaccttggctagggttatggctaccattgaattatcaagtagatatgggagcaaactttgtggttgatttagggatggcctttgtggataaatgggcggtaggtaaggagaag

SEQ ID NO: 64128 - DNA, 1535 bp, Glycine max
  Peptide Sequence Number=SeqID_155813
ctctatgctagatactcgcgagctgtacagccaaacctgggataccggattgcgttataaagaaggcatttacgcaacacaattgaccggcagctacagccatagcaaggattatgattacgatcctcgccgcggtatgcatgacagctcggccagcctggtggattccgaacagtacaacctgcagtggggcaatacgctgcaggttggacagggtaccgtaagctctggcgtcgactggcagcaacagaaaatcaaaccggactccaccaccgtaaagggtgaaaaaagccaacgtgatgcaggcatctatctgaccgcgcagcaactggttggcccggtgacgctggaaggcgcggttcggggtgacgatcattccgagtttggctggcacggcacctggcaaaccagcgcggcctgggagttcgtcgagggataccgttttatcgcgtcgtatggcacggcgttcaaagcacccaatatgggccagctatacggcaactttggcaataacaccgatctgaagccggaagaaagcaagcagtgggaaggcggcgaccatcaaagggatgaagcgacggcgtcttttgataccggcccgctgacgcaccagattggttacgattatgtcgacccgcgcaacgcaaaaactcacgaagtgctgctgcgccgcgccaaacagcaggtgaaatatgagctggactggcagctgtatgactttgactgggcggtgacttatcaatatttgggtcaacgttatgacaaggactacagtacctatccggagcagagcgtgaaactcggcggcgtgagcctgtgggatctcgcagtttcgtatccggaagagaatactacctcactggaagctataccttctaacagcaccgccacacctcgcccgacggtgctggttttcgattccggcgtcggcgggctgtcggtatatcaggagattcggcagttgctgccggatctccactatatatacgctttcgacaacgtggcgttcccctacggtgagaagtccgaagagtttatcgttgagcgcgtgatggagattgtcggcgcagtgcagcagcggcatcctctggcgattgtcgtcattgcctgcaacaccgccagcaccgtttccttgccggccctgcgcgagcgtttcagtttcccggtcgtgggcgtggtgcccgccatcaagcctgccgcccgtcttaccgttaacggcatcgtcggcctgttggcgacccgtggcaccgtacagcgcagctacacccacgaactgatttcccgtttcgctaccgactgcaagattgaactgctgggctcttcagagctggtggagttggcggaggccaagctgcacggcgaagccgtgccgttgccggtactgaagaagatcctgcatccgtggctgagcatgcgcgagccgccggataccgtcgtgctgggctgcacccatttccctctattagctgaagagctgatgcaagtgttgccggaaggcacccggctggtggattccggcgcggcgattgcccgtc

SEQ ID NO: 64129 - DNA, 327 bp, Glycine max
  Peptide Sequence Number=SeqID_155814
catgtgggggatgagtcaactgaggccaccatcctagagccatttgttataggagaagaggcagatgagacacaggtgagacaggtagctgctaccactcccgagagatcccttgaggccactttagagcctcctgcaccagtggtggacctaccctcacctcagcatacagcagacccttccactcctatcttagagataccagaggacccgaccacaccagtcttggctatggacacttctcctccagctactccaatacttcatctaacagatgaagaggatgttcagacacaggacacccaggaccagtcacaggaattctaa

SEQ ID NO: 64130 - DNA, 618 bp, Glycine max
  Peptide Sequence Number=SeqID_155815
atggccccgaggaagcttgcctcaaagagatctaggaaggataaagcggctgaaggacccagttctgctcccgaatatgacagccaccgttttaggagcgctgagcacatcaagggatggtcatttctctgggagcgacgcgtccagctcagggatgacgagtataccaacttccaggaggagatagttcgccggcgttgggcatcactggttacccccatggccaagtttgacccagacatagtcctcgaattttatgctaatgcttggcctacagaggaaggcgtgcgagatatgcgatcctgggtgaggggtcagtggatcccgtttgatgcggatgctcttagccagttcctgggataccctttagtgctggaggagggccaggaatgcgagtatggccagaggaggaaccggtccgatgggttcgatgaggaggccatcgcccagttgctatgtataccggggcaagattttgcccggactgctgctgggagacgggtgcggatcatgcgcaccaacatgaccaccctgactcagatctggatgactttgctgctcagcaacatccagcccagcgatcataattctgacctccccctgccgaagtgtcagctg

SEQ ID NO: 64131 - DNA, 255 bp, Glycine max
  Peptide Sequence Number=SeqID_155816
atgtgtgatgcaatcctccctaggaaaggaccagttaccaaagccatgagcaagaggctccaagaggattgggctagagttgataaagaaggccttagggttctcatgaaccttaggctaagctctagcttctcaaggaagcttctcaaggagcttctcaaggaagttttctcaaagaaacttctcaaggaagttttcttaagaaagcttctcaaggaagttttcttaagaaagcttctcaaggaagctacctag

SEQ ID NO: 64132 - DNA, 57 bp, Glycine max
  Peptide Sequence Number=SeqID_155817
atggtggagaagttcctgaagaagtacttcccaaagtccaagaccgctgaggggaag

SEQ ID NO: 64133 - DNA, 63 bp, Glycine max
  Peptide Sequence Number=SeqID_155818
atggaagagaagcgaaagacaaaggagaagaggtcagaggaggtgccatccactaaggaataa

SEQ ID NO: 64134 - DNA, 165 bp, Glycine max
  Peptide Sequence Number=SeqID_155819
atgatcctctccaatatgattgctctaaatctagaacagacccggtgggtatataacctcatcaacttgcgaaagttgtttgaatggccgcgtaagttccagctaagattgaaccctgccaagtgcactttcagggtcaagtcaggaatactactcggcttcgtt

SEQ ID NO: 64135 - DNA, 252 bp, Glycine max
  Peptide Sequence Number=SeqID_155820
atggccacatcacaagatggaaatggtggtgtccttcctctagcattcgcggtggtcgaagcattggtcaaatcaacgtacagtaggtgtcgaaagaactttgttgagcgtggccgccaagcccaaacacagttaaatgaaggacaagtatattgttcaaagcttgttaaagaacttaggaaaaatcaagaacaagcttgttcgcacatcgttcgcgtgtgtgatatccactccacacacggtttgaagtag

SEQ ID NO: 64136 - DNA, 501 bp, Glycine max
  Peptide Sequence Number=SeqID_155821
atggagagaagtatgatagatgctgccagtggtggagcccttggagacatgacccctgctgaagccagaaatttaattgagaagatggcttcaaactcccagcaatttagtgccagaagtgatgctattttcattagaggagtgcatgaagtagccacgaattcatctccatcaggtgagactaagaagcctgaaggtaaactagatgccttagttaacctgaatgttgttggcccaagcaaactatacgttcctccaccaatccatcagcaacaacagcaacagccccagaaacagcaagcagttgaggctcctccacaaccttcccttgaagagcttgtgaggcaaatgactatgcaaaacatgcaatttcaacaagagaccagagcctccattcagagcttaactaatcagatgggacaattggctacacagttaaatcaacaacagtcccagaattctgacagattaccttctcaatctgtccagaatcccaaaaac

SEQ ID NO: 64137 - DNA, 215 bp, Glycine max
  Peptide Sequence Number=SeqID_155822
gttatgaagcttgcttgtggggcttctatggaggctggatctttgagcttcaatggggtcctttaatggtgattttccaccatggagatgcagcgaaagacaaaggaaaagagcttggagaggatgcttcaatggaggaaaagaaagaggaagagaaagagagaggggggagcacgaaattgaaggaagaaaaagggagagaagttgaactttga

SEQ ID NO: 64138 - DNA, 585 bp, Glycine max
  Peptide Sequence Number=SeqID_155823
atggtgaggctcatgaaacaggccaatgtattcatgttgaagaaaacacacaagaaattcattatatgggaaatcaacagagacaagggtatactcaaggaggattttcaggattctagcagagtccttataatcagcaaggacagtggaggtcgcacccgggcaatcagttcaacaaagaccaggatagctgacaagtcatccaacagttttgtggcaaatacagaaaagaatgccaaggaggaatacaaagctgtgatgacaaggagtaaaaggtttgtggaggatgaggaagaggagagtgttgggctcaggaagaaagctattgaaaagaaaggtactgatggtaagaaaaatgaggtgagaggtgaaaaaaatcaggaaaaagaaaaacaaataatggtcaagaaaaaagaattgaatgaccaagaaaaagaaaaagaagtagaaaaagaaaaagaaaataaagaatttgaaaaagatgaaaaaatgagaatgaaaagaagagtagaagtgaaaaaagctgtgaatgaagatatggaagtaccatatcctgtggtaccttccaagaaggagaaggactga

SEQ ID NO: 64139 - DNA, 288 bp, Glycine max
  Peptide Sequence Number=SeqID_155824
atgtcttccaaggttattttgaggatgccaaagaatcaagggtcaagaaaattgcaaagattcaagaatcaagtttcaagaatcaagattcaagattcaagaatcaagtttcaagaatcaagattcaagaataatcaagatcaagattcaagactcaagattcaagaaataagagaagactcaataaagataagttctaaaaagtttttcaaaacattgagtagcagaagaagttttcacaaaatcattactaaagagttttactctctagtaatcgattaccagaag

SEQ ID NO: 64140 - DNA, 129 bp, Glycine max
  Peptide Sequence Number=SeqID_155825
atgggaggagcttgccacccagctcgcccaggcgagcaagctttcgaagaagttgcgaatactcacggattgcgaaaaacacctcctttcgatttccgtcacattacggaattttcacggatcgcgtaa

SEQ ID NO: 64141 - DNA, 561 bp, Glycine max
  Peptide Sequence Number=SeqID_155826
atggttaaggaggagtgtaaggaggtaagtgtctcctccaagaggttagctaagaaagaaagtcattttgaaataaagacaaatattaaagaaacttcccctcttagacaacctccgcatcttctcctttgtaaaaagacacttcttagcactgccacacctcttgggcttgaggttattccccaagtaaaggagttgttggatgagggtttggttcgtaagagcttaaatccttgtgctttgttggtgcctaaaataggtattattaggcaccaaatccctaaaataagtgatatgatgaatgttttgagtggtgcaaccctcttttgtaaaatcactcgtacacctaacatcttcatggtgtgtgtacatagggacccattaggtagtgatcaaggggttcccatgaaccctaggagaataaaggtcattcctaagtggctcactccaccaagtgttgagggaaggagcccagagtatgaagaacctcgggatttgaggtcaaatcctttacaaggtgaagggaatgatgcaatcctaccccgcaagggcattggatag

SEQ ID NO: 64142 - DNA, 99 bp, Glycine max
  Peptide Sequence Number=SeqID_155827
atggagagtttgagaaacttggaccttagcttaagtaattggcttcaagtagtgagtacacttccatctctttcagaactacacttggagagctgttga

SEQ ID NO: 64143 - DNA, 393 bp, Glycine max
  Peptide Sequence Number=SeqID_155828
atggatcatgaggatccatgcatgcatttttctaccttcataggactatgcagtactatgagagcttctaacgaagatgttgaagttgtctacctcagagcttttccattttcattagcaagtaaggcaaaaacatggctccaatcacatccaaataaaatccgcaacacttgtggtttgaaacttcaaaccataatgatccttgatgcctcagctggaggcactatgatgtccaagagtccagaggaagctattgtcatcattgactccatagcaactagtgatcatcaaagtcatcatgatagagctccgactcaaagaaaaggtataatggagctggacactcatagtgcaaattctagctcaaaacaaactcttgacacaacaaattga

SEQ ID NO: 64144 - DNA, 294 bp, Glycine max
  Peptide Sequence Number=SeqID_155829
atgttgcgaaacttcacggattacgcaacaatgctcgttttccttctggaacattgcgaaactttacgaattatgcaacgatgcttgtttcgagggttccgaagggagcaaacaaggttcaaggaccgaccacaagtactctcggacgaaattagggttcttttgggctttttgtcattatcaaaactacttgactcatacttgattcatcatcatgaagcttgcttctatagtgaatattgggttagcgcgtgtttttctcgctcagcagatggactgaagcggtgcgcttag

SEQ ID NO: 64145 - DNA, 223 bp, Glycine max
  Peptide Sequence Number=SeqID_155830
tggtcaaggggttcccatgaaccctaagagaataaaggtcactcctgagtggcccactccaccaacaccactcattgagttggtgttgagggaaggagcccagagtatgaagaacctcgggattagaggtcaaatcctttccaaggtggagggaatgatgcaatcctatcccgcaagggcattggatagaagactccaagtagattgggctagagatccaagg

SEQ ID NO: 64146 - DNA, 520 bp, Glycine max
  Peptide Sequence Number=SeqID_155831
atgggtgaagcagaggaggtgcaagagaagatgaaggccgacatggaggccatgaaagagcaaatggccacaatgatggaggccatgatgagaatgaagaagataatggaagccaatgcggttatagttgccgctactagcgctgtcactaaggtgaacccgatgctcccatctggcctcaagcaaatgaatcatccaacctcaaatatggatgtcaataactccactcccatactcattaagagccaacaacctcaatctgatcatgcacatgtctctcgacccatggaggagacacatgaaattccccaccatgatctagccaactttgagccttgcctcggatatgccgctgaagggcaagcagttggtggtatacccctgcaaaacactttggagggccctcagttttgcccacaaacacagccattgcattttgcggtgggaagagcccctcctgctatggccgaaaagggaaaggcggatcatctagaggaaaggttaagggccattgaaggag

SEQ ID NO: 64147 - DNA, 297 bp, Glycine max
  Peptide Sequence Number=SeqID_155832
atgaagctcaagtctcgtttccgacttcagaaatccagtatgtcaggcaggtccctgtatgacatttatgagaaacctgttgagttattgtgggatgggaaaaaatttggcgtaccaaatgcagatgcatccttcttcttgacatatttttatgtaaatgaaataatatcaggtttatggatgagtgaagttcaagctttggtcatgcttcaatgtatggattccttgagcctcaatccatacacaatgcaaaggttagacgtgctgaatgtcgacaatacattgaaacatgggtga

SEQ ID NO: 64148 - DNA, 354 bp, Glycine max
  Peptide Sequence Number=SeqID_155833
atgcgtctaccggggaaggagagtctgctgatgaaatctcccataaccataaatgagattttggatgttagcatttcgtttctaaatggctatttagaggaaacactgggttcgacaaaaatagaagaaatccactcaaagtgtatcaatctcgcacaggattttggctccaaagcttgtagaatggctagacatgatacatgtcaaggcttggtttggttcaaggataaaagggatgccccacattatttccatgacacaaatgcaaaaatgatgatttggaaactttatgcaaaactggtcatgcatgcgcctatgcggacgctcaagtgtcaaatttttatggtcgggtga

SEQ ID NO: 64149 - DNA, 183 bp, Glycine max
  Peptide Sequence Number=SeqID_155834
atgaattctgtttgggtttttgcttggatgtttgtggaagctgaggatgctgatggggacccggtgttagagagaaacgaggatatgggctacatgggagtacgtgagctcagatgtgaggtggaacaggggatggtgggtttagcgcgctttgtggatgtggaaaacttgttgaattctgtg

SEQ ID NO: 64150 - DNA, 477 bp, Glycine max
  Peptide Sequence Number=SeqID_155835
atgagaaaaggcaagtttgaatatgcctccaacgttgcccccaaaaacaatagaagagccccagtggtgggcacacggaaaaaggaaggagatacccacgcggtcaccaccgccccaacatggatgaaaacgccccaaaatgcccaaaactcataccaacacaaccacccgaacttttcgatccgagccggaagttccctcccaactcaagtggaagggcctcccgcaacagaaaaaacgtctacccaacacacagctccagccactccccggccagccaataatacaactcctggcgcgagctataacaatgcacgacgccccccgaaagacgagttctctcctatttccatggcatattccgagttgtggccctcattattggaaaatcatttggtggtggccatacccgggaaggtcttccagccaccataccccaggtggtacaactcggaagccacatgcgcataccaatag

SEQ ID NO: 64151 - DNA, 132 bp, Glycine max
  Peptide Sequence Number=SeqID_155836
atggcacatcaggaagacaaaggaaaggagcttggagaggatgcttcaatggaggaaaagaaagagggagagaaagagggaggggggagcacgaaattgaaggaagaacccgggagagaagttgaactttga

SEQ ID NO: 64152 - DNA, 754 bp, Glycine max
  misc_feature (80)..(80): n is a, c, g, or t
  Peptide Sequence Number=SeqID_155837
ctaggggatgtcaacatgactacggccgaagcgttaaagaaggaaacaaagaggggcccgaaaagaagaatggggcaaanacaagttctgaggggctctatggggcagcaacaacgagctcaagcttcaaagggctgaaagggacaagtcaagggtggaaagatgagcatgcgaaggtatcaactctgcaagtggaaaaggaagcaagagaaagggtgatagaatcattgcatgaggaagctacgaaatggatggatagattcgctttcactctaaatgggagtcaagagcttccaaggctgttagccagagccaaggcaatggcagacgtatactcagctcccgaggaagttcatgggcttttcgattattgccaacacatggaagtgcaagagcagatgaaggctgacatggaggccatgaaggaccaagtaacctccaagatggaggccatgttgagtatgagaaggatgatggaggacaacacagccgcaatcgccaccaccagtgccgccgctgaggcagatccaactcacccatccggcataaaccaaacaagtcgtccagccccagacgtggtaggtcagggaggagaagtgttgggcagtacgagcggtcctcatattgtgcaaagtaagaattctttcccactgtatggcttgccacctaactatacacctcccaatgcggtacatatgcccaacaagaacgccaaccactccattcccgttctccttgaaagccagcaacccca

SEQ ID NO: 64153 - DNA, 339 bp, Glycine max
  Peptide Sequence Number=SeqID_155838
atgggtgccaagcacctcacaaggaccaaacaaaagttgcatgtcatccatgcaaaggtctcccggacgaaaattaggaatgtttatacggataaccactcgggtatttccgccagtcagcgtgactcaaatgtcagtatgacagatctagtgagcgcggaagatgacgtaaatctccgcgtgtcaacaggcttgtcgaccgcgattgacgaagggcgcagaatgaccataatttgtctctgcgtgccatcggacacaactgtgtctgaatggcaaaaaggtgtgcagaatgaccataatttgtctccgcatgtcatcgagcccgccacctctggatga

SEQ ID NO: 64154 - DNA, 201 bp, Glycine max
  Peptide Sequence Number=SeqID_155839
ggaaagggaagaatcaaaagaattctcagactgtgtcgttttgaattctttgacaagggagaagggagacacaaaagaattcaggcgggagaagagaatgaaaagatcaatagaacaagttttcaaggtttggaaaaccagaaaacttcagaaagcttttggtacaaagaagaagaagaagttcaaagagattcaaggctt

SEQ ID NO: 64155 - DNA, 394 bp, Glycine max
  Peptide Sequence Number=SeqID_155840
gggttgtattaattataatcccgtcctcgccataagacagcttggctaccccatgagaggagtgccatcagatgaaagcatcacgcctttcatcgcacggggtttcagtgaccacaacgcgagggtactccaaggagttcgcaaggcatgggatgcggcagtccggacacaaggattggattggctcccaaatctaaagactgtgagagacgatgaggttaaaacttcggaagaaagtgatgaggtacaagccctaaaggcagagcttgaaagagcccgggtagtcgaagagaagttcaaggcagcaataatgagctcaagctccgaagaggtgaaaggaatcatcacgggtcaaaggcatgatcttgaaggacgagctaaaggcttgccttaa

SEQ ID NO: 64156 - DNA, 409 bp, Glycine max
  Peptide Sequence Number=SeqID_155841
atgtcgctggtcatgcccatggccaagtttgatccagatatagttctcgagttttacgccaatgcttggcctatagaggagggtgtacaggacctccggtcatgggtaaggggccagtggattcctttcgatgcagacgccctcagtcaattcccgagatacccgctagtattggaggagggtcaggagtgcgaatacggtcagaggaggaaccgggccgatggatttgacgaggaggccattgctcagctgctatgcataccaggtcaggattttgcccaaactgctgccgggagacgggtgcggatcatgcgcaccaacatgactacgttgacccagacatggatgacgttgctgctcagcaacatcctggccaacgatcataattccgacctccctctgccgaagt

SEQ ID NO: 64157 - DNA, 304 bp, Glycine max
  Peptide Sequence Number=SeqID_155842
accgccaaaggcaagtcgaaaatggggtggtcggaataccgagaaaatatttggagggagtcctctttccaaatgtggatgggttggtggacctggcagcgatcgacatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatggggggcgtctgttaattggttccctcgctag

SEQ ID NO: 64158 - DNA, 210 bp, Glycine max
  Peptide Sequence Number=SeqID_155843
atggcggggtgtttcagaaccaaccagaggatactggtgagaaaggggaataaagatgaactgggtaaaacaataggaagagaacaggagaaacctcccaagtctcaaattggttgtgagaatgggtccaaattctctaattggccgaatgagagagaagtgagatggaagggttttggagaaagccacgagctgatctggaaaatgtga

SEQ ID NO: 64159 - DNA, 474 bp, Glycine max
  Peptide Sequence Number=SeqID_155844
atggtagaagtctccacagaggccattgcctccctcgcccagtattatgatcagccgttgaggtgcttcacctttggggacttccagctatcacctatggtagaagaatttgatgagatcctaggatgccctctagggggaaggaaaccatacctcttctcagggttctatccctcattagctagaatttccaagatagtccaaatctcagcgcatgaattagaccacaagaagcaagtcgaaaatggggtggttggaataccgagaaaatatttggaggcaaaagcaagaatcttggcaggtaaaagcgagtgggccccgttcatagatattctcgcactgttgatcttcggaggagtcctctttccgaatgtggatgagttggtggacctagcagtgatcgacgcttttctcacctatcataaccacaaggaaagcccggtttgtcgctattgcttagccgacctattatga

SEQ ID NO: 64160 - DNA, 357 bp, Glycine max
  Peptide Sequence Number=SeqID_155845
atgaggctaaggagtcagtctgaaaaacctagcatgttgctatttatagctagggtattagctgagggagagactctacccgcatactctagatattgcaggttgcctacagacttcagagagataaaggttgctttatgcatacctggccgagggttcatcttgaactctgagggccatcctgggaggattctcaggaaggatttgactacactagctcaagtgtggagtgtcctctcatactccaacttagcccccacatcacatacctctgatctgacagtggacagagctaggctgatctttgggctagtctctcacttggatattaacataggagcactgatttctagctaa

SEQ ID NO: 64161 - DNA, 87 bp, Glycine max
  Peptide Sequence Number=SeqID_155846
acttcaagatcaagcatcaagaatccaatccaagattcaagattcaagagaagaaatcaagaagcaacaagtcaagacttcatatag

SEQ ID NO: 64162 - DNA, 193 bp, Glycine max
  Peptide Sequence Number=SeqID_155847
gggcattgcacaaggccgaaaggcatcctcctgtaggcaaaagtgtcgaagggggcaggcgttcaagcatctgatcaatgaatggcaggggaaaatggtcctttttggtaacctggttcagcctcctatagtcaatgcagactctccaacggacgggactcacccattggctgccggagatagggatgaatga

SEQ ID NO: 64163 - DNA, 184 bp, Glycine max
  Peptide Sequence Number=SeqID_155848
gcggtgccttctggtggaagcaacccagctcgcctgggcgagttgggtggcaaccacctccctcttttcccctataaattagggaaggagggtagaacaaaaatgttcaaccctcctgacgtttccgtgggctatttcgcgaaggttttccaccattcttcgtcgttcttcggtcttcaaaccg

SEQ ID NO: 64164 - DNA, 162 bp, Glycine max
  Peptide Sequence Number=SeqID_155849
atgattatgaggagccaagacatttatagtagccaagatgaggctactacttcaccttcctctagtgaaagtgaagaagcaaaaggagaagaatctagtgaagaaatctacccccaagaagaaggacaaccattaatggttagtgtaaggaggtattattag

SEQ ID NO: 64165 - DNA, 978 bp, Glycine max
  Peptide Sequence Number=SeqID_155850
atggccaagttcgatccagaagtagtccttgagttttatgccaatgcttggccaacagaggagggcgtgcgtgacatgaggtcctgggtgaggggtcagtggatcccgtttgatgcagatgctatcggccagctcctgggatatccgttggtgctggaagagggccaagagtgcgagtatggccagaggaggaaccggtctgatgggttcgatgaggaggccatcgcccagttgctatgtataccggggcaggattttgcccggactgctgcagggaggcgagtgcgaattatgcgcaccaacatgaccaccctgactcagatatggatgactttgctgctcagcaacatcctgcccaccgaccataattccgacctccccctgccgaagtgtcagctggtgtacgccatcctgacgcggatgagcatccatgtggctcagttaatcgctgatgccatctatatttttgcaggtatggcgcctaccaggcaccctttggatccagataagtccaacagggccctgggatttcccgcgctgatcacaggactctgccagtcgttcggagtcccgtcgcactaccaaggtgattcggccgcccatcaccccgggcttttattgagaagtactgccgcaggcgcgccaccaccacctcatcaggctggccaggctggggcatttgacatggagcagtatttacggcatttggttcgccagcaggcggccaaccaccgagcacatgtacagacccatgattttctgtaccagatgagccttagcatgcagagccagggcttcgcttctttttcatgccctactccagaccagttcaggacagaggttgcatggcccggagattggcccgaggcccaagcaggagaggcacccccagaagctcccggcgatggagaagaggcccacgaggacgaggagatggccgatttgcttgacttcttgggagggagtggagatacgtga

SEQ ID NO: 64166 - DNA, 204 bp, Glycine max
  Peptide Sequence Number=SeqID_155851
atggcacatcaccttcccattgagagaaaaaggaaaggcataaagtttcatgcattctatcgatacacaattttgtttcaccatgttggtcaacttgatcaacttcctcaggttgttatccaacatctgttagaacccgtgcttgaagtcaaatattactccttcaagcaactcggggagttggatggtattgatttcccctaa

SEQ ID NO: 64167 - DNA, 217 bp, Glycine max
  Peptide Sequence Number=SeqID_155852
atggataatgaaaagggcgtgcaggaacagatgaaggtcgatctatcggccttaaaagatcaaatggcttccatctcggaggtcatgttaaaactccaaaaaactatagaggataaagtcacggcaaccgcctccagtatagttagggaagtggagccggtgcttcaacccgccttaaatccgggccgagacagaaacacggccgtgtttgtcgaag

SEQ ID NO: 64168 - DNA, 321 bp, Glycine max
  Peptide Sequence Number=SeqID_155853
atggtctctggtaatcgattaccaagggggtgtaatcgattaccaggcttgaaaacgaggtcaggaagccatgagggcttctggcagcaggttgtagaggcctctggtaatcgattaccagtctgtgtaatcgattacacagaggaatgggtcactggtaatcgattaccaggttttcatgtcctgaagctgtgtgattcgagtttggcctctagtaatcgattaccaaggctgtgtaatcgattaccagagatgaaaagctttaagataccccttttacttgcatgtagtggctatgagacgaattgtgttgcggcatag

SEQ ID NO: 64169 - DNA, 495 bp, Glycine max
  Peptide Sequence Number=SeqID_155854
atggtgaggctcatgaaacaagccgatgtattcccattgaagaaaacactcaagaagttcactatatgggaaatcaacagagacaaggatatactcaaggaggattttcaggcttccagcaagaggactcctaagctggaggagactttgactcagtttatgcaagtaacattgtcaaatcataaaagcactgagtcagcactgaaaaaccttgaggtccaggtgggacaactggccaagcagatagctgacaagtcatccaacagtttcatggcgaatacagaaaagaatcccaaggaggaatgtaaagctgtgatgacaaggagtaagaggtttgtggaggcggaggatgaggatagtgatgtatccaagaagaaagctgcagaaaagaaaggtactgatgaaaataaagatgttgtgaaaggtgaaagcaatagggaaaaagaaaaacaactaatggtcaagaaaaagaaattaaatgaccaagaaaaataa

SEQ ID NO: 64170 - DNA, 213 bp, Glycine max
  Peptide Sequence Number=SeqID_155855
atggactggagcagtgtgcttcgctggatgacccttcgcttagcgcaaatgcacaactcatccttcttccagattcttcctcgcgctcagccgaggagtgttgcgctcagcgaatggttcgccaagcccgaagattggcttagcgagagaatgaaaatcaacactttacaaacttgcctaattatcctgaaatttagagaaaaggattattaa

SEQ ID NO: 64171 - DNA, 351 bp, Glycine max
  Peptide Sequence Number=SeqID_155856
atggatatctctgaagatactgacatccctgtaatcttggggaggccattcatgttgaccgcaagctgcatagttgacatggggaagaggaagctggagttaggttttgaagaccaaaaaattgattttgacttgtttgttgaagacaagcctgctccagaacacaatgtttgcttgcgggtaatgggagaagttcaagaggttctgaaggtgagaatcaaaatgatctattgtcgccaagcgcaattccttacggccttaattgaggaccatgatgctaagcgccagtcatggcagctaagcgagattctttgcggtaatatgagcgctaagcgagtacctctcagctaa

SEQ ID NO: 64172 - DNA, 168 bp, Glycine max
  Peptide Sequence Number=SeqID_155857
atggcaacttccaagaatagtgtagggggttctgtgggttcaagcgagcgaggacaatgtgggttttccggtagtgtagggggtactgtgggtctgagcgaggacaatgtgggggtcgagggagtggtttccgacagttttcaggcgggaggagaaagacaagagtga

SEQ ID NO: 64173 - DNA, 303 bp, Glycine max
  Peptide Sequence Number=SeqID_155858
atgtacatcaagtatggcccaaaatacatcatgaagcatagccaacaaaacaagttgtccaacatttatccaatatacaatgcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 64174 - DNA, 411 bp, Glycine max
  Peptide Sequence Number=SeqID_155859
atggagagaagtatgatagatgctgccagtggtggagcccttggagacatgacccctgctgaatccaaaaatttaattgagaagatggcttccaactcccagcaatttagtgctagaagtgatgctattgtcattagaggagtgcatgaagtagccaagaattcatcttcatcagccgagactaagaagcttgaaggtacaatcccgggtggaggaatcatcccaaccttagatggtcgaatccttcacaacaacagcaacaacaacaacaaccttattttcagaatgctgctggcccaagcagaccatacgttcctccaccaatccagcagcaacaacaacaacaacaacagccccagaaacaacaaacagttgaggcccctccgtaaccttcccttgaagaacttgtga

SEQ ID NO: 64175 - DNA, 348 bp, Glycine max
  Peptide Sequence Number=SeqID_155860
atggccattattgtcaatgcggaagctagtggttacgtgagcatgaactactaccaatatatagatgttgtttacaccaatgagcacatcttaaaagcatgctccgcacagtggtggcctcttgggaatgaagcggcaattcctccttctgatgaggcatggacactaatccctgacccaactacaattcgtgcgaaaggtcggccaaaatcaacaaggataaggaatgagatggattgggtcgaaccatctgaccaccgacaaaaatgtagtagatgtggagctgaagggcacaataggcgccgatgtccaatgcaatctgaccgtgggagtaatttatttaattga

SEQ ID NO: 64176 - DNA, 376 bp, Glycine max
  Peptide Sequence Number=SeqID_155861
gcccactcgggccttccagattcttcctccagaaggcggttgcttcgggaggaagcaacttagctcgcctgggcgagctgagctcgcctgggattattgtttccgtgaagaaaatccaagccgaggcacttccgtaacgtttccgtgggtaattacgcgaagattttcaatcgttgttcgacattcatcgttcgttcttcgttttcttcggtcttcaactgctgttttgggtgaaaaaaattgtttccgtgaagaaaatccaagtcgaggtgcttccgtaacgcttccgagatttttccgtaagcaaatccgtgaagcttttcctccgttatctaccgttcttcgttcgttcttcgttcttcaacggttggcttaa

SEQ ID NO: 64177 - DNA, 411 bp, Glycine max
  Peptide Sequence Number=SeqID_155862
atgaagctgacaggttcaggtgctgctattggtggaggcatttcaatttgcttgccagacctcaaaccatctgccccatctgatttgttagactctgaatggaggctcttgtctcttgctgaaattgcatattctggatggtcatttgcctcactaactcttctaaggaaggttgaggaggagcctcagttgcttgttgtctttgttgttgttgttgctgttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 64178 - DNA, 612 bp, Glycine max
  Peptide Sequence Number=SeqID_155863
atgttgtggaagcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgccccgaccgccacctaatcgtgatggcggcgcagctaattcgtgatcgagtagagatggagtgcctagagggagcttgggagaccctcgaaggcaacacgaggtgccgatttcggggcaccattcgattcacggctacttctttggtgcatccagatgaacctgcatggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 64179 - DNA, 213 bp, Glycine max
  Peptide Sequence Number=SeqID_155864
atgtcaggactcattcgcgattctcctcaaatttcaaccagcccgcatcaattagactttgcaccttacgcttcagggttatacaacgctcaatggaatgccccggggctcctccatgataagcacacgtttcgtccgagtcctatccttagaaaaatggaggttgaggaaaccattgcattatcaagtagatatgggagcaagtcagcatag

SEQ ID NO: 64180 - DNA, 369 bp, Glycine max
  Peptide Sequence Number=SeqID_155865
atgctgatctccccctgcgaatggatcgtgcccgcaagacacccagtagacccggagaagtccaacagggtcttggggtttccagctctgattatgggcttctgtcagttctacggagtgcctgtcacccccggcaaggtcatcaggtcccctactaatcaagctttcatcaagaagtactgcacccccaggcaggcgcagggtgaaacaccacagcagcctggggatggttggcaacgggcaacaaatgcaccgccgccacctccagagcccctcagctcatccacaaaaaggcgtccagctcaagacgttaaagaagcgctactaggaggcaacctagtaccttttgaatctatgcttgttatttga

SEQ ID NO: 64181 - DNA, 954 bp, Glycine max
  Peptide Sequence Number=SeqID_155866
atggtagaagtctccacagaggccattgcctcccttgcccagtattatgataagccgttgaggtgcttcacctttggggacttccagctatcacctgtggtagaagaatttgaagagatcctaggatgccctctagggggaaggaaaccatacctcatctcaggatattctcgcactgttgatcttcggaggagtcctctttccgaatgtggatgggctcgcgcctgtcaacttggctacccaatgagaggggcgccactagaggatgagctcgcgcctgtcatttcacgaggcttcaataagaccaacgtggagacacttcagaagatccgcaaggcatgggaggtgttgcaaaagaaggacaaggaactctggggcagtaacaatgggcctatcggtggctaccgtaagtggttgaaagcccacgtgcaaggtttggattggctcccgagtttgagaaccgctaaaagggaggaagttgaggcaccgaaggaagatgaagaggtgcaggcccttagggcagaactcgagcaagcccaaacagtcaaagaatggttcaaatcagcagctctaaagatccgaaaggagaatgccgaactgagagatataaatgtagctacctccaaagccttggaactagaaatcaagagggcttgtagggaagagcacggccggaacaagttccaaggggctctgtggggcagtaacagcgagcttaagctccggagagaggaaagggaccaatcacgaatagacagtttgatcttgaaagatgagttgaaggtttgctcaaggtccaaaagaaacttgtctcagcgattatgcgaaatagagaccaacatgctagccatcgtcagcacgtaccaagaagaactaaatctagccacgacccacgagcatagagtggcggacgagtatgcccaagtgtacgcgaaaaaagaggctagaggaagg

SEQ ID NO: 64182 - DNA, 522 bp, Glycine max
  Peptide Sequence Number=SeqID_155867
atgggtgatcaagaggagacacaggaacagataaaagtcgacatgtcggctttgaaagaacaaatggcttccatgatggaggccatgctaggaatgaggcagctcatggagaaaaacgtggccaccgctgccgctgtcagttcggttgtcgaagcagacccaactctcctagctaccgcgcaccatcctcccccaaacgcagtaggacgagagaagagcacacaggggcacaacagcaacccccatttgggatacaatcgggtggcttacccttatggattgtcgcctaattacatgccgctagtcatgcacgatgacgcgggtcatgtcccttcccccatccttgaaagggagcctcctcaacagctccacgaggcccatgaagatcatcaagagcatgcccaaggggaagttgatttctatcccccgatccccttcgaggggccggcacccaacacattgcctcagcacaacctcacaacacaacctatattcttgtccacagaaggaccacccctggcg

SEQ ID NO: 64183 - DNA, 117 bp, Glycine max
  Peptide Sequence Number=SeqID_155868
atggaagaagtggtacctagagatatgtcgcgagggtcaggagaccttggggacgtcaggtgggggtgctactgcccaaaaccaagcttggctaatcctgacccaacccgggcatag

SEQ ID NO: 64184 - DNA, 302 bp, Glycine max
  Peptide Sequence Number=SeqID_155869
atgcctaatgctggagccaatcataattttgcatcatcatccaacaccgataccaaaaacatgaaatgcttcaaatgcttaggtagaggacatattgcttctgactgtccaaccaggatgatggaagcttgcttgagaagaggtgagaggaggcgccatccactagggaataagccatggaagaaggagcttcgccaccaagaatgtgccttggataagaagcttggagaggatgcttcaatggaggaaaagaaagagagagaaagagagaggggggagcacgaaattgaaggaggaaaagg

SEQ ID NO: 64185 - DNA, 304 bp, Glycine max
  Peptide Sequence Number=SeqID_155870
gtacttacccgttgaagactgaagaaaacgatgaattgttgaagaacggtcgagaatctttgcgtaattactcacggaaacgttacggaagcgccttggcttggattttcttcacgaaaataattttcctcagcaatttcaagagaataagaagtgccaagaaggctgaaccccttctcccttacctccctccccctatttatagcaaaataggggaggagcttgccacccagctcgcccaggcgagcaaggttacttcctccagaagcaacagccttctggaggaagaatctggaaggcccaa

SEQ ID NO: 64186 - DNA, 300 bp, Glycine max
  Peptide Sequence Number=SeqID_155871
atgagttctggatgtttgctagtagatcccaacggtcaaaatcttgggaggattgatggggacccggtgttgagagaaacgaggatatgggctacgtgggagtacgtgagctcagatggaggtgggcaacaggggatggtgggtttatgcgcgcattgtggatgtggaaaacttgttgtgcaccatcgcccaccgccacctagtaccacatgtgatggagtggtacctggagatatgtcgcgagggtcaggagaccttggggacgtcaggtggggtgctattgcccaaaaccaagcttga

SEQ ID NO: 64187 - DNA, 339 bp, Glycine max
  Peptide Sequence Number=SeqID_155872
atggggccaaggacagggtatggaaaaatctggaataagtggctgaatcccaaaggaatagaggagcaatggggaataacctttgagaaacaacatctcattcagcatgcttgtgtgagcttcaaaacaaggaaagggaaacaaggctcgaaagggctatcaaaggaattaattcaaggtaagtccatttggctagaagcttataagaacaaaattgccttaatcatttccaaatatgcatgtgaattaggaagcatcaacaagaatcaagccaaggctatggggcaaaacacaccaaatgattatgatgatgaatggctcaaattctcacaaaggtaa

SEQ ID NO: 64188 - DNA, 1110 bp, Glycine max
  Peptide Sequence Number=SeqID_155873
atggctacctcaccaaaagaaacttcagctcctgggtcacccgctgtaccatcatctccatcatccaccaaagcaccatcaatccaggaacaacctgaattccatatccaacccatacagatgattcctggtcaagcccctgttcctgaaaaactggttcccaaagaacaacagggtgtgaagatttctgaaaaccctagccttgcaacaagtcctagggaagtagacacagagatggataagaagatccgcagtattgtaagtaacattctgaaaaatgcctctgttcctgatgctgagaaagatgttccgacatcttccgctccaaatgctgaagccctcccttcacccagtgaagaggaatcaacagaagaagatgatcaagccacagaagagacccctgcaccaaaggaaccagaacctgctccaggtgacctcattgacctcgaagatgtagaatctgatgaggaacccattgccaacaagttggcacctggcattgcagaaagattacaaaagcagaaagggaaaaacccccatcaagagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctgtagaaagagaactgggaagagatgccttggattgcaaggagatcatggacctcatcaaggctgctggactgctgaaaatagtcaccaagttgggagattgttatgaaagcctagtcagggaattcattgtcaacattccctctgacataacaaacagaaagagtgatgagtatcagaaagtgtttggcagaggaaaatgtgttagattctcccctgctgtaatcaacaaatacctgggcagaccaactgaaggagtggtggatattgctgtttctgagcatcaaattgccaaggaaatcactgccaaacaa

SEQ ID NO: 64189 - DNA, 363 bp, Glycine max
  Peptide Sequence Number=SeqID_155874
atggaaaggggagcaaatgagaaaagaagagagcaacaaaaaggaagagaaggaaaattcccaatcaaagagtgggagaaagcaaaaagaaaagaaaggaaattcccaatcaaagagtgggagaaagcaaaaagaaaagaaaggaaattcccaatcaaagagtgggagaaagcaaaaagaaaagaaaggaaattcccaatcaaagagtgggagaaagcaaaaagaaaagaaaggaaattcccaatcaaagaatgggagaaagaaaagaaaagaagagaaaagaaggacagaaagctcctgatcaaggatcgaaagaaaacagaagaaatgtgcagagaggtctttggaccggacaatatttga

SEQ ID NO: 64190 - DNA, 174 bp, Glycine max
  Peptide Sequence Number=SeqID_155875
atggcttttaaagaaaaattggtcacaaaagatgtttcacttctgtcaagatggatggcgattgacctctacattcgggaagtggatggcctaagatttgagctatccatgaaccagtgcagtgataagttgtcagaactggcacatgaaattctaaaaggtttgtctgtttag

SEQ ID NO: 64191 - DNA, 150 bp, Glycine max
  Peptide Sequence Number=SeqID_155876
atggattatggcctctggcttcaaaaagggaactgggagattgtggaggcctctggtaatcgattaccagtctgtgtaatcgattacacagaggaatgggtcactggtaatcgattaccagatcgtgatggcggtgcagctaatccatga

SEQ ID NO: 64192 - DNA, 675 bp, Glycine max
  Peptide Sequence Number=SeqID_155877
atggccccaaggaagcttgcctcaaagagatccaagaaagacaaggcggttgaaggaaccagttccgctcccgaatatgacagccatcgttttaggagcgctgagcaccagcagcgcttcgaggccatcaaaggatggtcattccttcgggagagacgtgtccaactcagggacgatgagtatactgacttccaggaagagatagttcgccggtggtgggcatcgctggttacccccatggccaaattcgacccagacgtagtcctcgagttttatgccaatgcttggcctacagaggagggtgtgcgagatattcgttcttgggtgaggggtcagtggatccctttcgatgcggacgccctcagccagttcttgggataccctttaatgctggaggagggccaggagtgcgagtatggccaaagaaggaaccaggacgatgggtttgatgaggagtccatcgcccagttactgtgtataccggggcaggattttgcccggactgctgctgggagacgggtgcggatcatgcgcaccaacatgaccaccctgacccagatctggatgaccttgctgctcagcaacatccagcccaacgatcctaattccgacctccccctgccgaagtgtcagctggtgtatggagcctaccaggcaccatctggacccggataa

SEQ ID NO: 64193 - DNA, 425 bp, Glycine max
  Peptide Sequence Number=SeqID_155878
gtatgccgcccaccaggcaccctctagacccagataagtctaatagggccctgggatttccagcgttgatcacgggcctctgccagtcattcggggttcccgtcacacctagcaaggtgattcaaccgccgatcacctgggccttcattgagaagtattgcacgcctagacaggcgcagggtgatgcaccgcaggccactgacgcagcgccaccacctcatcaggctgatccagctgggtcattcagcatggagcagtatttacagcacttggttcgccagcaggcggccaaccacagggggcaggtgcagacccacgagtgtctccaccagctcagcctcagtctgcagagccagggtttcgctccttttgcgtgccctactccagatcagttcagggcagaggttgcatggcccagagattag

SEQ ID NO: 64194 - DNA, 336 bp, Glycine max
  Peptide Sequence Number=SeqID_155879
atgcaagccttccgcaaggcgtacggaaagattttagatttgaccatagcagagatatccacagaagtcgttgtatcactcacccaatactatgaccaacctttgagatgctttacgtttggagacttccaattaggattcggcaagagagttggatcgtgtaaagcaaactcgaaacggcgtagtgggcctaccacggaagtacttagaaggcaaggcaaaggatatggcgaatcaagaggagtgggtcccgtttatggacgtattagcattgctaatctttggggttgtcctctttccaaacatggatggtttggtggacctagccgcaattga

SEQ ID NO: 64195 - DNA, 197 bp, Glycine max
  Peptide Sequence Number=SeqID_155880
aaaatgcttgtgcattgttggttatgggaaaggtgcttggaggggttgatggggacccggtgctgagaggaacgaggataagggctacgtgggggtatgtgagctctgttgaaggtgggcaactggggatggtgggttcatgtttgatttgtggatgtgcgagagttgatttgcaccatctcccgatcgccacctag

SEQ ID NO: 64196 - DNA, 523 bp, Glycine max
  Peptide Sequence Number=SeqID_155881
ttccctgacgagtccttgagtgaagcgttggagaggcttagaggtttattgagaaagactcccacccatgggttccctgagccaattaaattgaatatgtttatagatgggctgagaccacaaaccaagcaactgttagatgcttcagttgtaccatctgtggtgaggctcatgaaacaggccaatgtattcccattgaagaaaacactcaagaagttcactatatgggaaatcaacagagacaaggatatactcaaagaggattttcaggcttccagcagtgtccttataaccaacaaggacagtggggatcacacctggcaatcaattcatcaaggaccagggactactaagctggaggagactttgactcagtttatgcaagtaacaatgtcaaatcataaaagcactgagtcagcactaaaagcccttgaggtccatgtgggacaactggccaagcagatagctgacaagtcatccaacagtttcgtggcaaatacagaaaagaatcccaaggaggaat

SEQ ID NO: 64197 - DNA, 264 bp, Glycine max
  Peptide Sequence Number=SeqID_155882
atggctccgaaaaagctttccacaaagagatctaggagggacgccgcggctgaagggaccagtgccgctcccgagtttgatagccaccgtttcaggagcgccgagcaccagcaatgttttgaggtcatcaaggaatggtcgttccacagagagagacgcgtccagctcagggacgatgagtacatagattttcaggaggagatagcccaccgacattggacgtcgctggtcacactcccatggctaagtttgaccctgatataa

SEQ ID NO: 64198 - DNA, 747 bp, Glycine max
  Peptide Sequence Number=SeqID_155883
ggagttctcttctcatgtgggggctacccaaacatcccgttgataggaacgaggggttgcattaactacaatcccgcacttgctataagacagttagggtaccccatgaggggagcaccgacggaagaaagcctgcctcctttccttgtgagagattttggcgcgcaaaatttcaaggttatacaaagaggccataaggcgtgggaaagcccgttaaggaaagataaagagcttaggggcattcgtaatggcatcattggtggttatcatgaatggctgaaaatgtccggaaaaagtgtgccgggttacgagaagaaaatgcagctaccgcgaaagcccttgaataagaaaccaagagggctcgcaaggaagagcatggccgtgacaaattccgcggagcattgtggggcggcaacaacagagaccaacatgttcgctatcatcaccaagtaccaagaagaactaagtctagccacgacacacgagcatagggtggcggacgagtttgcccaagtgtacgcggaaaaggaggctagaggaagggtgatcgactcgttacaccaagaggcaaccatgtggatggaccgatttgctcttaccttgaatgggagccaagaacttccccgattgctagccaaggccaaagcaatggcggacacctactctgcccccgaggagatccacggacttctcgactattgtcagcatatgatagatttaatggcccatataattaggaaccgctag

SEQ ID NO: 64199 - DNA, 783 bp, Glycine max
  Peptide Sequence Number=SeqID_155884
atgaaagttgcggtttacagcaccaagcattacgaccagaaatacctcgagcacgttaacgaaggctacggatttgagctgcagttttttgacttcctgctgagcgaaaccacggcgaaaaacgccgctggctgtgatgcggtctgtatcttcgttaacgatgacgggagcaaagcggtgctggcggagctggcggcgctgggcgtgaaatatatcgcgctgcgctgtgctggtttcaacaacgtcgacctcgacgccgcagccgcgctggggctgcaggtggtgcgcgtgcccgcctactcgccggaagcggtagcggaacacgcggtaggtctgatgatgacgctcaaccgccgcattcaccgcgcttaccagcgcacgcgcgatgccaacttctcgctggacggcctgaccggtttcaacatgcataacaaaaccgctggcgtggtcggcaccggcaagattggtgtggcgacgatgcgcatcctgaaaggttttggcatgcgtctgctggcgtacgatccgtacccaagtgacgccgcgctggcgctcggggcggaatatgttgatttgaaaacgctgctggcggagtccgatgtcatcaccctgcactgtccgctgacgccggaaaaccatcatctgctcaacgcacaggcgttcagccagatgaaagatggggtgatgattatcaataccagccgcggtgggctgattgattcacaggcggcgattgaggcgctgaaacagcagaaaatcggctcgctcccgcatggatgtgtatga

SEQ ID NO: 64200 - DNA, 1620 bp, Glycine max
  Peptide Sequence Number=SeqID_155885
atgaaactaactttccgcaccacgctggccgcgctcatcatcagcagcgctctctcatccgcctatgccgccagtgtgcctgccggggcgcaactggccagcagccaggaaatcgtgcgccatatcaaagatgaaccggcctcgcttgatccgctcaaagcggtcggtctgccggagattcaggtgctacgcgatctgtttgaagggctgactaaccaggacgcgcagggcaaaatcgtgccgggcgttgcgcagagctggagcagcaatgacaacaaaacctggctgtttacgctgcgcaaagacgcacgctggtctaatggccagccggtgaccgcacaggattttgtctatagctggcaacgtctggtcgatcctaaaaacagttcgccttttgcctggtttgctgcgctgagcggcattgagaatgctgaagccatcaccaaagggcagatgagcccggacaagctgggcgtggtggcgaccgatgagacgcatctgaaggtgacattgtcacgtccgctaccgtggttccccagcatggtggctaacgtggccatgttcccggtgccgcaaaaggtcatcgcgcaaaacggcgatggctggactgcgccgggtaaactggtgggcaatggcgcttatcaattgcaggagcgtgtggttaacgaaaagattgtgctggtgcgcaacccgcactactgggataacgcccattcggtgctgacgaaagtgacctttattcccatcaatgaagaatccagcgccaccaagcgttaccgcgccggggatatcgatatcacggaatccttcccgaaaaatatgtacggcctgctgaaaaaagagctgccggggcaggtgtatacgccggatcagcttggcacctactattacgcgtttaatacccagaaagggccgacggcggatgtgcgggtgcgtaaggcgctgtcatggagcattgaccgccgcattatcgcggaaaaagtgctgggcaccggcgagaaaccggcatggcacttcacaccggacgtcaccgccggcttcacgccgcagcagagctatctgcagcagcacagccagcaggaactgaatgcgcaggccaaagccctgctgaccgccgccggttacggcccggctaaaccgctgcacctgacgctgctgtataacacctctgaaagtcaccagaagattgcgattgcggtggcctcgatgtggaaaaagaatctcggcgttgacgtgacattgcagaaccaggagtggaaaacctatatcgacagccgcaacagcggtaatttcgatgtgattcgcgcttcctgggtgggcgattacaatgagccatcgaccttcctcagcctgctgaccgccagccacagcggcaatatttcccgcttcagcaacgcggaatatgatgcggtgttgagtaaggccagcaatgaaaccagcgtggcggcgcgcaatgccgattacaacaaagccgagcagatcatcgctgaccaggcgccgattgcaccgatctaccagtacaccaacgggcggctgatcaagccgtgggtcaagggctatcccatcactaatccggaagacgttgcctacagccgggaattgtggattgaaaagcactga

SEQ ID NO: 64201 - DNA, 714 bp, Glycine max
  Peptide Sequence Number=SeqID_155886
atgatccaccagcccgctctcggtggcctgcaccgacgccagccccagacaatccatgctgatgccttcgaacgcggcattctgccacgcgtcctgcaccagctgctgcagcagcgacaccatattggcgtgctgatcggcggtgatgtgatcggccttggtggcggcaaacagcaacttatcgatgaccggcgagaacagacggcggaacagcgtgcgctggccatagtgaaaactttgcatcagctgggtcagcgccagccgcatatcattgaacgcctgcggtccactgttgagcggctgcaggcaatcgaccagcacgatctggcgatcgaagcgcaggaagtgatttttataaaaccctttcaccacatgctgacagtagtagtggaaacgctgctgcagcatggcgaaattgctgccagccggcgcctgcagcagcttgccggcctgctgttcatcgacgttgggccaggggaaaaactgcagtgccggcgcgccagccatgtcacccggcaacacaaaacgtcccggctggatgaagtgcaatccttcggttttgcactgatgcaggtagtcggtccaggcggctgcgatctccgccaggcggttttcatcggcgggcgcgaacgggtcgaggtcggcgctcaggctgtgccagcgcgcggcccactgctgacgatcgccctgcagcaggccgaccatctggcgtga

SEQ ID NO: 64202 - DNA, 241 bp, Glycine max
  Peptide Sequence Number=SeqID_155887
atggctactcagttgaaccaagctgattcccaaaattctgacaaattgccttcacaaactgtgcagaatccgaaaaatgtgagtgccatcaccttgaggtctggcaagcaaattgaagtacctccaccagtagcaacacctgcacctgcacctgaacctgaacctgtcaagcttcattctacacctgaaaaagaggatgagctagctacacaaaagagaaagcttcctgatcatgagggag

SEQ ID NO: 64203 - DNA, 264 bp, Glycine max
  Peptide Sequence Number=SeqID_155888
atggcttcctatggtggagaaaaggactccattgatgaagaagatccaaggcctccaagcattcacatgggagctacatccagaatggtcttaaagtgtgggaattgtggcagtgctaagcctttggagcttgtccataagctccctttcatagtaggagggaatgtgcctcttcctaagggcattcttaagatcattccaatactttactggaggatccccatgaatccttttttccctaacaagggaagtccaccaacataa

SEQ ID NO: 64204 - DNA, 372 bp, Glycine max
  Peptide Sequence Number=SeqID_155889
atggcatttctaggagaaactagcagtcagacgattgtcaactcaaggttggctttcatttatccaactggatcaattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccattcaccgatacaggaaaaaaattcctaagaaatttcaaattcctttcaacatgttccatcgatgaactgaagaatttaatcaagcaagttgcacctaaagggatccccctcttggaattcacgaatcacaaacggtag

SEQ ID NO: 64205 - DNA, 489 bp, Glycine max
  Peptide Sequence Number=SeqID_155890
atgggtgatcaaggggagacacaggaaaagatgaaagccgacatgtcggctctgaaagaacaaatggcctccatgatggaggccatgttaggtatgaggcagctcatggagaagaacgcggccaccgctgcagctgtcagttcggctgccgaagcagactcgactctcttggcaactgcgcaccatcctccctcaaacatagtaggacggggaagggacactctggggcacgatggcagccctcacctaggatacaaccgagcggcttacccttatggattgccgcccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcatcttgcctcagcccaacatcgcaacacaaccaata

SEQ ID NO: 64206 - DNA, 564 bp, Glycine max
  Peptide Sequence Number=SeqID_155891
atgcagccaccggtcatctatatcatcacccgtcaaagaatcacaaaccggcggtggagggacagtctgaatgtagccaaactgtcaaagaacccgctcaggtcgaacgtacacgacaatttgaccccttctgagctagccggtgtacgacgatatcaagtcaaagcccctgactccccggtgctcagcatagggcatccagtacacgtcagtcacagtcagggcatccatacgtctctgatacggggctcccttgatccccgtcatatgagccttacccataagccacttgcaggcccatgggctcccctcatcataagtggtgtaagctccattggagcttgtaggcctaggatcttcttcatcaatggaatcctttgcttcttggaagatgaatggcagcggaatggagaaaggaagagagagaggagacgccccttcaaggagaagatgagtctagaagaagctcaccaacataggaggccgtggataagagcttggaggaagaaagagatgaatgaagggagagggagagaagagcacaaaattttgtgctctaaatga

SEQ ID NO: 64207 - DNA, 166 bp, Glycine max
  Peptide Sequence Number=SeqID_155892
atgggtgccaagcacctcacaaggaccaaacaaaagtcgcatgatgatagcaagagttttctagtgattatatctgcctcccttgctgatgagcaagaggagaagttgttgtcagttctcaagaagcataagaaggctataggctggaccctggtggacattcctg

SEQ ID NO: 64208 - DNA, 438 bp, Glycine max
  Peptide Sequence Number=SeqID_155893
atggcttctatcacgaaggccatgctaaagcttcaaaaaactatagaagataatgccacggcggccgcttccaatacagctagggaagcagaaccggtgctacagctcgtaataaacttgggccgagacaaaaatgcgacaggtttcaatcggaggtatagtcctcaagcttacccttatggtttgcctccggacttcactcctcgtaccgctccagacgatttgagccaagcccctaccttcgaggggcagctccctcctcatgccgactatcctctgcaagaagatgatgaaggagatgcccatttaggccctctacttcccctcaaggatccgaccccccatgagttaccccaaccaaacatagtctgccacgtcccgtctccatccgcacccgttaaggaactcgttccctttgcctcaacgaagcccacgtag

SEQ ID NO: 64209 - DNA, 690 bp, Glycine max
  Peptide Sequence Number=SeqID_155894
atgggatcaagtcaaatggcttcgcttaaaaagaggttctatcaagtcaagatcaagagcctagggatcaccaatctaaaagagttggggcagttgatgggtcagctccagtggcaagcttttcgcaaagcttacggtaaaatctgggacctagccatggtagaagtctccacagaggccattgcctccctcgcccagtattatgatcagccgttgaggtgcttcacctttggggacttccagctatcacctatggtagaagaatttgaagagatcctaggatgccctctagggggaaggaaaccatacctcttctcagggttctatccctcattagctagaatttccaagatagtccaaatcttggcgcaggaattagaccacaggaagcaagtcgaaaatggggtggttggaataccgagaagatatttggaggcaaaagcaagaatcttggcaggtaaaggcgaatgggcctcgttcattgacattctcgcacttttgatctttggaggagtcctctttccgaatgtggatggtttggtggacctagcagcgatcgacgcttttctcgcctctcataatcacaaggaaagcccggttgtcgctatgctagccgacctttatgacaccttcgaccgaagatgtgaaaagagaaatacgaggattgtttgttgtactccagatctttat

SEQ ID NO: 64210 - DNA, 531 bp, Glycine max
  Peptide Sequence Number=SeqID_155895
atggccccgaggaagcttgcctcaaagaggtccaggaaggacaaggcggccgaaggaactagttccgctcctgagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtggacatcactggttactcccatggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttagtgctaaaagaggaccaggaatgcgagtatggcccagaggaggaaccgggaggccgagtgcgaatcatgcgcaccaacatgaccaccctgacccagatatgggatgacgttgctcctcagcaacatcctgcccagcgatcataa

SEQ ID NO: 64211 - DNA, 445 bp, Glycine max
  Peptide Sequence Number=SeqID_155896
caacgcttcgaggccatcaaaggatggtcattccacagagagaggcgcgtccagctcagggaggatgagtatacgaactttcaagaggagatagctcacagacgttggacgtcgctggtgactcccatggctaagtttgaccctgagatagtcctagagttctatgctaatgcttggcccacagaggagggagtgcgagacatgcgttcatgggtgaggggtcagtggattccctttgacgcagatgccctcagccagttcctaggccattgcccagctgttatgcacaccgggacaggatttcgcccagactgctacagggaggcggctgcggatcatgcgcaccagcatgaccactttgacccagatgtggatgacactgctactcagcaattgctagttggtgtatgccatcctgacacggatgagcgtccccgtggcccag

SEQ ID NO: 64212 - DNA, 159 bp, Glycine max
  Peptide Sequence Number=SeqID_155897
atgcctataggtggagctgatattgaggaggatgaactaacagatttgaggtcaaatcctcttcaaggggaaggggacatgatcggaatggagaaggaagagagagaggagatgccacttcaaagagaagatgagtctagaagaagctcaccaccatag

SEQ ID NO: 64213 - DNA, 211 bp, Glycine max
  Peptide Sequence Number=SeqID_155898
aaaatgcttgtgcattgctggttatgggaaaggggttgatggggacccggtgctgagaggaatgaggataagggctacgtgggactacgtgagctcagttgaaggtgggcaactagggatggtgggttcattggtacctggagatatgtcgcgggggtcaggagacctcggggacgtcaggtggggtgctattgcccaaagccaagcttga

SEQ ID NO: 64214 - DNA, 606 bp, Glycine max
  Peptide Sequence Number=SeqID_155899
atgcatgcagtccacggatgggagcactgttgcgaagcccaaacccttggtgatatacttcaccaagggcacagcttcacaaaaagcccagacaccccttggcagctaaacctgttcctttccccgtaccaaaatagccacgcagtcccatggagatatacacctccgagggggaaggaagaagaagccaccgacgtcagctcgttgtcggctaaggtaacaaatatcacgggactgagtggtgtgacccgtagcggtcgtgtgttcgcacccgcggacctaccagtccaacccgcgaacgtcaaggggaaagaaaaagtggtggaggaacaagatgacgaagcacccctcacttcgaataaagatattccggcgaaaggtcttccggagaaaaaggatggtaaaaaggaggtgtcactagaggaagccactcaacaaaaccccggccagggtctcgctgttggagttactcatgagctccgagcctcatcgggctctgctagtgaaggttttgaacgaggcccatgtggcccaagacatctcggtagaaggtttcagagggctggtcaaccatatcactgccaacaactatctcgcctttgctga

SEQ ID NO: 64215 - DNA, 492 bp, Glycine max
  Peptide Sequence Number=SeqID_155900
gtcggaattatgatcggtgggcaggatgttgctgaggagcaaccagctgggcgatggcctcctcatcgaacccatcagaccggttcctcctctggccatactcgcattcctggccctcttccaataccatcggatatcccagagctggctgatagcgtcggcatcgaacgggatccactgacccctaacccaggatctcatgtcacgcacgccctcctctgttggccaagcattggcataaaactcaaggactatttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggctgccttgtccttcttggacctctttga

SEQ ID NO: 64216 - DNA, 51 bp, Glycine max
  Peptide Sequence Number=SeqID_155901
atgggggatagcatgaaggatttaaaaatgagtgcccgaatgcaattctag

SEQ ID NO: 64217 - DNA, 521 bp, Glycine max
  Peptide Sequence Number=SeqID_155902
cctatgatgtgtacgaggatcttcaagggatcaaagacaccttgtcaattgtgaaaggcgtgctgttggatgcagaagagaagaaggagcagaagcacgggttgcgcgaatggctcaggcagattcaaaatgtctgctttgatgctgaagacgtattggatggatttgagtgccataacttgagaaagcaagttgtcaaagcatcaggcagcaccgggatgaagatagcagctgatgggaacaagtttggtctagagaggatttctgttgaccacagacttgtgcaaaggagagaaatgacttattcacatattgatgcttcaggagtgatgggaagggacaatgatagggaagaaattatcaagcttttgatgcaacctcaccctcatggggatggtgatggagataaaagtgtgtgtgttattcccatagtgggtattggaggcttggggaagactacacttgcaaggttggtgttcaatgataagaggatggatgaccttttccaattaaagatgtgg

SEQ ID NO: 64218 - DNA, 81 bp, Glycine max
  Peptide Sequence Number=SeqID_155903
atggcggaaaatcttcacagaattacccatggaaacgtttcggacgcgttacggaagcgcctcggcgtggattttcttcac

SEQ ID NO: 64219 - DNA, 630 bp, Glycine max
  Peptide Sequence Number=SeqID_155904
atggcttcccgcaaaagaaaggcactagcctcagcatctcaggcccgctatgatagatcaagatttaaatcccaagaggcctgggatcgctattctgacattatgattggcaggaagattcttgctaagaggaatgtaatgatatatcatatagaatttgatgaattccagactgagttggaaagaaggaattggcacaaggagttgaccaattttctagacgggagcatcgatgttgctatagtgaaggaactttatgctaatttgtatgaccttgaagataaatcttctaagcaagtaagggttaggggtcacttgataaagtttgatgaggatgacctcaacactttcctcaagacgcctgtgattattgaggagggggagagcctatctgcctactccaggttttgtagactgaggccagatccccaggaactggcagcccgattatatgtccctgggaagggatttgagctaaatacaaatgggctgcctttgaagattttgcggaagaatttgaccacactcgctcagacctggagcattttgtcattctctaacttggcccctaattcctacacttttgatataaccttggatagggccaagctaatatttggaataatttag

SEQ ID NO: 64220 - DNA, 135 bp, Glycine max
  Peptide Sequence Number=SeqID_155905
atggtgattttcagccatggagttacaacagaagataaaggagaagagatgaatggcagcggaatggagaaggaagagagagagaagacgccacttcaaagagaagatgagtttagaagaagctcatcaccatag

SEQ ID NO: 64221 - DNA, 330 bp, Glycine max
  Peptide Sequence Number=SeqID_155906
atggctcaacctccacctcgtgaaaggactcttagggagatggctgcacctgatttcacttatgaaagcttgtgcattcaatatcctgatgagggtgttccatatgttctcaagactggactaatacatttgttgcccaagtttcatggtcttgcagagggagtggcaaaagattggctatactaccttgctcccaggtccattttcagctgggatgaccttaagagagtgttcttggagaaattcttccctgcatctaggaccactgccataaaaaaagacatttcaagcatcaggcaacttagtggagaaagcttgtataagtactag

SEQ ID NO: 64222 - DNA, 229 bp, Glycine max
  Peptide Sequence Number=SeqID_155907
atggttgaacaaggggagattgtagaagcaaagcttcatggtgaatcaaaggtgattcaaagatgttttgatgataacaatgatgatgacaaaggtgatgacaaaaatctcaaagatcaatcaaagaacaactcaagtgagtcaagaacaattcaagagttcaagataagaatcaagaagaattcaagaactcaagaagaaagtctagagacaagaatcaagattaaag

SEQ ID NO: 64223 - DNA, 159 bp, Glycine max
  Peptide Sequence Number=SeqID_155908
atggaggagatacatggtgaagatgatgaagaacaaggaactaaaatcattagcagcagaatggagaaggaggaaagcttattgcagatgccacttcaaggagaagatgagttaagaacaagctcaccaccagaggaagtcatggataagagcttgaag

SEQ ID NO: 64224 - DNA, 349 bp, Glycine max
  Peptide Sequence Number=SeqID_155909
ggtgaaacttcctgcttttattgttgaccacagagtggtacctggagatatgtcgcgggggtcaggagaccttggggacgtcaggcttgaaaacgaggtcaggaagctaaggaagcctctggtaatcgattaccaagggatcgtgatggcggcgcagctaatccgtgatcgagtagagatggagtgcctagagggagcttgggagaccctcgaaggcaacaagaggtgccgatttcggggcaccattcgattcacggctacttctttggtgcatccagatgaacttgcacggacgcttcagcgcacggtggagtggacagctccttggattagttttgtgtatttttga

SEQ ID NO: 64225 - DNA, 356 bp, Glycine max
  Peptide Sequence Number=SeqID_155910
ctccggaggaagatgaagaagtccgagctctaaaattagagctagggaagggcaagactcgccaaggagaagttcaagtcagctgctacagacatccggaaaagagtgcaccgagttacaagaagaaaacgcgaccactgcaagagtccttgaacaagaaaccaaaagggcctgcaaggaggaatatggccgagagaaattccgaggagcattgtggggtagcaacaatgagctcaagctccgaagagaggagagagatcggtcacgggtgcatgacacccgtgtcctacttcaaagctatcgctcatgcgccgaaaaaggaagattcattgggacctaacaatttggctggatag

SEQ ID NO: 64226 - DNA, 165 bp, Glycine max
  Peptide Sequence Number=SeqID_155911
atggaggttaaagatttgatttgggcaagattggatgacgggaagtgtggttttcgaaatctgcactttatgcagaattttgctgtgaaattgtgcagcagaattttgcataagtgcagaaaaatgctatgttttgctggttgtggaaagagtagtgcagaatga

SEQ ID NO: 64227 - DNA, 240 bp, Glycine max
  Peptide Sequence Number=SeqID_155912
atgaatcttcaacttggaaggataaggatacattcaagaagaagggaggatcttcattcaaatctcatgaaaaaggtgttacccttggaaagggtcatattgcctcccaatgtcctaacaaaaggattatgccctagtgcatcttcttctagctcttctagtgagagtgaaagtgaatgtgatgtacaacccctggaaggtaatcttttgattgttatgaggttaatgggtagtgtgtaa

SEQ ID NO: 64228 - DNA, 984 bp, Glycine max
  Peptide Sequence Number=SeqID_155913
atggcgagagatgctgtgaccgacaatgaactgttgctcaaaaaaactgcccgcaggcggttggtaggagcgattaccctggtggtcctgatgttgattatcctgccttttgtgcttaaggacagagtggtcgaatccagtcatgataatgtcgaaattacagtcgttaatcgccaggccaaccgtgatcccatccttgaattgcctgatgatgaagtggtcatcgataacgaagtggcttcttctgcggggacaacgccctctagcgcagaagtaccagaagcgcgcattgaagaaccttcagctgtcgcgctaacgaaatcacctgagtcgcaaaaactcgttaaaaccgaagcatccaagcctgtagttgcaccagaagcaaccgctcaagctaaacctgtgcctgtggaaccaaaagtggaaccaaaagtggaaccaaaagtggaaccaaaagtggcgccggttcaggcagttgctaaagaagagccagccgtatccgataagaaaacaggaaagttttttgtacagtttggtgttttttctgatcccaaaaatctggaaaacttgcaaacaaagctgaaacaagccggctttgaaacggctagcgaaaatgtagatgctgcaggacaaaaattgcgtctacgtacgcgtacttatgctacgcggaatgaagccgcggccgcgctgaaaaaactacaggcagcagggctcatgcgtggggccatacatgagcttttttcagtactgggctgggtgttggctttttatctggctaaccgtttcaacagccaggtaatgcattacatgccagaacaaattcctggtgaggcgattaaagcgatggccgcatttttaatcgtatttttactggtgttgtttgtctctgctttatgtgcactgttattaactacactcatgaaagccattggtctgggtgggttcaataggatacttggcggcatcgctggcgcaggcaagggg

SEQ ID NO: 64229 - DNA, 132 bp, Glycine max
  Peptide Sequence Number=SeqID_155914
attccattgggagcgattttagccattgttgattctgtggtcattgaaactggtcctgcggtcattgctagaaagtcaattgtgccaaaggcctcaaactcagggtatttatatgtttcattcgaaaactaa

SEQ ID NO: 64230 - DNA, 522 bp, Glycine max
  Peptide Sequence Number=SeqID_155915
atggaactaattgagaatatggctgctagtgatcacgttatcttgcatgatagaacacactatcccaccaagaagagtttattagagttgtcatcacaagatgctctgttggcacaaaataagttgttgtccaagcaactagagactttaacagaaacactgagttgcacactttgtggtagagctcatgaatcaggctgttgtatgcccactgaagaatcaacacatgaagttaattatacgaggaaccagccaaggaagaattttaatgcaggtggattttctagatttcaacagggccaacattacaaccagcaccaaaatcagtggaggactcaccctggtaatcaattcaacaaagaccagggtggaccatcaaataggccaccacaacaagggcctaaactctatgagaggacaacaaagctggaggagacttttgctcaattcatgcaggtttcaatgtcaaatcacaagagtactgagtcggccattaaaaatttggagatccaggtggtatag

SEQ ID NO: 64231 - DNA, 600 bp, Glycine max
  Peptide Sequence Number=SeqID_155916
atggagagaagtatgatagatgctgccagtggtggagcccttggagacatgactcctgctaaagccagaaatttaattgagaagatggcctccaactcccagcagtttagcgccaaaaatgatgccatagtcattagaggagtgcatgaggtagctacaaacccatctgcatcatctgaaactaagaagcttgaaggcaaactggatgcattggtcaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcaaagcaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaata

SEQ ID NO: 64232 - DNA, 186 bp, Glycine max
  Peptide Sequence Number=SeqID_155917
atgaggcgggtcattacattagtggtatcagagccagtcgaacatttttggccaggagtaatggttagacggaatgatcatgcgatagctgatgctctccaagccttagctcaggctatagggaatccgaataggggagaagcttctggagctactgagtaccaagggttggaccgcttccaatga

SEQ ID NO: 64233 - DNA, 466 bp, Glycine max
  Peptide Sequence Number=SeqID_155918
tgtgcatcctgatcattctatgcatttcgagcattgtgagtattttgagcattctgagtattccgttgttggtgattctgaatattctgattttgagcattcaactactaattttcacactgaaaacatggctcaacctcaaccttgtgagaggacacttagggagatggttgcacttgatttcacttatgaaagcttgtgcattcaatatcctgatgagggtgttccatatgttttcaagactggactaatacatttgttgcccaagtttcatggtcttgcaggtgaagatccttataagaatcttaaggagttccatattgtttgttccaccatgaagccccctgatgatgaccttaagagggtgttctcggagaaattcttccctgcatctaggaccactgccatcagaaaagacatttcaggcatcaggcaacttagtggagagagcttgcatgagtactag

SEQ ID NO: 64234 - DNA, 171 bp, Glycine max
  Peptide Sequence Number=SeqID_155919
atgactaaagcacgtcaaaagggggtacataaagggaaaagaaggaggtggttgctgcccagctcgctcaggcgagctgggttgcttccactagaaggcaccaccttctgttggaagatcctggaaggcccaagttggcctgatttgctatttgtacacccctgttactaa

SEQ ID NO: 64235 - DNA, 270 bp, Glycine max
  Peptide Sequence Number=SeqID_155920
atgttggggaagcttgagaggattgatggggacccggtgttgagagaaacgaggatatgggctacatgggagtacgtgagctcagttggaggtgggcaacaggggatggtggttttatgcgcgctttgtggatgtggaaaacttgttgtgcaccatcgccaaccgccacctagtaccacatgtgatggagtggtacctggagatatgtcgcgggggtcaggagaccttggggacgtcaggtggggtgctattgcccaaaaccaagcttga

SEQ ID NO: 64236 - DNA, 349 bp, Glycine max
  Peptide Sequence Number=SeqID_155921
atgtcaatgtcttcgcgctttttgagaatgaatgacaatataactttagtattgcaccatggaggaagattcactccacgtgccagtgatggaaaggttgaatatataggcggagaatttgacgtttgggaggatatatctgcagattgcctgaatgcatttatcttatatgatctggtgaaagcttctgttgagaatgaggatgatttagatgatgtacctgttgctggccatgaggaagatgttggtgctggagagcagagagatgctggtgagcagatggatgctggtaagcagagggatggtggtgagcagagggatggtggtgagcagagggatactgatgctg

SEQ ID NO: 64237 - DNA, 321 bp, Glycine max
  Peptide Sequence Number=SeqID_155922
atgccgatggccccctgcgaaagtatcggttggtatgtgccgtcacgacatagctctggttacgggcctctatcagtcctgcagggtgcccgtacccccccggcaaagtcatgccatcgcgacataaggatcacgcccgcaggacacccagtggacccaaagaagtccaacagggtcctggggtttccagctctaattacaagcctctgtcagttctacggagtgcccgtcacccccagcaaggtcatcaggcctcctactaaccgagctttcatcaagaagtattgtgcccccatgcaggcagagggtgagacaccataa

SEQ ID NO: 64238 - DNA, 276 bp, Glycine max
  Peptide Sequence Number=SeqID_155923
atgtcattggggcatttcaccaagcactcggtgggcgcatgtttagacataaattgcaagagaacggggggcaatgtggcatgccccgttgcttcagaatacaacataggcctaaggccttctcacacaaaccctcaactcaacaaaacaagcatggattcagatgtgaattgcttcacgaatattgcgaaaaatgagcaactaaagcaccaaaacacatcaatggagagccaaataaccaagggaaattgcacttacttgtggggagagaattaa

SEQ ID NO: 64239 - DNA, 216 bp, Glycine max
  Peptide Sequence Number=SeqID_155924
atgccaccggactcttgggtcatttcctatcaaatcaaggattacatgcgtgatcatggatcaataggactttttcttgggaatgggcaaggattgacattctcaccctgggtcaaggtttatggtaagttgggattttggctcatggcttgtagaacggctggacatgatgatggaagcttgcttgtggagcttctatggaggctggatctttga

SEQ ID NO: 64240 - DNA, 301 bp, Glycine max
  Peptide Sequence Number=SeqID_155925
atggcagaagtctccatagaggccattgcctccctcgcccagtattatgaccagccgttgaggtgcttcacctttggggacttccagttatcacccatggtggaagaatttgaagagatcctaggatgccctctacggggaaggaaaccatacctcttctttggattctatccctttttagctagaattcctaagatagtccaaatctcagcgcaggaattagaccatagaaagcaagtcgaaaatgggatggttggagtactgagaaaatgtttggaggaaaaagcaagaatcttggctg

SEQ ID NO: 64241 - DNA, 261 bp, Glycine max
  Peptide Sequence Number=SeqID_155926
atggtagaagtctccacagaggccattgcctccctcgcccagtattatgatcagccgttgaggtgctttacctttggggacttccagctgtcacccatggtggaagaatttgaagagatcctaggatgtcctcttgggggaaagagaccatacctcttcacaggacattctcgcactgttgatcttcggaggagtcctctttccaaatgtggatgggttggtggacctagcagcgatcaacgctttcctcgcctatcatga

SEQ ID NO: 64242 - DNA, 1083 bp, Glycine max
  Peptide Sequence Number=SeqID_155927
atgctggctaaaattaccggttttgcaggaacttcacttcagccaaattctggtgcgcagggagaatatgcaggattgatggtcatcagagaatatcatatttcaagaggagaaggtcatagaaatgtagtattgatccctcagtctgcacacggaacaaatccggcctctgcggcaatggcgggaatgaagatcgtagtagttaaaaaccttgaaagcggggagattgatttcgacgatttaaaagctaaaacagaacagcattctgaaaacctgtcatgtgtaatgattacatatccgtctacatacggattctttgatgccaacattattgaaattaccaatcttatccaccagcatggcggacaagtatatatggatggtgccaatatgaacgctcaggtaggatatacaagtcctggaaacatcggagcggatgtatgccacttgaatcttcacaaaacttttgctattccacatggaggtggaggacctggagtaggaccaatctgtgttgcaaaacatttggtgcctttcttgcctaccaatgccaacattaaagtgggaactaaagaagctattgaaggaatctctgcagctccttacggttcaggattgatccttaatatttcatatgcatacattaagatgcttggagcttcaggattgaaaaaagctactgagcatgctattctgaatgccaactatctgaaagagatcttagcagagcatttccctattttatattcaaacaaaaatggaaaagtagctcacgaatgtatcgtagatttccgtcagtttaaaactttgggaattgaggtggctgacgtagctaaaagattaatggattatggtttccatgctcctaccgtatctttccctgttgcaggaacattgatgattgagcctactgaatctgaaactttaattgctatcaaaaaagaaattgatgagattgccaacggagaagctgatccggcaaataacgtgttgaaaaacgctccgcacacagaacagcttgttatctctgattcatgggataaaccatatagcagagagaaagcagcttatcctcttgactgg

SEQ ID NO: 64243 - DNA, 366 bp, Glycine max
  Peptide Sequence Number=SeqID_155928
atggtgatcactggagacaaaatgagggaaaatgtgtgcccacggagctttctgagcacccaaaaagagttcagtctttttgcttccattagagaagacgaggcaagcaaaaagttttatcgactccaattcgcgaatctgctgagagcatcaagaaagaacaaaattgcaaaagaagatggagctgaattagaggaccaagattttattgatcttcttctcagaatccaacaagatgacactctcgacatccaaatgacgactaacaacatcaaagctttgatattggacatatttgctgctggaactgatacttcagcatcaacactagagtgggctatggcagaaatgatgagaaatccaaga

SEQ ID NO: 64244 - DNA, 588 bp, Glycine max
  Peptide Sequence Number=SeqID_155929
atggagagaagtatgatagatgctgccagtggtggagccctgggagacatgacccctgctgaagtcagaaatttaattgagaagatggcttcaaactcccatcaatttagtgttagaagtgatgctattgtcattagaggagtgcatgaagtagccacgaattcatcttcatcaggtgaaactaagaagcttgaaggtaaactagatgccttggttaacctggtaacccaactggccatgaatcaaaaatctgcacgtgtcgctagactctatggtttaggttcctctgccgaccaccacacaaacctttgcccttctgtgcaacaatctgaagcaattgaacagcctgaagcttatgttgcaaacatctacaacagacctcctcaacctcaacagcaaaatcagccacaacagaataattatgacctctccagcaacaggtacaatcccggatggaggaatcatcccaaccttagatggtcgaatccttcacaacagcagcaacaacaacaacagacttattttcaaaatgctactggcccaagcagaccatacgttcctccaccaatccagcaacaacaacaatag

SEQ ID NO: 64245 - DNA, 376 bp, Glycine max
  Peptide Sequence Number=SeqID_155930
aggcctccacaatgttccagtcccctttctaagcctggtaatcgattacacccccttggtaatcgattaccagaagccctcatggcttcctgacctcgttttcaagcctggtaatcgattacaccccgtggagctcgcctgtttaggtacatcacaggttctcactgaccgactatgcccgggttgggtcgggattggtcaagcttggttttgggcaatagcaccccacctgacgtccccaaggtctcctgacccccgcgacatatctccaggtaccactctgtggtcaacgaataaaagcaggaagtttgacccttctacacttcctcatctcaagcttgtaggattatggggtacccatcacctgtggtactag

SEQ ID NO: 64246 - DNA, 531 bp, Glycine max
  Peptide Sequence Number=SeqID_155931
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatgctggacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggtggatcatctaaaggaaaggctcagggccattgaaggaggtgaagattatgcctttgctaacctagaaaagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 64247 - DNA, 447 bp, Glycine max
  Peptide Sequence Number=SeqID_155932
atgcctttcgcgggcgagcgagggcgaggctcatgggtgcgctttccaaaggaggaaagatgcgcggagtcgccaccaacgtttatttttggaaaacgtcgggaaaaccgaaggaaaccggtcaaaaagaaaattctaagttcgggagttgtatttacgcttgaggaaggggaaaagcttgccgcccaggcgagctcagctcccccaggcgagcaaggttgcttcctccagaagcaacaaccttctggaggaagggtctggaagggcccacacagctttcgaagaagttacggaaactcacggattgcgcaaaaacatctcttttcgacttccgccacattacggaatttcacggatcgcgcaagcctgcttccttttgatttccgagacgtctcgggacttcatatattgtgcaacaaaggacgccaagtacctcaaagcggctaa

SEQ ID NO: 64248 - DNA, 267 bp, Glycine max
  Peptide Sequence Number=SeqID_155933
atggcgtcatcgacgactatcacaagtgaagtgcaagctttgaaagcaaagctcaaaaagacaagagtggtgaaagagaagctgaagacgacattcactagggtcaggaaagagtgtgatgagctaaaagatatcaacatgaccatggttgaagctaaccagttcaagcttagaaaggccgagagggacgaatcatggatggaaagcatggtgttagaggataagttaaaggcttgtcagaggccgaagagaagtttgacggaatag

SEQ ID NO: 64249 - DNA, 108 bp, Glycine max
  Peptide Sequence Number=SeqID_155934
atggcctctggtaatcgattaccaagggagtgtaatcgattaccaggcttaaaaatgggatcaggaagtcgagatggcttctggttttcatgctatgaggctgtgtaa

SEQ ID NO: 64250 - DNA, 162 bp, Glycine max
  Peptide Sequence Number=SeqID_155935
atggaaaggagtatgattgatgctgccagtggtggagctcttggtgatatgacccctgctaaggctaggaatttgattgagaagatgacttccaactcccaacaattcaatgcaagaaatgatgctattgtccttagaggagtccatgagatcaccatatag

SEQ ID NO: 64251 - DNA, 255 bp, Glycine max
  Peptide Sequence Number=SeqID_155936
atggagaacaacgatgggtgttacacggaggcacttcagaaggtccgcaaggcatgggagatggtgcaaaagaaggacaaggaactcagaggcagtagcaacgggcccatcggtggctaccataggtggttgaaagcctacacgcaaggtctggattgtctcccgaatttgagaaccactaagggggtggaagttgaagctctggaggaggacgaagaagttcaggcgcacacggcagaagtcaataaatcctaa

SEQ ID NO: 64252 - DNA, 425 bp, Glycine max
  Peptide Sequence Number=SeqID_155937
atctagcagtttctattcgaagagctaggagggcgtgggcaaggtcggctgagcttccttctacttgtgcagctcctactccagcatccaattcagtagccccttctatcccagctcagacagattctcagcgctttgaagccatgcttcaaagaattcatcaggaagacgaaggtcccacagcccaggtacctcagcatgtggaggatgagtcatctaaggccaccatcctagagccatttgatataggagaagaggcagaggagacacaggtgagacaggtagctactgccactcctgagcgatcccttgaggctactacagagccttctgcaccagtggtaaacctaccgtcacctcagcctgcagcaggccctccacccctcttctatagatgccagaggacccaactacaccaatcctag

SEQ ID NO: 64253 - DNA, 267 bp, Glycine max
  Peptide Sequence Number=SeqID_155938
atggagtggttttacatgatatcccatcccttcatgagtctgacacagcctggggatcctcctaaacatcccaatgtcttccaaggttattttgatgatgccaaagaatcaagagtcaagcaaattccaaagattcaagaatcaagatttaagattcaagaatcaagattgaagattcaagaatcaagtttcaagaatcaagattcaagaataatcaagatcaagattcaagacacaagattcaagaaacaagagaagactcaataa

SEQ ID NO: 64254 - DNA, 132 bp, Glycine max
  Peptide Sequence Number=SeqID_155939
atggccgagcagcaggcgagcaagtctaaagacaaagataagcaaagtactagtaggacacacctagttgctcatgatcctaggaatttaaataaaacaagcacaagctcagaaggtagaaagataccttag

SEQ ID NO: 64255 - DNA, 810 bp, Glycine max
  Peptide Sequence Number=SeqID_155940
gtacattgagcaactgactgaaatgcctcaaaatgttcttacgatgccattgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagagatcatgaaggtgctagaaggggagaaggcctgaggacagcgcgcgctggctttgcccttggagctggagcccttccggaatctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64256 - DNA, 339 bp, Glycine max
  Peptide Sequence Number=SeqID_155941
atgaggtctaaggggattgaacccacagacaacctcaaaaagggattgcttggtggttctatgaacccccctattgtaggcaaattcctaaacaagaggcatcacatggtagctcaaaacgttctaaaaaggagttttgaagatgtgggaagcatccttagtcaagcttttcttgtggcatggtatagcaaagtgtggcatcttgctttaactatcaccccaggtaaagacatagagtcttcttacacctcattgggtctagggagcccaaggacaaagtccatactaatgtctacccaaggtgccgatggaatgggtaagggtgtgtacagcccatga

SEQ ID NO: 64257 - DNA, 582 bp, Glycine max
  Peptide Sequence Number=SeqID_155942
atgggtgatcaagaggagacacaggaacagatgaaagccgacatgtcggctctgaaagaacaaatggcttccatgatggaagccatgttaggaatgaggcagctcatggagaaaaacatggccaccgctgctgctgtcagttcggctgccgaagcagacccaactctcttggaaaccgcgcaccatcctccctcaaacatagtaggacggggaagggacacattgggacacgatggcaaccctcctctgggatacaaccgagcggcttacccttatggattgccgcccaactactcaccacccgtcctgcaagacgatgcgggctatattgcttctcccgtccacaaagaccctcaagactatgctcgaagggatgtcgagttctatcccccgatccccgaagggccggcacccagcacgttgcctcatcccaacatcacgacgccaccaatagttttgtccacggaaggaccgcccccggcaactgaagaaaggaggaagctcgatctcctagaggagagactgagagccgtggaaggatttggggactatccgttcgtagacatgacgatctttgcttag

SEQ ID NO: 64258 - DNA, 138 bp, Glycine max
  Peptide Sequence Number=SeqID_155943
atggaatacttacttgttggtgatgaacaaaagcgcaaaacggaatcaaaaaatgcgaaaaaggatgaccatagggctgcaaattcgtcaatcccgggtggctcgcccaggctcgcccagctcgcccaggcgagctaa

SEQ ID NO: 64259 - DNA, 531 bp, Glycine max
  Peptide Sequence Number=SeqID_155944
atggtagccacaacctaccaaacatctcatgagtgtccggaagaaaccattattgatatcctagtagaaggattttccagacagttgaaagttaagacgaatctcaacggaaaagtcattactaatgacgataataagaagattcctgacgctgttaatacacttatatttacaatagcccaacattttattggagaccggtctctttggaaagataggtctgcagaattactatccaatcttaagtgtagaacattagcagattttaggtggtacagagataccttcctaactagagtttacaccagagaagatagtcaacaacctttttggaaagaaaaatttctagccggtcttccaagatcattaggagataaagttagagacaaaatccgtagccagtctgctaatggagacattccatatgaaagcttaagttacggtcaattaatctcttatgttcagaaagtagccttaaaaatatgtcaggatgacaaaattcaaaggcaactagccaaagagcaagcctaa

SEQ ID NO: 64260 - DNA, 393 bp, Glycine max
  Peptide Sequence Number=SeqID_155945
atggtgggttacacaccttcaagctttgctgacgaaaggatcgaagtgggtctaaaaagagacaaatttaatcatcttgctttgatgaatgcgaaaactggggcaaatgaagagggtgagaataaaggacaaacccatgctgcgactgccattcctatacggccaagtttcccaccagcccaacaatgtcattactcagccaataacgatccttttccttacctaccacccagttatccacaaaggccatccctaaatcaaccacaaagcctgtctaccacacttccaatgacgaacaccacctttagcacaaaccaaaacaccaaccaagaaatgaattttgcagcaaaaaaagcttgtagaattcacccccattctagtgtcctatgctga

SEQ ID NO: 64261 - DNA, 300 bp, Glycine max
  Peptide Sequence Number=SeqID_155946
atggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatatgagtatggccagaggaggaaccggtctgatggggaggcgagtgcgaatcatgcgcaccaacatgaccaccctgacccagatatggatgacgttgctcctcagcaacatcctgcccagcgatcataa

SEQ ID NO: 64262 - DNA, 847 bp, Glycine max
  Peptide Sequence Number=SeqID_155947
tagtattgacatcgccattgtgaaggagttttatgccaacctctatgtccccgatgataaatcacctaagcagatgagggtgagaggtcatttagtgaagtttgataaggatactcttaacacattcttgaagacccctgtaatgttggaagagggggagaacttgtgcacttattccaggttttcactcttaaggtctgatcctcaggagttggctgctaagccttgtatcccagggaggggattcgaacttaatgttgatgggcagcctttgaagattttgaggaagaacatgactactctggctcatacatggagcattctttccttttctaacctcattcccacctcccacacatctgatgtgaccctggacaaagccaaattgatttatgggattattatgaagatggacatgaacctggggtaccttatctcccaccagatctctctgattgcacagcatgacacatccagacttggattctttgccttgatcacaactctatgcaaggccagaggagtccagtcagactctagatccctagagaacttgagccttgccattaacttggcttatattaagaataactgttggaatcttgatgatccaaaagtgacatttagagggccaaggaaggccaggggtaagagatcagaggcccctactacttcagcaccagagacaccaattccttcttcttcgatagctccattacctcccactcaaactccaattattcctcctacacctacacagctaggagcccaaccttctccttctggaaggggtggggcctccgtagcccaggagcttgcttctgaggagccagtagcagcagcagca

SEQ ID NO: 64263 - DNA, 737 bp, Glycine max
  Peptide Sequence Number=SeqID_155948
ctagggaaggcgagactggccaaggagaagttcaaatcagccgctacacacatccggaaagagtgcaccgagttacaagaggaaaacgcggccactgcaaaagcccttgaacaagaaactaaaagggcctgcaaggaggaatatggccgagagaaattccgaggagcattgtggggtagcaacaatgagctcaagctccgaagagaggaaagagaccgatcacgggtgcatggcatgatcttaaaagaagagttagctgcgtgcgcaaggtccaagaggagtttggctcaacacttggaaaccacagagcaaagcatgctagctatcatagggcaatacaaggaagcgttgaaccagtttgtgacccatgaacaaaagctagtggaggattttgcacaagtgtacgccgaaaaagaagcaagaaggagggtgattgatgcattgcatcaagaagcgactatgtggatggataggttcgccttgaccttgaatggaagtcaagacctcccgcgtctattagccaaagcaaaagccatggccgaagaacagatgaaggccgatctatcggctttaaaagatcaaatggcttccatctcggaggtcatgttaaaactccagaaaaccatagaggacaaagccatggcaaccacctccagtacggttagggaagcggagccggtgctgcaacccgcttccaatccgggccgagacagaaacacggtcgtgtttggtcgaag

SEQ ID NO: 64264 - DNA, 339 bp, Glycine max
  Peptide Sequence Number=SeqID_155949
atggcaaccaggcccacttgggccttccagattcttcctccagaaggagggaggagtgaagaaggaaagggttcagccttcttggcacttcgtattcacttgaaatcagtggagaaaattgtttccgtgaagaaaatccaagccgaggcgcttcctcttcaactgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 64265 - DNA, 531 bp, Glycine max
  Peptide Sequence Number=SeqID_155950
atgttcctcctctaccagctcaatatctttcgtttcacctttgcttttgtaaactacattgtaatttacaaaacaaaagttgaaaggaaagatattgacctgatagtcgaggaagaagcacagattggtgctgatcgttctagtgcaacctcgaataaagctaagatttataacgaggaggcacggaagaaaacacagaagcataaaccaaagagggtggagagtgtcaatgatgatgcagaagcctttgctgaagtactagaacatacgaagaaaagagatataggccatcaaagtgtgtcattggagaataagacaggagatttgactatgctgaagatggcagattcagctaaagttgtgataaaacaagacatgaagggaagaaagcataaatatgggtttaacaacaataaacgtgagaagaaaagggtggtggatgatgaaactggcgacaaacatcagctggatgaattcccaaggaggcaaattgaaacaaaaaaccgatgcctcaatcagagaaaaatgtag

SEQ ID NO: 64266 - DNA, 369 bp, Glycine max
  Peptide Sequence Number=SeqID_155951
atgtcaggattgacacgcgattctcttcaaatttcagccggcccatatcaattagaccttgcaccttacgcttcagagccctacaatgctcaatggaatgccccggggcttctccatgacaagcacacattgcgttcgagtcgtattctcggagaaatggaggttgatgaaccttggttggggttatggctaccattgaattatcaagtaggcatgggagcaagctttctcgctgcaaaattcatttcttggttggcgtttttggattgtgctaaaggtgatgttcgtcattggaagtgcgatagacagactttgtggttgattttagggatggcctttgtggataactgggcggtgggtaaggagaag

SEQ ID NO: 64267 - DNA, 213 bp, Glycine max
  Peptide Sequence Number=SeqID_155952
atgaagaaacaacaatggaagaaaagcggaagacaaaggagaagaggtaagaggcggcgccatccactagggaataagccttggaagaaggagcttcaccaccaagatgagccttggagaggatgcttcaatggaggaaaagaaagagggagagaaagagagagggggagcacgaaattgaaggaagaaaaagggagagaagttgaactttga

SEQ ID NO: 64268 - DNA, 312 bp, Glycine max
  Peptide Sequence Number=SeqID_155953
atggttcaaatgatttctgataccatctattgtttgcaggaatcgcacccacaaagacacccagtggacctggaaaaatccaacagggccctagggtttccagctctggttacgggcctctgtagtcctacagggtgctcgttccccccggcaaggtcacgtcatcatgacatagggatcgcgcctgcaagacacacagtggacccgaagaagtccagtagggtcttgaagttgtcaagctctaattacgggtctctgtcagttctacggagtgcctgtcacctccagcaagggcatcaggccccctactaa

SEQ ID NO: 64269 - DNA, 348 bp, Glycine max
  Peptide Sequence Number=SeqID_155954
atggtcattattgtcaatgcagaagcttgtggttacgtgagcctgaactactaccaatatatagatgttgtttatacaaatgagcacatcgtaaaagcttactccgcacaatggtggcctcttgggaatgaagcgactattcctccttctaatgacgcatggacacttatccctgacccaacagcaattcgtgcgaaaggtcggcctaaatcaacaaggataaggaatgagatggattgggtcgaaccctctgagcaccgacaaaaatgcagtagatgtggagccgaagcgcataacaggcgtcgatgtccaatgcaatctgagcgtgggagttgttcaactcgttga

SEQ ID NO: 64270 - DNA, 75 bp, Glycine max
  Peptide Sequence Number=SeqID_155955
atgactctattgatgaagaagatccaaggcctacaagctccacatggagctacatcatgtggtattgttggacaa

SEQ ID NO: 64271 - DNA, 231 bp, Glycine max
  Peptide Sequence Number=SeqID_155956
atgggtgccaagcacctcacaaggacccaaacaaaagttgcatgtcatcaagcaaagcaaaagaatgtttatacggataaccactcggatatttccgcccgtcagcgcgactcaaaagtcagtatgacagatcttgtgagcgcagaagatgacgcttttcgtcttacaaatagcaaaaaggtttatacggatgaccactcgggtatctccgcccgtcagcgtgactcaaaa

SEQ ID NO: 64272 - DNA, 256 bp, Glycine max
  Peptide Sequence Number=SeqID_155957
atgcagggttgcctaagctatcggaagccaatcgattctgaaagatggatctatgttgaagatgtctcctgtggtgaatcctttaatgtaaaattgcatggtactaagcatagaattgataatacaaactcaggagcattatggcacaaatgcttaggtcacatttctaagaatagaattgaacgacttgtgtcaaacggaatcttggattccattgatttcacaagctttgatgtttgtgttgaatgccttaaag

SEQ ID NO: 64273 - DNA, 378 bp, Glycine max
  Peptide Sequence Number=SeqID_155958
atgctggctactggtaatcgattactaccttctgataccttatgccgacctgctaccatctttgctcagaaaccaaatggatgtggtgagcccgagaaaggtctatcaacctcattttccttgatgtgtgtagccttcaagcacaaggtacaaagcttgattgatgctggatggctgacatttcaagaggatagtctgaatgtgaggactaatccactcacttgtcatagaggctcggcggtgaattcagtggaagaatgggagtctcgggggctgaagcagatagggaatgtgtcaaccttcaggcggttcatattggaagcattgcgcgcggctggtatgattgaccttgatggtgacaaggagattcttgtttaa

SEQ ID NO: 64274 - DNA, 579 bp, Glycine max
  Peptide Sequence Number=SeqID_155959
atgagtgccttcatacgccagtggttgaggacaaatcctcaggagattgaagctaggctctgtattccccgcaaggggtttgttttgaatgctgagggtcagccatggaagcttcttagaaaagatctgaagacactggccaagacatggagtgtcttcccttactccaacctagctcccacatcccacacctcagatctagatatggatagaggtaggttggtctatggcttagtgactaacagggacatgaacattagagcccttatcttaggtcagatttattctattgctcagagtaactcctctaggctcagatttccagccttgatgactgccctatgcagagctagaggagttacctctcacagtctgacctatgagagcctgagcctggccattaacttggcctacattaagaaaaactgttggaatgtggatgatctaacagttaacttcagaggggtgaggaaggcaagggtgagaccaactcatgttccttcttctactctaccagctccttccacttctgctactcctacaccagctcctccaggctcatctactaaggactcttag

SEQ ID NO: 64275 - DNA, 270 bp, Glycine max
  Peptide Sequence Number=SeqID_155960
atgctgtggaagcttggaggggttgatggggacccgatgctgagaggaacgaggataagggctacgtgggagtacgtgagcttagttgaaggtgggcaattggggatggtgagttcatgtgtgatttgtggatgtggagagtcgacttgcaccatcgctcgatcgccacctagtaccacatatgacggagtggtatctggagatatgtcgcgggggtcaggagaccttggggatgtcaggtggggtgctattgcccaaaaccaagcttga

SEQ ID NO: 64276 - DNA, 282 bp, Glycine max
  Peptide Sequence Number=SeqID_155961
atgccccatgggttgtttccttacaaaattcatgcgctaatgccattgaggcatttcaccgagcacttggcgggcgcgcgtttaggcatcaatagcaagagaacggggacaatgtggcatagcaccaaaaggagatcaaaatacaccaatgagaagctagaaagcttagggatggaacacttacttgttggtgatgaacaaaagcgcaaaacggaatcaacaaatgcgaaaaatgatgaccctagggctgcaaactcgtcaatcccgtgggtatggctttga

SEQ ID NO: 64277 - DNA, 549 bp, Glycine max
  Peptide Sequence Number=SeqID_155962
atgatgcttggcagttgcaaaggacctacttcatttgaggatatcagaacggttgcaaatatccaatatccaacatatagagaaacatgttttgcaatgggctttttacaagatgacagagaatatgttgaggcaatcaaagaggctaaggactggggcatagctaattatctaaggaaattgtttgtattaattctattaataggtgccatgagcaaacctgaagaagtttggaaccaatgttggcattggctggttgatgacattgcatatcaacatagcaaatcaacaatgaactccaaattacagatcaatgatgatactcttagaaatttgacattgattgaaattgaacaactattgcacataaaccaaagatcactgaaagactatcctacaatgtcatatcctcaggatatcaatctgacatcctacctacaaaacaacttggtattatcagaacttgattacaaccatgatgcaaccagatcagaatttgagcatctttttgcatccatgacaggcaatctacctattcatatattataa

SEQ ID NO: 64278 - DNA, 378 bp, Glycine max
  Peptide Sequence Number=SeqID_155963
atggttttattcagcattttgtatttgactggcatgtacattgctaggtatagagttgaagtaatggttacccaaaacaatgagagtagcaagtttttgctctgggaccatgaatgtgctgaattgaatgatcaaacagctgatgaagtgaatagggtcaagattgaagtggatttttcctctttctggcacgatggtgatgttgatttgaatgcttctcctcaagcacttgataggctgttgggttatgtgcttgcttttaaggttaggattcaatcaaaattcaggaatgtcgttgttcttagatactcaaatgaactagatttgatcaatgttgtgctcgagatgctggctgatagtgagcgatatgatgcatga

SEQ ID NO: 64279 - DNA, 1221 bp, Glycine max
  Peptide Sequence Number=SeqID_155964
atgggctttgcgctggtgccgctgatctttaccctggcggaagatgcgctgtttagcgtgccggtggcactggggcagggctcgctggcgctgggcgcgacaccgtggcaaaccctgacgcgcgtggtgctgccgggcgcgtcggcaggtatttttgctgcattgatgatcggctttggtccgtgcggtgggcgaaaccatgattgtactgatggccaccggcaacacgccggtgagcgaaggcggacttgcgttgctgctgctgatattcacgctggcgatcaacaccgtggcggaactgattcgtcagcggctgcgccagcgctacaggcgttctggccgcagccggtcgatcagtatcagttccagccgccgcagggggcaccgctgagggtgctgggtgaaacgctggatcgccagcagcagggcgatcgctggcgctacgtagtgaaaaccggtaaccgcgattttgccgcgccggatttccgcgtcatcgttagtcagggcgaagcgcaaacccgacgcccggcagaagcgctggtgctacagcgacgcagtggcggcaatgcctacggctggctggttgagctgcgtgaggacaacgaggtgctgaccgcgcgcgaccgcgatgcactgctgcagcagcggctgaagcaggtgcatgagcagctgcgccaggcgagcaacatccggcgtattgaaatggcgcgccttaacgcccagctggagagtctgcaacagcaggctgacgagcagcggcgcggtggtcacttcagcctgcaggatcagtcagaactggatgccaacagcgcggcgctgcataaacgcttcggcgcgctggcgcagcagctggcgcatctgcagcatgaaagccagcgcgatacgctggtgctgcgcgacgtgcagggcgacgatcatctgattccgctggcgcaggtggtggccgcctggtatccaaacagcctgagcatcgggcagaaaatcgggcatttcctcagtcagatctggcagtttgtcagtgactcgcccacctcgggcggcagtgaaaatggcgcgctgccggcgattttcggcactgttttgatggtgctgctgatgtcagtgattgtcatgccgctgggcgtggtggccgccgtctggctgcacgaatacgccgggcgcaacgcactcacccggctggtgcgcattgcggtggtgaatctggctggcgcaccgtcgatt

SEQ ID NO: 64280 - DNA, 319 bp, Glycine max
  Peptide Sequence Number=SeqID_155965
gcataaggcattgcgattgaatgctccattgccttaccctcatcttgttacccgttttcttcaacacttcaacatccctcttgattttgaaccttatgttccaatcaagagatctttccttataggcgcttcagtcatagcatcttttggttatcaaaaggagcatgatggctcttgggtgaagaaaggtttgacaatttggaattacaaagtggatatgcgcttcaatgaaatggagtcaagaatcacaaaggttgaagatgtgtcttacattcgttcaagcttcgatcttccaccaccgtcgccaccatcatcttag

SEQ ID NO: 64281 - DNA, 435 bp, Glycine max
  Peptide Sequence Number=SeqID_155966
atggccccgaggaagcttgcctcaaagaggtccaggaaggataaggcggccggaggaactagttccgctcctgagtatgacagtcaccgctttaggagcgctatacaccagcagcgcttcgaggccatcaaaggatggtcgtttctccgagagcgacgcgtccagctcagggacgacgagtatacggatttccaggaggagataggtcgccggcggtgggcgtcactagttacccccatggccaagggtcagtggatcccgtttgatgccgatgctatcggccagctcctgggatatccgttagtgctggaagagggccaggagtgcgagtatggccagaggaggaaccggtctgatgggttcgatgaggaggccatcgcccagttgctatgtataccggggcaggattttgcccggactgctgccggaagactg

SEQ ID NO: 64282 - DNA, 168 bp, Glycine max
  Peptide Sequence Number=SeqID_155967
atgaatcttgaagaacagtcgagaatcttcgccaaaataggggagaagcttgtcgcccagctcgcccaggcgagcaaggttgctacctccagaagcaacagccttctggaggaagggtctggaaggcccaagtgggccagattgctatttgcaccccccttttactaa

SEQ ID NO: 64283 - DNA, 546 bp, Glycine max
  Peptide Sequence Number=SeqID_155968
gtcggaattatgatcggtggcagggatgttgctgaggagcaacgtcatccatatctgggtcagggtggtcatgttggtgcgcatgattcgcactcgcctccctgcagcagtccgggcaaaatcctgccccgaccggttcctcctctggccatactcgcattcctggccctcttccaataccatcggatatcccaggagctggctgatagcgtcggcatcgaacgggatccactgacccctaacccaggatctcatgtcacgcacgccctcctctgttggccaagcattggcataaaactcaaggactacttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 64284 - DNA, 261 bp, Glycine max
  Peptide Sequence Number=SeqID_155969
atgcacagctgcagacctgaggactacatacagtcggcccagccccaggttccaatagcatttgacccccctccacatgtggatggttacaacggatatgaggcgattgcacagaggttggagcgtgtgctcaagcttaggatagtcactgcaggcacagagttatatgacattatgcaagattgcctgacgattgcgagagggggacccagtgctgatgggactgtcagggctcgtcagagacgccgcacggaccattga

SEQ ID NO: 64285 - DNA, 333 bp, Glycine max
  Peptide Sequence Number=SeqID_155970
atgcttgccgcccagctcgcccaggcgagcagggttgcttcctccagaagcaacagccttctggaggaatcttctggagggcccaagtgggcctggttgctatttgcacccccatttttactaaaatgttacggaacctcactaattgtgcaacgatgcttccatttgatttccggtgtgtcacggaaccttacggattgtgcatcaatattttcttttgttttccggcatgtcccggaatttcacaaattgcctaatgatgggtgccaagcaccttacaaggaccaaacaaaagtcgcatgtcatcaagcaaaggtccccggacgaaattag

SEQ ID NO: 64286 - DNA, 183 bp, Glycine max
  Peptide Sequence Number=SeqID_155971
atgttctttcatgggaagatgcccaggaaatgggtttttagaccttaccttacttcaacataccaaacacgggggggtgttgagggaaggagcccagagtatgaagaacctcgggatttgaggtcaaatccttttcaaggtggagggaatgatgcaatcataccccgcaagggcattgggtag

SEQ ID NO: 64287 - DNA, 307 bp, Glycine max
  Peptide Sequence Number=SeqID_155972
atgattgctcacatcccagatccaagggttgatccttctcaatatcgtgatttagtacattattggtgttctgagaaaggacagactacaaaggctaagggagtgcaaccttctagggcagaaatttatattgacactcgaactcgaaaagatggaagcattgttactgaaaaggctgctattgtaattgatgaactaaaaaagaaaattgttgaagcagagagttcgcaaaatttacaaagcacccaagattctactgattggacaaatgatatatattcaaaagtcaaaggacctgaaaaaagag

SEQ ID NO: 64288 - DNA, 186 bp, Glycine max
  Peptide Sequence Number=SeqID_155973
atggatgttatggactggtgtgagcttgagaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 64289 - DNA, 495 bp, Glycine max
  Peptide Sequence Number=SeqID_155974
atgacttgcatccttttgagttcaaccattcccacttctgcaccatggggagtgctgaaacgtctcgagcctgacgtgagacccaagaaacccactggggcgaaatccaggaagggaaaacaagaagagaaggaagaagaggagagacctctcataagaaaaagaaagttacctacgacttcgaccaaatctgctgaccaaacagaggcaggcaattcccaggctcaaatgcctaagaagaaaaagaaagtgaagcaggtcgagcctgaaccttctgtggctgtcgaggatggtgagccagccaagaagaaaaagaaaaagaccaagtcttcaaaagaacaaggtgacaatcaacctgttgacgtccaaccaccttcgaccgatattggcggcactgaggtagaagctgctccttctgttgctgagatgggcaaccctatcgagcaaccgaacttaccacaagaacaacctgtcgtcgaggtatcattctcttaa

SEQ ID NO: 64290 - DNA, 285 bp, Glycine max
  Peptide Sequence Number=SeqID_155975
atgatgatctttttctttcttgaacgacaccataggatatgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcggggggaagggtgtttccctttgctcctacgtattcctcaatttgggatgagaaaatcagacctacgtag

SEQ ID NO: 64291 - DNA, 487 bp, Glycine max
  Peptide Sequence Number=SeqID_155976
aggcaatccatctgacttacaaccctttgatcctgagatagataggacatttcatagattagttaggcatcattttgtaccttttgagcatcttgagcattctattactggtgagtctgtgcattctgttattggtgattttgaacatcctgattttgagcattataattttgaacattctgattttgaacattctgagaacatggcacaacctccaccccgtgagaggactctaagggaaatggctgcacctgatttcacctacgaaagcttgtgcatccaataccctgatgaggatgtcccatatgttcttaaaactagactgatccatttgcttccaaagtttcatggccttgcagggactggctatattaccttgctccaaggtccatcacgagctggggatgacctcaagagagtattcttagagaattttttccctgcttctagggaccccggccatcagaaaagatatttcagaaattag

SEQ ID NO: 64292 - DNA, 273 bp, Glycine max
  Peptide Sequence Number=SeqID_155977
atgatgtcaagattgagtcaacaagttcaagatcaagtttacagaaaagacatcaagaagaatcaagattcaagagaagatgatttcaagattcaagagaataaaccagaaagcaacaagtcaagacttcacaagggaatgacaagttttgagataaaaagtcaaggagatgtaactcttccaatgggttttctcaagatttttctcgaggttataactcttccaatggttttcttggccagacatgaagagtctataaaagcaagaccttga

SEQ ID NO: 64293 - DNA, 322 bp, Glycine max
  Peptide Sequence Number=SeqID_155978
atgggctatgtgggagtacgtgagctcagttggaggtgggcaacaggggatggtgggtttatgcacgcattggtgaaacttcctgcttttattgttgaccatagagtggtacctggagatatgtcgcgggggtcaggagaccttggggacgtcaggcgagctcctgccaatcaaccgataaaaggaacaaagaccacaaagcaagggaggcttgcgtggtggctgggccagctgcttagaaatgagactggaatgttgaaggggcctttggtaatcgattaccagtgctgggtaatcgattacacagaggaacaggccacta

SEQ ID NO: 64294 - DNA, 439 bp, Glycine max
  Peptide Sequence Number=SeqID_155979
gaaagaacgcgctttacggcgcctttaccaaacgtgtgctaaagctagagtgatgagtgaaataaaggaggtacaagaacagatgaaggccgacatggaggccatgaaagagaaaattaccacaatgatggaagctatgatgagtatgagaaaaatgatggaggtcaacacggctacagtcgttgccgcaagtaccgccactgaggtggacctgactcacttatctggcctcaatcaagtaaatcatccaatctcagatatggtaggtcagagaggcaaagcattaggaagaagagggcctcctgctatggtggaatgggagaaatttgatcatatagaggaaaggttgagggtcattaaaggaggggaaaattatgcctttgctgacatggcagagttatgcttagttcccgacatggtcattcctccaaagttcaag

SEQ ID NO: 64295 - DNA, 117 bp, Glycine max
  Peptide Sequence Number=SeqID_155980
atgtggaccaccacgggggagatgcttgccgcccagctcgcccaggcgagccaggttgcttcctaccaatgcaacaaccttctggaggaatcttctggaaggcccatgtgggcctga

SEQ ID NO: 64296 - DNA, 531 bp, Glycine max
  Peptide Sequence Number=SeqID_155981
atgactaggggcaatccaggtgatttacaaccctttgatcctgaaatagatagaatctttcatagattaattaggcatagtgtgcatcctgatcattctatacattttgagcattgtgagcattttgagcattctgagtattctgttactggtgattctaaatattctgattttgagcattcaactactaattttcatactgagaacatggctcaacctccacctcgtgagaggactcttagggagatggctgcacctgatttcacttatgaaagcttgtgcattcaatatcctgatgagggtgttccatatgttctcaagactggactaatacatttgctgcccaagtttcatggtcttgtaggtgaagatcctcataagcatcttaaggagttccatattgtttgttccaccgtgaagccccctgatgtccaggaagatcatatctttctaaaggcttttcctcattctctggagggagtggcaaaagattggttgtactatcttgcgcccaggtccattttcagctag

SEQ ID NO: 64297 - DNA, 267 bp, Glycine max
  Peptide Sequence Number=SeqID_155982
atggaggttgaggaaccttggttggggttatggctaccattgaattatcgagtggataggggatcaagtttagcatatgacaacggaatttggggctttgtggttgatttagggatggcctttgtggataactgggcggtgggtaaggaggagacccacatcgatcctttcactggcaaagaccaaatcctcaaagctttgaaggttctccacctttgggcgtattctttgaaagatttgtgccccctttttgcacatgttctgtag

SEQ ID NO: 64298 - DNA, 82 bp, Glycine max
  Peptide Sequence Number=SeqID_155983
atgggaattatggtggagtttgttagagagggagggagtgctactagaataggcataaaatgtgtaaggggattctgggagg

SEQ ID NO: 64299 - DNA, 756 bp, Glycine max
  Peptide Sequence Number=SeqID_155984
atgatgagtgacgctagacactttgtgactggcacctttgtcgatggtgtggcactaaacgcacttggtcttgaagatcttctcatcgtttttagagttttcgggaggagcttcatcgaacaacaaaagttagaagcaatagatggaagctctgtcatggtgccagttcttgttgtctctacaactgaggcagctcgtgaagttttgaaaacacatgaccccgttttctccaacaaaccacatcgtaagatgtttgatatcctcttgtacggttccgaagacgtggcatctgctgcatacggcaactactggaggcagacgaggagtatccttgtcttgcatcttcttctcagtgccaaaaaggttcaatcttttgtggccaatgatatagtgtgtagagctgctctaggaaggagatacagtggagaaggagggagtaagctttgcacgcagatcaacgagatggtggagctgatgggtactccgcttttgggagactatataccttggcttgattggttgggaagagttaacgggatgtatggtagggcagagagagcggttaaacaggttgatgaattctttgatgaagttgttgatgaacatgttagtaagggaggccatgatgatgctaatgaggatgaccagaatgatttggttgacattttgttgaggatccaaaagacaaatgccatgggatttgagattgataaaacaaccataaaggctttgatccttctacgtacgcaagattag

SEQ ID NO: 64300 - DNA, 312 bp, Glycine max
  Peptide Sequence Number=SeqID_155985
atgacagctggcacaggcacaactaacagaaggataaaaaagataatgttggtttcttgtgtgctcttgtgggtttgctgcttggtgggttgtttttgctatcaataccctcctttggtagaacaacctttccctaaggttgtaggaggtgcaaatagaatcccaatcttcctatgtagtgtcctccggagccaaacctgtccactgcaccaagacttttcgaacaggggaagtgtaattagtatcccatttctagtccaggatagagagaggttcgactatggaatgattatcagactggagaggaggtaa

SEQ ID NO: 64301 - DNA, 864 bp, Glycine max
  Peptide Sequence Number=SeqID_155986
atgggctcttccaagagaggtgttgggaggtgtgttattggaaggagatatggtgggagtgagcttagggagccaatgagtcagatggaagagttgtatggggtttcagttataggggactatttaccttggtttgattggttgggaagggttaatggggtgtatggtagagcagagagagtggcaaaacggcttgatgaattttatgatgaggttgttgaggagcatgttagtaagagaggccttgatgggcatggggatgttgatagtgaagaccagaatgattttatgggcattttgctgtcgattcaagagagtatcaccacagatttccagattgataggacattcgtcaagactttggtcatgttattatttgcaaattgtaactatgaagccagcatgtttgttgcaggaagtgatactacccttggagtcctagagtgggctatgacagaactcttgaggcaccaaaatctggttgcgacaagagttaccaaagtgatgggttatgacattgcagctggcacacaagcattagttaatgcttgggcaatttcaacagacccttcatattgggaccaacctctagggtttcaaccagagagattctcaaagagttcaatgaatatcaaaggacatgatttccaattgatcccatttggagcaggaagaaggggttgttcaggaataggctttgtcatggctttgaatgagttggtccttgcaaacattgtgcaccaatttgattggtcagtgccaagtggagtggttggggaccagacacttgatatgtctcaaactactggattgactgttcacaaaaagttatctctcgtgactcttgcatcacctaatgtgtaa

SEQ ID NO: 64302 - DNA, 1383 bp, Glycine max
  Peptide Sequence Number=SeqID_155987
atgcctattgggcatcctcagtccactggaattgatcttttcgaaataacatggttagagcatggcactgatcttggaggggtcaagggccactcccgctgccgagactatatggcccaagtactgaagttcagttctggcaaacagacacttctgccggatgtcattgaaaaagaatgcaacgaacttgcgaagaaacggtttaagcaattcattcatcatggcttggaacgttgccagcgcattgcagaggccgaagggtattactttgtattcgtaatgtccttgatgggtgcgaaaagcagttttgggcacgtcgtcggtggccatggggatttgatgaaatccctgacggagcatattggctatttgacgctcaagctcaactttctgactatgagggtatcggtagggtcgtatattgacgggttgggaatcagggtggttcctgaaagaggtgatcgtaacgagaaagaaggtgtagtaggggaggtggaggccgaggtggggtggaagggaacattggcggtgagttggattggacggcctaacaaggagaagctcatggtgcgggagtggaacattagggcaaacttgttggcatatgagggtgccgccatcgccaatcataacttagagagggttgatgacggtggtgtgcagggtgagaaattaggcgacctgggcttgaatgaagttctgggtactgctgccgtcgacaaggatcgcatgcctgacaaggcattgagactgagctgcagggtttctgatagcggtggaagaggaaactgtgagatcgggtctggtgtctcaagcgtgagtctgtggtctctgcaagaagtgagcttctccgaagaaaggcgtttcaccggcagcttgggtggtggtggtgaagtggtcgtggtggagagtgggcaaggagttgcagcttgtcctcctagagcttggccagggcgaaatgttgcggcagcaacattggttgaagggcttgcacctcacggcggagcctctttgttgaagcttgaacaaagtgccatgagggtcctcgtagaaggatggtgcgaaacaagcttcgagggcctccacggtcagacgctcattgtcagggatgcaatgatagtcgaagaactgggtgattttgaaaatccaccccggtggatcattaccgtcaaatcgagggacgtcgagcttcatgtgcaaccggggaattggagaggaagggtgatttggctgaggcgttcaaggatagaatcaatttttgagtccatggttgattggctttgggaaaaggtggagcatagcctcctcaagtcgctccgtggttgcttgcttggtattgtgctcaggcatggaggcacgacagggcagatcagaccaagttga

SEQ ID NO: 64303 - DNA, 468 bp, Glycine max
  Peptide Sequence Number=SeqID_155988
atgttcaatgtgcgtttgagggactccaagaagaagatggtgtttccaaagaaactcatcaggcctccccgccagtggttcaataacatttgggtcctccaatcacaaatcacaaggtatccgtgggaggaagtggaacaaaattttttgggtttgtttttgtggcaaatttttccagatggggcacttttaaaaactatttccccaaatgggatagttttgaaagaatttactcaagggagctgttttttacgtggtctgcatggattacaaagcaaaccgccattggcaatggcgagttcgctgtgcaacgtccacgtggcagataaactgccattcgtgatggcgagttggtgtcaggtggaactcgccacctctgctggtgaagtttttgatcttctttggcctacactgtttttggttgcttttcttagtacgtacttgaggttagatttttataagttgtaa

SEQ ID NO: 64304 - DNA, 153 bp, Glycine max
  Peptide Sequence Number=SeqID_155989
atgggatcttcattagttatggatgctcatttgggtttaatgtttgtgtttgtggttgttgtgatggggttgttgtatggaggttattgtacaataatggttgtggagacggtagttgtggttgtggacacagtggttgtggttgaggaataa

SEQ ID NO: 64305 - DNA, 504 bp, Glycine max
  Peptide Sequence Number=SeqID_155990
atgagatccccagggacagatggacagatgaacataagttcatatttcttctcaactttcgcgcaagaaatgctctgttatgcgctctatctcaagaagagtattccaaagttcacaacttcagaatacgaactcttcagtatggaagagggagaagatatccaaaccatgtttggatgcttccaaatcattctgaatgagcttttatctctagcgtccgctaagtgcaacactattgggctaagcacaaggaagactctggaagaagatgagttgtataggttcgctgagcgcatcacttcatctcaccaagcgcaccgcttcagctcatccgctaagcgagagaagtgcgctaagccaaaatccactaatgagagtttggactgggattcagagcttttcctgtctagggtttctagagagagaaaggtccaagttctagagagttttgagagattttgctgtgtgaagatctgcagagaccaaagcttgaagcaggagccg

SEQ ID NO: 64306 - DNA, 153 bp, Glycine max
  Peptide Sequence Number=SeqID_155991
atggatacaagtgagagtggtatcaaagatccgactagaagtgggtttggtgatacaaaactgagagcaccccatcctatttatagagtctgtccatcacagagctctctcaacttgttatcagaacgtgagataggaagttatcagacgtga

SEQ ID NO: 64307 - DNA, 246 bp, Glycine max
  Peptide Sequence Number=SeqID_155992
atggttttattaaaatcatctttgaaatatattctggttcagtctataccctcagtctacgtgcccttctccgcatacctcctttatttgtgtcctagcctcactcaaaatatgttcttccacgaggaacaccatttccgtcttctccttccacctgcgacaacgacgaagacaagctcctccagagcggtagcgagatgtcaacactcccatttcctcaacctcaggaaagtgtttggaaagtga

SEQ ID NO: 64308 - DNA, 450 bp, Glycine max
  Peptide Sequence Number=SeqID_155993
atgaaaatgtttaatggaatattggtacttccaatctctctaatggtgcaatatatatctgagaagggacgtgtaaggtgggatgaggctaatattggagaaattgaggcaaacaaacctgtgaggcagaaaattactgagcctaagactccatatcatcctatgattgatgatgacagtatcaatcttctgaaaatcagcatgtattacctaatttttctaggttctctatctcctgtacgaggaagttttgatgcatgtattgataatgaaaatcgtgctgaagcaatatggagtgctctgaatgatgtagcctccagtagcagaagaggcactggacaatctggtggttggacatcatctgaggatgagccagaagcaatggagcaagatgatgatgataataacggaatcagggattctgacagacctagtaatatagagctataa

SEQ ID NO: 64309 - DNA, 153 bp, Glycine max
  Peptide Sequence Number=SeqID_155994
atggctcttatcatgtttcctttcttggaatctattaatctgaaagctttagctgtttctagattaaatgctactgtactacactatgaaacaaacaatatgctctacaagggattgagaaagaaagctagagtgatagaagacactaactaa

SEQ ID NO: 64310 - DNA, 1677 bp, Glycine max
  Peptide Sequence Number=SeqID_155995
atggggaattcatttgggtgttcggcttccggcgagaggttggtgtcggcggcgagggacggcgatttggttgaggcgaagatgcttctggaatgcaacccttgtcttgcaaagtactcaactttcgggggtctcaattcccctcttcattttgcagcttccaagggccataacgagattgtggcattgttgcttgaaaatggagctgatgtgaattcgagaaattattgtgggcagaccgctttgatgcaagcttgtagatatggacattgggaagttgtacagacccttctgctcttcaaatgcaatgttatgaaagcagattatctcagcgggaggacagctcttcactttgcagccatcaatgggcatgcaagatgcattaggcttgttgtggcggattttgttccaagtgctccgtttgaagcattacatgctcacatggttgctgaggcttcgtttgtgaagttggctttgttttctgcaattcccacaatcccactcagcatagccaaaccctgcatgacccacggtggagacaccagatcttctagaggtttacacagcagtggcgtttctgatgggtttgccagaggtttgcacagcagtggagatgagatctatgcgtttcagcccttctgctgcctgcaacaaatgaacaaattcattcctctgcttgagcttcttcaagttgaagagggtgcgctgtccaagtttataaacaaaacagctgatgctggtatcactgcccttcatatggctgcattaaatgggtactttgattgtgtacaactgctacttgatcttagtgctaatgtgtcagctgcaacatttcattatggaacatcaatggatttaataggtgctggaagcactccattgcattatgctgcttgtggaggcaatttaaaatgctgtcaggcaagaattgcttcaactttgataggtgcaagtcgaatggctttgaattgcaatggatggcttccacttgatgttgctaggatgtgggggcgccattggcttgaacctttgttgacacctacttctgatgccacaatatcatcattcccttcttcaaattatttatcccttcctctcatgagtgtgctcaacattgccagagagtgtggactgcaatcaactacaacctcctctaacgaagttgatgcttgtgctgtctgcctggagagacaatgttctgtggctgcagaaggatgtgggcatgagctttgtgtaagatgtgcactctatctttgctcaacaagcaatgtttcttctgaaacgggtgggcctcctggttctatcccttgtcccctttgtagacatggaattgtctcttttgtcaaattatcagatcgaccgtctctttctcttacccccgagattcgaagaaaccgtgtagcttctgttccgtcggagatgctttgccccgtcacttgtactccatttccatctgtagcaattcctctgtgtacatgcaatgatggtccttgtccatcatttgaaccccgggaagcagaagcacaagatggatcacctcgccactcacaagctgcgatgatggatcagaataaaatggatggtccgaggctggagaaaatgacatgctcaggcatgttttggggtagaagaagttgcagcagggagcatcaatgcaattcagaaataaatgcttga

SEQ ID NO: 64311 - DNA, 469 bp, Glycine max
  Peptide Sequence Number=SeqID_155996
atggagtatgctatgcagttcttgatggggctgaacaaatccttctctactatcagaggtcaaattttatctatggctccctttccctcagtaactaaggtttttgccttagtttttcaagaagaaaagcaaaaggaagttggtgcttccacctctgctagtgaagtttcacatgcttttgccttgaagacttcttctgctacacgcaatcatcctgacaatcgcttcaaaggatcttccaagaatcgccccttgtgtgctcattgtgcaaagaaatattctttttcttctgaaccaccacacaaggttgctcaacaagtatttgttgatatgtctcactcacaaccttcctctggtgactcgggttcccagtttcagcttactgcccaacaatatagccaattgatgaatattttagaaagacatgttaccaatgttgtcatccctcaaggtgttttttctgccagtg

SEQ ID NO: 64312 - DNA, 186 bp, Glycine max
  Peptide Sequence Number=SeqID_155997
atggtctcccttattcgttgcatggagagccgcaacaacaccgtgggggatgtgaacgtcatcgccaactcccaagtccaatcgatcatcgtgcaccgccacttcagttccaaatctgagactgagatcaagggaattagtgaaaaaagaggaggtggtggtggcaccacaagagagaagaaatag

SEQ ID NO: 64313 - DNA, 147 bp, Glycine max
  Peptide Sequence Number=SeqID_155998
atggcgaaggagtatatgaagagggagaggagaatgaaaaaaaaaagaggcgagaaaaaggtgatagcgaaatccttgaggctgctggaacgcatactccttcaagtggtggtgggtaacacttctagggcaggtgttgttatttaa

SEQ ID NO: 64314 - DNA, 204 bp, Glycine max
  Peptide Sequence Number=SeqID_155999
atggtggttttgtgcgagagagcagtggtggcagctcaaggagcaatgatggttgtgcgagtgagcgacaatggtagtttaaggagttgtcttggttgtgagggagcaacgttggtggctcgaggggcaactgtgactgcacgagggagcggtaccagtggctcaaagggcagtcgtggttgcgttagggagcggcaacactga

SEQ ID NO: 64315 - DNA, 432 bp, Glycine max
  Peptide Sequence Number=SeqID_156000
atgacagggagttaccgccattgtcattggcaagacaagcacaggctacacagtagaacgcagaacagcagcaggctagggtttagcttttctgagcatatcgccattctattaatgacatcttcgtcaacatgttcatcaaatataaagattaagtctggtccaattgatggtgacgttttatggatgcaagaaagatggaggccggaaacacatacttttcacatgagatacggagagtgcattattactcttcaagttttattacgtctccgtgtggatgggttaccattaattggtccaataaaccttgattgggttgatttatgtgaagaattgttaggagtcagaccacaagaaggtgaacttcaagagagatgtgcagcgccaccgattataaaactaaatcaatcgaaggtggttgtgacgtga

SEQ ID NO: 64316 - DNA, 1020 bp, Glycine max
  Peptide Sequence Number=SeqID_156001
atgtcatcatcaacaatacggagagatctagaaagtggaggggcgaacaagaacatcaacaacataagctacagtgccgctcccacttcctatgtttacgatccggaagttcattggacatcgtggctcgtgccgctgtttgtggcggttaacgttgtggtgttctttgtggtcatgtatgtcaacgattgccccaggaaaaatctcggctttgaaggggattgtgtcgccaggtttctgggtcgcttctcctttcagccccttagggaaaatccgttatttgggccctcttcatccaccttaacaaagatgggagcacttcggtgggatgatgttgtgaatcatcatcaagcatggagactcgtcacttgcatttggttgcatgctggagttgttcatttagctgccaacatgttgagtctggtcttcattggcattcgccttgaacaacaatttgggtttggtatgtttcttttatctgcttatttcagttttatacctatggacatggtcacccatttggaagtgttcatgttcttttgtgttcttcaaattttgcttttgaatggttatgacctcacatttttgaaaacattggcagtgaggataggaatcatttacttgttgtctggattcggcgggagtgtactgtcttccttattcattagaaacaatatctctgttggtgcttctggtgctctatttggacttcttggtgcaatgctttcagaacttatcacaaactggagtatttataccaataaggcagctgctttgttcacacttctgtttattattgtcatcaatcttgccattggaatgttgccacatgttgataactttgcgcatattgggggattcctctcaggatttctccttgggtttattttgctgctccgtcctcaatttgggtggttagaacaacaacgtctccatgctggtgttcacctcaagtccaaatacaaggcttaccaatatgttctatggattgtctctgccattttactgattgttgggtga

SEQ ID NO: 64317 - DNA, 285 bp, Glycine max
  Peptide Sequence Number=SeqID_156002
atggtgatgatgatgctggaaaaagaaggttcaaagggaaaggaaaagagaaaaaaaaatcagaaaaatcataccggtatcaacaaagctcaagcacatctagcagaaaatgaagaagtaatagttgttgtggtggtggaggcaagcttggttgataacaagctttttcaccactttgaggatgttgttgatggagagtgtgtcttcatgggaaattctactacagctggagtgcttggtaaaggaaagattcttctcaaacttctagaaaaaatttatccttga

SEQ ID NO: 64318 - DNA, 459 bp, Glycine max
  Peptide Sequence Number=SeqID_156003
atgattcttgtaccaaaaaaaaggtggaaaaagaaaaaaaaagcgtaccccgcagccagtgtccacggcggttcgaaccgtcccgtcacggaggttgacgaggtcggcaatgtcgtcgatgtacttgtctgctccgttggggaacatggtgccgccgccggggaagcggaacctgtcgccgtcgtagcggatccagttctggacggccttctccaccgtgagctcgcggtggggcacgttggcgtaccacgcgacgtcgcggctggccggccaggggaaggggttccggtagccgtgcggggcggggacgcggcacttgagaaggtcgctgttcgtcggacagtggcgctcgcggtagaccattctcctgcgcgagtactggagggagcgcgcgtggtcctcgcagggggtgtactcgctgagcgacacgtggcagggagggtagtggagggtggttga

SEQ ID NO: 64319 - DNA, 213 bp, Glycine max
  Peptide Sequence Number=SeqID_156004
atggagatgaaacgacaccacaaggaaaaactccaaaacactgaccatgatcagctagaggctcgtttaagacacccccagagcaacgagtactctactcacaaattgcttgaacgcactcaagagggatcacacccccgacgcataatcaacactcaagatggtccaagtctatcccatatacaccgtctaacagggcggacttctcgttga

SEQ ID NO: 64320 - DNA, 612 bp, Glycine max
  Peptide Sequence Number=SeqID_156005
atgaggcctcagtcatcaaactcgtctggtttaagatttatcagtgggattatttgtaaatccaaggttcttaggtttgaaaggatgttgttttgtgctatgagaggcaatatgcttttcattcaggcaccgactgatgaacaaatcatggatcttgtttcagctgagatggcaagaaccaagattttgaaaatttgtgaggcatttggtgcaaattgttatcctgttgctgaagatattagtaagcagaggcaaataactagagaggtgtgtgtgcttggcttagctccattaatggatcctctgtcaacatatttgtatgatacactgcatcccaaagttgttcatgaaacaaatattgattttctttgtgaccttcttgatatacttaaaatggaagtcctgggggaacaacatagtaggaggagtgaatcactagctggtcttcgtcctacatttgagagaattttagtagatgttcatgagcggttcacatttcgtgctcaaactcatatacgggatgagatagtgaattacatgcctactaatgaagacttggactaccctgaaaagcagaagagatatgctgaaaatgtgactgcttttcactaa

SEQ ID NO: 64321 - DNA, 207 bp, Glycine max
  Peptide Sequence Number=SeqID_156006
atgtggtgtcgaagagtttggttcagtgcttggtcgagtcatcgagcagtgcgaggtagattggttaagcgagatgcatccaactcgcttagtggatgggaaaccctagaagaggataagtcagagatctgcacgcccagtgcacaaccagcctgcccagcgaggacgttgtgtcttcttgcgcttagcgcgcccatgctcgcttag

SEQ ID NO: 64322 - DNA, 480 bp, Glycine max
  Peptide Sequence Number=SeqID_156007
atggaggagggtgttgccactgtggaactggtcctgctcagagaagtatctaaagcagtggtccagcttccaccaagagagggcgatctactgttttcttcacactattgcttctgttggagttctagtttttccagcattagcttctggcattttgcttgtgcctcatgtctctccttgatgaccctgcctaagaggtcattcacatggatcaattcacattctcttcttgtaatgtcctccttagctgatgcaattgttgcatctagcaacaagtttaggagtgttctaaggctttatgctgattatatagctgaagcagaagcaacagctgctattccagcagcaacttttatgcccaaaattccattaggagcaattttagccattgttgatcctgtggtcattgctgtttcgaaattcaaagtggtcctgtggtcattgctggaaagtcaattatgtttgaagcctcgaactcag

SEQ ID NO: 64323 - DNA, 210 bp, Glycine max
  Peptide Sequence Number=SeqID_156008
atgtgcgagttgtcaattctttggttggtttatggagcaaaggcagaggcaacaattgctattgggttcgatgacttcatttcagatgcattgcgaggtactgcattctatcagaaggcacaattgcagattaaaagggttgatggcaaagaagctaacattgctggagaagtttttgagagaacagaggaaaaattccgaatgtattaa

SEQ ID NO: 64324 - DNA, 582 bp, Glycine max
  Peptide Sequence Number=SeqID_156009
atgggtgatcaagccacaagcataaccccctacactgccgaaaaacccacactgtcctcgctcgaacccacaaaaccccctacactgttcttggaagtgtggctcgaagaaatccctacatacattgttgctacaaaggtgttgaaacactcatgggtgctcaaagctcaaagctttctccgtgaggtactattgctgattgaggtacgaggaaagcttaaagtttcatgccattttgttagatctcactgccattgtcactgtttgggttcgagactgcttggagcaccagtagagataactagtgataaggatcctgttattgttcataacaagttactgacacttcttgtaattattttggagtttggggcacttgtttgcaaactttccttccgcgagttgaatggccatccaatggccttattgaataccattttttatgcctctttgaaactagtcaatgcaaagaaaaagaatttgaagaaggcctacgatgatctcctaactcacccttctctcctccgcatgttccctcatgatcctacctcaagactcagttcatcttcgtccacaatgtga

SEQ ID NO: 64325 - DNA, 1025 bp, Glycine max
  Peptide Sequence Number=SeqID_156010
ccagcgatagtagcatctctagcggttccctgagattcctccagttttttcctctaattgctccgatagagttgtcaaacgtcagggagacagagaagggattgaagcctccacttatattgtcttggtgcgattcctttttctctctccgtgaatattatcatgcaaatcccaacggtgaagaccattttgagtttctgcgggaaaggaaaagactacgatgcgaaaggtatttctctcatctcaaacattatatcaaaattcccaacggtgagaatgctcggaattgggttgcgaacatagtgctcaaattttacgatgatccaatggtgaatcgttccaagatcgtcttttttctgatacaggccactagtagatcagggatcatgtggccagtaaaaataggcgtggagtctactgagaaatggcttgacgggcataataggcgccggaggaaacctcaaccatcctctcttttcatggctgctgagaagttcatgtacaattacaaagggagagatgtggtggcttgtctaaacgaggcaatggaaaggcaaggaatagacatgcgactttctgctctggtgaatgataccgtggcactgttagctggagtagaatactgggataatggtgtcgtggttgctagaaccaatgcttgctatgttgaacagatcagtgccattcctaacactgactggggtgccttctcaaatggtctccctttaaccaagatcaatagggaaatggatgttgctaccatcaatttgggtgatgagcagatatttgaaaagacaatctcgggaatgtatctaggcgaaattgtcagacaagtgctgctggaaatggctgaagagggttgtttgtttggaaaatgtgtgccgcagaaactatctacacctttgatactcagggaattccttcttggatgttttatgtcaaaagtgagagatgggaacatgagatttggtccagactgtatattgatgggtggaggggccacaggagcaaacaagctaatctga

SEQ ID NO: 64326 - DNA, 552 bp, Glycine max
  Peptide Sequence Number=SeqID_156011
atgctggagaaggcaaaattaatcactaataatggaactagagcagaaaatattccagggaaccgacaactgcctcaacagctacacgacaatgttgcagaaaatgataatggtacttcaatcggcgagggcaatgtcagccacatggaaaatgatgacctttctgatcttttcaagatgctagatgaaatgtatcttcttactgagggaagccagattcagaaaaactttatatatataaagcaaatctacaaaaattatgaggaatgtaaagtgtcaactatttttattgtgaaaagtgatggaacttatgagatcactattcatgactcttgttgtcttaatcagactgaagagaaccctaatacacatgagttcttaaagtctgacttttcaagctctaatcatgttgtgcagtaccttgaacagtctaacagagctactgatgtgattgttaacccaactgaaggcacatcaaatatgccaaaccagacctcaataagctctgacaacaattctaaccagaaaaagaagattgattgtgctgattga

SEQ ID NO: 64327 - DNA, 237 bp, Glycine max
  Peptide Sequence Number=SeqID_156012
atgtcattcaataaagaagaggaggtatctcattgcggtggaggagagggtgtgcgttcattaggaatgggaggtggcagagtcaatgacctggaagatgaaaaagaaggaggatttggtgctggtgggtcaccggatgtgccgtggcggcgttggccttcagcggtggtggtgaaggatgagccctttctcttctttgagggttctgccagtagaacgagtttctacaaattctga

SEQ ID NO: 64328 - DNA, 463 bp, Glycine max
  Peptide Sequence Number=SeqID_156013
ttcacaagcacctcgcgccgtgaagcatatcttggtcaaacccttgctacgtgacttaaacccctatctccctcaaacccttgctacgtcaagcagtggagctcacgccatgaagactgtgtccatcatagtgagcttgtgtcgtgacccactccacgaagaactattgttgtcgtcaagcggtatctccctaaaacctgtttggctccacgtgttaggttgtggtccagttcgctacagttttctttctttggatctgtctaatgtgggagcaatggtgggagctataacaagtgtcattgatgattgttgcgatccccaatataatagggattcctcatttttgtatatggggatgttgttggaaggttttggtgttgggattatctcttatgtggtgcctgtttatatagctgagattgcacctcaaaacttgagaggtggccttggatcagtgaactag

SEQ ID NO: 64329 - DNA, 267 bp, Glycine max
  Peptide Sequence Number=SeqID_156014
atgtggactacgagctgcatagttgatatggggagaaagaagctggagctgggctttgaagatcagaaaattgatttcgatttatttgtggaagacaagcctgctccagaacaaaatgtttgcttacagcttattttgaaggatagatataagggtttcaatttcttgaggaagagactgaaaaataacttagaaattttttttctaaaaatagtcctttcgctaaccgcaagccttgtgctaactgcattttttgtcatgctctaa

SEQ ID NO: 64330 - DNA, 282 bp, Glycine max
  Peptide Sequence Number=SeqID_156015
atgcagatgctcccattcttgtacccactgaagaggttaagagatgtgggaccagcgaaacctgcagataggccgaatcatgatgccaatgatcccctatatctgatgacattgaccatcccacaactttttctgaagctgttgcaggttatgtgggatgctaccgtgtttgggatgtttaatgaaagctaccccttgtacataaagcatgaagatctgtctgaaatagcacatggtggtcaatgtctcagtatctctattatacagttgtggattctgtaa

SEQ ID NO: 64331 - DNA, 213 bp, Glycine max
  Peptide Sequence Number=SeqID_156016
atggaacggcagcaggaaaaagagccaaaagaaagaagtggaggtgtcactactgttggcaagctatgctccactaaagctgaatgtcccacccatctcaagaagatcactggaatgggaaaggactttctagtcatgatggactctatgaacaaagtactgctagtgaagggtgattctgcaaatgtgatcagcactcactgggagatttga

SEQ ID NO: 64332 - DNA, 273 bp, Glycine max
  Peptide Sequence Number=SeqID_156017
atggcagcggaatggagaagaagaggagttgagaggagatcccacttcaaggagaagatgagtctagaagaagctcaccaccataggaggccatggataagagcttggaggaagaaagagatgaatgaagggagagggagagaagagcacgaaatgttttgctctaagagagctctaaactttgaaaaccaaaccacaagacaatggagtatatacatggagaataagatgaagaacaaggaattaaagagaattcacataacaaaaagatag

SEQ ID NO: 64333 - DNA, 162 bp, Glycine max
  Peptide Sequence Number=SeqID_156018
atgggggtgagcttagctattatagggctaagctctagcttctcaaggaagcttctcaaggaggcaattcttggtggtgaagctccttcttccttggcttattccctagtggatggtgcctcccctctcctattctcctttgccttccgctgcatctccatg

SEQ ID NO: 64334 - DNA, 360 bp, Glycine max
  Peptide Sequence Number=SeqID_156019
atgagttgttattctctgaaactattttatgcacttttgctgcttttattgcatgctgctggatccattcttggattcaacagccttcccaatagcacagaaattaagtgcattcagactgagagacaagcactcctcaacttcacacatggcctcaaagatgactctggcatgctgtctacatggagggacgatggcaataacagagactgttgcaaatggaaaggcatccaatgcaacaatcaaactggtcatgttgagatgcttcatctccgtggtcaggatacacaatatttgatagctataatgattttcaaaggagtcatatcccagaactcatgggctcgttcaccaacttaa

SEQ ID NO: 64335 - DNA, 432 bp, Glycine max
  Peptide Sequence Number=SeqID_156020
atggggcaaccttcttggtcatcttggaccatgttaacagaggatccgtggttaggtaagggattggcctggacattgggacttgagtcggagtctttgaaggtcaaaagtttcgcctggattagcttttggacttcggtcttgagagcaaggcaatgctcaacatcatggccgggcgctccttggtggaaggcgcatgttaggtcgtgccggtaccagggggagcgggaagcaaatcagcatactttatcgggattggatcaaaggtcactttttggcggttttgtgagcgatatggttgttgaggggtttggcgattttgttgttgttgagggtattgtggttgatggtattgttgtgggggatactgtggtggaggatattggtaagggtaatgtggcctttgttggtgatatgctgggttcgggatag

SEQ ID NO: 64336 - DNA, 645 bp, Glycine max
  Peptide Sequence Number=SeqID_156021
atgctggaaagttttaaacaacaagaccaaatgtcagttctggaattgtacatagaaaaggatgtggctggtggttcaatgtttcattctgcaaattcgcttacatcaggtggaaattatttatctaatgatgagacacaaccgacaacaaatttgagcaatttacatattgacgaagacgatgatgatgatgacgatgattatgttgtgtctaactcatacgttgaagagtctttagacgaagatgacagtcttgacagtatatctgatacagacgatgaagtcaccgacattcctcaaccagtaagaattgttcacccagcagaaggtgcacaacgaattgaaaatccattttggaatgatgctttacattataacaatatcaactggagttatcttgatgaggaggacatttgcggtttggagatgccgtcgacctttaatgttggccaagaattatatgttggcatggaatttgatagtaaagatgcggtcaaaaatgcagtcaaacaatatgttatgaaggtgcatcaaagcttcaaagttgttgaaagcaaaacgaacaaatatgtggaaagtcacacaatggggtggaccacacacatgtctgaatatgaccatgacacaagatcacgagaaacttga

SEQ ID NO: 64337 - DNA, 78 bp, Glycine max
  Peptide Sequence Number=SeqID_156022
atggggctaagctcaagcttctttgggaatcttcttaaggaagcttctcaaggaggtgaacttagttatgagagggat

SEQ ID NO: 64338 - DNA, 318 bp, Glycine max
  Peptide Sequence Number=SeqID_156023
atgggaccaagtcaaacgccttcgcttaaaaagaggttctatcaaatcaaggtcaagagcctaggaatcaccagtctaaaagagttcgggcagttaatggggcaactccatcggcagcttttcgcaaagcttacgctatcacccatgggggaagaatttgaagagagcctaggatgccctataggggggaggaaaccatacctcttctcagggttctatccctcattagctagaatttccaagattgtccaaatctcggggcaggaattagaccacaggaaggaagtcggagatggggtggttggaataccaagataa

SEQ ID NO: 64339 - DNA, 522 bp, Glycine max
  Peptide Sequence Number=SeqID_156024
atgggacagttggctccacacttaaatctccaacaatcccagaattctgatagattaccttctcaatctgtccaaaatcccaaaaatgtgagtgccattacattgaggtctggaaagcagggtcaaggacctaaaccagtagcatcttcctcatccgcaaatgaacctgcccaccctcactctgctccagaaaaagatgatgacaaaaatttaaagagtaagttacctaacaatttctatgcaggtgaatctaaagagaagcagcatatccctcttacattcccaccaagagcaacttccaacaaaaaaatggaagaggcagagagggagatcttggaaacatttaggaaagtaaaggcgaggctcacgggtgcgctttccaaaggaggaaagatgcgcggagtcaccaccaacgaaggtattagcacctctcacgtcgacaaaagcggggcttttgctcctacgtaccctctatcgaagaggaaatcagacctacgtagttctttcttatgcgtggatcaa

SEQ ID NO: 64340 - DNA, 93 bp, Glycine max
  Peptide Sequence Number=SeqID_156025
atggaatgctcaggaagatcaaaaggatcaaagggttgtaagtcagatggattgcctctagtcatacactacattcagcatgcacacaactag

SEQ ID NO: 64341 - DNA, 87 bp, Glycine max
  Peptide Sequence Number=SeqID_156026
atggagaaaaatgaagaaacaacaatggaagagaagatgtcagcggaagacaaaggagaagaggtgagaggaggcgccatccactag

SEQ ID NO: 64342 - DNA, 117 bp, Glycine max
  Peptide Sequence Number=SeqID_156027
atggaaaaaggtgttgagggaaggagcccagagtatgaagaacctcgagatttgaggtcaaatcctttccaaggtggagggaatgatgcaatcctatctcgcaagggcattgggtag

SEQ ID NO: 64343 - DNA, 129 bp, Glycine max
  Peptide Sequence Number=SeqID_156028
atgggttccaagtgggcccctgagaaaatcaaggccttccaagaatggccccccctaaaaagtgtggaagatattaggagcttccatgggttgccaagcttctatagaagattaattaggcaagcttag

SEQ ID NO: 64344 - DNA, 285 bp, Glycine max
  Peptide Sequence Number=SeqID_156029
atgggcattgaccaatcccttttccatgacttaacccaattgtccagtgacggtgtaccatttgaaggcaacctacgaactgaagatagttcctctcttcttcgaaagcttttggacaagttcgatggtcttcagacttttgttggtgacaagtttgatgccatggaattgcatgtcgacatgcggttcgatgccatggaatcaaggatcaccaaagttgaagaagatgtctccttcatccgtacttgctttgatccaccaccatcgcctccatcatcctcttag

SEQ ID NO: 64345 - DNA, 944 bp, Glycine max
  Peptide Sequence Number=SeqID_156030
aacaatcaactggtttcctcgatggaaggaaggaaacgagggagttctcttctcatgtggggactacccaaacatcctgttaataggaacgaggggttgcattaactacaatctcgcacttgctataagacagttagggtaccccatgagtggagcaccgacggaagagagtctctctcctttccttgtgagagattttggtgcgcagagtttcaaggttatacaaagagtacataaggcatgggaaggcccgttaaggaaagataaagaacttaggggcatctgtaatggcatcatcggtggttattatgaatggctgaaagttcatacacgagggttagattggctctccaagttgaaaattatcaaagaggagagcttcgaagctccggaagaggatgaagaaacgttcggaaagagtgtgccgggttacgagaagaaaatgcagcaactgcaagagcccttgaacaagaaaccaagaggcctcacaaggaagagcatggccgagacaaattccgtggagctttgtggggcagcaacagtgagctcaagcttcaaagggaagagagagactaatcacgagcacatagcatggtctttgaaagaggagttagctgcttgctcaaggtccaaaagaaacttgtctcagcgtttatgcgagagagagaccaacatgttagccatcgtcagcaagtaccaagaagaactaaatctagccacggcccacgagcataaagtggcggacgagtatgcccaagtgtatgcagaaaaggaggctagaggaaggatgatcgacgcgttacatcaagaggcaacaatgtggatggaccgatttgctcttaccttgaacgggagtcaagagcttccccgattgcaagccaaggccaaagcaatggcggacacctactccgccctcgaggagatccacagacttctcagctatt

SEQ ID NO: 64346 - DNA, 96 bp, Glycine max
  Peptide Sequence Number=SeqID_156031
atggaagtgcttcttagtccaatagctcttaaggtggttgtgatggaagtttgcttgtggggtttctatggaggccggatctttgagcttcaatga

SEQ ID NO: 64347 - DNA, 462 bp, Glycine max
  Peptide Sequence Number=SeqID_156032
atgaccatgattacgccaagctcgaaattaaccctcactaaagggaacaaaagctggtaccgggccccccctcgagatgctgatcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 64348 - DNA, 312 bp, Glycine max
  Peptide Sequence Number=SeqID_156033
atgccatttggagaagcacttcagcaaatgcccctctatgccaaatttttgaaggatatgttaaccaagaagaaccggtacatccataatgacagaattgttgtggaaggttattttgatgatgccaaagaatcaagagttaagcaaagtttcaagcaaagattcaagattcaagaatcaagtttcaagtttcaagattcaagattcaagaaaaatcaagatcaagattcaagactcaagattcaagaatcaagagaagactcaatcaagataagtactaaaaagtttttcaaaacattgagtagcacatga

SEQ ID NO: 64349 - DNA, 129 bp, Glycine max
  Peptide Sequence Number=SeqID_156034
atggttggctcatggtaccgaatatatgcaaccaagaataggaaaattcaaggatcacgcatgagcgaacatgaaaacaaaaggtatgcagtttgtagaacaaaaagtatgttgaacgcatatgcatga

SEQ ID NO: 64350 - DNA, 588 bp, Glycine max
  Peptide Sequence Number=SeqID_156035
gacgcccgctcaaccacaaagggcccccactcaaaacccggctcctacacaacctctccctgtcagcagttccaatcctagcatgagtgccaatccgggaaggaaccctccagtgaagaagcttctggagttcgccgcgattccgttgtcgtacacaaacttgtttccatctttgatcgccaaccaaatggcgatggtgacccccggaagaatttacctgtctcctttcccttggtggtacaaccccaacgcaacctacacgccaaagcaaatgaaagacgtggtaacctctaggaggtttatacttgaggcgctgcaagaggcgggcatgatttcctttgatgagcacgaaggggattcttgtttaatacatccgggtgcatcacatgacgtggaaacatgctcaacggcagaagagttattacaaggaatgatggaccaaggctggtatgcccctcaaaagcccaacgaaaagaaggacgagatcgtcgaagatgacctatcctttgccaaagttactaacatctgtggtatgagcggtgtgacccgtagtggacgtgtcttcgaagcacaaaacccgttggtgcg

SEQ ID NO: 64351 - DNA, 416 bp, Glycine max
  Peptide Sequence Number=SeqID_156036
atgaccggaaggcttcttgtcggttcattggcttttgagagccgcatccttcattacatcattgttcgtatcttgattccaagatcttcaaaccttgcacaggcacacttagtccgatattgcatgcataaggcttttcgattaaatgcttcattgctatatccatacctagtcaccctcttccttcaacacttcaacatccctcttgattctgaaccttatgttccaatcaagagatcctttctaataggtgctgctgtgattgcatcctttggataccgtaaagagcatgatggctcttgggcgaaaatgggtgctcaacccattgatgacgaaggacatggtggagaagattcctctcttcttcaaaagattttggacaggttcgatggtcttcaaacctttgttggtgaaag

SEQ ID NO: 64352 - DNA, 636 bp, Glycine max
  Peptide Sequence Number=SeqID_156037
atggagagaagtatgatagatgctgccagtggtggagtccttggagacatgactcctactgaagccagaaatttaattgagaagatggcctccaactcccagcaatttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgtcgcaagggtttatggtttgtgctcctctgttgaccaccatacaaacctttgcccttccatgcagcaacctggagcaattgagcagcctgaagcttatgctgcaaatatttacaatagacctcctcaacctcagcagcaaaatcaaccacagcagagcaattatgacctctccagcaacagatacagccctggatggaggaatcaccctaacctcagatggtccagccctcagcaacaacaacagcagcctgcttcttccttccaaaatgctgctggcccaagcagaccatacattcctccaccaatccaacaacagcaacaacccctgaaacagccaacagttgaggcccctccacaaccttccctcgaagaactt

SEQ ID NO: 64353 - DNA, 432 bp, Glycine max
  Peptide Sequence Number=SeqID_156038
atggcgcctaccaggcaccctttggatccagataagtccaacaaggccctgggatttcccgcgctgatcacaggactctgccagtcgtttggagtccccgttacacctaccaaggtgattcggccacccatcactcaggcttttattgagaagtactgcacccagagacaggctcagggggatgctccacaggctgcgggcgcgccaccaccacctcatcaggctggcccggctgggtcatttgacatggagcagtatttacggcatttggtttgccagcaggcggccaaccaccgggcacatgtacagacccatgattgtctgtaccagctgagcctcagcatgcagagccagggcttcgcttctttttcatgccctactccagaccagttcagggcagaggtcgcatggcccggggatttgttgcgttag

SEQ ID NO: 64354 - DNA, 423 bp, Glycine max
  Peptide Sequence Number=SeqID_156039
atgaggggagcgccaaccgaagaaagtctctcgcctttccttgtgagggatctaggtgcgcaaggtctcaaggttatacaaagaatccataaggcgtggaggagtccgttgaggaaagacaaggagcttagaggcatccgaaatggcgtcatcggagattggctctccaaattgaaagttatcgatgaggagaacttcgaagctccggaggaagatgaagaagtccgagctctaaaattagagctaggaaaggcgagacacgccaaggagaagttcaaatcagctactacacacatccggaaagagtgtaccgagttacaagaggaaaacgcggccactgcaagagcccttgaacaagaaaccaaaagggcctgcaaggaaagaatatggccgagagaaattccgaggagcattgtggggtag

SEQ ID NO: 64355 - DNA, 246 bp, Glycine max
  Peptide Sequence Number=SeqID_156040
atggattttgaaatctgccaaattgtgcagcaaaaagctgtcaaattttgtgcagcagaattttgttcatatgtagaaaatgcttgtgcattgttggttatggaaaagtccatgatgattggatgtggaattacctggatgttgtggaagcttgggaggattgatggggacccgacgttgagaggaacgaggataagggctacgtgggagtacgtgagctcagttggaggtgggcaacaagggatg

SEQ ID NO: 64356 - DNA, 978 bp, Glycine max
  Peptide Sequence Number=SeqID_156041
atggtaatgaacggcactgcctctcattccaccatcctggcggttgttgtcggcatggcggttatccaggtgattgttcacctggtttacttcctgcacatgaacacctcatcggaagagcgctggaacctggtggcattgctgttcaccgctatgatcatcggtatcgttgttgtagggagcatcgactatcccctgtttctcgccaccctggtgggtgtctcgttggtggtcgcgtcgggctgtgtgtttaacaactacatcgaccgcgacatcgacaagaaaatggagagaacgaagaatcgggtgctggtaaaaggcctgatcgcgccgagtgtcaccctggtttatgcgaccgttctgggtattgtgggcttcgcgttgctgtatatcgcggccaacccgctggccatgtggctggcggtgatgggcttcgtggtttatgtcggcgtttacagcctgtacatgaaacgccactcggtctacggcacgctgatcggcagcctgtcgggcgccgcgccgccggttatcggctactgcgcggtaaccaacgagttcgacgccggcgcgttgatcctgctggctatctttagcctgtggcagatgccgcattcttatgcgatcgctatcttccgctttaaagattaccaggcggccaacattccggtgctgccggtggtgaaaggcatttccgtcgccaagaaccacatcacggtctacatcctggcatttatgatcgccacgctgatgctgaccctggtgggctacgccggctacaaatacctgatcgtcgctgcggcggtgagcgtctggtggctgggcatggcgctgcgcggttacaaaaccgaaaacgacagcgtctgggcgcgtaaactgttcgtgttctccatcgtcgccattacctcgctgagcgtgatgatgtcgatcgacttcagcgccacggcggcgcctgaagcgctggtgacctacgtttggtaa

SEQ ID NO: 64357 - DNA, 57 bp, Glycine max
  Peptide Sequence Number=SeqID_156042
atgcatattgttgtggtacatagggacagatgcaagtggggatggggtcacaactga

SEQ ID NO: 64358 - DNA, 243 bp, Glycine max
  Peptide Sequence Number=SeqID_156043
atggcagcgcagttcatccatgaccgagatggagtgcctagagggagtttgggagaccctcgaaggcaatgcgaggtgccgattccgtggcacgatccgactcacggctacttcgttgagggtgatgaggatccacttcttgaggtggattctcccgaggaagtcatgtcggcatctgaggcagactctacggaggatggtggcccgggggagatggcaatcagcggaggctcttcatcctag

SEQ ID NO: 64359 - DNA, 99 bp, Glycine max
  Peptide Sequence Number=SeqID_156044
atggctgatggaaaaatgataaagatgaagggtagaattaacctagggttaaaaagactgtgggaaagcttgggttgtgcaaatgagttagaagaatga

SEQ ID NO: 64360 - DNA, 144 bp, Glycine max
  Peptide Sequence Number=SeqID_156045
atgactaaagcacgtcaaaaaggggatacggaaagggaaaagggggaggtgattgccgcccagctcgcccaggcgagctgggttgcttccaccagaaggcaccgccttctgttagaacatcctggaaggcccaagtgggtttga

SEQ ID NO: 64361 - DNA, 225 bp, Glycine max
  Peptide Sequence Number=SeqID_156046
atgagtattacggaagatatgatgaactgggcacacccaggtccatttgctaagcttgttcagaaacgtgcatttgtgtttaaaacgcaacactggacattgtttagatttaattggaaactccttacacttcccgccttgaaaacagttgtcatgtattttactctgcatcataatgttcctagtaaggctagtttagtaagacatcttttctgtggacaatag

SEQ ID NO: 64362 - DNA, 306 bp, Glycine max
  Peptide Sequence Number=SeqID_156047
aaaagtatcccagctgtcgcaacgtgcccttttgcgggcgagcgaggcgaggctcacgggaagcgctttccaaaggaggaaagatgcgcggagtcgccaccaatgtttatttgtgaaaaacgtcggaaaaaccgaaggaaaccggtcaaaatgaaaattctaagttcgggagttgtatttacgtttgaggaaggtattagcacctctcacgtcgacaaaagtggggcttttgctcctacgtaccctcctctagaaaacttccagaacccaatatgtacaaccctttccacagacagtcatgcctaa

SEQ ID NO: 64363 - DNA, 372 bp, Glycine max
  Peptide Sequence Number=SeqID_156048
atgcatggaactgaaaggaaggtagagctctaccacactgagtttgatgattttaagactaagttggaaaggcgtaatctccataaacgcctcaccaatttggctgatgggagcatagatgtggctttggtgcaagatttctatgcaaacctatacaactctgagagtccttcaccaaagcaagccagggtcaaaggccatctagtgaagatcgacgctgacagcctcaacacattcctagagacacctatggtgttggcagagggtgagacattgcccatatactccaaatactgcaggctgcctttagatcttagggagattgaggctgccctatgcataccaggccgagggtttcatcttgaatgctga

SEQ ID NO: 64364 - DNA, 223 bp, Glycine max
  Peptide Sequence Number=SeqID_156049
atggaaaaaggatgggtgaaagaaatcttgagcccatgtgctatgcctgtcatcttggtaaatcaaaatctatctcaacttctaaggcatgtggtagatacctttaacatcaattcaagggcgaattcttcccacgaagtagggtatgatagaggactatccaaggaggaagagtttgacttacgtgggcttaacatggatggaccaatcactagagcaagga

SEQ ID NO: 64365 - DNA, 759 bp, Glycine max
  Peptide Sequence Number=SeqID_156050
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcctgagttattggacaacatttcgaaaaattaaagctccagataatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64366 - DNA, 374 bp, Glycine max
  Peptide Sequence Number=SeqID_156051
atgtgggctatcattgaccagtataaagagaaactaagtctagttgctagccatgagcaaattctagaggacgagcacgtaaaagtatcggtcctacaagtggaaagggaagcaagggagagagtgactgattcattacacaaagaagctatgatgtggatggataggttcgcttttactttggatggaagtcaagagcttccaagactgttagccaaagccaaggcgatggtggacgtgtactcagctcccgaggaagccgatatggaggccatgaaggatcaaatgaccttcatgatagaggccatgttaagcatgaagcggatgatggagagcaatgcggccgcagttgccgcaccagggtcgccgctgag

SEQ ID NO: 64367 - DNA, 55 bp, Glycine max
  Peptide Sequence Number=SeqID_156052
gctacggaggttttggatgacgccacttccagtgaaggaagataagtctgggtag

SEQ ID NO: 64368 - DNA, 318 bp, Glycine max
  Peptide Sequence Number=SeqID_156053
atgacccctactcatgatgccctgctatattacaatgggaggtggaacatgtcacgccaaaatgagtttgttggttactcgttcacaggaaaaaattcaaaaaagtttgacattccttccggatgtaccatggatgaactgaaggatttgatcaagcaagttacgccacatgggattcccctttatggtattcacgaaacacaaacggtgttaattgagtctaactattggaaaaagattgggccaatagaaattttagttgttttcagtgaacttgtaatggaaatgaaagacgagttggccctgtcgcaaaattag

SEQ ID NO: 64369 - DNA, 521 bp, Glycine max
  Peptide Sequence Number=SeqID_156054
ttaccctcaccgtcagaggactacacgtcctcgcctttagaggactacatgtccttgccaacggagggttgcacgccctcaccttgaaaggactacacgtcctcgccagcagagggctgcacgccctcaccttgagaggactacacgtcctcgccatcagagggctgcacgccctcaccttcagagggctacacgccctcgccatcagagaactgcatgtcctcaccttcgtagggctacacgccctcacctttagaggactacacgtcctcaccaacagagggctgcatgccctcaccttgagaggactacacgtcctcgccaacagagggctgcacgccctcaccttgagaggactacacgtcctcgccaacagagggctacacgccctcacctccagaggactacacatcctctccttgagagggttgcacgccctcacctttagagggctacgtgtcctcattttcagtgtgctccacatccgcaccttaagagaatttaaggtcctctgtccttaa

SEQ ID NO: 64370 - DNA, 367 bp, Glycine max
  Peptide Sequence Number=SeqID_156055
ggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggacgcacctagttgctcatgatcctggggatttaaataaaacaagcgcaagctcggaaggtagtgaaagataccttagatatgcatgtatgtaa

SEQ ID NO: 64371 - DNA, 171 bp, Glycine max
  Peptide Sequence Number=SeqID_156056
atgagagaaatagtgaacggagtgagcacaggaaatgcgaaaagaagaaatgggaaaaaatggaaagcagaaaagggaagaagcaaaaagggacaggatgaacataaacaaagggacaggacacgtggactgaagtggcaacacacgggaatgaggaaagaagaagcataa

SEQ ID NO: 64372 - DNA, 270 bp, Glycine max
  Peptide Sequence Number=SeqID_156057
atgactatagacaatccatctgacttacaaccctttgatcctgagatagataggacatttcatagattagttagacaacatttagtaccttttgagcatcctgagcattctgttattggtgattttgagcattatagttttgagcattctgattttgaatattctgagaacatggcacatatttctgaaggcctctcctcattctttagaaggagtggcaaaggactggctatattaccttgctccaaggtccatcacgagctgggatga

SEQ ID NO: 64373 - DNA, 407 bp, Glycine max
  Peptide Sequence Number=SeqID_156058
gtgtaccatttgaaggtgcattgattgacgattggaagtttgaattttctgtgcatgatgtccgccggttggtttgcaccaaccaagaaaatatgaccggaaggcttctttccggttcattggcttttgaaagccgcatcctccattttctaattgttcacatcttgcttccgagatcttcaaaccttgcacaggtttctgaagaagatctcattgttatgtgggcctttcataaaggcattgcaattgaatgctccattgccttatcctcatctagtcacctttttccttcaacacttcaacatcccttgatgcaatcctatcccgcaagggcattgggtagaagactccaagtagattgggctagagatccaagggaaggccctagggttctcatgagccttagg

SEQ ID NO: 64374 - DNA, 111 bp, Glycine max
  Peptide Sequence Number=SeqID_156059
atggagattggtagatcttctagaggtccacccccgccatctggattggagttgtcggtgggacaagattgtgcgggaaatgagttttgtgggggaggcctttgtggctga

SEQ ID NO: 64375 - DNA, 726 bp, Glycine max
  Peptide Sequence Number=SeqID_156060
atgactatgcaaaacatgcagtttcaacaagagaccagagcctctattcagagcttaactaatcaaatgggacaattggctacacagttaaatcaacaacagtcccaaaattctgacatattaccttctcaatctgtccagaatcctaaaaatgtgagtgccattacattgaggtcaggaaagcagtgtgaatctaaagagaagcagcatatccctcttccattccctccaagagcaatttccaacaaaaaaatggaagaggcagagaaggagatcttggaaacatttacgaaagtagagtcaactgatgtggtaattcatttagctaatagaagtgttgcctatcctgctggtttcatagaggatgtcttagttaaagttggcacactatctatgcagtttggtgatataactgttcattttaatattcttgatgctatgaaacacccatctgaagatctttttgtatttcgtgttgaaataattgaccatattgttgatgaatacatgacttatcttcattctaatctgcatgactatcactcttcatgcattgaatatgaatttgcacttgatcatatgtctgaatttgatgctgagagtgaatttgaatttgatattgattacatgtctggtgatgttttacctcttgagattgattttatagagtcaaatagaactaaccatgtttcaggaagtacacatacctctgactttctttatgag

SEQ ID NO: 64376 - DNA, 330 bp, Glycine max
  Peptide Sequence Number=SeqID_156061
atggataatgaagagggcgtgcaggaacagatgaaggccgatctatcggccttaaaagatcaaatggcttccatctcagaggataaagccacaccaaccgcctccagtacagttagggaagtggagctggtgctgcagcctgccttgaatccgggcctagacagaaacacggccgtgttcggtcgaaggtatagtccgcaagcttatccttatggcctgcctccggacttcaccccccgtgccaccccggaagatttaagccaagcccctactttcgaggggcaactcccaccttatgaagactatcccgggaaagacaatgaggaatga

SEQ ID NO: 64377 - DNA, 231 bp, Glycine max
  Peptide Sequence Number=SeqID_156062
atggaggaagaagttgatccgccgataaaaagggagaagcacaaggaaaacaaagtgacgaatgtggattgcgaagatgattttcttgataacccaattacaaatttaatcaagaaggaactcgaagctgatttccatacaaagattgcttatggtgaaacaaaaatcattcatgaaggtggttggaacaacaatggtgttgaaaccttggagtgtcaacttgttgggtga

SEQ ID NO: 64378 - DNA, 312 bp, Glycine max
  Peptide Sequence Number=SeqID_156063
atgaccaccctgactcagatatggatgactttgctgctcagcaacatcctgcccaccgatcataatttcgacctccccctgccgaagtgtcagctggtgtacgctatcctgacgcggatgagcatccatgtggctcagttaatcgctgatgccatctatatttttgcaggtatggcgcctaccaggcaccctttggatccagataagtccaacagggccctgggatttcccgcgctcaaaggatccaggaaagacaaggcggtttggaaggaaccagttgccactcccgaatatgatagccatccgttttag

SEQ ID NO: 64379 - DNA, 114 bp, Glycine max
  Peptide Sequence Number=SeqID_156064
atggtgcgacagcttgcaacaacagctcgtggtggtcactggtgggtcgtgggtggtagaggagaagctgttaggatttctcttagtgagaagaaacttcacttttggtgctaa

SEQ ID NO: 64380 - DNA, 433 bp, Glycine max
  Peptide Sequence Number=SeqID_156065
gtggaaatggaagagggataggagggttgctgcaagtgctactactggtggaggcacttcaaattacttgccagacctcaaggtgatggcactcacatttcttggattctgcaaagtcttgtctcttgctgaaattgcatattctggatggtcatttgcctcactaaatcttctaaggaaggttgaggaggggcctcagttgcttgttgtctttgttgttgctgcattggaggaggaacacatggcttgcatggaccagcaacattctggaagggaggggcaggctgttgttgttgtggagtacttgtccatctcagatttgaatgattcctccaacctggattgttgctcattgactccaaattgctcaaagaaggatagagatctgcatggtgatctgcagaagaacatagaccgcagactcttgcaacag

SEQ ID NO: 64381 - DNA, 486 bp, Glycine max
  Peptide Sequence Number=SeqID_156066
gcttttcgtcttacagatagcaaaaaggtttatacggataaccactcgggtatctccgcccgtcagcgtgactcaaaagtcagtatgacagatcttgtgagcgtggaagatgacgcttttcattttacagatagcaaaaaggtttataccgataaccactcgggtatttccgcccgtcagcgtgactcaaaagtcagtatgccatatcttgtaagcgcggaagatgacgcttttcgtcttacagatagcaaaaagttttatacggataaccactcgggtatctccgcccgtcagcgtgactcaaaagtcagtatgacagatcttgtgagcgcggaagatgacgagacaacgttagtctctgcgtgctatcaagcttttcgtcttacagatagcaaaaaggtttatacggataaccactcgggtatctccgcccgtcagcgtgactcacaagtcagtatgacagatctagtgagcgcgcaagatgaa

SEQ ID NO: 64382 - DNA, 300 bp, Glycine max
  Peptide Sequence Number=SeqID_156067
atgaacgaccaacgacgaagaacggttgaaaatcacccacggaaacgtcacggaagcattacagaagcgcctcggcttggattttcttcacgaaaacaatttttctcactaattttaagtgaatctccgataccaggagggaaaaggaaggagaagcttgttatccagctcgccctggtaagccaggttgcttcctccagaaggcaccgccttctggagaacatcctggaggcccaagtggacctggttgctatttgcaccccctatttactaaatacacccctttcctttttttgctaa

SEQ ID NO: 64383 - DNA, 375 bp, Glycine max
  Peptide Sequence Number=SeqID_156068
atggtgggttacacaccttcaagctttgcggatttggacttcgccagcagaaggatcaaagcgggtctgaaaagaggcaaatttaatcatcccacttggacgactgagaaaactgggccaaatgaagagggtgagaaagagggagaaacccatgctgtgactgccattcctatacggccaagtttcccaccaacccaacaatgtcattactcagccaataacaaacctcctccttacccatcgcccagttatccacaaaggccatccctaaatcaaccacaaagtctatctaccgcacttccaatgacgaagaccacctttagcacaaaccaaaaaacaccaacaaaaaggaattttgcagcaaaaagcttgtag

SEQ ID NO: 64384 - DNA, 480 bp, Glycine max
  Peptide Sequence Number=SeqID_156069
atggcttcgaaaaagcttttcgcgaaaagatctaggagggacgccgcggctgaagggaccagtgccgctcccgagtttgatagccaccatttcaagagcgctaagcaccaagagagacgcgtccagctcagggacgatgagtacacaaattttcaagaggagatagcttgccgacattggacgtcgttggtcactcccatggctaagtttgaccctgatatagtcctggagttttatgctaatgcttggcccacagaagagggagtgcgggacatgcggtcatgggtgaggggtcagtggattccctttgacgcagatgcccttagccagttcttgggtgacccgttagtgttggaggaaggccaggagtgcgagtttagtcagaggaggaacagggctgatgggttcgacgaagaggccattgctcagctattatgcatactgggtcaggatttcgcccggacagctgcagggaggcgg

SEQ ID NO: 64385 - DNA, 304 bp, Glycine max
  Peptide Sequence Number=SeqID_156070
gtacttacccgttgaagactgaagaacgaatgaagaacgtcgaagaacggtcgaaaaccttcgcgaaatcactcacggaaacgttacggaagcgcctcggcttggattttcttcacggaactaattttcttcagctatttcgagaaagagagaagtgcctaaggggccgaacccttttctacttcacttctccccctatttatagaaaattgggggagaagcttgccacccagctcgcccaggcaaggaaggttgcttcctccagaagcaacagccttctggaggaatcttctggagggcccaa

SEQ ID NO: 64386 - DNA, 345 bp, Glycine max
  Peptide Sequence Number=SeqID_156071
atgacctctccagcaacagatggtcgaatccttcagaacagcagcaacaacgacaacaaaccttattttcagaatgttgctggccctagcagaccatacgtttctctaccaatccagcagcaacaacaacaacagcaacagccccagaaacaacaaacagttgaggctcctccgcaaccttcccttgaagaacttgtgaggaaaatgactatgcaaaacatgcagtttcaacaagagaccagagcctccattcagagcttaactaatcagataggacaattggctacacagttaaatcaacaacagtcccaaaattctgacagatcaccttttcaatctgtctag

SEQ ID NO: 64387 - DNA, 684 bp, Glycine max
  Peptide Sequence Number=SeqID_156072
atgtctgctagtgatcatgccattttgcgagataaagtgcatcaacccaccaagaaaagcttgttggagttatcatcacaagatgctttgttggcacagaataagttgctctctagaaaacttgaaatcttaacagaaacacttggttgtaccgtttgtggtgaggctcatgaatcaggtcattgcattcctattgaagaacacactaaggaagttcattacatgggaaatcaacagaggcaaggatacaaccaagaaggatttttaggttttcaacaaggtctctacaatcagcaagggcaatggatatcacaccctggcaatcaattcaataaggaccagggtggaccatccaacaagccaccccaacaagggccaaatatttttcagaggaccaccaaactggaggagacactagctcaatttatgcaagtgaccatgtccaaccataagagtactgagtcaaccctaaaaaaccttgagatccaggtgggtcaactggttaagctgctagctgagaagtcatccaacagccttggagcaaataccgagaaaaatcccaaagaagaatgcaaagctattatgacaagaagcaggaagcttgtggcggctgaggatgaggatattgtcgctttgaaggagcaagttgttttgaaggacactattgataaaaataatgatgag

SEQ ID NO: 64388 - DNA, 125 bp, Glycine max
  Peptide Sequence Number=SeqID_156073
atgaaggaagcaatgcggattctcaagataatggggctagagggaaataatgaactttccaagagaatggaaagccctcaagagatcatcccctcgaaaacattattggagatatatcaagaggg

SEQ ID NO: 64389 - DNA, 417 bp, Glycine max
  Peptide Sequence Number=SeqID_156074
atgtgtcacccaactgcatatctctatgattactacaacagccaaatctgcaacactaatgagggcaccaccttcgttagtaacaacacaaaaactttgatggtcaacaaggtcataacctttacacaattgcttgaactttttcaccaaaaactaaacattgaaccacatcaacatatccaacatctccactttcgatgtcccatatttgagtcaggacaacattataggtacacatctattattctgcgagatgatgttgatgttcgacaaatgttcaacattttttacaacaacccaccactaccatttgtggagttatttgccataatttgtaacaataataacccaccaaacaaccaacattactcaacctccaatcttgaggacctatcagatgaatacaagagttgttgg

SEQ ID NO: 64390 - DNA, 399 bp, Glycine max
  Peptide Sequence Number=SeqID_156075
atgattactttgtttctacaacattttaatgtccctcttgactctgagccctttgtcaaagtcaagagatccttctctataggtgcaaatgtaatctcttccttcggataccgcaaagagagggatggctcttgggtgaagaaggatgctccagtacaggccgctgaagaccgctctccatcaccacattctcagagagatgactcttcatctcttatgcacaacattcttgaaaggtttgatggacttcaaacctatgttggtgagaggtttgatgctttggaacgacaagtggacatgcgattcgacaaaatggactcaaggatcacaaaggttgaagaagatgtcaccatcattcgcgactgccttgatttacctccaccacctccatcagtttag

SEQ ID NO: 64391 - DNA, 441 bp, Glycine max
  Peptide Sequence Number=SeqID_156076
atgaagctttacttctacaagatagtcctggagttctatgctaatgcttggcccacaaaggagggtgtgcgagacatgcattcatgggtgaggggtcagtggattccctttgacgcagatgccctcagccagttcttgggtgactcgctagttttggaggaaggccatcagtgtgagttcggcaagaggaggaacagggccgatgaattcaacgaggaggccattgcccaactgttatgcacaccggatgagcgtccacgtggcccaagtatgccacccaccaggcaccctctggactcggataagtctaacagggccctggggtttccgccgttgatcacgggcctctgccagtcattcggggttcccgtcacccccagtaaggtgatccgaccaccgatcactcgggccttcatcgagaagtactacacgcctaggcag

SEQ ID NO: 64392 - DNA, 114 bp, Glycine max
  Peptide Sequence Number=SeqID_156077
atggaggttgtgcttccgtttgaagtagatgttggccgccatgagccatggatgattgtgatggaagcttgcttgtggggcttctatggaggctggatctttgagcttcaatga

SEQ ID NO: 64393 - DNA, 186 bp, Glycine max
  Peptide Sequence Number=SeqID_156078
atgatcatgagggttcaagacatttatagtagtcaagaggagactacttcttgcccttcctctattggaagtgaagatgaattaaggggtgaagagtctagtgaggaagtttacccccatgaaaaaggtgacctcttaagggttagaaggctccttggaggttcagaaggaaaatcctcactatag

SEQ ID NO: 64394 - DNA, 255 bp, Glycine max
  Peptide Sequence Number=SeqID_156079
atggtgggctacacaccttcaagctttgatgatatggtcttcaccgaagaaaggatcaaaggtgaaaatgtgggagaagcctatgctgtgactgccattcctatacagccaagtttcccaccaacccaacaatgtcattactcagccaataaaccaaccttctccttacccaccgcccagttatcgacaaaggccatccctaaatcaaccacaaagtatgtctaccgcacttccaatgacgaacatcacctttag

SEQ ID NO: 64395 - DNA, 246 bp, Glycine max
  Peptide Sequence Number=SeqID_156080
atgggagagttgaattgcgccatcgcccgatcgccacctagtaccacatatgacggagtggtacctggagatatgtcgcgagggtcaggagaccttggggatgtcaggtggggtgctattgcccaaaaccaaggtgatagggcactggtaattgattaccagttgggtgtaatcgattacacagtgttacctgctactgagaggaaatcccttgaacaagacatcttgactatgcgtagccgttag

SEQ ID NO: 64396 - DNA, 210 bp, Glycine max
  Peptide Sequence Number=SeqID_156081
atgggagagttgatttttgccatcgcccgatcgccacctagtaccacatatgacggagtggtacctggagatatgtcgcgggggtcaggagaccttggggacgtcaggtggggtgctattgcccaaaaccaagcttggctaatcccgacccaacccaggcatagtcagtcagtgagaacctgtgacgtacctaagcaggcgagctcctga

SEQ ID NO: 64397 - DNA, 282 bp, Glycine max
  Peptide Sequence Number=SeqID_156082
atgagggcaagagggatttcgaaatctgcccaatttgtgcagcaaaaagctgtcaaattttgtgcagcagaatttggctcttgtgcagaaaatgtttgtgtattgctggttgtggaaaggcttggaggggttgatggggacccggtgctgagaggaacgaggataagggctacgtgggggtacatgagctcagttgaaggtgggcaactggggatggtgggttcatgtttgatttgtggatgtgggagagttgatttgcaccatcgcccgatcgccacctag

SEQ ID NO: 64398 - DNA, 257 bp, Glycine max
  Peptide Sequence Number=SeqID_156083
atgagaggaacgccgtcggaggaaagtatcacgcctttcatcgcacagggtttcagtgaccccaatgcgagggtgcttcaaggagtccgcaaggcatgggatgtagtgcaaaggaaagataaagagcttaggggaagcaaggaagagactgaaactccggaggagagtgaggaagtacaaaccctaaaggcaaaacttggaagagcacaagcagtcaaagagaagttcaagtccatggccatcaaagtccagaaaga

SEQ ID NO: 64399 - DNA, 291 bp, Glycine max
  Peptide Sequence Number=SeqID_156084
atggtggaaggagacatcatcgaagaactcggccagtttcttgatgtaggcctgatagggtatcaatttatgatccctagtttcccattctcccctcagctggcgaattaccaaggccgagtctccatacactttgagcaacttgacattaaagtcaattgccgcttagattccaagagcgcacgcctcgtattcagccatattattcatgcaatcgaagcccaatcttgccatgaagggaatgcattgattgtcgggagagaccaacaccgccccaaccccatggcctag

SEQ ID NO: 64400 - DNA, 102 bp, Glycine max
  Peptide Sequence Number=SeqID_156085
atggaagagaagcttcaatggggtcctttaatggtgattttccaccatggagatgcagcggaagacaaaggaaaagaggtgagaggaggcgccatccattaa

SEQ ID NO: 64401 - DNA, 246 bp, Glycine max
  Peptide Sequence Number=SeqID_156086
atggcaggaacaaatcctaatgatggaggggggctttcgcaattccaaatgcaagctttgatgcaacatttggagaggttaatgaaacaacgagatgatgcgctccatgagagacaaaaccgaattgatggtattaaactcaacattcctccctttaaaggaaagaatgatccggaggcctacttggagtgggagatgaaaatagagcatgttttctcatgcaacaactatgaggaggaccaaaag

SEQ ID NO: 64402 - DNA, 306 bp, Glycine max
  Peptide Sequence Number=SeqID_156087
atgaactggcaagaagccttccggtcatatctgcttggttggtgcaaaccaaccgacaggcatcataaacagaaaaatcaaacttccaatcgtcaatcagtgcaccttcaaatggtacaccttcacttggcaattgggacgaaaagaggtttgtgtaccgtattcgctgttcctcagatgaaaacaatgatccagagggaatggaggaaggaattggcgtttcctatgaccctgaatgtcgttgactctgactcaaagtgccctttcacttcttcgatggttccgccatttgaagagattttttga

SEQ ID NO: 64403 - DNA, 87 bp, Glycine max
  Peptide Sequence Number=SeqID_156088
atggagaaaaatgaagaaaaaacaatggaagagaagtggaaggcaaaggagaagaggatagggaaggcaccatccactagggaataa

SEQ ID NO: 64404 - DNA, 836 bp, Glycine max
  Peptide Sequence Number=SeqID_156089
tcgccatcagaggactgcatgtcctcaccttcgtagggctgcacgccctcacctttagaggaccacacgtcctcaccttcagagggctacatgccctcgccatcagaggaccgcatgtcctcaccttcaaagggctacacgccctcgccatcagaggactgcatgtcctcaccttcagagggctacacgccctcgccatcagaggactgcatgtcctcaccttcgaagggctacacgccctcacctttagaggactacacgtcctcgtcaacagagagctgtacgccctcaccttgagaggactacacgtcctcgccaacagagagctgcacgccctcaccttgagaggactacacgtcctcgccaacagagggctgcacgccctcacctctagaggactacacatcctcgccttgagagcgctgcacgccctcacctttagagggctatgtgtcctcattttcaggaccagtagtttccttttaacggttcctgggccaccccctgatattgggagggcgaccaactatgcaagcacaaccagagagggaggctatcacacagctactatgcataccggggcaagatttcacccgtgtcgctgcaaagaaacgaatgcagatcatgcgcaccaacatgacaactttttcgcaacctacccttctgcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 64405 - DNA, 252 bp, Glycine max
  Peptide Sequence Number=SeqID_156090
atgaagcttgcttctacaaaatctacacctgttgcaagagtctgtgaggaatcatccaaatctgagatggacaagtcctccacaacaacaacgcctgtccctccttttcagaatgctgctggtccaagcaagccatatgttcctcctccaatacaacaacagcagtcacaacaaagacaacaagcaactgaggcccttcctcaaccttccctagaagagttagtgaggcaaatgaccatggggtcctctaga

SEQ ID NO: 64406 - DNA, 282 bp, Glycine max
  Peptide Sequence Number=SeqID_156091
atgacggaaagggagatgatcacaattatggtaaatacgttacccacgttctactatgaaaagctgataggctacatgccacctaactttgcggatctcgtcttcgccggagaaaggattgaatctggattacggaaaggcaagttcgaatatgcttccaacaacaatagaagatccccggtagtgggcgcgagaaaaaaagaaggagacgcccacgcagtcaccaccgccccgacgtggatatcaagcttatcgataccgtcgacctcgaggggggccccg

SEQ ID NO: 64407 - DNA, 252 bp, Glycine max
  Peptide Sequence Number=SeqID_156092
atgcctatttccgtgtgccagcgacttggagagatagagataatgcctacacgcatgaccctccattgtgtagtagatatgggaaagaagatgttgcgaatgggcatagaagatcagaaaatcagctttgatttatttcatgaagataaaaagccacctgaccggaatgtctgttttaaagttcatgtgatggaggaaagaagacctgagaagaaaatccttgaagtgggaacattattggatcctagataa

SEQ ID NO: 64408 - DNA, 407 bp, Glycine max
  Peptide Sequence Number=SeqID_156093
cttcattacctaacagtccaacttacaacaacaagccccaagagactcagcataaggatgcacaggccaaagttgagtatgtgaaaagattgtatgaccaagtgaaggtgcaaattgcaaagaagaatgaaagttatgccaagcaagccaacaagaaaaggaaggaagtggtacttgaacccgatgatgattttggacatttgagggcaaatgttttccaagaaggagggaatgatgagaatcttaaaactgtccaaatacagggacctatgaccaggagtatgaccaaacaatcagtggatacccttcaacaaatggtagcaggcatacttagcaaggcccaagtggagaaggacgaaagacctaagtggagaaggatgaaggcccaaaagcaaaggcactactaa

SEQ ID NO: 64409 - DNA, 268 bp, Glycine max
  Peptide Sequence Number=SeqID_156094
gttggtccttcagctgctcgtgtcaacacaaaggagagttgtgttgatcactcaggaacgatccagacatgggggtccacaaccgttcacaacattcctttactccatgatcaagtcaagcttggtgttgaggaggttagagatgcagatgctcccattcttgtacccactgaagaggttatgtgggatgctaccgtgtttgggatgtttaatgaaagctaccccttgtacataaagcatgaagatctgtctgaaatagcacatggtg

SEQ ID NO: 64410 - DNA, 297 bp, Glycine max
  Peptide Sequence Number=SeqID_156095
atggctgatggaaaactgatagagatgaagggtagagttaacctagggttaaaaagtgagaataaaatgcttatgtatggctggttgtggaaagggttgtacatattgggttatggacgttttctagtagatcccaacgatcaaaatcttggagggattgatggggacccggtgttgagaggaacgaggatgagggctacatgggagtacgtgagctcagttgaaggtgggcaactggggatggtggatttatgtgtgatttgtggatgtggagagtcgacttgcaccatcgcctga

SEQ ID NO: 64411 - DNA, 294 bp, Glycine max
  Peptide Sequence Number=SeqID_156096
atgaaattctttcagatgtttgtgcgggtcttcacctgcaaggccatgaaactttggaagcaaatggatcagtccagttttaagaacatatgggatatcctcatcagggtattggatgcacaagctttcgtaggtggaaatcaggtgcagccatttccctttagagtcctctcacggggtggaggttgtgccatgttctcagaatgttcaaaaatcagaaggttcaaaactataatgctcaaaatcaccaataatagagtgctcaggatgctcaaaaggatcaaagggttgtaa

SEQ ID NO: 64412 - DNA, 573 bp, Glycine max
  Peptide Sequence Number=SeqID_156097
atggagcggagtatgattgatgctgccagtggtggagctcttggtgatatgacccctgctgaagctaggaatttgattgagaagatggcttccaactcccaaaaattcagtgttagaaataatgctattgttcttagaggagtccatgaggtggccacggattcatcttcatctactgaaaataaaaagcttgaaggaaaacttgatgccttggtcagcctagtaacccagcttgccatgaatcagaaatctacacctgttgcaagagtctgtggttggaggaatcatccaaatctaagatggacaagtcctccacaaccacaacagcctgtccctcctttccagaattctgctagtccaagcaagccatatattcctcctccaatgcagcaacagcagcagcaatcacaacaaagacaacaagtaactgaggctcctcctcaaccttccttagaagagttagtgaggaaaatgacaatccagaatatgcaatttcaacaagagacaagagcttccattcagagtctaacaaatcagatggggcagatggctactcagttgaaccaagcttag

SEQ ID NO: 64413 - DNA, 870 bp, Glycine max
  Peptide Sequence Number=SeqID_156098
cgaagagatctgaggaaggaagccgcggccgcagggactagtgccgctcccgagttcgatagccatcgtttcagaagcgttgagcaccagcagcgtttcgaagccattaagggatggtccttccaccgagagagacgcgtccagctcagggacaacgagtacacagatttccaggaggagatagctcgccggcgttggacgtcgctggtcactcccatggccaagtttgatccagatatagttcttgagttttacgccaatgcttggcctacagaggagggtgtacgggacctccggtcatgggtaaggggccagtggattcctttcgatgcagatgccctcagtcaaatcctgggatacccgctagtattggaggaaggccaggagtgcaaatatggtcagagaaggaaccgggccgatggatttgatgaggaggccatcgctcagctgctatgcataccaggtcaggattttgcccggaccgctgctgggagacgggtatgccacttaccaggcaccctcctagacccagataagtctaacagggccctgggttttcccgacattgatcacgggttctctgctagtcgttcggggttcctgtcacacctagcggccaaccacagggcgcacgtgcagacccatgactgcctctaccagctcagccttagcctgcagagccagggtttccctccttttccatgccctactccggatcagttcagggcaaaggtcgcatggcccggggattggcctgaggcccaggcaagggaggcacccgcagaggctcccggcaatgcagatgaggcccgcatggacgaggagatgaccgatttgctcgatttcttgggagggagcgaagccacatga

SEQ ID NO: 64414 - DNA, 132 bp, Glycine max
  Peptide Sequence Number=SeqID_156099
atgttaacaacattcaacacaagacatgtgaggagatacatggagaaaaatgaagaacaacactggaggagaagccatggagttgcagtggaagataaaggagaagaggtgagaggaggcatcatccactag

SEQ ID NO: 64415 - DNA, 271 bp, Glycine max
  Peptide Sequence Number=SeqID_156100
atgggtgccaagcacctcacaaggaccaaagaatggtcgcatgtcatcaagcaaaggtccccggacgaaattaggaagaaaatctataagaacaaagaaaaaaagggtgttatgagtacctgggaagatctagatgacactttgtctaatgaagatgatgaagaagccaacatatgtctaatggcagatacaacttctgaggaatctgaattagatcaagaagatgagggggagtctaagggttgtgacaagagtggccatgagaatactc

SEQ ID NO: 64416 - DNA, 373 bp, Glycine max
  Peptide Sequence Number=SeqID_156101
cttgggaggattgatggggacccggtgttgagagaaacgaggatttgggctacatgggagtacgtgagctcagttggaggtgggcaacaggggatggtagtggtacctggagatatgtcgcgggggtcaggagaccttggggacgtcaggcgagctcctggcagtacacagataaaacgaacaaagaccacaaagcaaggaggcttgtgtggtggctggccaactgtgaactttgatttatatgtgagatatggcctctggcttgaaaacgaggtcagggaactgggagattgtggaggccctctggtaatcgattaccagtcctgtgtaatccattacccagaggaatggggcactggtaatcgattaccag

SEQ ID NO: 64417 - DNA, 558 bp, Glycine max
  Peptide Sequence Number=SeqID_156102
atggtttgtaatgaccaggcagaaacgaccggtagattactggccggatcattaacctttgattgtcgcatcatgcactatattatagttagaattatgcttccctgttcttctaatttggctcaagcctctgaggaggacatgattttgatgtgggctttccttaccggtcatcagatcgattgtgctcacttggttaggtaccgaatgcataaggcatcacgggccaatgcacctcttccatatcctcaattggtcaccctctttctccgacattttcaaattcctcttgatgatgaaccttttgttcaagtcaagcgttcctttgctataggtgctggtgcagtcacttcatttggttatcgtaaggatcatgatggtcaatggctgaagaaggacacactccctccacaagacgagcgtactccttctcctcctcctcatgaacgattcgattacttcgatggtcgctttgaaggtatggatacccgcatcacccaggttgaagaggatgtcacttatcttcgtcggtgctttgaccttccaccaccgtcttag

SEQ ID NO: 64418 - DNA, 153 bp, Glycine max
  Peptide Sequence Number=SeqID_156103
atggcagagttctgcctagtgcctgacgtcgttatccctccgaagttcaaggaaagtcttactggggcagccgtcacctggtatactaatctggaagtatctcgagtccattcatggaaggaccaaatggttgtcttcattaggcagtattag

SEQ ID NO: 64419 - DNA, 196 bp, Glycine max
  Peptide Sequence Number=SeqID_156104
atgtcgcgggggtcaggagaccttggggacgtcaggcgagctcctggcagtcaacagataaaaggaacaaagaccacaaagcaaggaggcttgcttgaaaacgaggtcaggaagctaggagggcttctggttgtggaggcctctggtaatcgattaccagtctgtgtaatcgattacacagaggaatgggtcactg

SEQ ID NO: 64420 - DNA, 270 bp, Glycine max
  Peptide Sequence Number=SeqID_156105
atggcaaagaagaaacttcttcagactatcagcgagtggtggaggcagtttaaattagatttgaccaggaaatgggcacttgcagccgacaaggacgatgtggaagacaatgtctatgaaaaatacggcattagcaaggacaaatgggcccagttttatcagacatgccgagatccctcatgggaggatgtgcagaaaaaaacacaggccatccagaagcaaaacactggcccccacatgttgtctcgtgaccgcgttatgattatttag

SEQ ID NO: 64421 - DNA, 165 bp, Glycine max
  Peptide Sequence Number=SeqID_156106
atggataagagcttgaaggtaggaaaaaatgattggagagagagggagagaaggggcatgaaatttatgcctcaaatgagcctactaatccaagatcaagtccaagattctccactaagtgtgcttaagtgtcatgaggcatgtaaagcatcaaggatagcataa

SEQ ID NO: 64422 - DNA, 573 bp, Glycine max
  Peptide Sequence Number=SeqID_156107
atggagagaagtatgatagatgctgccagtggtggagcccttggagacatgactcctgctgaagccagaaatttaattgagaagatggcttccaattcccagcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgtcgcaaggcaaaatcaaccacagcagagcaattatgacctctccagcaacagatacaaccctggatggaggaatcacgctaatctcagatggtccagccctcagcaacaacaacagcagcctgcttcttccttccaaaatgctactggcccaagcagaccatacattcctccactaatccaacaacagcaacaaccccagaaacagccaacagttgaggcccctccacaactttccctcgaagaacttgttaggcaaatgactatgcataacatgcagtttcagcaagagaacagagcctgggggatcctctag

SEQ ID NO: 64423 - DNA, 273 bp, Glycine max
  Peptide Sequence Number=SeqID_156108
atggcaagttcaacatgctttcaacaaatttcttcacaaataactatcatgaagcagaaacctagcaaaactacacatcatatctcccaaaacccaatacccacgaaaatcaaagatgcgcttcacgactccgaaaatgccttcctttcgcgatttggagtagaaatgggcaccaaaggttggagctttaatggagtttcaatggaggatgaagaagaaagaaaaagcaacgtgagggagagggagaaagcttctgaaatgtgggctgagtga

SEQ ID NO: 64424 - DNA, 384 bp, Glycine max
  Peptide Sequence Number=SeqID_156109
atgccctttggagaagctctacagcagatgccactctatgctaaatttctgaaagatatgctaactcggaagaacaagtacatccatagtgacaccatagtcgtggaaaagctgcaatttcttcattccatcagtttcctgatgaatctttgggttacaggttgcacactttgtggtggagctcatgggtcaggcttgagaaatcccactaaagaaacatctcatgaagttaattacatgggaaaccaacctagacaaaatttgaatgcgggtggattttctggatttcaacatggccaaccttaccagcaacataatcaatggagaactcaccctggtaatcagttcaataaagaccagggtaggccacctaacaggccatag

SEQ ID NO: 64425 - DNA, 621 bp, Glycine max
  Peptide Sequence Number=SeqID_156110
atgtctcctttccttgtgagggatctcggcgcacaaaattccaagactatacaaagaatccataaggcatgggaaaccccgttaaggaaagatcaagagcttagaggtattcgtaatggcatcattggtgggtaccacgatggagacagaaactcaacatttagctatcatcgccaagtaaatgaagagattgggtctaagccacggaagaggcagaaggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcactagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgct

SEQ ID NO: 64426 - DNA, 186 bp, Glycine max
  Peptide Sequence Number=SeqID_156111
atgtggtccaaacacttgacggatacatgtaaggccttattatgtccctggacctcgacgggtatcccttcatcaacgaatgtgaggtcaattaggcaagtttgtgaagtattaattttcaccctctcgctaagccaatctgttggcttagcgagccatccgctgagcgcaccattgcttggctaa

SEQ ID NO: 64427 - DNA, 402 bp, Glycine max
  Peptide Sequence Number=SeqID_156112
atggtggaagaatttgaagagatcctaggatgtcctctaaggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaagggattgtttgctgtactccagctctctatgtggggctggtttcacacctttttttccaagaaggtag

SEQ ID NO: 64428 - DNA, 180 bp, Glycine max
  Peptide Sequence Number=SeqID_156113
ttgaacttagctcatcaatgggctaagtgcgcatccaccactaagcgcaacttcagcgtgcttagcgcgatagaagaatctggtagggcgtcaatatcaaggccgcgcgctaagcgcgagttcagtgcactaagcgcaacagttgtcttcagccaggctctagcgcacaactggcactaa

SEQ ID NO: 64429 - DNA, 339 bp, Glycine max
  Peptide Sequence Number=SeqID_156114
atggtgaaaagttggaacctcttacgtgccgatcaacgtctcattttcgccaaaaagttggcccagggcttcccggtatcaacagggacaccaggatttattttattctgcgaagtgatcttccgtcacagcgggtcccccctgcgcgtaaccaccacacccgccgcgcttaaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 64430 - DNA, 276 bp, Glycine max
  Peptide Sequence Number=SeqID_156115
tggaactctcaagcgggttgcttggggactggacgtaggcacaagggccacttgtctaacaatcttgttacccttttccttcaacacttcaacatccctcttgattctaaaccttatgttccaatcaagagatctttccttataggcacttcagtcatagcatcttttggttatcaaaaggagcatgatggctcttgggtgaagaaaggtactcgacatgttggtgaagaaggacatgatggagaggattcatctctcctttcagattttagacag

SEQ ID NO: 64431 - DNA, 355 bp, Glycine max
  Peptide Sequence Number=SeqID_156116
atggccggaacaaatttcgcggagctctatggggtagcaatagtgaactcaagttgcgaagggaggaaagggaccaagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctatt

SEQ ID NO: 64432 - DNA, 210 bp, Glycine max
  Peptide Sequence Number=SeqID_156117
atgaatatctctgaagatactcacatccctgtaatattgggaagaccattcatgttcaccgcaagctgcatagttgatatggggaagaggaagcgggagctaggttttgaaaatcagaaaattgattttgatttgtttgttgacaacaaacttgctccagaacacaatgtttgcttactggtaatggaaggaggccaagaggttctgaaa

SEQ ID NO: 64433 - DNA, 328 bp, Glycine max
  Peptide Sequence Number=SeqID_156118
ggctcgcaagggaaggagtatggccggaaacaaatttcgcgaaggctctgtggggtagcaaacaatgaactcaaggctggcgaagggaagagagggaccagtcgcgagcacatagcatggatcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 64434 - DNA, 447 bp, Glycine max
  Peptide Sequence Number=SeqID_156119
atgccactggtaatcgattaccaagggcttgaaaacgaagtcaggaagctaggagggcttctggtaatcgattaccaagggggtgtaatcgattacacagaggaatggatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgagcgatccacttcttga

SEQ ID NO: 64435 - DNA, 144 bp, Glycine max
  Peptide Sequence Number=SeqID_156120
atgaaagaaactgtgcagaaacacagtcaatcaaatgtttattcaactttactcgtcgcttatggcacccccaccaaacgtgtagaacatgcaatttctgattgggtggacttggagatcaactcaggagtgcaggtcacttga

SEQ ID NO: 64436 - DNA, 219 bp, Glycine max
  Peptide Sequence Number=SeqID_156121
atgcctataggttggacctcccaagagagtgaagctgatatagaggaggaggaaccaacagatttgaggtcaaatcttcttcaagggggaggggatgatgcaatcctccctaggaaaggaccagttaccagagccatgagcaagaggctccaagaggattgggctagagttgataaagaaggccttagggttctcatgaaccttagggtagatttttga

SEQ ID NO: 64437 - DNA, 318 bp, Glycine max
  Peptide Sequence Number=SeqID_156122
atgacggagaaagagatgatcaaaataatagtagacacattaccagtgttttactatgaaaaatcgtgggagggtgaggatgagcgagaaacccatgctatggctgccattcctatacggccaagtttcccaccaacccaacaatgtcattactcagccaataacaaaccttctccttacccaccacccagttatccacaaaggccatccctaaatcaaccacaaaacccaccttccacaccaccaatgctaaacaccacctttagcatgaaccaaaacaccaaccaaggaaggaattttgcagcaaaaagcctgtag

SEQ ID NO: 64438 - DNA, 111 bp, Glycine max
  Peptide Sequence Number=SeqID_156123
atgggagcgggctttgtggctgatttaggagtggcctttgtggatgatttagggttcttggttgatagggtggtgggtgatgcaatcctatcccgcaagggcattgggtag

SEQ ID NO: 64439 - DNA, 201 bp, Glycine max
  Peptide Sequence Number=SeqID_156124
atgctatgtatttactgggtgtggaaagagcagtgcagacttgggaggattgatgggggcccggtattgagagaaacgaggatatgggctacatgggagtacgtgagctcaattggaggtgggcaacaggggatggtgggtttatgcgcgcattgtggatgtggaaaacttgttgtgcaccatcgcccgaccgccacctag

SEQ ID NO: 64440 - DNA, 246 bp, Glycine max
  Peptide Sequence Number=SeqID_156125
atgtcaggattcacacgcaattctcctcaaatttcagccagcccgtatcaattagacttcacactttatgcttcagggtcatacaatgctcaatggaacgccccggggcttttccatgacaagcacacgttgcgtttgagtcgtattctcggagaaatggaggtggtcttcgtcattggaagtgcagtagacagactttgtggtagatttagggatggcctttgtggatacctgggtggtgggtaa

SEQ ID NO: 64441 - DNA, 363 bp, Glycine max
  Peptide Sequence Number=SeqID_156126
atggcatctagcagagactctgaatggaggctcttgtctcttgctgaaattgcatattctggatggtcatttgcctcactaacttttctaaggaaggttgaggaggagcctaagttgcttgttgtctttgttgttgctgcattggaggcggatcatatggcttgcttggaccagcagcattctagaagggagggacatgttgttgttgatgtggaggacttgtccatctcagatttggatgattcctccaacctggattgtatctattgcttgaaaggtcataattattctgctgttgttggttttgctactgagggggtctattataaatgtttgcagcataagcttcaagttgctcattga

SEQ ID NO: 64442 - DNA, 177 bp, Glycine max
  Peptide Sequence Number=SeqID_156127
atggcggaaccatcaaagaagcaaaaaggcacttcgagtcggagtcaacgacattccgggtcacaggaaacaccaattccttcctccattccctctggatcattgttttcatcagaggaacagcatatatgccttctattcaaacttagaaatccaagaaggcaccctaatgtctga

SEQ ID NO: 64443 - DNA, 207 bp, Glycine max
  Peptide Sequence Number=SeqID_156128
atgtcaggacttacacgtgattctcctcaaatttcagccagcccgcatcaattagaccttgcaccttatgcttcagggccctacaatgctcaatggaatgtcccggaactcctctatgatatgcacatgttgtgttctagtcgtatcctcggaaaaatggaggtggtgttcgtcattggaagtgcggtagataggctttgtggttga

SEQ ID NO: 64444 - DNA, 213 bp, Glycine max
  Peptide Sequence Number=SeqID_156129
atgaaagagctgagagcatttcgggttttacaaaggaacatcatttggaaattccgaccacgccaatgtgaccggggttcagtgtttttcaaagtaagcataagacatgcaatggcggttccaaagtctagaagcttcattaagaggcttcctctagaagcttcctcgtggttctttgagaagctttctcaagaggcttctttgagaagctag

SEQ ID NO: 64445 - DNA, 618 bp, Glycine max
  Peptide Sequence Number=SeqID_156130
atgggtgaagtagatgaggtgcaagagcagatgaaggccgacatggaggccatgaaagagcaaatggtcacaatgatggaggccatgatgagcatgaagaagataatggaagccaatgcggttgcaattgctgctaccagtgctgttgctatggtgaatccaacacccccatctagcctcaaccaaatgaatcatccaacctcagatatggtaggcaaagatttgggaagtacgggcagcccccattatgtgcaaattcaaaacaagcacaccttcccgccatatagcttgcctcccaactatacaccacccaatgtggcgtacactcccagtgagaatttcaataactccactcccatactcattgagagccaacaacctcaatctgatcatgcacatgtctctcaacccatgggggagacacatgaaattccccaccacaatctagccgacttcgagccttgcctcggatatgccactgaagggcaagcagttggtggtatacccctgcaaaaacactttggaagggcctcaatttcgcccccaaccacaactcttctatggaaaaatggtgggttacacaccttcaagctttgcggatttggtcttcgccaatga

SEQ ID NO: 64446 - DNA, 384 bp, Glycine max
  Peptide Sequence Number=SeqID_156131
atgggtcaacttcaacggcaagccttccgcaaagcctatgcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcaaaggatgtccaaatgttcccttga

SEQ ID NO: 64447 - DNA, 363 bp, Glycine max
  Peptide Sequence Number=SeqID_156132
atgtaccctcccttgttctctttgaacctagtggaagtaccctccactagaactgatccacaagaggatgtcccctctcttgttctcagtcaaacccaagtagatgtaccctctacttgtaccacaaaggatgtaccctccaatgagttaagacaaagatctcaggctgttaaacctttgatactttgtgaatggggatacaaaagaattctcaggtgggagaagggagacacaaaagaattcaggcggttagtcctttgttcttttggaaaagggagaagagagacacaaaaagaattcaggcagttagtccttggcgaattctttttggcaaagggagaagggaatgaaaaagatgaatag

SEQ ID NO: 64448 - DNA, 183 bp, Glycine max
  Peptide Sequence Number=SeqID_156133
atggaggagaaggtagagcttaaaattaatagagggaataagccatggaaggaggagcttcaccaccaagagagtgccttggataagaagcttagagaggaagcttcaatggaggaaaagaatgagggaaagagagagggggggagcatgaaattgaaggagaaaaagagggagagaacttga

SEQ ID NO: 64449 - DNA, 444 bp, Glycine max
  Peptide Sequence Number=SeqID_156134
atgactagaggcaatccatctgacttacaaccctttgatcctgagatagataggacatttcatagattagttaggcatcactttataccttttgatcttcctgagcattccattactggtgaatctgtgcattatgttattggtgattttgaacatcctgattttgagcattataattttgagcattctaattctgagcattctgattttgaacactctaagaacatggtacaacctccaccccatgagaggactctaagggaaatggatgcacctgatttcacctacgaaagcttgcacatcccataccctgatgaggatgtcccatatgttcttaagactcgactgattcatttgcttccaaagtttcatggccttgcagtgaagacccgcacaaacattttgaaggaatttcatattgtctgctccaccatgaacccctag

SEQ ID NO: 64450 - DNA, 522 bp, Glycine max
  Peptide Sequence Number=SeqID_156135
atggcttcaaactcccagcaatttagtgccagaagtgatgctattttcattagaggagtgcatgaagtagccatgaattcatcttcatcagccgagactaagaagcttgaaggtaaactagatgccttggttaacctgcaatctggagcaattgaacagcctaaagcatatgctgcaaacatctacaatagacctcctcaacctcagcagcaaaatcaaccacaacagaacaattatgacctctccagcaacaggtacaatcccggttggaggaatcatcccaaccttagatggtcgaatccttcacaacagcaacaacaacagccttattttcaaaatgctgctagcccaagcagaccatacgttcctccaccaatccagcaacaacaacagccccagaaacaacaaacagttaaggcccctccgcaaccttcccttgaagaacttgtgaggcaaatgactatgcaaaacatgcagtttcgacaagagactatagcctccattcagagcttaactaattag

SEQ ID NO: 64451 - DNA, 603 bp, Glycine max
  Peptide Sequence Number=SeqID_156136
atgaccgcatacgcccgccgtgaagccaaaggcagctggggcagcgccgcctgggaactgcgttccgtcaaccagcgttatctcgaaacctatatccgcctgccggagcagtttcgcagtctggagccggtgatccgcgaacgcatccgcaaccgcctgacgcgcggcaaaatcgagtgcaacctgcgcttcgacgccgatgccagcgcccagggtgagctgcagctgaatgagtcgctggctaaacagctggtgcaggcggcgaactgggtgaagatgcagagtgatgaaggcgcagttaacccgctggatattctgcgctggccgggcgtgatgaccgcgcaggagcaggatctggatgccatcaacgcggaactgctggcggcgctggatggtgcgctggacgatttcatcattgcgcgtgaaagtgaaggcaacgcgctgaaagcgctgatcgaacagcggctgcagggcgtgaccgatcaggtcagcaaagtgcgtgcacagatgccggaagtgctgaaatggcagcgcgagcgtcttgtgagcaagctggaagaagctgaggttcagctggagaataatcgccttgagcaggaactg

SEQ ID NO: 64452 - DNA, 471 bp, Glycine max
  Peptide Sequence Number=SeqID_156137
atggcgatacgcgaaagaaatctggccagcgccaaatggtcagtgttgtcatccataaaaatcgttggcattggggtattacagctttcactgctggcgcaaatcctgcaggcaaatgagctcaatttgctcgcgattgccgtagtgatattattagtgattgatacactagccgatcgcggcttcggtaacgcacttattcgctatcaaagtttaaataacagcgaactctcgaagctttactggggggcagcactatcgcgccatcctgcaacgggaaaaacaatttacgcgcattgcctttacggaaacgtcttccgtgctggcagggctggcggtcacgctgtttaccgtgtggctgacgccgtcagtgctgtgcgccatctggggttacctggcgatggtttccatcagaatgctgatctactgctactacgggcgtccctggttccagccggagtaccgttttag

SEQ ID NO: 64453 - DNA, 1671 bp, Glycine max
  Peptide Sequence Number=SeqID_156138
atggctcaaggcacgctctatattgtttccgcccccagcggcgcagcactctgcaggtcaaccttgtatctgtttgaaagcctcaatcagctgattgaaaaatacttgcctgaggagcaaatcaagcgcctcaagcaagcttaccttgtcgcacgtgatgcccacgagggccagacacgctccagcggcgaaccctatatcacccatcccgttgcggttgcctgcattctggccgagatgaaactcgaccacgaaacgctgatggcggcgctgctgcatgatgtgatcgaggatacgcccgccacctatcaggacatggaacagctgttcggaaaaagcgtggccgagctggtagaaggcgtttccaagctcgataagctgaaattccgcgacaagaaagaagcgcaggctgaaaacttccgcaaaatgatcatggcgatggtgcaggacattcgcgtcatcctaatcaaactggctgaccgcacgcacaacatgcgcacgctgggcgcgctgcgtccggataaaaaacggcgcatcgcgctggaaacgctggagatttacagtcctctggcgcaccgcctcggtattcatcacctgaaaacggaactggaagagctcggctttgaagcgctctatccaaaccgtttccgcgtgattaaagaggtagtgaaagcggcgcgcggtaaccgtaaagagatgattcagaagatcctgtcggaaatcgacgggcgtctgcaggaagccggcattccgtgccgcgtcagcggacgtgaaaagcatctctattcgatctaccgcaaaatgcacctgaaagagcagcgatttcactcgatcatggatatttatgcctttcgcgtcatcgtgaaagacctcgatacctgctatcgcgtgctcgggcagatgcacagcctgtacaaaccgcgtcccggacgcgtgaaagattacatcgccattcccaaagccaacggctatcagtcactgcacacttcgatgatcggcccgcacggcgtgccggttgaggtgcaaatccgtaccgaagatatggatcagatggcggagatgggggtggcggcccactgggcttataaagaagctggcgaaagcggtaccaccgcgcaaattcgcgcccagcgctggctgcaaagcctgctggagctgcagcagagcgctggcagctcgtttgaatttatcgagagcgtaaaatccgatctgttcccggatgagatctacgtgtttacgccggaaggccgcatcgtcgaactgcccgctggcgccacgccggtggatttcgcctatgcggtgcacaccgatatcggtcacgcctgcgtcggtgcgcgcgtcgatcgccagccttatccgctgtcgcaggcgctgaccagcggccagacgattgaaattattaccgcacctggcgcccggccgaatgccgcgtggctcaactttgtggtgagctcaaaagcgcgtgccaaaattcgccagctgctgaaaaacctcaagcgcgaagattccgttaatctcggccggcgtctgctgagccacgcgctcggcggcagcaaaaagctggccgaaattccggcggagaatattcagcaggagctggagcgtatgaagctctccagtatcgacgatctgctggcggagattggcctcggcaatgccatgagcgtggtg

SEQ ID NO: 64454 - DNA, 1227 bp, Glycine max
  Peptide Sequence Number=SeqID_156139
atgccggcacgccaccaactggtggataaactgctggctgcgctgccattctcgcccaccgcggcgcagcggcgcgtggtcgcagagattgagcgcgatctggcgcacgacttcccgatgatgcgcctggtgcagggggatgtcggctccggtaaaacgctggtggctgcgctggcggcgctgaatgtgatcgcccacggcaaacaggtggcgctgatggcgccgaccgaactgctggctgaacagcacgccagtaatttccgccagtggtttgcgccgcttggcgtagaggttggctggctggccggaaagcagaaaggcaaagcgcgcgaagcgcagcaggaggcgattgccagcggtcaggtggcgatggtggtgggcacgcacgcgctgttccaggaacaggtgaagttcaacggcatggcgctggtgatcattgatgagcagcaccgtttcggcgtgcatcagcggctggcgctgtgggaaaaaggcgaggagcagggtttccatccgcatcagctgatcatgaccgccaccccgattccgcgcaccctggcgatgacggcctacgccgatctcgatacctcaaccattgacgaactgccgccgggccgtacgccggtgaccacggtggcaattcccgatacccgccgcagcgacatcatcagccgggtgcaaagcgcctgccatgaaggccgtcaggcctattgggtgtgtacgctgatcgatgaatccgacgtgctggaagcgcaggcggcggaagccacctggcaggagctgaaagtggcgctgccggacctgcaggttggtctggtacacgggcgcatgaagccggcagagaagcaggcggtgatggcggcgttcaaggccaacgaaatccagctgctggtggctaccacggtgattgaggtcggcgtggatgtgcccaacgccagcctgatgatcatcgaaaacccggaacggcttggtctggcgcagctgcatcagctgcgcggacgcgttggccgcggtgccgtcgcctcacactgcgtgctgctgtacaaagcgccgctgagtaaaaccgcgcagaaacgcctgcaggtgctgcgcgacagcaacgacggttttgtcatcgcccagcacgacctggagattcgcggtccgggtgaactgctcggcacgcgccagaccggcaacgccgagtttaaagttgccgatttactgcgcgatcaaagcatgattccggaa

SEQ ID NO: 64455 - DNA, 441 bp, Glycine max
  Peptide Sequence Number=SeqID_156140
atgtatgacacgtttgaccagagatgtgaaaagagcggcgcaagaattgtttattgtacaaaggctctctatgtgtggctggtttcgtacctttttcaccaagaaggtaggccagtctgtccgctacaaggtcatcgcttgtacgctgagaaaggaaaggcgaattgggaccaactcttggctagcatggagggggtatctgttaattggttccctcgttggaaggaaggaagaaccaggattctgacctcgtgcgaaggatttccaaatgttcccttaatgggaacaaggggttgtattaattataatcccgtcctcgccatcagacagcttaggtaccctatgagaggagcgccatcagaggaaagcattgtgcctttcatcgcacagggtttcaatgaccccaacgcgagggtacttcaaggagttcacaaggcatga

SEQ ID NO: 64456 - DNA, 183 bp, Glycine max
  Peptide Sequence Number=SeqID_156141
atgccaaaagatagggggacttgtcttgatttcagggattgtcatcatcaaaaagggggagattgtagacaaaggatcaagctgaatgttttgatgatgtcaaaggatcacatgtttctcaaagctttattcaagacaaagaaatcaaagatactcaagatggaggatcaagacagtctctaa

SEQ ID NO: 64457 - DNA, 308 bp, Glycine max
  Peptide Sequence Number=SeqID_156142
ctctgaatggaggctctggtctcttgttgaaactgcatgttttgcatagtcatttgcctcacaagttcttcaagggaaggattcaaccatctaaggttgggatgattcctacacccgggattgtacctgttgctggagagcataagcttcaagctgttcaattgcttcagattgtcgcacagaagggcaaaggtctgtgtggtggtcggggtcatgtctccaagggctccaccactgataacatctatcatacttctctctatgttgttgagtccttcatacaaaatattacagaagaagctgcttag

SEQ ID NO: 64458 - DNA, 219 bp, Glycine max
  Peptide Sequence Number=SeqID_156143
atgcctataggttggacctcccagaagagtggagctgatattgaggaggaggaactaacagatttgaggtcaaatcctcttcaaggggaaggggatgatgcaatcctccctaggaagggaccaatcactagaaccatgagcaagaggctccaagaagattgggctagagctgttgaagaaggccctagggttctcatgaaccttagggtagatttctga

SEQ ID NO: 64459 - DNA, 321 bp, Glycine max
  Peptide Sequence Number=SeqID_156144
atgtggaccaccacggaaaattgggggagaagcttgccacccagctcgcccaggcgagcaaggttgcttcctccagaagcaacagccttctggaggaatcttctggagggaccaagtgggcctgctttcgaagaagttacggaaacttacggattgcgcaaaaacacctcttttcgatttccgccacattacggaatttcacggattgtgcaagcctgcttccttttgatttttgacatgcctcgggacttcattcattgtgcaactaaggatgccaagtgtctcgaagaggccaatcaaaggttgtatatcttcaaataa

SEQ ID NO: 64460 - DNA, 243 bp, Glycine max
  Peptide Sequence Number=SeqID_156145
atgtgcacatgtgcaatttttggtaccccaaatgctttgagtatgcatgaaatggccccgaggaagcttgcctcaaagaggtccaggaaggacaaggcggccgaaggaactagttccgctccggagtatgacagtcaccgttttaggagcgcggtacaccagcagcgcttcgaggccatcaagggatggtcgtttctccgggagcgacgcgtccagctcaagacgttaaagaagcgctactag

SEQ ID NO: 64461 - DNA, 189 bp, Glycine max
  Peptide Sequence Number=SeqID_156146
atgtggatggatcggtttgctcgtaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcacccagatccaaatctag

SEQ ID NO: 64462 - DNA, 330 bp, Glycine max
  Peptide Sequence Number=SeqID_156147
atggccccgaggaagcttgcctcaaagaggtccaggaaggacaaggcggccgaaggaactagttccgctccggagtacgacagtcaccgctttaggagcgctgaggaaatagggcgccggcggtgggcaccactggttactcctatggccaagtttgatccagaaatagtccttgagttttatgccaatgcttggccaacagaggagggcgtgcgtgacatgaggtcctgggttaggggtcagtggatcccgttcgatgccgacgctatcagccagctcctgggatatccgatggtgttggaagagggccaggaatgcgagtatggctag

SEQ ID NO: 64463 - DNA, 156 bp, Glycine max
  Peptide Sequence Number=SeqID_156148
atgaagatgctcttgataccacatgatgtagctccatgtgaagcttatcatgacagcggaatggagaaggaagaaagatgttggagacgctacttcaaggagagtatgagtcaagaagaagctcaccaccacaagaagccatggataagagcttga

SEQ ID NO: 64464 - DNA, 357 bp, Glycine max
  Peptide Sequence Number=SeqID_156149
atgtacaaaggtgtatgctacaaagtgactgattgcatgataagaggatggagtaagatgccctcatcacttgtctttcacaagaatcagaaggactttctcaggtttgtagtgaggcttggctacaaaaatttgttggtggtatacactcccaataaggatgttaataactctgctcccatactcattgaaatccgacaacctcaaactaatcatgcacatgtctctcaacccataggggagacacatgaaatgccccttcacaatctagcggactttgagccttgcctcggatatgccactgaagggcaagcagttggtggtatacccctgcaaaacacttttgagggcccttag

SEQ ID NO: 64465 - DNA, 369 bp, Glycine max
  Peptide Sequence Number=SeqID_156150
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccagccagttacctcggttcaagagttggtagctcagagaaccttcgaaaaaccgccctgcaaggcg

SEQ ID NO: 64466 - DNA, 941 bp, Glycine max
  Peptide Sequence Number=SeqID_156151
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgctggtcttgctttcatcaaattgaaagactggagcgagcgtacaacacctgaatcacaaattggtgccatcattcaacgtggtatggcattgaacatgatcgtaaaagatgcatcttacatcatgccattacagcttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64467 - DNA, 491 bp, Glycine max
  Peptide Sequence Number=SeqID_156152
agttttctgcctttgctctgctttgcttggctgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttatcgttgaccacagagtggtacctggagatatgtcgcgggggtcaggagaccttggggacgtcaggcgagctcctggcagtcaacagataaaaggaacaaaaaccacaaagcaaggaggcttgtggtggctggccagttgtgaattttgtatgatatgtggattatggcctctggtaatcgattaccaagggtgggaagctaagggagcctctggtaatcgattaccagcctgtgtaatcgattacacagaggaatgggtcactggtaatcgattaccag

SEQ ID NO: 64468 - DNA, 366 bp, Glycine max
  Peptide Sequence Number=SeqID_156153
atgaggaagtgtggaaggagtggtacctggagatatgtcgcgggggtcaggagaccttggggacgtcaggtggggtgctattgcccaaaaccaagcttgaccaatcccgacccaacccgggcgagctcttggcagtcaacagataaaagaacaaagaccacaaagcaaggaggcttgtgtggtggctggccagctgtgaactttgagtgttatatgggatatggcctctggcttaaaagtgaagacagacaagctaagatggcctctggtaatcgattaccaaggggtgtattcgattaccaggctttaaaaaacgagatcaggaagctaagagggcttctagtaatcgattaccaaggggtgtaa

SEQ ID NO: 64469 - DNA, 93 bp, Glycine max
  Peptide Sequence Number=SeqID_156154
atgttccctcatgggaagatgtccatgaaaggagttttcagaccttaccctactctaacatacccaacaccactaatacatatggcattttga

SEQ ID NO: 64470 - DNA, 138 bp, Glycine max
  Peptide Sequence Number=SeqID_156155
atggcgaagagcgaccgttcacccgtgaactctgatgtcggtcggactatattatgcctagaagctagggcaattaaggatgtcgcggcatgggcaggatcaccttgggctaccttctggagtggagacaaaacatga

SEQ ID NO: 64471 - DNA, 246 bp, Glycine max
  Peptide Sequence Number=SeqID_156156
atggattttcagaaccttacttctcaatccccaccactaaaaaccatgattatgagggcaagatttatagagcccaagtataaggtactacttcaccttcctctagtgatagtgaaaaagcaaaaggggaagggaataatgcaatctacccctgcaagaagcataggtaaaactccaagtagattgggccagagatcaaagggaagtgtccctagagtattattagcccaagtcaatggggagtga

SEQ ID NO: 64472 - DNA, 939 bp, Glycine max
  Peptide Sequence Number=SeqID_156157
atggccaagtttgatccagaaatagtccttgagttttatgccaatgcttggccaacagaggagggcgtgcgtgacatgagatcctgggtaaggggtcaatggatcccgtttgatgccgacgctatcggccaactcctaggatatccgttggtgttggaagagggccaggaatgtgagtatggcctgaggaggaaccggtctgacgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggactctgccagtcgttcggagtccccgtcgcacctaccaaggtgattcggccgcctatcacccgggcttttattgagaagtactgtacccagagacagggtcagggtgatgctccacaggccgcaggcgcgccccccaccacctcatcaggcgggccaggctggggcattcgatatggagcagtatttacggcatttggttcgccagtaggcagccacccccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagagacacccccagaagctcccggcgatggagaagaagcccacgaggatgaggagatggctgatttgcttgacttcttgggagggagtggagacacgtga

SEQ ID NO: 64473 - DNA, 264 bp, Glycine max
  Peptide Sequence Number=SeqID_156158
atgttcttaattttcttcttgtggggaccgtcggccttccctgtagcagtatcaacaagcaccactgttctctcagcaccaggtggtctagtggacaaggatcgtaggcgtgaggctttgggtgtccgcttcacggcagacgtcgaagccgatgcgtccgaagtaggaggaggaggaggtgaaggaggaggaggaggaggagtggaggcagaaaagaaagaggggaacaagcaacaatttgaaggttgtacattcaggaactaa

SEQ ID NO: 64474 - DNA, 514 bp, Glycine max
  Peptide Sequence Number=SeqID_156159
atgtcgatgttgacgcttgcaacgatgataaatgtgattacgatcatgggagcttgccaatactatattgatagcgatgatgaacatgtccacaaccatggtggactctcatacatgcacaacgacatcattgggatgtgcacgagtacaaaaggcactcaatgttgttgtaagggtgtgaaagatgtcctccatggctttgggggttgtaggggtgttgtcgtggttgtgtttgaggtgaggcattttggagctggtgatagggtagagcgaaaaacaattacgggcaaggaaacatggtggttgggaatgttggaaaagggtgggttgttgtacatggttttgatacccaccattaagggtccaatggtagaaaaaagaatccatggaggtgcaaagggaacgagtgtgattgtggatgggggttgtggtatggttgtgattgtgggtgataaactttgtatggttggtggcatgggtctaccatttgcggtggtggcagtggctggggagg

SEQ ID NO: 64475 - DNA, 282 bp, Glycine max
  Peptide Sequence Number=SeqID_156160
atggccccgaggaagcttgcctcaaagagatctaggaaggataaagcggctgaaggaaccagttccgctcccgaatatgacagccaccgttttaggagcgctgagcaccagcagcgcttcgaggccatcaagggatggtcatttctccgggagcgatgcgtccagcttagggatgacgagtataccgacttgggttcagccttcttggcacttctgattctctcgaaattgctaaggaaaattgtttccgtgaagaaaatccaagccgaggcgcttccgtaa

SEQ ID NO: 64476 - DNA, 258 bp, Glycine max
  Peptide Sequence Number=SeqID_156161
gaaccgtgttccttcatggtgttgagggaaggagcccagagtatgaagaacctcgggatttgaggtcaaatcctttccaaggtggaggggatgatgcaatcctaccccccaaggcatcctcttcaagcttcttatccaaggcaattcttggtggtgaagctccttcttccttggcttattccctagtggatgcctccatagaagctccacaagcaagcttccatcaagtggtaatcagagcacaagagcttcaagcag

SEQ ID NO: 64477 - DNA, 174 bp, Glycine max
  Peptide Sequence Number=SeqID_156162
atggggaactatatcataattactttcatccttatatgtcccaatggagaaagatcacaagatttgatgcaatcctaccccctaagggtattggatagaagagtccaagagaattgggctagagctgctaaaaaaggccttggggttctcatgaaccccagggtagatttctga

SEQ ID NO: 64478 - DNA, 198 bp, Glycine max
  Peptide Sequence Number=SeqID_156163
atggtttgggctctagaacggtttcaaggtctttttctaagacgtgatgccttccttggagttattgtgaccgacagagacctagcattgatgaatgcagtgaaaactgtattccctgagtgtaccaacttgtggtgttggttttacatcaacaagaatgtcaaggcaaaatggttgaatatgctcattgggctttaa

SEQ ID NO: 64479 - DNA, 207 bp, Glycine max
  Peptide Sequence Number=SeqID_156164
atggtctctggtaatcgattaccaagggagtgtaatcgattaccaagcttgaaaacgaggtttcatgtcctgaagctgtataattcgagtttggcctctggtaatcgattaccaaggctgtgtaatcgattaccagagatgaaaagcctaaagataccccttttacttgcatgtagtggttatgagacgcattgtgttgcagcgtag

SEQ ID NO: 64480 - DNA, 251 bp, Glycine max
  Peptide Sequence Number=SeqID_156165
atggctactcagttgaaccaagttcagtccaaaaattctgatagattgccttcacaaactatgcagaatccaaaaaatgtgagtgccatcaccttgaggtctggcaagcaaattgaagtgtctccaccagtagcagcacctgcacctgaacctgtcaagcttcattctatacctgaaaaagaggatgagccaactgcacaaaagagaaagcttcatgatcatgagggagctaacaaaaatttccattgcag

SEQ ID NO: 64481 - DNA, 159 bp, Glycine max
  Peptide Sequence Number=SeqID_156166
atggcgtcagcaatcacttgggccacatggacgctcatccgtgtcaggatggcatacaccaactggaacttagcggtccgggcaaaaccctgccccggtgtgcataacagctgggcaatggcctcctcgtcaaacccgtcagccctgttcctcctctga

SEQ ID NO: 64482 - DNA, 672 bp, Glycine max
  Peptide Sequence Number=SeqID_156167
atggataacgaagagggagtgcaagaacagatgaaggccgacctattggccttaaaagatcaattggcttctatcacggaggccatgctaaagcttcaaaaaactatagaaaataatgctacggcggccgcttcgaatacaactagggaagtggaaccggtgctacagcctgcaataaacttgggccgagacaagaacgcgacgggtttcaatcggaggtatagtcctcaagcctacccttatggtttgcctccggacttcactcctcgtaccgctccagatgatttgagccaagcccctaccttcgagaggcagctccctcctcatgccgactatcctctgcaagaaaatgatgaaggagatgcccatttaggccctctacttcccctcaaggatccggtcccccatgagtttccccaaccaaacatagtctgccacgtctcgtctccatctgcacccgttaaggaactcgttccctttgcaaaagacaagggaaagattgatttacttgaagagaggctgagagcggtagaaggcctcggcaactacccgttctcggatttagcgtgtgtctgggacgacatgtccaaaaggtcatcttcggatgtattgccgaaggatgggggcatattctacggacgaaaagtagttaatgcacttctttcaagatag

SEQ ID NO: 64483 - DNA, 87 bp, Glycine max
  Peptide Sequence Number=SeqID_156168
atggcaattttgatcgccgatacttcaacaacatttcatagagatgaaagacccgggaatataggaaaatgcaaggatcatgcatga

SEQ ID NO: 64484 - DNA, 216 bp, Glycine max
  Peptide Sequence Number=SeqID_156169
atgttctggttaagggtgaaacaattcactttccctgtagatttcgtcgtgatggatattgaagaggacactgaaatccccttgattttgggtcgtcccttcatgttaactgccaattgtcgcaacctacccttcggcgggagggcgacgcgtgactcgcgggatgcgtgttccacgaaaggaatacgcgcggagtcgccaccaacgtttatttga

SEQ ID NO: 64485 - DNA, 164 bp, Glycine max
  Peptide Sequence Number=SeqID_156170
gctcatcttggtggtgaagctccttcttccatggcttattccctagtggatggcgcctcctcttacctcttctactttgtctttcgctgcatctccatggtgttgagggaaggagcccagaatatgaaagaaccttgggatttgagggcaaatccctttccaag

SEQ ID NO: 64486 - DNA, 309 bp, Glycine max
  Peptide Sequence Number=SeqID_156171
atggagtcaaggatgacaaaggttgaagaagatgtatcttacatccgccttgtattttggctatattactatgaagttgtcatcatcaaaaagggggagattgtggaagcaaagcttcatgatgaatcaacaatgattcaaagctcaaaagatcaaagaacaactcatgtgaatcaagaacaagtcaagagttcaagaatcaagaagaattcaagactcaagaagaaagtctacaatcaagaatcaagattcaagattcaagatctcaagaatcaagatcaagattcaagactcaagattcaagaatga

SEQ ID NO: 64487 - DNA, 462 bp, Glycine max
  Peptide Sequence Number=SeqID_156172
atgcaaaagcttcaagccaaggtcagactctcatgcatgcagaggcttcttcaagagcaatgccaaactccttttgcaaatctgatttcaggcttaaatagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 64488 - DNA, 408 bp, Glycine max
  Peptide Sequence Number=SeqID_156173
atgaacaaagacttttttggtagtaatgttggtgatgttactggtagtgaagttgttggtgatgcattatctgagtatgatagatttattataaggaaaaaaaaggctagaagttcttatgttaaatcagagttagaccactatttagaagaagaggttttaccaagagctattgactttgatattttgatgtggtggaaatttaatggagtcaacccatatcgtagtcgacttcaatggactactttagaggctttaatgtgcactagaagttggttgtggagtgctgaaaatactggttctatgagctataaagttgttgctgaatgtgctactataatgaatgaaatggtttcagatgatgaaggtggaatgatgggtgctggtgtcactaatttggaggaatga

SEQ ID NO: 64489 - DNA, 636 bp, Glycine max
  Peptide Sequence Number=SeqID_156174
atggagagaagtatgatagatgctgccagtggtggagcccttggagacatgactcctgctgaagccagaaatttaattgagaagatggcttccaactcccaacagttcagcgccatgaatgatgctatagtcattagaggagtgcatgaggtagctacaaactcagctgcatcatccgaaactaagaagctagaaggcaaaatagatgcattggttaacttggtaacccagctggccttgaataaaaaatttgtacctgtcgcaagagtatgtggtttgtgcacctctgctgaccaccatacagacctttgcccttccatgcagcaacctggagcaattgagcagcccaaagcttatgctgcaaacatttacaatagacctcctcaacctcatcagcaaaatcaaccacaacagaacaattatgacctctccagcaatagatacaaccctggatggaggaatcaccctaatctcagatggtctagccctcagcaacaacaacagcagcctgctccttccttccaaaatgctgctggcccaagcagaccatatattcctccaccaatccaacaacagcaacagccccagaaacaaccaacagttgaggctgctccgcaaccttcccttgaagaactt

SEQ ID NO: 64490 - DNA, 294 bp, Glycine max
  Peptide Sequence Number=SeqID_156175
atggcatccaggaagagaaagagcactgcttctagacctgcatcttaccggaatatccttcaggagataaatgttaagatttatcatactaagtttgatgagttcaaagtggagttggagaggcgtaatctacacaaacgcctcaccaacctccaggatggaagcatagacatggttatggttaaggaattctatgctaatttatacacctcagaggaccaagctccaaagcaagctagagtaagaggacacctgatcaaaatagatgcagacaacctaaatgagtttctctag

SEQ ID NO: 64491 - DNA, 507 bp, Glycine max
  Peptide Sequence Number=SeqID_156176
atgaccatccagaatatgcaatttcagcaagagacaagagcctccattcagagtctgaaaaatcagatggggcagatggctactcagttgaaccaagctcagtcccaaaattctgacaaattgccttcacaaattgtgcaaaatccaaaaaatatgagtgccatcaccttgaggtctggcaaccaaattcaagtgcctccactagtagcagcacttgcacctgaacctgtcaagcttcattctgcaccggaaaaaaaggatgagatagttgcacaaaagagaaagcttcctgatcatgagggagctaacaaaaattttcatgcaggtggaccttcttcgagtaattctgacttgcagcatcctcctatccctcttccattcccacctagagaaattccaaacaaaaagatggaagaagcggaaaatgagatcttggagaccttctggaaagtagaggtgaacatacctctgctagatgccatcaaggcagattccaagatatgctaa

SEQ ID NO: 64492 - DNA, 131 bp, Glycine max
  Peptide Sequence Number=SeqID_156177
ttgtgtatgtgtgtcttaatgcggtcttggttgagtttagtcttacaagaggaatctgtgaatgtggcttgatcaggactaggctaggctatcatgaggaatcaggtctagcagtccaggagacaacatag

SEQ ID NO: 64493 - DNA, 675 bp, Glycine max
  Peptide Sequence Number=SeqID_156178
atgggtgatcaagaggagacacaggaacagatgaaagccgacatgtcggctctgaaagaacagatggcctccattatggaggccatgttaggaatgaggcagctcatggagaagaacgcggccaccgctgccgctgtcagttcggttgccgaagcagacccaactctcttggcaactgcgcaccatcctccctcaaacatagtaggacggggaagggacacactggggcacaatggcagccctcacctgggatacaaccgagcggcttacccttatggattgccgcccaactactcaccacccgtcttgcaagacgatgcgggccatattgcttctcccgtccttgaaagagagcctcctcaacagcccgaagaagtccacaaagaccctcaagactatgctcaaagggatgtcgagttctatcccccgatccccgaagggccgacacccagcacgttgcctcagcccaacatcacgacacaaccaatagttttgtccatggaaggaccgcccccggcaactgaagaaaggaggaagctcgatctcctcgagggagagattgagagccgtggaaggatttggggactatccgttcgcagacatgacggatctttgcttagtacccgatgttgttatccccccaaagttcaaagtactggacttcgacaagtataa

SEQ ID NO: 64494 - DNA, 126 bp, Glycine max
  Peptide Sequence Number=SeqID_156179
atggcgatgagaaggagagacatgagtaaaggtaagaaggaggatgagtgtcgcggttggagcgacgtggtaaagcatggaggagttgaaggatttgggaaaggtgatggtgagccattgggttga

SEQ ID NO: 64495 - DNA, 312 bp, Glycine max
  Peptide Sequence Number=SeqID_156180
atgtacctctcaacaatagatgcttctagacgatatagattctttgtatacccttttaagatcttcatgtatcactcaaccggctcatcaaaacttgacaggatcaacgactttgctacatatggcatggaagacaaagcaccagtatccttgtggaaccgtcacccgacgaagacactgacaaaaagtgatgcaatcctccctaggaagggaccagtcactagagccatgagcaagaggctccaagtggattgggctagagctgctgaagaaggtcctagggttctcgtgaacctcagggtagatttctga

SEQ ID NO: 64496 - DNA, 366 bp, Glycine max
  Peptide Sequence Number=SeqID_156181
ttttcaagtgttggtccaattgagttattatgcatcattggtagaacaccggttggtatattaaacatacttgaagccactatgacccctactcatgatgccctgctatattacaatggggggtggaacatgccacgccaaaatgagtttgttggttactcgttcacaagaaaaaatcccaaaaagtttgacattccttccggatgtatcatggatgaactggaggatttgatcaagcaagttgcgcctcatggattcccccttatggtattcatgaaacacaaacggtacgatgattgttttttcaacaaccaagtcactatgagtattcagataaaaatatcaaattcgaaattattgaactaa

SEQ ID NO: 64497 - DNA, 219 bp, Glycine max
  Peptide Sequence Number=SeqID_156182
atgactcaacaaacttttacaaaaggtgtcgagggaaggagcccagagtatgaagaacctcaagatttgaggtcaaatcctttccaaggtggagggaatgatgcaatcctaccctcacaagggcattggataaagactccaagtagattgagaagagatccaagggaaggccctagggttctcatgagccttagggtatattttgagcccatgggctaa

SEQ ID NO: 64498 - DNA, 732 bp, Glycine max
  Peptide Sequence Number=SeqID_156183
atggacatgaacatcggtggtttgatgtctagacaaatgaccatgatcgctcagtctaacttttctcgattaggcttcccagccttaatcacagccttttgtagatcgaggggagtgggatctgatgcccttacctcctatgaaaacctaagaccagccattgacttagcttatatcataaggaattgttggaatgcaaatgaccaaacagttaattttccagagacaaagaagactaagctcagagaagctgatattcctcattcctttacaccaatagctggcatttatgcatcttctacttcaactcgacctccagctttagcagacttatctgcccaaagctctcagacttcagatgccaaatttcaaagcttgtttgaaggacaagcacctcaacagcatgagccagaaccagaaaatgatcactcatctgaagccacaatctctggagctgttgattgtaaaaaaagaaaattagagacgagatccaatgaggctgctcatcatagaccagtgctagcatcagctgatgcaccatttccaggagtggatccatcttcacctcagcatgcagcagactcttccatttcgatcttagagatacttgagggccagaccataccagttctgcctttggacacttctcctccagttactccagtatggcatctaacagatgagaagaatgttcagatacaggacaatcaggaccagtcacaggaattttaa

SEQ ID NO: 64499 - DNA, 255 bp, Glycine max
  Peptide Sequence Number=SeqID_156184
atgttccgtcatggaaagatgtccatgaaaggggttttcagactttaccctactctaaacatacccaacaccagtgtcgagggaagaagcctagaatatgaagaacctcgagatttgaggtcaaatcctttccaaggtggaggggatgatgcaattctacccccaagggtattggatagaagactccaagaggattgggctagagctactaaagaaggccttggggttctcatgaaccctagggtagatttctga

SEQ ID NO: 64500 - DNA, 561 bp, Glycine max
  Peptide Sequence Number=SeqID_156185
atggagaggagtatgattaatgctgccaatggtggagctcttggtgatatgacccctgctgaggctaggaatttgattgagaagatggcttccaactcccaacaattcagtgcaagaaatgatgctattgttcttagaggagtccatgaggtggccacggattcatcttcatttactgaaaataaaaagtttgaaggaaaacttgatgccttggtcaacctagtaactcagtttgccatgaatcagaaatctgcacctgttgcaagagtctgtggtctatgttcttctgctgatcaccatacagatctctatccttttttgcagcaatctggagtcaatgagcaacctgaagcttatgctgcaaaaatttataatagacctcctcaacagcaaaaccaacaacaacaaaataattatgacctttcaagcaatagatacaatccaggttggaggaatcatctaaatctgagatggacaagtcctccacaacaacaacagcctgtccctcctttccagaatgttgctggtccaagcaagccatatgttcctcctccaatgtag

SEQ ID NO: 64501 - DNA, 267 bp, Glycine max
  Peptide Sequence Number=SeqID_156186
atggctactcagttgaaccaagctcagtcccaaaattctgacaaattgccttcgcaaactgtgcagaatccgaaaaatgtgagtgccatcaccttgaggtctggcaaccaaattcaagtgcctccaccagtagcagcacctgcacctgaacatgtcaagctttattctacaactgacaaagaggatgagatagttgcacaaaagcgaaagtttcctaacaaaaattttcatgcaggtggaccttcttctagtaattcctacttatag

SEQ ID NO: 64502 - DNA, 62 bp, Glycine max
  Peptide Sequence Number=SeqID_156187
atggcgacgatcgggctttccttgcccttattttgggcgaggaaagcgtcaatcgctgctag

SEQ ID NO: 64503 - DNA, 234 bp, Glycine max
  Peptide Sequence Number=SeqID_156188
atggcaggaacaaatcctaatgatggaggggggctttcgcaattccaaatgcaagctttgatgcaacatttggagaggttggatcaaatggagaacagagatcataatgaagaagaaaggaggagaagagggaatgatggtgttcctagacaaaaccgaattgatggtattaaactcaacattcctccctttaaaggaaagaatgatccggaggcctacttggagtggagatga

SEQ ID NO: 64504 - DNA, 212 bp, Glycine max
  Peptide Sequence Number=SeqID_156189
atgtggcataaaccttcattcttcattgttgtcgcaacctacccttcggcgggagggcgacgcgtgactcgcgggatgcgtgttccacgaaaggaatacgcgcggagtcgccaccaacatttatttgaggaaaacgtcggaaaaaccggaaaagacgcgatctacgaacttttaagtgaaaggttcgggagttgtatttacgcacggggaag

SEQ ID NO: 64505 - DNA, 288 bp, Glycine max
  Peptide Sequence Number=SeqID_156190
atggagcttttccgcagaaaccgtggtagcacttttctcagcacgcgttctgtttgcctagtagaattcgtcttaaccgacggagaagtcggtggctggccctcacatggacagtgtggcagcaccggaataaaatcatcttctctaatcaaacttttgatgggtgaatggatccagaaccccaatgaagttaagaaggaagctgcgaattttttccttaacagattttctgagcagcagctttgtagacccactcttgatggagtgcatttctcttcactaaactag

SEQ ID NO: 64506 - DNA, 373 bp, Glycine max
  Peptide Sequence Number=SeqID_156191
caaagggaggtcagagttgtggtcgctaggcagaatcatgctaagtagcaatgtcatccatatctgtgtaagggttgtcatgctggtgcgcatgatccgcaccccgtctccttgcggcatccaggcgaagttgatgcaatccgaccccccaagggtattggatagaagaatccaagaggattgggctagagctactaaagaaggccctagggttctcatgaacctagggtggatttctgagcccatgggtcaagctctagcttctcatctcaaggaggtgaacttagctattagtgagcttctcaaggaagttttctcaaagaagcttctcaaagaagttttctcaagaaagcttctcaaggaagctacctag

SEQ ID NO: 64507 - DNA, 330 bp, Glycine max
  Peptide Sequence Number=SeqID_156192
atgaagagctgggtgtgcgatatatatccatgcattgaattggctaacggccaaaccaaatacgccaaatacagtgattcaaaaagcattcaaatgcctaagctgcgtcgcattttagtaagttgcagatcacctgtagcagatgacgagagtgatgagcaaaatgacggcgacaacgatgaagtctatttcgttgaagcctttgggaagagacggcactgtgaggcgccatttggtggaggagattccgattgtggtgccaaggtacgccgtcaagcctctggcgacggtgacattggaaagcacggaccaaaggtgacacggaggtag

SEQ ID NO: 64508 - DNA, 531 bp, Glycine max
  Peptide Sequence Number=SeqID_156193
atgagggacgacaagaggtcttcgtacgtcattgggatcggggtgaattctggagttggccttgggggaaagttcctcatcgcgttggaactggcgccaaagtgggcgttgccagccgggcgagtcggggttggagccagagcttgggggacctccttctggatgggtgcgggcgctctaggttgtacgggtgctgaattggaagagtccccagcgcgagctgagaagctcggttgctccgatcctcctagcattggtacttgtttaggagacgtaatcgaacttccctctcttcaaacctacctcgattctctccccgatgaataccaagtccgcgaagctggagggcatatagcctaccaacttctcatagtccctccaccgctgagagtactctttaaaggtctcactttcctttttaaccatgttctgcagctgagtgtgatcgggagccatatcggaattgtattgatactgcctaaggaaggcagtaatcggatccttccaagtacggatgcgggaagcttctag

SEQ ID NO: 64509 - DNA, 606 bp, Glycine max
  Peptide Sequence Number=SeqID_156194
atggagagaagtatgatagatgctgccagtggtggagcccttggagacatgacccctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctgtcgcaagggtttgtggtttgtgctcttctgctgaccaccatacagacctttgcccttccatgcagcaacctggagcaattgagcagcccgaagcttatgctgcaaatatttacaatagacctcctcaacctcagcagcaaaatcaactacagcagaacaattatgacctctccagcaacagatacaaccctagatggaggaatcaccctaatctcagatggtctagccctcagcaacaacaacatcagcctgctccttccttccaaaatgctgctggcccaagcagaccatacattcctccaccaatccaacaacagcaacagccccagaaaaaaccaacaggttga

SEQ ID NO: 64510 - DNA, 384 bp, Glycine max
  Peptide Sequence Number=SeqID_156195
atggcaaagttggggatgaccatgtatgcatctatttggatattctgggttggaccattcgtgggagcgttggtggcggtggcataccaccagtttatcctaagagcagtggctattaaggccttaggagatcaatctcccctactaatcgtagaggtaattaagcaggaaaaagttaaagaatatgaaaaagttgaaccagccaagtctgcatttgcaacaaaggccaaagttcgccgagctattgaggctgaaggaattccttcacttatgtgtcaagcaacttctttgctggttacttcctacccaacttgtcacagcctggagccacaactgcccctagaaacagagttatatcctaggagatggaaaccccaaaggtag

SEQ ID NO: 64511 - DNA, 477 bp, Glycine max
  Peptide Sequence Number=SeqID_156196
atgatgcatgaggatggtgggttgtggtacgagatgattaaagccatgggtggcaacatcttggaagggtgtgtggggggaggatggtttgatgataatatggtgtcgtgtgtaggtgatgtgggtgagatagtgttttggaaacatagatgggtgggtgaggagagattgatgacaaggtggtttacgtgggaaggtggagatgtgatagcaatcaggactaggaagagcacaatcacaggcccaaacgtattggtaaaaagccccaaggatgggaggattatgtccactaggctgtgtccattagtgaatggtgctgttagaacgatatgttacaattgtcaatggggtatctctgaaaaagcaccaaaggcccaattggaggtggaagctagaatcattggacctttactcggttgcatcggcgtacactctactacaaccactactagaattatgacgttttatgtcggttaa

SEQ ID NO: 64512 - DNA, 351 bp, Glycine max
  Peptide Sequence Number=SeqID_156197
atggaggagcaattcatacttagagttccacctaatgtggcagagcggatagagcgtcttctgaatgaaaacaatgcttcttcatctgaagacaaacagtatctcaaatttttcgttaagcatgaccattgctttcgccctctccgacctcctcttaacgcgacgttattcatgcaggcatcgatggactttacttgcaaggttgactctaccattagcgcatccttgtcgtgccattcttcgagtctgcacactcctttaggcgtcaaggcctcctcgccaatcaacttccttgatgaccaccacttgttctctaacatggaccctaacatcaacattgaagagggagag

SEQ ID NO: 64513 - DNA, 267 bp, Glycine max
  Peptide Sequence Number=SeqID_156198
atggttgtacttgttcgagaagaagaaggatctacagatgatgcctcgagagttttgaagtggaactggaaggaagtccctgctgctcagaaggatttgatatgggaggatattcaggcggaatttgaaatccatgaagcttctgacagtaggacaaagaagaaagttcttcagactgtcggcgagcggtggaggcagtttaaatttgatttgacgaggaaatgggcacttgcagccaacaaggacggtgtcgatgacactctgtga

SEQ ID NO: 64514 - DNA, 399 bp, Glycine max
  Peptide Sequence Number=SeqID_156199
atgaggaaacctgatctgatggccaacaagaacaaaatgaacaacattaagagcaagttcagaaaagggttgtggtcactagatgaagatgagaggctcgtaaaggtcattcgaatgacgacacccccgccatctcccacacaggccgagattccttctgatgggacgtctaggaaaactagacaagccactcggctaagaaggttgacaacaagaacattggatcaagcaagggcaacaatcagcgtgaatccagcgactggtagaggattcggacctcacaaggatcagtttcacagttaccttagagttgtggcacgagacaagattccaattgttcaccctagctggaatgatgtgcctgaaacactgaagagcatgatatgggatgacatatag

SEQ ID NO: 64515 - DNA, 438 bp, Glycine max
  Peptide Sequence Number=SeqID_156200
atgtctctaggcaacaagattttgtacttttctatggctagaatagtagttgctgaccttagggatgtaaatgtgatttcaacgacggttaaagaaaactgtcgtagacattctacaattctaagacgggctgccagacagcctcatcttcgaacttacgaaaaactacgacggtcatggggacaacaccgttgtagacctaatcgtgttctacgacggttgtctgctatggaccgtcgtagaatggtctacaattctaagacggctgccggacagccccgtcgtagaactaacgaaagactacgacggtcatggggacagcaccgtcgtagagataatcgtgttctacgacggttgtctcctgaggaccgtcgtagaatggtcctaatactagtacggtcttctgttaccgacgaccatcgtaagagagggtcttaa

SEQ ID NO: 64516 - DNA, 171 bp, Glycine max
  Peptide Sequence Number=SeqID_156201
atgagtgaaatagaggagatgcaagagcagatgaaggacgatatggaggccatgaaagagcagatgaccacaatgatggaagccatgatgagtatgagaaaaatgatggaggtagggtaccctagaaatataggatttttcagcccttgtattttagggcacttagactag

SEQ ID NO: 64517 - DNA, 910 bp, Glycine max
  Peptide Sequence Number=SeqID_156202
atggatttaggtaatgtatttctaagcaacttgcttaagagggctggagtgcagtttgctcaaaaggatcaagtggtccaaccaaataatcctacttcacaacctagtaggactactaatgtaccaaacagggagcaggcctcacctagacatgaagcaattgctcagccagtagaatcccaggctgtccctgagtttctactattgattcagaatatgaaaattggatctctctatacatacagagatcaacaagaaaagattgggagatggactgaacaagatgctgcaattttggtcccaagagacataatcagcatcaaactgagagatatcattcatgctgatgcacgtcttctagagggtgatgctttaagtgttgatcagtcttctttgactggagagtctcttccagtaacaaagaatctctctgaagaagtgttttctggatcaaccgttaaaaaagtgggaataatcattgagccaatgtggttaatggcggatggcggttcatggcggaaagtcgcggttctgggtcgtcttctccgttcgcgtcgccgccgttcacgccatgggtcgtcgctgctggctgctgtgtgcagcgggtcacgcgcggctggttccgaggctggttgcaggggtcgtggctggttccgaggtcgcgctgtgttgaagcttcgagggttgcagcagcgttctgaaagcccaactcctaccgcggacaaaaaaaaaaattccgccattttccgcctccccgccacatccgccatggccgccatggctatggcggccgccatggcgccgccatctttaacccgtcacgccaccgctattcggtggcgttttttcagaaaaccgctacgcaactccgccatggcgccgccatggccgccatttaacaacactgacg

SEQ ID NO: 64518 - DNA, 526 bp, Glycine max
  Peptide Sequence Number=SeqID_156203
atggcagaatcatccaagaagcgcaagggttcatccacctccgttgcggcacatagaacatcacgttctggagtcaccagagtatcctcggcaccaattccaccatccttgtcatcctttacactgttttcatctgatgaacagtgtatccgatattcctttctctttcaatctcgtcaaattcttgatcctaaatatcttgaccttgaattctttgatggggaaacatttgattgctatcaagatggaactttaatttatgaggtgcatggtatacctatgattattgatgagtctcttttcttttctttgacacaactacccagtcagggtgcaccttttgagggtacccttgttgatgactggaaatttgattactatagtcatgatgcccgccacatggcattgcggtctgctgcacctctcccttaccctcagcttgtgactttatttcttcgacattttgaaattccattggattctgagccttttgtgctagttaaatgctcctttgctattggtgccg

SEQ ID NO: 64519 - DNA, 390 bp, Glycine max
  Peptide Sequence Number=SeqID_156204
atggctacattcagcaacatttctcaaatgttcctatgtttcatgattagttccacattgatggtcaaaatcgggctttcacaagatgctccggaaccatcaaatgcaccagggccattgtcatcgaatgagaagtatttaaccaattgtggatcgcatttgtatccaaattgtggtgatgaggtattctcagcaatatttttcggtaacaaaacagttagtgagtattgttgtgacaagcttgtgaatgatgttggaaaaatgtgccatgatgacatgacaaagtatattttgacattgccaaagttccgggcccatgaaactcagatcttgaagaggagtcagacgtatgttccaagttatattgcatatgcatctgttgatgtttga

SEQ ID NO: 64520 - DNA, 282 bp, Glycine max
  Peptide Sequence Number=SeqID_156205
atgagagattggggcagcttggttatagatcttgctacaatgaagattatgattttccaaggatcaagctttggacatgtcgagcttcaaagccataaagcctcacttgctagtatgctttgtcttcatgaaatggaaggttttgaaggtagtcgtggcattataaaaaatttaccttctaggaacaaaagcactctgattctaggacaccatatcaaggaggatctatttgagcctattagctatggttttgttgatgagcttgaacaagatgttgcatag

SEQ ID NO: 64521 - DNA, 423 bp, Glycine max
  Peptide Sequence Number=SeqID_156206
atgtcggcgccagcgatcctaatcccaatccttgtcgccaccgccgacgcggacgcgatcgtcagcggcggcgttcccaagggacttccagtaggaatcgactcggttggcgacctcggagaactggtgcaacacggagtcttagccgctgcgtttggcgccggcactgcggtcgtcggaggaggaagaggcgaggcagcgataggggggttacgatgggaacgagaaaagcaagggcgtccgttgtgcggggaacggaacggcaagcttctagcgtcgggaagagaaagagtaaaagacaagaaagtggtcattgagcatataagcattgagctaatgatctttgatcctttgactaagggcatgccactctttaagttcaaggatcatgtagagaaaatgatacttggttctactttatga

SEQ ID NO: 64522 - DNA, 393 bp, Glycine max
  Peptide Sequence Number=SeqID_156207
atggaaaaatctcttttgattgtagaagaagcaaacttatcatccagatctttttctggaagagttagtgatgataaagctaacagaagtggaaggaagggtatggttcttccttttcaacctctatctctcacatttgatgagatcaaatattctttagacatgccacatgaaatgaaaaagcaaggagtttttgaggaacgtcgagaacttttgaagggtgttagtggtgtctttaggccaagagtactaacagctctgatgggtgctattcaaggagttcctaagatcaaagaaggttataatcctgcaacctggatgttggaagttacatcagcaggcatagaagcatctcttaaggtcaacttcaccaatgtgtacagaaactcataa

SEQ ID NO: 64523 - DNA, 342 bp, Glycine max
  Peptide Sequence Number=SeqID_156208
atgcaagattattcttcccctaaattaaataacctggagcttgcaaaagattttgttgtttctggcactgcatctgagtctctgtatggtgcttgtgaggcaatgtttaagcctgacatggaaccagaggaattgtttgagaccatctcccaagcactgctatcatctgtagatcgtgattgtttgagtggctggggaggacatgtctatgttgttttgatctttagatttttagatgctgctgttgtcaatttcccatctgagtacttgtacaagccactggccagaccggaagttctgacttttgcatctattaaaaataattttcacaataaggcatga

SEQ ID NO: 64524 - DNA, 609 bp, Glycine max
  Peptide Sequence Number=SeqID_156209
atgggggttcaaattgcaaccagacccacttgggccttccaggatgctcctccaaaaggcggttacttctggaggaagcaacctagcttgcctgggcgagctggaaaatccaagccgaggcgcttccgtaacgtttccgtgggtgatttcgcaaagattttcaaccgttcttcgacgttcttcgtttgttcttcgtcgttcttcggtcttcaaccgcaagttgaaaatggggtggttggaataccgagaaaatgtttggaggcaaaagcaagaatcttggcaagtaaaggcgaatgggccctgttcatagacattctcgcactgttgatctttggaggagtcctctttccaaatgtggatgggttggtggacctagcagcgattgacgcttttcttgcctatcatgaccacaaggaaagcccggtcgttgctatgctagccgacctctatgacacctttgagcgaagatgtgagaagagcagtacgaggattgtctgcagtactcccgctctttatgtatggttagtttcacaccttttttgccaagaggtgaggcatgccaccgttcatgcacagagaaaggaggggcaaattgggaccaactcttag

SEQ ID NO: 64525 - DNA, 498 bp, Glycine max
  Peptide Sequence Number=SeqID_156210
atgtttgataggtcggctgctgaagcattcgaggcctcagaaattctagaaagtacaagaaacaaagaaatatatcgaaaacccaatggagatgaacatcagaggatgaggagagatgcgatattggcaatgcaacagaaaagtggtgccaaaccttcagtcttcaacagaattagtgaaggtccacccctagttttcgatccacccactgatgatatgagatgccacataaagccactccatttgactgctatggtggaggcccaaattattaataagatcttggttgattggggggggggggggggctacattcaatatcctgctaaggtctatgctacgaagggaatgaatccatggagttggaacaaagatggaaaatttgagatggtcaaagcggatcaatcatcgtatgggatttacgatgcctttgcgagagaaggtggtcaagaaatggcgaggaccgctccagtcgaaatcgagattcattctatgtga

SEQ ID NO: 64526 - DNA, 309 bp, Glycine max
  Peptide Sequence Number=SeqID_156211
atggctactccacccagctctcgtcgtcgtcgttgtcctcctcctagtggtgcagcatcacaatcgccatctaccttgaagcggacaagaaaagccacacagctaagatcattggcgactagactagctgggacagagacaccgctggtccatgtagatcctgcgacgggaaggccaacggtcgatgtgacatacgagaattggaagcaagtccctactgctcggaaggatttgatatggaaggatattcaggttgaatttgatatccctgaagcatctgatgtaaggacaaaaaagaaaacactttag

SEQ ID NO: 64527 - DNA, 873 bp, Glycine max
  Peptide Sequence Number=SeqID_156212
atgtcttcccgaaagtctagtcaaagggatcatctagtcgtggtgcccttagttgtttcgaaaaccctagaaatgttccagttattggtcataaaggcaaggaatacatactccaatgttcaagtgcaagttggcagggttggaaaatatgttcgccgtaagaagcatcctttgtcggtagagcctaatgacaacgagattactagttcgaaaccttctaaagattgttgggacgacctctttgttgttaataaaggtgagggtggtgatcaatttaagtctaactttgagctttattggtcctccactcattataataagttggttaattttaatgggaaacaagaggaagagttgtctacaaaaaagctcgcttctacgaattccattgtcgaattggttaatgagaaaggagatgcaatcacttgtaaattgcttttacaaaccgttgatgaagattggaagtcagttttagaagtgctcatggggaaatcaaagaataagcctatgtcaatcgctcctctttatactgaaaataggggtgataagaagaaacttttgaataagtcaaaagcgtctgacagagggaaaggtcttgctatggagattcactctaaagcttctcatgatatacctcatcctccttcttcgaaaaggaaaaaagagtatctgactcacattactctcgagtacaaaagcattctagttctaaagcaatccctaggtaatgttaacctgctaaagctgattaagggaaaggatgccgccttaaaagaagagattgatgatggatttattaataccctagaggctaactctgacgataggactgctagagcttctaaagctaatgtcgacctagaaggatcttaa

SEQ ID NO: 64528 - DNA, 768 bp, Glycine max
  Peptide Sequence Number=SeqID_156213
atgcatctttattacatgaacccaatagagcatgaaagcaacatagattcaatagaagaatctatgatttatgttctcgttttctccgagaactatgcatcttccacatggtgtttggatgaactcacaaagatacttgattgcaagaagagatatggaagggttgtgatcccagttttctataaggtggatccatcaattgttaggaatcagagagagacatatgcagaagtattcgttaagcatgaacatcaatttgaagacaagatcgacaaagtgcatgcatggaaggctgctcaaactaaagcatgtgtgagcaatagcatcaacccagcaagctgtgtcttggtacctgttggtgttaagactacaagtacaaaaagcctaagcacaagcatcaacccttctttgaagagacctcaacaacaaaatgagccacatttgcaaaactttgttgtgccagggaagccaaggagcaaaaggaagaggctttcagaaccaagaaccaacaaagaccctctaagcatatggtcacaccacttgaaccctcaaattgaggccttgtgttctgaccctcctctactcaaacaggcttattggttggtagacagtgaactcatcatgccaaagccaaaggataacaaggagcaaaaagaagaggttgtgatcatgaccaaaaaggatgaagaaaaagtgattattaatgtgagcaaggaaataagctttggggactctgaacttgatgagtgtagcaatggtcaacactaa

SEQ ID NO: 64529 - DNA, 882 bp, Glycine max
  Peptide Sequence Number=SeqID_156214
atgagagctcaagctcaattccccaacactacacctccattcccaacacgtgatatatatggaagtgtgcataggccaagagaatgcactgtagattatgagctagttgtagccatggatgagatcaactttgttacagactctgatgagaaaaaacattctccaaaagatgcaaatgatgtccttactgaaaaggaccaagcatcggagaaggttgaggttcctactgatgggaactcaatgctaaagaaggaaggggataataagaaagagatattgatatctcctctgcctacaaacatctctcttcaccttgctgatcgttcagttgtctatcctagaagggcgattaaggatgtgcttgttaaggttaggcttggtagactcaccttaagattaggggatgagaagggtgcattcccaagtgtggggacacctaatccttttgagaggattctcactaatgaggatcttgactgggaactgaacctaaaagtagaagagatactttcattgcatcactctcatcatagtcccaaatcatccaattttgagaggttggaatatgactatggcactaaaacaaagccttctgttgaggaacctcttgaattggacttgaagcccctcctttccaacctcaaatatgtcctaagggacaacaaggaagtctttggatggagcattcatgacataaggcttaaccccaacatgatggaagtagttaaaggaaaggttagtcctgttcaatgtgtccctaagaaagggggcaccactaacgtagctccatatggagcttgtaggccttgggtcttcttcatcaatggagtcatttgcttcttgaagatcaatggcggcggaatggagacggaagaaagatga

SEQ ID NO: 64530 - DNA, 471 bp, Glycine max
  Peptide Sequence Number=SeqID_156215
atgtcagaaacagaaatgttagggattaaagatagaggtcagggggagcaaaaatcacctggaattatcccacttgcagtgaaggatgtctttagtattatacaggagactcctggacgagaattcttgttacgtgtctcatatcttgagatatacaatgagattggtatcagtgccctggttgggttttctggggaagttgttctaggtaaaatcaagaatgtgttatgcaaagctcttaaaagagaaaaggggttgcctgcaacaatgtcagaaagggagaataaggaggttcttgacaaggctcatagtgctttgatcctgtctcttggagataaagtattgagggaagtttcaaaggagaaatcaactgttgtgatttggaacaagttggaaaacctgtacaagaccaaatcgttggccaacaagttatacaacaacaacaacaacaacaacgccttatcccactag

SEQ ID NO: 64531 - DNA, 234 bp, Glycine max
  Peptide Sequence Number=SeqID_156216
atggggcgtttaggagtacataacaagacacaccataaaatgagtatgtcagtcagggtcacgctgttttgcaagaatgctccaaccatgtgggatcggcacaggcttaaaagagcacttaaaccgggtgtatttacccccaaggcctacactccgaatagtccgttagagcctctccctcctaattcaggtccaacccctaaaacaatttttgcatacagacactgctcatga

SEQ ID NO: 64532 - DNA, 966 bp, Glycine max
  Peptide Sequence Number=SeqID_156217
atggcatgggacagtgcttgccaaagtgaatcagcagttaatgttatcattgtaccccaagatttctcctttcttgttcagtccactatcttcactggtccttgtcaaggtgtcttggagttgaaggttgatggaactcttatgccacctgatggacctgaatcttggcctaagaacaatagtaggcaccaatggctggtcttttacagaatcaatggaatgtcactggaaggaagtagtttaatagatgggagaggagaaaaatggtgggaccttccttgtaagcctcataagggacctcatgggacaacactcccaggagcttgtgatagcccaattgccataagatttttcatgagttccaacttgactgtgcaaggacttgggataaagaacagtccctggttccatttcaaatttgatggctgcaaaaacgtccatatagaatcaatctacataacaactccaaaactaagccccaacactgatggaattcacatagaaaataccaatgacgtgaaaatatacagttctgttatttctaatggtgatgactgtgtatccattggatccggttgcaatgatgccgatattaagaacattacatgtggacctggtcatggaattaggcaacctattattatttgctttcaagaaaagctttattctcctcatctattgcatcaaaaggcattgatggcggacatgatggcgttgctgttaggatctccaggatcgggcaaaactaccttaattttggctcgtgcaggaaagcttgaaagcaacctcaagggcaccttgaacaaggagtcacaggttgatagagtaaggaaggggctcactaacataaatattgagggtagtagtcaaaatagtcatcatgagagtgcctccgttggtcatttgtatgctggtcatctgcttggtcctgatgctgctggtgagcgtgttgttattgatgaataa

SEQ ID NO: 64533 - DNA, 1263 bp, Glycine max
  Peptide Sequence Number=SeqID_156218
atggatgttaaaatgaagggaataacagcattgcacacgcttttgcaatttcttctgttttctgccattttcccactctctttctcagctcaaccccgcaacgccaagaagctatcttctgataatcatcatcgcctttcctcctcagctgttttcaaagttcagggaaatgtttaccctcttgggcattacacagtgtctctcaacattggctatccccccaagctttatgaccttgacattgactcgggtagtgacctcacttgggttcagtgtgatgcaccatgtaaaggttgcaccaagcctcgcgatcaactttataaacccaatcacaaccttgtgcaatgtgtggaccagttgtgttctgaagtgcaattatcaatggaatatacttgtgcttccccagatgaccaatgtgactatgaggttgagtatgcagatcatggatcatctcttggtgtgctagtccgggactacattccttttcaattcaccaatggctctgtggtgcgccctagggtagcctttgggtgtggatatgatcaaaagtattctggttctaactccccacctgctacatcaggagttcttggccttggaaatggaagagcaagcatcttatctcagcttcattctttgggtctgatccacaatgtggttggccactgcttaagtgcacgaggaggagggtttttattctttggagatgattttattccctcttcaggaattgtttggacatccatgttgccgagttcttcagaaaaacactacagctcaggaccagcagaactggttttcaatggaaaggctactgttgttaagggtcttgaacttatcttcgatagtgggagctcttacacatacttcaactcacaagcctatcaagctgttgttgatttagtaactcaagatttaaagggaaaacagttgaaaagagctactgatgatccatcacttccaatttgttggaagggtgcaaagtctttcaaatcgttaagtgatgtcaagaaatacttcaagcccctagcattgagcttcacaaaaaccaagattttgcagatgcacctaccaccagaagcttatcttattatcactaaacatggcaatgtctgcttggggattctagatggcactgaagtaggactagaaaatctgaacataataggagacatctctttacaagataaaatggtgatttatgacaacgagaaacagcagattggatgggtttcttcaaattgtgataggcttcccaagtaa

SEQ ID NO: 64534 - DNA, 339 bp, Glycine max
  Peptide Sequence Number=SeqID_156219
atggatgtaatcttggcaaggtctggggcaaagctggaagctgacacaatgtgtctgaggggagtgaaacaagagacgaggttggtaatagaggaaggaagagggacatcgcctggaagggaaggggatgatgggatgtgggtcggttcggctatgggtgaaagatggaacaaggccgagatgctctggcgctggcctaaaagggacatcagcgtgcaactggacgggaaggcccaattgggagaaagacataatgaaggaggcgtagtcagtagtcatcgggcccatctatttaagccattggacgcccaagactatgttagcgccgctaaaggttag

SEQ ID NO: 64535 - DNA, 348 bp, Glycine max
  Peptide Sequence Number=SeqID_156220
atgaggaccaaagatttgtatccattggacatggatgttattctgaaggagaaactcagcttaggaacatggaaatcaatagcagtgcttctcaagtggattcaccccaagctattattactagttcctggtaatgctaatgcagtagctgctgctgctctagaaaataaggatctaccattcctagtcgctgaacttggttcaaattcacaccaaagcaacaacaacaacaatagtgatggtgatgataggcaattttatcctctcctacctttcaatcactccagcctaaaagacaaaagttggacaataaagaaaatgaatagagaaatgggtgcatctgtgtga

SEQ ID NO: 64536 - DNA, 1491 bp, Glycine max
  Peptide Sequence Number=SeqID_156221
atggcgcatcataacaataatagggtttcgatttggttcctcttcgtctcatcacttctttctctcttcgctcagatctcctccgcagagaaggagttcgttctcactttagatcgctccaacttctctgacattgttaccaaacacaacttcgtcgtggtcgagttctacgcgccttggtgtggccactgtatgaagcttgctccagagtatgagaaagctgcttctatcttgagtagcaatgatcctccggttattttggctaaagttgatgccaatgaggaaaagaatagagaacttgcaagacaatttcaggttcagggatttccaacgattaagattctaagaaacgggggcaaggttgttcaagattacaaaggtccccgtgaagcagatgatattgttgactatttgaagaagcaaagtggtcccgcaacagctgaaattaaatctgcagatgatgctagtgctttgattggcaaaaataaagttgttattgttggggtcttcccaaaattttctggggaggagtatgagaacttcaatgcattggcagagaaattgcgttctgaatatgatttcggtcacaccttggatgccaaataccttccacgtggagaatcatcggtgactgggcctgtagttagattattcaagccatttgatgaactttttgttgactcccatgatttccatatggaagccttagagaaatttgttgcagaatctagtgtccctgttgtgactgtttttaacaatgacccaagcaatcacccttttgttgtcaaattctttgacaatccaaacgtaaaggcaatgatgtttgtcaacttcactgctgacaatgctgattctctcaaattaaaattccgtgaatctgccgagcagtatagacaacagggcgtaagctttctagtgggagaccttgaggctagtcaaggtgcattccagtattttggccttaaggaaaaccaagtgcctctaatgatcattcaacataatgatgggaaaaagtttttgaaaactaatgtggaaccagatcacattgcaacttggttgaaggcatacaaggatggaagtgttgaaccattcaagaagtctgaacctattcctgaagttaacaatgaacctgttaaagtggtagttgcagacaatcttcaggacattgttttcaactcagggaaaaatgttttgctagagatttatgctccttggtgtggtcactgcaaaaagttggctccgatattggaggaagttgctgtttcatatcaaagtaatcctgatgttattattgcaaaactggatgcaactgccaacgatataccacgcgagacttttgaggtacaaggttatccaactgtgtacttcaggtcagcaagtggaaagatatcacagtatgatggaagtaggacaaaggaagacatcatagatttcattgaaaagaaccgggataaagcggatcagcaagaatcagtcaaagatgagctttga

SEQ ID NO: 64537 - DNA, 1140 bp, Glycine max
  Peptide Sequence Number=SeqID_156222
atgccgtgcttagcaagttgtgttgcttgggtcaaattccaagaggttgttggtcttctgttagtggctaagcgaatggcctcaaggaaaaggaaagccacaacatcccggccccaagagccctatgataccacgagattcacttatgagggggactgggaacgttattctcagaacattcactctcagaatgtccttccggagagaaatgttaacttatttatcacagaatatgatgaattccgccaagagctgatcaggaggaactggcacaaggccttgacccagcatatggatgggcacattgatgtggccctggtcaaggagttctacttaaacctgtatgatccagaagataaattgccaaaacaggttcgagttagagggaagctgataaagtatgatgttgcatcgctgaatgctttcttggagacaccaccagttcttcagccaggggagcagtacacatcatactccattttttgcagatcgcacccaaatcctcaggagcttgcttccaagctctgcattctagggtgcggattcgtgttgaatgctaaacgggcgccctggaagctcttgaggaaggacttgactacactggctcagacatggagtgtgttttcatactctaaactcgcccccacctctcacacgtccgatcttaacatggacaaggcgaggttagtttacgggctaattatgaggatggacatggacgtgggctcactcatatcaggccagatttctcatatgtcccagtccaactcctccaggcttggttttccagccctgatcactgcactctgcatatctagaggagtggtggcctggacaagagtccaaccttcttctttggggggaggtgaggcttctgtagcccaggagcctcagccagagcctcaaccacagtcggaggccacaccagagacgactccacaggtttcacctgctaccacacctgttgtggaggtctctgaggatgtagaaggcgccaaggacacagactacacaacagatctagaggcggcacagagtacctgggatccctggcctacagctgcacaggagacacctcagccagcccaggacactccttcttcacctcatggcgagcagacaccatcccaggatgactga

SEQ ID NO: 64538 - DNA, 531 bp, Glycine max
  Peptide Sequence Number=SeqID_156223
atgagcgtggaggagttccttgaacaggtggctttgccaggtgatgcaatcctacccccaagggtattggatagaagactccaagaggcttgggctagagctactaaagaaggccctagggttctcatgaaccttagggacctcattgaagctcaaagatccagcctccatagaagccccacaagcaagcttccatcactaggagtccagccttctccttctggagggggtgggacctctacagaccatgaacctgtgccagcagaggagcctcttccagatgcagaggatgagcttgttcctcctaagccatttatctttgagactgatccagtcactcaggaggaagcagcagctcaagatcctacttatctagttcatatctctctagcacccatccctgaggattcccaaccatctacaccagcatcgaagccagagcagcctattgttcaagatccaccaactacttcggtgctggatctgaacgagcatgcagaagatcagcagcgggatgatcaggagttttaa

SEQ ID NO: 64539 - DNA, 576 bp, Glycine max
  Peptide Sequence Number=SeqID_156224
atggctgcaagtgacgttgctattcttagagatagagctcatataccaacaaagaaaagtcttatggaacttacatcacaagatgcatggttggcacagaacaagttgttgtccaagcaactggaagcattcatcgaaacactaaggtgtgccatctgtagtggagctcacaattttggctgttatatccccaatgaagaaccaactcatgaagtcaattatatggggaaccagccaagacaaaatttcaatgcaggtggatatttcggatttcagcctggccagccatataattcacagcagagacaatggcaaaatcaccttggtaaccaattcaacaaagaccagggtggtccatctacaaggccacaacagcaagggcgtagtctctatgatcgaacaacgaagctggaagagactctagctcaatttatacaggtttctatgtctaaccagaagagcacggagtctgccataaaaaatttggaaatccaagtgggacagctggcaaaacagttggcggataggccgtcaagtagctttagtgctaacactgagaaaaatccgaaggaataa

SEQ ID NO: 64540 - DNA, 466 bp, Glycine max
  Peptide Sequence Number=SeqID_156225
tggatggcacctcctctcaccccttctcctttgtcttttgctgcatctccatggtggaaaatcaccattaaaggacctcattgaagctcaaagatccagcctccatagaagccccacaagcaagcttccatcactaggagtccagccttctccttctggagggggtgggacctctacagaccatgaacctgtgccagcagaggagcctcttccagatgcagaggatgagcttgttcctcctaagccatttatctttgagactgatccagtcactcaggaggaagcagcagctcaagatcctacttatctagttcatatctctctagcacccatccctgaggattcccaaccatctacaccagcatcgaagccagagcagcctattgttcaagatccaccaactacttcggtgctggatctgaacgagcatgcagaagatcagcagcgggatgatcaggagttttaa

SEQ ID NO: 64541 - DNA, 231 bp, Glycine max
  Peptide Sequence Number=SeqID_156226
atggagatgaaaaggtgggatgctatacattttgtggaattagatggaaacaatgaaaaaggtggattgtctaagaagttaaagatatatagaaaggcattgttcgaggagttttgggaggtgtctagaaactatgaatccattgtccataaaaaatctaggattaggtggttaagggagggagatgccaataccaacttcttccattcttcagttaattggagaaggtga

SEQ ID NO: 64542 - DNA, 288 bp, Glycine max
  Peptide Sequence Number=SeqID_156227
atgtcactcgctgtgggtgacatgtactggagatttagtggcgtgctcttgcatagatggtttctcgacttcaacgggatcatggcgtctatgccatatgtgagtcgatgttcggcagaggtgacaaggtgcttaatgcctagccttgttaggaagtcttcattgttgtctgtgacaatggcgtatgagaggtcgtacctacatatgaggtgtttccaggtgaacttctccacctcgctaatcataatttcccgcaatggtcttgcttctatccacttggtgaagtag

SEQ ID NO: 64543 - DNA, 243 bp, Glycine max
  Peptide Sequence Number=SeqID_156228
atggagaaacaagtgatcagaggattcaaaatcagcaccacaattaccacatacagaaactataatgcaaccttttttatgcagagggtcatcagtaggaagttgaccatgaagcactgttctaatcagaaaagaaggtataacgctcttgattttgtgagccacttaagggaggaaatgaacaaactcgtccgggagatcctagcagccattatgcaagaacatgctgacagtagagtttag

SEQ ID NO: 64544 - DNA, 918 bp, Glycine max
  Peptide Sequence Number=SeqID_156229
atggtagaaccctcaaagaagagaaagggctcatcctccataaccaccgttgcaagccaatgccgccacggcacatcctatgacccaccagcaccacctcatccttttttttcttctccaatgtcattggctttattttcttcagatgaacagcgtcaaaggtactattccctattctcaaatcgtgtcatactcgatcctaagtatctagacgtagaattctttgatggggaaacctttgattgctatcaaggcactctagttgatgattggaaacatgtctattctagtcatgatgctcgtaaaatggtttgtaatgaccatgctgatatgaccgacagattgcttgctggctcattcacctttgaatgtcgcattatgcattatatcctttgtcgagttttgcttccacgttccataaatcttgctcaggcctctgacgaggatttaattttgctatgggctcttcaaaccggtggccaaattgactgggcccatcttgtcaggtatcgtatatataaggcattacgggctaatgcacctcttccatatcctcatcttgtcactctgtttcttcagcattttaatattcctttagaggatgaaccttttgttaaggttaaaagatcatttgctattggtgctggtgttgttgcctccttcggataccggaaggatgtggatggccaatgggtgcataaacaagacctgccccctcccattcctgatgaacgcacaccctccccacccccgcaacgagatacctcctcttccttatcgaatgacgttctcactaagctacgggatctttgggctttcattggcgatcgcttcgatgcaatggactcacgtatcacgcgtcttgaagacgacatgagcttcattcgacgttgctttgatccttctgcggattcttag

SEQ ID NO: 64545 - DNA, 421 bp, Glycine max
  Peptide Sequence Number=SeqID_156230
atggtgtcatccaatgaggtagccaaatccaaggaagaaggtgaggatgccgcattgaggatgatagaggagcatggagacatagccaaggaacatgtggacgaggaagtggaggttggaggagaagccgaaggagaggtaggagagggtgacgctaacgatggaggagtagaggtgcttggggaggccgcgggggaggaagcacagaggaagttgaggggtacgatggcagcgaagcaaagaaggaagcagagcatggggatcgagactccgatggaagcgaccatagaatccacaaattttttgttgttcttgattatgtcgtcgagcgacatattcatggctgtagacatgtttgctggttcagagttagggttcataaggataatagctatgaaaagaggggaaaaaaggagcagtg

SEQ ID NO: 64546 - DNA, 402 bp, Glycine max
  Peptide Sequence Number=SeqID_156231
atggaggccatgaaagagaaaatgaccacaatgatggaagccatgatgagtatgagaaaaatgatggaggtaaacatggctaaagttgttgccacaagtgctgccactaaggtggacccgactcacccatctggcctcaatccagtaaatcctccagtctcgaatatggtagggcagggaggcaaagcgttaggaagtacaggcatcccccattttgtgtttaatgaatactttgatattgatggtcttgatttattttcagaattgaaagtcccaatatgtctgtacacggccctgggcatacccctgccaaacactttggggggccttcagtataacccacaaccacaacccttgcattttgcggtgggaagagtccctcctgctatggtggaaaggtag

SEQ ID NO: 64547 - DNA, 189 bp, Glycine max
  Peptide Sequence Number=SeqID_156232
atggcattaggggtcatggcagctcacctaagcgagttgttgcttcaacctaaagtaaccttgctcgcccaggcgagctgggaagtaaagagaaggacactaattttgttcgagcgatcttgtattcgattgggcaatggtgaaacagggagtgaaactgagaaacatgaggacattgaagtcctgtag

SEQ ID NO: 64548 - DNA, 1964 bp, Glycine max
  Peptide Sequence Number=SeqID_156233
cacctcacaaggaccaaagaaaggtcgcatgtcatcaagcaaaggtccccggacgaaattagggtatgacagactgcacgtgctcgcctttagaggactacatgtcctcgactttagagggctacactttctcgcctctagagggctgcacaccctttccttcagaggattgcaaatcctcgtctttagaggattacatctcctttactttagagggctacacctcctcgccttaagaggaggactggatgtccttgccttcagaggagtacatgtcctcgactttagagggctacacgtcctcgtcttaagcgggctgcacgttctccccttaagagggctgcacgtcctcgccttaagagggttgcacatcctcgccttcagagggctgcatgccctcacattcaaaggacttcacatcctcgccttcagagcactacatgtccttgactttagagggctacacgttcttgcctttagagggctgcacgccctttccttcagaggattgcacatcctcaccttcaaaggactacatctacttgactttagagggctacacgtcctcgccttaagagggttgcacatcctcgccttcagaggactacaggtcctctcctttaaagggctgcaagccctcgcctttagaggactggatgtcctcgccttcggaggagtacatgtcctcgactttagagggctacacgtcctcgccttaagcgggctgcacgttctccccttaagagggctgcacgtcctcgccttaagaggaggactacacgtcctcaccttcagagggcttcacgtcctcgccttcaaaggactgcacatccttccctttagaggactgcacgtcctcgcctttagagggctacgcgccctcgccttaagagggcagcacatcctcaccttcagagggctacacaccctcactttcaaaggattgcacgtcctcgccttcagaggactacatgtcctcgactttagggggctacacgttctcgcctctagagggctgcacgccctttcctttagaggattgcacatcctcatctttagaggattacatctcctttactttagagggctacacgtcctcgccttaagagggttgcacatcctcgccttcagaggactacaggtcctctccttcagagggctatgcgccctcgccttaagagggttgcacgtcctcgtcttcagagggctgcacgcgcttgcctttagaggactggatgtcctcgccatcagcagagtacacgtcctcgactctaaagggctacacgtcctcgccttaagtgggctgcacgtgcttgccttaagagggctgcacatcatcgccttaagagggctccacgtcctcgcctttagaggactacacgtccttgactttagagggctgcacgtcctcgccttcagagggttgtacatcctcgccttcagagggctacacgtcctcactttcagagggttgtacgtccttgccttcacagggctacacatcctcgcctttagagaacttaagtggttttcttttatcagttcttgggccatcccctttgatcttggaggagggccaactatgcgagcacaaccaaaggaggaggctattgcccaactactatgcataccggggcaagatttcgcccagaccgttggcgaggcaccacagcagcctggggatggccagcagtgggtgatagacacaccgccaccacctccagagtccacctcagctcatttacaaaggttgaagcattgcctacgacacatggtccaccagcagatggctaaccaccggggcagctccccacgaagcgatccaggaagggcaccattgaagagggttccagtgcggccccacaagccgacacaggctttgacaaacaccaattctagagtgcagaacatcagtagcgtttccaggccatcgagggatggtcattcctcagacagagacaggg

SEQ ID NO: 64549 - DNA, 128 bp, Glycine max
  Peptide Sequence Number=SeqID_156234
tgcggttaacgaatgtgggacttcgaaatttcaggtattgggtggacttctttctcctttgattttcgtggtcgggaaaaagagtgagctcagttggaggttgaaaggcaacatgggatgtggtggag

SEQ ID NO: 64550 - DNA, 268 bp, Glycine max
  Peptide Sequence Number=SeqID_156235
cttgtgctgtttgaatgttgttttgcttggatgttgtggaagcttgggaggattgatggggacccggggatggtgggtttatgcgcgctttgtggatgtggaaaacttgttgtgcaccatcgcccgaccgccacctagtaccacatgtgatggggtgaaacttcctgcttttattgttgacctcagagtggtacctggagatatgtcgcgggggtcaggagaccttggggacgtcaggtggggtgctattgcccaaaaccaagcttga

SEQ ID NO: 64551 - DNA, 619 bp, Glycine max
  Peptide Sequence Number=SeqID_156236
atgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactggggcacgatggcacccctcacctgggatacaaccgagcggcttacccttatggactgccgcccgactattcaccacccatcttgcaagaagatgcgggccacattgcttctcccgtccatgaaaaagagcctcctcagcagcccgacgaagtccataaaaaccctcaagattatgctcggagggatgtcgagttttatcccccgatccccgaagggccggcaccgggcacgttgcctcaacccaacctcgcagcatcgccaatagttttgtctatggaagggccgcccccggcaactgaagaaaggaggaagctcgatctccttgaggaaagattgagggctgtggaaggatttggggactatccgtttgcagacatgacggatctttgtttag

SEQ ID NO: 64552 - DNA, 144 bp, Glycine max
  Peptide Sequence Number=SeqID_156237
atgaagaaacaacaatggaagagaagcggaaggcaaaggagaagaggagaggggaggcaccatccactagggaataagccaaggaagaaggagattcaccaccaagaattgccttggataagaagcttgaaggggatgctttga

SEQ ID NO: 64553 - DNA, 327 bp, Glycine max
  Peptide Sequence Number=SeqID_156238
atgaggctactacttccccttcctctagtgaaagtgaagaagcaaaaggggaagaatctagggaagagatctccccccaagaaagaaggacaacctttaatggttaaggaagagtgtaaggaggtaagtgtctcctccaagaggttagctaagaaggaaagacattttgaaataaagacaaatattaaagaaatttctcctcttagacaacctccacattttctcctttgtaaaaagacaattgttagcattgccacatctcttaggcttgagtttattcctcaagtaaaggagttgttggatgatggtttggttcgcaagagctga

SEQ ID NO: 64554 - DNA, 132 bp, Glycine max
  Peptide Sequence Number=SeqID_156239
atgcctcagaagatcaaggtggcgctaatctccaaatcaatgggaatcaaatcacctgcagtagatcttctttgcatacaagaatacaaaacagcaattatccagttcaaaagaataatgaatgtacgataa

SEQ ID NO: 64555 - DNA, 555 bp, Glycine max
  Peptide Sequence Number=SeqID_156240
atggaggatcaagcaatcgtagttgagatcgttgatggaaaaccgaagatgagaggctataattactattactgtaaaggttgcggactttgtgcaaatgtatgtccaaagagtatagacccgaaaacgaaacaaccggctcctgaagaaaaacgtgctatagtaatgaaaccagaaacagattttgcggatgacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 64556 - DNA, 762 bp, Glycine max
  Peptide Sequence Number=SeqID_156241
atggctagaaccaaacgatatggccagatgacatcaaaggcagcaaaagaaatttcggatagaattgactcgttagaagagcagacgacacagggtagttttgttccccatggtcgggatgacatcttgaatacggccattggcaaaccggaacatccaggtcgagttcgtgcagcgggatctggtatgacccttactcaattttatggtagggcaacacgtacgtcgagtagttcctcagcaacactaatgcaacaacagtgggctgacattattggaaacataaaggaacaagtaaggaatgaatatgaagaacaacacaagaggagtctggaggaatttaagaaggagttgtccagtcagatcttcattcaattgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatacgtgcaacgacaaaatactacagtgttggtggccttggggaaaatatgtgagggtggatcagccattcacaatgtcacttatgctgatgatgttgtgagggtgagtgttgacaaagttatagaaggtgatgccgaagtgcccttcccgacatcagagattcaatatgtcaagcaggctcttcaaacattcattgcatggccaacaaatcttgtgaaaaaagtgtcacatgag

SEQ ID NO: 64557 - DNA, 669 bp, Glycine max
  Peptide Sequence Number=SeqID_156242
atggtaattgaccaatccctattctatgacttgacccaattatctagtgaaggtgtaccatttgaaggcacactaaatgatgattggaaatttgatttctctgtgcatgatgcctgccggttggtttgcaccaaccaagtgaatatgaccggaaggcttcttgctggttcattggcttttgaaagccgcatccttcattatctcattgtgcgtattttgcttccaagatcttcaaaccttgcacaggtttctgaggaagatcttattgtgatgtgggcttttcatacaggccaacaaattgattgggcacacttagtccgatatcgcatgcataagacattgagattaaatgctccattgccatatccacacctagtcactctctttcttcaacactttagcatccctcttgattatgaaccttatgttccaatcaagagatccttcttaatcggtgccattatgattgcatcttttggttaccgtaaagagcatgatggctcttgggtaaaaaagggtgctcaacccattgatgaagaaggaaacttaccagttggagaggattcctctcttcttcaaaggattttggacaggttcgatggtcttcaaacctttgttggtgaaaggtttgattgctttggagttacaagtggacatgcgattcgatga

SEQ ID NO: 64558 - DNA, 318 bp, Glycine max
  Peptide Sequence Number=SeqID_156243
atgacgtttcgacttcatccgcagtcaccggaacttgaagtcatggatcatccaaggtgcagacaacccaaattcctccctccatatcatctcctaagttgttttcctcggaagaacaacatatctgcatttcaaaatcctggtttaattcaatttatctacatgaaacttcctttttaccctgaattggttaaagccttttattctaacttggaaattcaagaagattccttgatttttgaagtttatgggattaagatggtcatagatgttagacaagtggcctcagatatcttaagaagggggggggggggttga

SEQ ID NO: 64559 - DNA, 204 bp, Glycine max
  Peptide Sequence Number=SeqID_156244
atgggtcagggtattaatcctagatctcttaacatcaattgtgccttcatgcggaacataaggtcctatttctatggcttcccaaatgttgtcgtctatggcttcaataaagatttgcattcaggttttccagtagtggtaaccctcaccattaaagataggtggcctatggatggagtttcctttgggaaacagagaatatga

SEQ ID NO: 64560 - DNA, 64 bp, Glycine max
  Peptide Sequence Number=SeqID_156245
atggatttggccacgacttcgcctgcggatgaaaggctagaccgtagtaacaatgatacaggcg

SEQ ID NO: 64561 - DNA, 300 bp, Glycine max
  Peptide Sequence Number=SeqID_156246
atgttaaccaagaagaatcggtatttccatagtgacagaattgttgtggaagatatagaagaggatgctgatattcctctcattcttggccacccattcatgtctactgcaagctgcatggtggacatgggaaagaaaatactgcagatgggcatagaagatcagaagatcagctttgatttgttccaggaggacaaagatccacctagccaaaatgtttgttttaaagtgcatgtgatggaggaaaggagacctgagaagaaggtccttgaagtaggaactctattggatcctggatag

SEQ ID NO: 64562 - DNA, 246 bp, Glycine max
  Peptide Sequence Number=SeqID_156247
atggcaagaatagcaaaagtggtcgagatctcggaacaagagctagaccgagtgaagcaaaataggaatggagcggcaggggtaccaaggaagcacttggaggagaaggcggaagctctaaccagccaaggagaatgggcaacattcatcgatacggttggtggatctagcggcgatcgacacctttcttgcttatcaccacagcaaggaaagcccggtcatcgctgttttggcaaatgcatatga

SEQ ID NO: 64563 - DNA, 448 bp, Glycine max
  Peptide Sequence Number=SeqID_156248
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggggcgaaagactaatcgaaccgtctagtagctggttccctccgaagtttccctcagggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 64564 - DNA, 228 bp, Glycine max
  Peptide Sequence Number=SeqID_156249
atgttgttgggcagtcgaaaccccagcttggttgtctggaagggtattgtgcatttccgtcacatggagagacaacaatcgctctccatggcttaccgtcccgttcctcttccacccgacaacaatgtgcgggttagccacgacaccagaactcaatgtacagtaggtccccgtgcggtgttaggctggaacatggatgctaaagtggcaagcgcatccgccatttga

SEQ ID NO: 64565 - DNA, 267 bp, Glycine max
  Peptide Sequence Number=SeqID_156250
atgacacgcagagacaaaatttggtcattctgcacccttgtgtcatctagaggcggcgggcccgatgacacgcggagatacttacggttatctgcacccttgtgtcatccaaaggcggcgggcccgatgacacgcagagacaaaatttggtcattcttcacccttgtgtcatccagtccgggcccgatgacacatgcggagataccttacttatcggtcacccgttgtgtcataaccgagaggaacgaaattagtgtcataccctaa

SEQ ID NO: 64566 - DNA, 216 bp, Glycine max
  Peptide Sequence Number=SeqID_156251
atggaggctctgtcatttgcctcacaagttcttcaagggaaggttgcggaggggcctcaactgtttgttgtttctagggttgttgctgttgctgttgttgttgttgttgttgctgttgctggattggtggaggaacgtagggtctacttgggccagcagcattctgaaaataaggttgttgttgttgctgctattgtgaaggactcgaccatctaa

SEQ ID NO: 64567 - DNA, 342 bp, Glycine max
  Peptide Sequence Number=SeqID_156252
atgggttatggtgatggggtgaaaggttataggatctggtcaccctcgaaaaagaaagttcttctcagcagagataggtgccactctcctcgagaaaaggatgtagaatctataaccaaagactcagaaaaaaggggtcattccaaaacatctcctgtggttcttcaagaaggtgagaaatcaaaagattccagtgcaaatgagtcttatttggctgctgaactggatcatccacagctcaattctggaattaatcagagaccaaaaagggtcactaaacctcctgaaagatatggttttgaagacatggctgcctatgcattacatgcagctgaaaaatag

SEQ ID NO: 64568 - DNA, 282 bp, Glycine max
  Peptide Sequence Number=SeqID_156253
atgtggcggaaatcgaaaagaggtgtttttgcgcaatccgcccaagtgggccctccagaagattcctcccagaaggctgttgcatctggaggaagcaaccttgctcgcctgggtgagctgagctcgcttgggcgagctgggtggcaagctccctatttagctataaatagggggaggagtgaagaagaaaaggggtcagccttcttggcacttctctctctctcgaaattgctgaggaaaattattttcgtgaagaaaatccaagccgaggtgcttccgtaa

SEQ ID NO: 64569 - DNA, 438 bp, Glycine max
  Peptide Sequence Number=SeqID_156254
atgactaggggcaatccaggtgatttacaaccctttgatcctgaattagatagaacctttcatagattagttaggcatagtgtgcatcctggtcattctgtgcattttgagcattctaagcattctgttgagggtgattctgaatattctgattttgagcattccactactaatttttatactgagaacatggctcaaccttcacctcatgagaggactcttagggagatggctgcacctgatttcacttatgaaagcttgtgcattcaatatcctgatgagggtaaagatccttataagcatcttaaggagttccatattgtttgttccaccatgaagccccctgatgtccaagaagatcatatctttctaaaggcttttcctcattctctggagggagtgacaaaagattggctatactaccgtgggatcctctag

SEQ ID NO: 64570 - DNA, 369 bp, Glycine max
  Peptide Sequence Number=SeqID_156255
atggacgtgtggggtgctaataccttccccgtgcataaatacaactcccgaacctttcacttaaaagttagtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacaggggtggataaacagactcgggttcatgaatcagatagcaaggtctgcgaggcgggtgcggactaatgtattaagtttgtgtaagagtgcgggacagagtggtccgtttgttaccattgtgggcttatgccgaacgagacggcctgcttacccacacctttga

SEQ ID NO: 64571 - DNA, 150 bp, Glycine max
  Peptide Sequence Number=SeqID_156256
tcaaatacaaactgcatgttctgaagcgtgatgtcgtgacatccagtacgacatctgtcattggtatcagaatttcagacgttagtctctacgtgctattaggcttttcgacttacagacagcaaaaactttatacggataaccactcgg

SEQ ID NO: 64572 - DNA, 903 bp, Glycine max
  Peptide Sequence Number=SeqID_156257
atggccaagttcgatccagacatagtcctcgaattttatgccaattcttggcctacagaggagggcgtgcgagatatgaggtcctgggtgaggggtcagtggatcccgtttgatgcagatgctatcggccagctcctgggatatcctttagtgctggaagagggtcaggagtgcgagtatggccagaggaggaaccggtccgatgggttcgatgaggaagccatcgcccatttgctatgtataccggggcaggattttgcccgaactgctgccgggagacagcaacatccagccccagcgaccataattccgacctccccctgccgaagtatcagctggtgtatggcacctaccaggcaccctctagacccggataagtccaacagggccctgggatttcccgccttgatcacaggactctgccagtcgttcggagtccctgtcgcacctagcaaggtgattcggccgcccatcacccgagcttttattgagaagtattgcacgcagagacaggtccagggggatgctccgcaggctgcagacgcgctaccacctcatcaggccggtccagccggatcgtttgatacggagcagtacttgcggcatttggttcgccagcaggaggccaaccaccgggcacatgtacagacccatgattgtctttatcagatgagcctcagcctgcagagccagggctttacttcttttccgtgccctactctggaccagttcagggcagaggtcgcatggcctggagattggcctgaggcccgagcaggagaggcacctgcagaggcaccagcagaggctcccgacgaggctcccgacgaggcagatgaggcccgcgaggacgaggagatggtcgatttacttgatttcttaggagggagcggagccacatga

SEQ ID NO: 64573 - DNA, 423 bp, Glycine max
  Peptide Sequence Number=SeqID_156258
atggactgccccctgtgtaagctctgtagcatggagtgcagcatctgtggtgtaaatgaaaaatctgaaagtcctgcagataaaggaactagaagtggtatctgtgtagatgctagaggaatagctggagtcggaatgggaggtactggggttgtggaagaagaaggagctgttgtctttggtgttgctgaagtagtggggacctatgttctcttacccctggccttccttgaccctctaaatgtcactgttggatcatcaagattccaacagttcttcttaatatatgtcaagttaatggtagggctcaagttctccagggatctagaatctgattggactcctctggccttacatagaactgtgatcaaggcagggaatccaagtctggatgtatcatgctgtgcagtcagagagatctag

SEQ ID NO: 64574 - DNA, 582 bp, Glycine max
  Peptide Sequence Number=SeqID_156259
atgacgttgctgctcagcaacatcctgcccagtgatcataattccgacctccttctgccgaagtgtcagctggtgtatgccatcttgacacggattaacgtccatgtggctcagttgatcgctgatgccatttatttatttgaaggtatgccgcctaccaggcaccttctagacccagataagtctaacagggccctgggttttccagcattgatcacaggtctctgccagtcgttcggggttcctgtcacacctagtaaggtgattcgactgccgatcacccgagctttcatagaaaagtattgcacgcctagacaggcgcagggtggcgacccgcaggccccagacgcactgccgccacctcatcaggctgatccagctaggtcatttgacacagagcggtatttatggcatttggtttgccagcaggcggccaaccacagagcacacgtgcagacctatgactgtctctacgagctcagcctcagcctgcagagccagggtttcactccttttccatgccctactccggatcagttcagggcagaggtcgcatggcccggagattggcctgaggcctag

SEQ ID NO: 64575 - DNA, 408 bp, Glycine max
  Peptide Sequence Number=SeqID_156260
atgtgggcctttcataaaggtttacaaattgattgggcacatcttgttagatatcacatgcataaggcattgcgattgaatgctccattgccttacccttatcttgttacccttttccttcaacacttcaacatccctcttgattctgaaccttatgttccaattgtcgcaacgtgcccttttgcgggcgagcaaaggcgaggctcacgggtgcgctttccaaaggaggaaagatgcacggagtcgccaccaatgtttatttgtggaaaacgtcgggaaaaccgaaggaaaccggtccaaatgaaaattctaagttcgggagttgtatttacgcttgaggaaggtcgacaaaagcggagtttttgctcctacgtaccctccatcaaagaggaaatcagacctacgtag

SEQ ID NO: 64576 - DNA, 673 bp, Glycine max
  Peptide Sequence Number=SeqID_156261
gaagacatcttggtgagctgcccatcctctacgccttatgtggaagccgcagaggagtcattagaaaccgctttccagtcttttgaggtggtaagcatttcctccgtggactctttctctgggcaaacttgcctgtccgatgcagcagtaatgatggcccgagttatgttggggaacggttacgaacccggaatgggtttaggcaaagacaatggcggcataactagcttgataaatgccaaaggaaatcgtggaaagtatagtttaggctataaacccactcaggcggatataaagagaagcatcgcgggaagaaagagcggtggtcaaagctcgcggttgagacaagaaagtgaaggaagcccgccctgccacataagtagaagctttataagcgcgggtatgggagacgaaggtcaagtgttcgcgatatacgaagatgatgttcccgaatccgatgacgagtcccccgaaggtactaatacctgggacccgcctattgacttcgagcaagaaatgaatcaaacggaagatgaaggaaatgaggatgtgggacttcccccagaactagaaagaatggtcactcatgaggaccaagaaacggggcctcatcaagaagaaacagagctggtagacttaggaattggcagtggaaagagggaagtaaagatag

SEQ ID NO: 64577 - DNA, 124 bp, Glycine max
  Peptide Sequence Number=SeqID_156262
ggatcgtgcccgcaagacaccaaaaggtttgagtattgcctacaccacatggccgaccagcaggctaccaagtccaaagccaaagataagcataagtgctaggtccgtgaccaacaagtcataa

SEQ ID NO: 64578 - DNA, 590 bp, Glycine max
  Peptide Sequence Number=SeqID_156263
atgggtgatcaagaggagacacaggaacagatgaaagccaacatgtcggctctgaaagaacaaatggcctccatgatggaggccatgttaagtatgaagcagctcatagagaagaacgcggccaccgctgccgctgtcagttcggctgccgaagcagacccgactctcttggcaactgcgcaccatcctccctcgaacatagtaggacggggaagggacacactggggcacgatggcagccctcacctgggatacaaccgagcggcttacccttatggattgccgcccaactactcaccacccgtcttgcaagaagatgcgggccacattgcttctcccgtccttgaaagaaagcctcctcaacagcccgacgaagtccacaaagactctcaagactatgctcgaagggatgtcgagttctatcccccgatccccgaagggccggcaccaggcacgttgcttcaacccaacatcgcggcatcaccaatagttttgtccacggaaggaccgcacccagcaactgaagaaaagaggaagctcgatctcccgaaaagaagattgagggccgtggaaggatttggggactatcc

SEQ ID NO: 64579 - DNA, 280 bp, Glycine max
  Peptide Sequence Number=SeqID_156264
atggaaaaattggacaagaaaaccttcaaagacaagaaaggaaagaaaacttacatcacttgggaagataacgatatggattcatcaggagattcagaaaatgaagtcatgaatctaagtttcatgcccaaaaattatgaaagtaaagaagaggattctttgaagagaagttggtacattgatagcggatgctctaaactcatgatgagagatgcatcaaagtttactcatatttctcccaagaatagtggacacgtgacttatggagacaacaacaaag

SEQ ID NO: 64580 - DNA, 192 bp, Glycine max
  Peptide Sequence Number=SeqID_156265
atgcagaacatgcagtttcaacaagagaccagagcttccattcagagcttgaccaatcagatgggacaattagctacacaattgaatcaacaacagtcccaaattctgacaagctaccttctcaagctgtccaaaatcccaaaggtcatagggaatagcagtgccaaggacctcaatgccatgcagatttag

SEQ ID NO: 64581 - DNA, 513 bp, Glycine max
  Peptide Sequence Number=SeqID_156266
atggcaaaagatactctacaaacagcagagcatattagagtattcaattccagaaccagaaaatcattgaccaaaggtctgttagatgcatctccagcaagaaagaaggatgtcgaagaagatgcagaatcgggagacaatgtcagatcagtggagaagcaagtcaagatgtcccaccagaattcaaacatcaaccaacggtgctggaccaagagaccctccattagaatagccaggaagatgcaccaggtatgcatgttgttgtggagatccaatttacctaggggtcactttatcagggaggttgagaaatcgtctcaaactcgttttgaagttctccaaagattgagcccaagaatgtcgaaagagactgaaaggatcaatgctatgcaagagaattggagtgaccaattggcagagaatttgaaaacagcaggttcacccgaggtgaattctgcacatgtgaaggcatctcagagttcttgcagcatacaccacaacagaatggcatag

SEQ ID NO: 64582 - DNA, 470 bp, Glycine max
  Peptide Sequence Number=SeqID_156267
atggaaccatcaaagaagcgaaaaggcacttcgagtcggagtcaacggcattccgggtcacaggaaacgccaattccttcctccatttcctttggatcattattttcatcagaggagcaatggatacggtacacaaaccttttttcttatcgttccattattgacccaaaattcatagatatggatttcttttcaaatgagagttttgaatgttttcaagcatttgaaaactccaatcttattccattcatgtctctaaaattgcctgtttattctgatcttgtcaaagccttctactcaaacttagaaatccaagaaggcaccctaatgcatgaggtttatgggattaagatagtcattgaccagtccctattctatgatttaacccaattgcctagtgaaggtgtaccatttgaaggtgcattgattgacgattggaaatttgatttttctgtgcatgatgcccaccg

SEQ ID NO: 64583 - DNA, 355 bp, Glycine max
  Peptide Sequence Number=SeqID_156268
atgtggagtcgaagtgaatggtgctgaaggatctggtaaagtagatgaagaaggagcagaagcatctggtgctgttgaagtagggggagcctcaaatctcttacccctggccttccttggccctctgaatgtcactgttggatcatctagattccaacagttcttctttatatatgccaaaagtgtgagaggtagggaccaagttggagtaagaaagaacactccaagtctgagcgagtgtggtcatgttctttctgaggatcttcagaggttgaccatcaacattcagctcaaatcccctccttgggatgcagagcttaacaaccaactcttgaggatcaggcctcaagagtga

SEQ ID NO: 64584 - DNA, 1577 bp, Glycine max
  Peptide Sequence Number=SeqID_156269
atgaataactcgcgcccccacgagagaaaccttatgtctgttcaagatcaactgcatcgttacctgtttgaaaacgtcgccgtgcgcggcgagctggtcaacgcatctcaaacctggcgcgacatcgtgcagaaccacgactacgccgagccggtcaaaacgctgctgggcgaactgctggttgccaccagcctgctcaccgctacgctgaaatttgacggcgacatcaccgtgcagctgcagggcgatggcccgctgagcatggcggtgatcaacggaaataaccgccaggagctgcgcggcgtggcgcggctgaaagaggatgcggagatcgctgccggcagcagcctgaagcagatggtgggtaacggctatctggtgatcaccatttcgcctgagaaaggcgagcgctatcagggcgtggtcggcctggaagccgataccctggcgggctgtctggaagattacttcatgcgttccgagcagttgccaacccgcctgttcattcgcaccagcgagaaaggcgcagccggtattctgctgcaggtgctgcccgcgcaggagcccaacctggatgacttcaaccatctggccacgttaaccgaaaccgtgaagagcgaagagctgattgagctgcccgctactgacgtactgtggcgtctctatcatcaggaagaagccacggtttacgatccggcgccggtcagcttcaaatgcacctgctcgcgcgaacgctgcggtgaagtgctgaagacgctgccgccagaggaagtggatgagattctggtcgaagacggcaaaattgatatgcactgcgactattgcggcacgcactatgtgtacgacgcagtggatattgctgctattcatttctctacttgtcacgttccagctcgcatttttaactctcttcacttttccacctcgctcagacgtgtacactgcgcgcgatctgcccttcacatgcgcgttaacggcctgacatcgcaagacctcgaaacgctcggaattagcggcaccaccgaggtggtgtacaaccctgattacgccacgttatttcaggaagaaacccgcccggagctggaaggttacgcgcgcggcaccctgacgcagagcggtgccattgccgtggataccggcatcttcaccggacgttcgccgaaagataaatacatcgtgcgggatgacaccacgcgtgacacgctgtggtggaacgatgttggcaacggcaagaacgacaaccagccgctgtcacaggaaacctggcaggcgctgaaagatcgctgcacgcaacagctttccggcaagcgtctgtttgtgattgacgccttctgcggcgccaacccggacacccgcctcagcgtgcgtttcgtgatggaagtggcgtggcaggcgcatttcgtcaaaaacatgtttatccgtccgactgaagccgaactggctgagtttacgccggatttcgtggtgatgaacgcagcgcagtgcaccaatccggactggcaggcgcaggggctgcattcagagaattttgttgcctttaacctgactgaacgcatgcagctgatcggcggcacctg

SEQ ID NO: 64585 - DNA, 1944 bp, Glycine max
  Peptide Sequence Number=SeqID_156270
agccgcagctgcctgatgtgaacacattgaaagatgtgcgcctgcaaaccccgatgcaggtttacagcgcggatggcgagctgatcgcccagtacggtgaaaagcgccgtatcccgcttaccctgcaacagatgccgcctgagctaatcaaagcgtttatcgccaccgaagacagccgcttttatgagcatcacggcgtcgatccggtggggattttccgcgccgccagcatcgcgctggtctccggccacgcctcgcagggcgccagtaccattacgcagcagctggcgcgtaacttcttcctcagccctgaacgcacgctgatgcgtaaaatcaaggaagccttcctggcgattcgcatcgagcagttgctgagtaaggatgaaatccttgagctgtatctgaataaaatctatctcggctatcgcgcttacggcgtcggtgcggcggcgcaggtgtacttcggtaaaccggtcgatcagctgtcgctgagtgagatggcgatgatcgccggcctgccgaaagcgccgtcgacctttaacccgctctattcacacgcccgtgcgctggcgcgccgtaatgtggtgctggctcgcatgctggatcagaactacatcacgcagcagcagtataacgacgcgcgcaacacgccgctgaccgccagctatcacggcccggaaattgccttctctgcaccgtatctcaccgagctcgtgcgtcaggagatggtgaaacgctacggcgacagcgcctatgacgatggctacaaggtgtataccaccgtgacccgccatctgcaggaagccgcacagcaggcggtgcgtaacaacgtgatggcgtacgatatgcgtcacggctatcgcggtccgaccaacgtgctgtggaaagtgggcgaagccagctgggatcacacccgcatcgtcaacgcgctgaagatctgccgcgccgacgaagccaccgccatgctgaaagatggcagcagcgtttcgctgactttagccggcgtgcgctgggcgcgtccgtataaatccgacaccctgcagggcccgacgccgcgcagcgtcactcaggtgctgcaggctggccagcagatttgggtacgtaaagtcggtgacgcgtggtggctgggacaggtgccgctggtgaactcggcgctggtgtcgctcaatccggaagatggtgcggtacgcgcgctggtcggtggttttgacttcaaccagagtatgttcaaccgcgccacccaggcgctgcgtcaggtcggctcgaacatcaagccgttcctgtataccgccgccatggaccgcggcctgacgctggcctccatcctcaacgacgtgccgatttcacgctgggatgccggtgccggcgcagactggcgaccaaagaactcgccgccgacctatgcgggtccgattcgtttacgccaggggctgggtgagtcgaaaaacgtggtgatggtgcgcgcgatgcgtgctatgggcgttgattacgccgctgagtatctgcagcgctttggcttcccggcgcagaacattatccataccgagtcgctggcactgggcgccgcatccttcacgccaatgcaggtggcgcgcggctatgcggtgatggccaacggcggcttcctggtcgatccttacttcatcgcgaagattgagaacgaacagggcggcgtgattttccaggcgcagccgaagatcgcctgcccgcagtgcaatctgccggtgatctatggcgacaccaaaaagtcggtggcgctgaatgaagagagcgtggaaaacgtcgctacctcgaatcagcagcagaatcagaccgtgccgcagcccgagctggagcaggtaccggcgcagccgcagccggccggcgatcagcagtacgcgccgcacgtgatcaacacgccgctggcgttcctgatcaagagcgcgctgaactctaacatcttcg

SEQ ID NO: 64586 - DNA, 835 bp, Glycine max
  Peptide Sequence Number=SeqID_156271
atggatgagttcaaaccggaagacgagttaaaacctgacgccagtgaccgccgtcccacgcggcctcgcaaatcgtcttctgcgccgaaagcgaaagtaccggtttcccgtcagcatatgatgatgggcatcggcattctggtgctgctgattctggtgctgggcattggctccgcgctgaccggcccggacgagaagaaaccggccagcaacagcgccagcaccggtagcgcggctccggctggcggcggcagtgaaaagaatatcgacctgtcaggttcaaccaccatgagcggccagcagaatgccacgccgtcggctgagggcaccgccggtaacgccgcacccgccggcagtgacggccagtcaatctccatgccgtctgtctcctccacgccgactcaggcagcaccggttgacacaccggccaaccagcagcgcgtaacgctgccgggcgatctcaataccgcgctgaataatcagcagggttccgttgatgccgcggcgcagggcgcacagggcaacagttcgctgcctaccgcaccggcaacggtcagcggcagcgctggcaaagcggtcacgccgccggcggtacgcgctgagacgccaccgcgcagcctcggtgccagcagcagccacaaaaccccggctgccagcaaaccggctgcagtgaaagagaacaaaacgcacaccaccaccgcgcacaacagcgcaccggccagcagtggcggtgccagcaagtcgctgccatcgggcggcaactacacgctgcagctgagcggtgcgtcgaaagaagcgagcctgaacgcctgggcgaagaaacagaatctgagcg

SEQ ID NO: 64587 - DNA, 99 bp, Glycine max
  Peptide Sequence Number=SeqID_156272
atggttaacatggagtttatctctggaataagcaatgatactttcattctcaatactttgttgctaccaagttcatattcactatatcaaaagacctga

SEQ ID NO: 64588 - DNA, 265 bp, Glycine max
  Peptide Sequence Number=SeqID_156273
gtctgccataaagaatctggaggtccaagtgggacagcttgcaaagcaattggcagatagatcatcaagcagtttcacagctaatacagagaaaaatcccaaggaagagtgtaaagctgtgatgactagaagcagaatggcaatccatctggcacctaagccagcacttgaacccatttttgattttgtagaacttgaagagattaatgaggaggttgaagatgataaggaagaagagacaccaataaaagagaaagaaaaataa

SEQ ID NO: 64589 - DNA, 804 bp, Glycine max
  Peptide Sequence Number=SeqID_156274
atgcatccgatgctcaacatcgccgtgcgcgcagcgcgcaaggccggaaatttaattgccaagaattatgaaaccccggacgccgtcgaagccagccagaaaggcagcaacgacttcgttaccaatgttgaccgcgacgcagaacgtctgattgtcgaagtgattcgcaaatcctacccgcaacacaccatcatcaccgaagaaagcggtgagctggcgggcgacgatcaggatgttcaatgggtaatcgatcccctggatggcaccaccaacttcatcaaacgtctgccccactttgctgtttctatcgccgtgcgcatcaaaggccgcaccgaagtggcggtggtttacgatccaatgcgtaacgaactgttcaccgcggtacgcggtcagggtgcgcagcttaacggctatcgcctgcgcggcagcacggcgcgtgacctcgacggcaccattctggctaccggcttcccgttcaagctgaagcagcacgccacgccgttcatcaacatcgtggcaaaactgtttacccagtgcgctgatttccgccgtaccggctctgctgcgctggatttggcctatgtggccgcaggtcgcgttgacggtttctttgagattggcctgaagccatgggatttcgctgccggtgaactgctggtgcgtgaagcgggcggtctggtgaccgatttcaccggtaaccacggctatatgctgtctggcaacctggtggccggtaacccgcgtgtggtgaaggcgatgctggccagcatgcgcgaagaactgagcgaagcgctgaagcgctaa

SEQ ID NO: 64590 - DNA, 978 bp, Glycine max
  Peptide Sequence Number=SeqID_156275
atggataggccagaatatgtgtggaaacaaacttggcaatggatggcaaatgatattgtatttaatcatagaagacaaggcatccaactaatagacaaagaaaaaatgcatctttgtttgacgacaattgaaaacctcttgcaagccaacaggaaaagcctacgagattttccttcaatgccatacccactaggatatgccgccaacacgcaccaaaataatctcatctacaatgaattggcttacgacggggacatattggccgccgaatttgacaaatgctaccagtggctaacagatgagcaggcttctatttttaataagattatgcatgtggttgcaactcaatcaggtggagtttattttctatatggatatggtggcacaggcaagacatttgtgtggaaaactttatcatctgctatacgctctactggcggaattgttttaacagtagcttcaagtgggattgcctcgatactattgcctggtggtagaacaacacattctaagtttgctattcctgtccctgcaacaaaaaattcgacatgcaatatccatcaagggagtgatttggctgaattgttgcatatcacaaaactcatcatatgggatgaagctccaatgtgtcacagatatagtattgaggcccttgacaaaagtttacaggacatcatgcacaacagcaatccttttggaggaaaggtcattgtttttggtggtgatttccatcaaattctacctgttgtgccaagaggtaatcgttctgacattgtctatgcaactttaaattcatcttacatttggaaccattgtcaaattctaaaactgactaaaaatatgcggttgcaatcaaatcctactgaccattccaacttggatgaactaaaacaattttctgagtggttgctagacataggtgatggtaaacttgcagaacctaaagagggttatggtgaaatcaccatccccagatga

SEQ ID NO: 64591 - DNA, 186 bp, Glycine max
  Peptide Sequence Number=SeqID_156276
atggcaaatttatgttatgatgctccccttccatctttaaatcgtcaatccattggtcatttccctcctgaactctatgccaaactctcaaaattcaacttgataacaatgactttggtggaaataacattccagaatcttatggcaatatctcaaaattgtcaaaattgtaagtgcattttgtga

SEQ ID NO: 64592 - DNA, 567 bp, Glycine max
  Peptide Sequence Number=SeqID_156277
atggcagaagtctccatagaggccattgcctccctcgcccagtattatgaccagccgttgaggtgcttcacctttggggacttccagttatcacccatggtggaagaatttgaagagatcctaggatgccctctacggggaaggaaaccatacctcttctttggattctatccctttttagctagaattcctaagatagtccaaatctcagcgcaggaattagaccatagaaagcaagtcgaaaatgggatggttggagtactgagaaaatgtttggaggaaaaagcaagaatcttggctggtagaggcaaatgggccccgttcatagacatcctcgcacttttgatcttcggaggagtcctctttccaaatgtggacgggttggtggacctagcagcgatcaatgcttttctcgcctttcatgactacaaggaaagcccggttgtcgctatcctagccgatctatatgacaccttcgaccgaagatgtgaaaagagcagtacaaggattgttttctgtactccggccctctacgtatggttggcttcgcaccttttccgccaagag

SEQ ID NO: 64593 - DNA, 227 bp, Glycine max
  Peptide Sequence Number=SeqID_156278
gctaagcgcgcatccaccgctaagcgcaacttcagcacgcttagggcgacagaagaatctggcatcagcatcaaggctgcgcgctaagcgcgagatcagtgcgctaagcgcaacagactttaagcagaggattggcacaaattccaaagcacaccacagtgcctacttcgggaaaagagctctggaggcagcaagaggagcaacttttgcagagatacctatgtttt

SEQ ID NO: 64594 - DNA, 443 bp, Glycine max
  Peptide Sequence Number=SeqID_156279
cctcaaggaattaggacgattgatgggacctctccaaaggcaagccttccgcaaggtgtacgggaagattctagatttggccacagcggaggtatttacggaagctgtcgtatccctcgcccaatattaggaccagccgttgagattgcggccgtggttggtgattcagcaaaggagttggatcgcacgaagcaaactcggaacgacgtagtgggcctgcctcagaaatacttggaaggtaaggcaagggatatggcaagccaagagaagtggggcccgtttgcggatatattagctttgttgatttttggggttgtcctctttccgaacgttgacggtttggtagacttagctgccattgatgctttcctcgcatatcaccatagcaaggaaagtccagtggtggctatcttggcagatttgtttgacacctttgaccggag

SEQ ID NO: 64595 - DNA, 303 bp, Glycine max
  Peptide Sequence Number=SeqID_156280
atgattgccaagtctcggactgaggacgaacaccttgtcaatctgcgtaagctgtttggaaggttgcggaaataccaattaaaactaaacccaaccaaatgcactctttggggtgaagtcggggaagctgaggatttatcgcggtcctatggaacagtgactgccaagaggataacccttcttgagaagatcaagagtctcgcgaatcccggtcatatcaagcatgcccagtcaggaagacctcttttccgacatgaccgtgttgcgatgagttctttgaccgggtctgttgggttagcatga

SEQ ID NO: 64596 - DNA, 527 bp, Glycine max
  Peptide Sequence Number=SeqID_156281
gtttcaataagaccaacgtggagacacttcagaaggtccgcaaggcatgggaggtgttgcaaaagaaggacaaggaactcaggggcagcagtaacaatgggaccatcgatggctatcgtaagtggttaaaagcccacgtgcaaggtttggattggcttccaagttttagaaccgttaaaagagaggaagttgaggcaccggaggaagacgaagaggtgcaggtccttaggggggaactcgagcaagcccaaacagttaaagaaaggttcaaatcagcggctctgaaaatccaaaaggagaataccaaactgagggatgtaaatgtggctaccaccaaagccttggaacgagaaaatatgagggcttgtagggaagaactcggtcggaacaagttccgaggggctctgtgggagaccaacatgttagctaattgcaccaagtaccaagaagaactaaatctagccgcggtccacgagcatagagtggcggacgagtatgacccaactgtacgcgaaaaaggaggctag

SEQ ID NO: 64597 - DNA, 432 bp, Glycine max
  Peptide Sequence Number=SeqID_156282
gattcagaccttaatgtgtggaagccagttgaacatagtagtgatgcaaagcttgcaggtgaatccgatccattgggagagttgatgaagatattgttttatgtgtaccagaatccagtggaagtgtcgtgggaggcgagccaatttggacttcctgatattggggcaacaatatcaggtgacaagtgtttaaacatagtgatactacaattgtggaccatatttatgaatgagtgcggtagaagcatagctgatcaatcactgtatggtttgctggagcctcaatctatacaaaatgctaaggaaagacgtcaacaatgccaacaatacattgaaacatgggtcaaggaatcacaaaggcagttgtatttaggagcttacttgcatcaagtaatgttcaaagtggagggttcgagtgcagatattatgtga

SEQ ID NO: 64598 - DNA, 207 bp, Glycine max
  Peptide Sequence Number=SeqID_156283
atgatgataacaaaagatgatgacaaagatcaatcaaagaacaactcaagtgaatcaagaagaattcaagagttcaagataagaatcaagaagaattcaagactcaagaagaaagttaagagtcaagaatcaagattcaaggttcaagatctcaagaatcaagatcaagattcaagactcaagattcaagaatcaaagaaggcttaa

SEQ ID NO: 64599 - DNA, 526 bp, Glycine max
  Peptide Sequence Number=SeqID_156284
gagaatgccgaactgagagatataaatataactaccaccaaggctttggaacaagagaccaagagggctcgtagggaagagcatggccggaacaagttccgaggggctctgtggggcagcaacagcgagcttaagctccgaagagaggaaagggaccaatcacgagtagacagtttgatcttgaaagatgagttgaaggtttgctcaaggtccaaaagaaacttgtctcagcggttatgcgaaacagagaccaacatgttagctatcatcagcaagtaccaagaagaactaaatctagctacggcccacgagcatagagtggcagacgagtatgcccaaatgtacgcggagaaggaggctagaggaagggtgatcgacttgctacatcaagaggcaacgatgtggatggaccgatttgcccttaccttgaacgagagtcaagagctttcccgattgctagccaaggccaaagcaatggcggacacctactccgcccccgaggagatccacgaacttctcagctatt

SEQ ID NO: 64600 - DNA, 187 bp, Glycine max
  Peptide Sequence Number=SeqID_156285
atggcggaagactatgaaagcggagaagagaacaattcaagagttcaagatagaatcaagaagaattcaagactcaagaggaaagttaagagtcaagaatcaagattcaaggttcaagatctcaagaatcaagatcaagattcaagactcaagattcaagaatcaagagaaggcttaatcaagataa

SEQ ID NO: 64601 - DNA, 557 bp, Glycine max
  Peptide Sequence Number=SeqID_156286
gtagaggcgaatgggccccgttgatagacattctcgccctgttgatcttcggaggagtcctctttccaaatgtggatgggttggtggacctagcagcgatcgacgcttttctcgcctatcataaccacaaggaaagccgggttgttgcaatgctagccgacctatatgacaccttcgaccgaagatgtgagaagagtagtacgaggattgtttgctgtactccaactctttatctctcgagtttgagaaccgctaaaagggaggaagttgaggcaccggaggaagacgaagaggtgcaggtccttagggcagaactcaagcaagcccaaacagtcaaagaaaggttcaaatcagcagctgttaagatccgaaaggagaatgccgagctgagagatgtaaacatagctaccaccaaggccttggagcaagagacaaaaagggctcgtagggaagaacagggccggaacaagttccgaggggctctgtggggcagtaacagcgagcttaagctccggagagaggaaagagaccaatcacgagtagacagtttgatctga

SEQ ID NO: 64602 - DNA, 168 bp, Glycine max
  Peptide Sequence Number=SeqID_156287
atggaacatctacatgaaccattgaggaaaaagtggtacatagatagcgggtgctcaaaacatatgacgggagatgcatcaaagttcacacatatctctcctaagaagagcgggcatgtaacttatggtgacaacaacaaaggtagaattcttggagttggaaaatag

SEQ ID NO: 64603 - DNA, 465 bp, Glycine max
  Peptide Sequence Number=SeqID_156288
aagctcctagctgagaagaccaagaagaagttggaggaagctgtacagttaggaagcgttgatggtgtcatcgaccctccatcccccttcagatgccatgattcctttgaggagcaggcgtcacaaggatccttcgtcccccatcgacgtcaggatgttctcactactgctattggatgtccagagcaccctggacgtgtccgtgctgctggagccggtgtcaccatcatgaaatactttagattggctccacggatgtcccgcaactcttcctcgttgcctcctgaagaattgcatcagctgacccagcaaatcagggaccaactagaggagttgatcacagaaaaagtgactcgacagcttatgacatcatttagccagatgcagtcccactttcggtcccagatgcaatctcagggacttgcactgcctccggagcctctggttggttcctcaggtcctcga

SEQ ID NO: 64604 - DNA, 438 bp, Glycine max
  Peptide Sequence Number=SeqID_156289
gaatttcacgtgaacctctatgaccccgaggataaatcacctaagcacgtgagggtgagaggtcatttagtgaaatttgatgaagatactctgaatacctttttgaagaccccagtgattctggaagagggggagaatcactgtgcttattacaagtttgcacttctaaggcctgatcctcagcagttagctgctaagctttgtatcctagggaggggattcgagctaaacgatgatggtcagcccttaaagatattaaggaagaacatgaccactttagctcagacatggagtgttctttccttctctaatttgaatcctacctcccacacatctgatgtcacattggatagagccaagttaatctatggcatcattatgaagatggatatgaatgtggggtacctaatctcccaccagatctttcttacaacatag

SEQ ID NO: 64605 - DNA, 324 bp, Glycine max
  Peptide Sequence Number=SeqID_156290
atggagtgcctagaagttcatccggagcaacccacacgcacacttcaacagcatgtggagtggatactacctacacctactccatatcgactagttgagccggttcaactaatagaggtgtcatcctctgaagaggatcttaaggaggacccagaggagttacctcctgaacctgctgtggatgcccttgacttcccagaggatgatgaggacccactccctgatgttgattctccagaggatattatgtcagcatctgaggcaggctctacagaggagagtggccctggagggacagcgaatagtgacgactcatcatcatag

SEQ ID NO: 64606 - DNA, 137 bp, Glycine max
  Peptide Sequence Number=SeqID_156291
atttcagagctcttttagagcacaaaattttgtgctcttctcgtgcctctcccgtcagtcatcgccgtgtttcctcaaagctcttagccatggcctcctatggtggtgagcttcttctagactcatcgtctccttga

SEQ ID NO: 64607 - DNA, 949 bp, Glycine max
  Peptide Sequence Number=SeqID_156292
gaggtagaacaatcgagttggttcccccgatggaaggaagggaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatgaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 64608 - DNA, 270 bp, Glycine max
  Peptide Sequence Number=SeqID_156293
atgtggtgttatgagtggaaaaagagtgaggctttgagagttggaaggttaaatctggattctgtgtttgtgctgtttgcctgttgtattacttggatgtcggggaagcttgggaggattgatggggacccggtgtcgagagaaacgaggatatgggctacgtgggagtacgtgagctcagttggaggtgggcaacaggggatggtgggtttatgcgcgatttgtggatgtggaaaacttgtagtgcaccatcgcccgactgccatctag

SEQ ID NO: 64609 - DNA, 91 bp, Glycine max
  Peptide Sequence Number=SeqID_156294
atggatttcaacagtgatgatttcatggacaaattgcgtgaagccttaaggaacgttaacttgagagatgaacgatggaggcctagaaggg

SEQ ID NO: 64610 - DNA, 210 bp, Glycine max
  Peptide Sequence Number=SeqID_156295
atgaagatgctcttgatacctcatgatgtaagctccattggagctttagaatggagaaaggaagagagagagaagagacgcctcttcaaggagaagatgagtctagaagaagctcaccaccataggaggccatggataagagcttggaggaagaaggagatgaatgaagggagagggagagaagagcacgaaattttgtgctctaaatga

SEQ ID NO: 64611 - DNA, 411 bp, Glycine max
  Peptide Sequence Number=SeqID_156296
atggctaagtttgacccagatatagtcctagagttttacgctaatgcttggcccacggaggagggggtgcgggcatgcggtcatggccagttcctgggtgacccgttagtgttagaggagggccaggagtgcgagtttagtcagagaaggaaccgagccgatggatttgacgaggaggccattgcccagctcttatgcataccgggtcaggattttgcccggaccgctgccgagagacgggtgcggatcatgcgcaccagcatgaccaccttgactcagatgtggatgacgttgctgctcagcaacgtcctgcctagcgatcataactctgacctcccttttcccaaatggtcagctggtgtatgccatcctgacacggatgagcgtccatgtggctcagttggtcgctga

SEQ ID NO: 64612 - DNA, 671 bp, Glycine max
  Peptide Sequence Number=SeqID_156297
agcaccctggacgtgtccgtgctgttggagccaatgtcaccatcaagaaatacttcggatcagctccacagaagtcccgcagctcttcctcactgcctcctgaagaattgcagcagctgacccagcaaatcagagaccagctagaggattcgatcatagaaaaagtgactcggcagctcatggcatcattcagtcagatgcagtcccagtttcagtcccagatgcaatctcagggacttacactgcctcccgagcctctggttggtccctcagtccctcgagtaagcacaaaggagagttgtgttgatccctcaggaaatgatgctgagacaggtgactcagacaggtgcgacttgtacattgaagcaattcctgcccacctggttgccctaggaagagtttatgagggatccactattgttcataacactccttttgtttcctgggcaaatgctctcgttcctgtacccactgatgaggtttccttagtggggcaagcaattcacaccttccttgcttggccgacacatttggtcaagtctttatcacagcaggcagctgtgtctccggcaaaaccacctcaaaagcccgatccaaaggtcgataatccgctttatctgatgacattgaccatcccagagcttttcttgaggccttaccaggttacatag

SEQ ID NO: 64613 - DNA, 162 bp, Glycine max
  Peptide Sequence Number=SeqID_156298
atggagaaatctgaaaagaaattttttagtgaaaataaggtgaagaaggcctacattacatgggatgacaatgatatggaatcatctgaggattcagaaaatgaagaaataaatctgtgtctaatggctaaaagttatgaaagtgatgaagagcaagtatga

SEQ ID NO: 64614 - DNA, 270 bp, Glycine max
  Peptide Sequence Number=SeqID_156299
atgacagatcttgtgagcgcggaagatgatgtaaatctccgcgtgtcaaagggcttgtcggacgcgattgacgaaggtcgcagaagacgaagcttttcatcttacagacagcagaaggtttatacggataaccactcgggtatttccgcccgtcagcgtgactcaaaagtcagtatgacagatcttgtgagcgcggaagatgacgtaaatctccgcatgtcaacgggcttgtcggacgcgattgacgaaggtcgcagaagacgaagttag

SEQ ID NO: 64615 - DNA, 333 bp, Glycine max
  Peptide Sequence Number=SeqID_156300
atggctagaggaaagatccagatcaagaggatagagaacaccaccaagaaggccaacgagctcaccattctctgcgatgccaaggtttctattattatgttctccagcactggaaaactccacaagatcgagcaatcaacaaagcagttcttcgatcaataccagatgactctgggagttgatatttggaactctcattacgagaatatgcaagagaacttgaagaaattgaaagagagaatgggagattgtctgaatgagctgggcatggaagatctcaggctccttgaggaaggaatggacaaggccgccaaggttgttcgtgagcataag

SEQ ID NO: 64616 - DNA, 123 bp, Glycine max
  Peptide Sequence Number=SeqID_156301
atgagccttggatatgaagcttggaaggatgcttctttggaggaaaagaaagagggagagaaagagagatggggggagcacgaaattgaaggaaaaaaagagggagagaagtggaactttgaa

SEQ ID NO: 64617 - DNA, 258 bp, Glycine max
  Peptide Sequence Number=SeqID_156302
atgtctaaccaaaagagcacgaagtctacaattaagaatctggaagttcaggtgggccagcttgcaaagcagttagctgaaagaccatccagcaactttacaacaaacacagagaaaaatcctaaggaagagtgcaaagctgtgatgactagaagcataatggcgattcaagctgaggaaagtatagctgatcagaagggcaagagtgaggccaacatagaaaagaagaaaaaggctactcctattgaatgcaaggag

SEQ ID NO: 64618 - DNA, 366 bp, Glycine max
  Peptide Sequence Number=SeqID_156303
atgaaaagagaaaaacatgcctcctatagtagtcatgacttttgcaaaagtttaagtgaagaacttagcgactattatagagggttccatagttcacatgctaaacatcactcccaaagaagagaaaaggatagaaggcctcaagaggttaacattagcctcccatatttccatggaaaagataatgttgaggcctacttagattgggaaatgaaggttgaacaactctttgcttgccatcatattggtggacttctattgagtattggaatgatcttaagagtgcccttaggaagagacacattccctcctactatgaaagggagcttatggacaagctccaaaggcttagacaagggagtatga

SEQ ID NO: 64619 - DNA, 237 bp, Glycine max
  Peptide Sequence Number=SeqID_156304
atgggtgctcctccgtcaaagggtttcattgaccacattgtggatgtgaaagcagacgataactgtggatatcggtccattgccgctttgttaggtatgggtgaagattcttggtcgttggtgcgcaacgaattgattaaagaacttggcaaatggtcgcatgactacatcaacctcttcggtggcacagagagatttgaagaattaaggttagtgtggacaagtggatggatataa

SEQ ID NO: 64620 - DNA, 905 bp, Glycine max
  Peptide Sequence Number=SeqID_156305
atgctatcggccagctcctgggatatcctttagtgctgcatgagggccaggagtgcgagtatggccagaggaggaaccggtccgatgggttcgatgaggaggccattgcccagttgctatgtataccggggcaggatttttcccggactgctgccgggaaacgggtgcggatcatgcgcaccaacatgaccaccctgactcagatatggatgactttgctgctcaacaacatcctgcccagcgatcataatttcgacctccccctgccgaagtgtcagctggtgtacgccatcctgacacggatgagcattcatgtggctcagttaatcgctgatgccatctatatatttgcaggtatggcgcctaccaggcaccctctggacccggataagtccaacagggccctgggatttcccgccttgatcacaggactctgccagtcgttcggcgtccccgtcgcacctagcaaggtgattcggcatcccatcacccgagcttttattgagaagtactgcatgcagagacaggtccagggtgatgcaccacaggccgcggacgcgccgccacctcatcaggctggtccagccggatcgtttgatacggagcagtatttgcggcatttggttcgccagcaggcggccaaccaccgggaacatgtacagactcatgattgtctttatcatatgagtctcagcctgtacaaccagggctttacttcttttctgtgccctactccggaccagttcagggcagaggtcgcatggcctggagattggcctgaggcccaggcaggagaggaaccagcagaggcaccagcagaggctcccgacgaggcagatgaggcccgcgaggacgaggagatgaccgatttacttgatttcttaggaggaagcggggccacatga

SEQ ID NO: 64621 - DNA, 642 bp, Glycine max
  Peptide Sequence Number=SeqID_156306
atgaagagatctaggaaggacgccgcggctgaagggactagtgctgcccccgagtttcattgccaccgtttcaggagcgctgagcaccagcaacgtttcgaggccatcaaaggatggtcgttccacagagagagacgcgtccagctcagggacgatgagtacacagattttcaggaggagatagctcgccgacattggacgtcgctggtcactctcatggctaagtttgacccagatatagtcctggagttttatgctaatgcttggcccacagaagagggagtgcgagatatgcggtcatgggtgaggggtcaggggattccctttgacgcagatgccctcagtcagttcctgggtgaaccgctagtgttaaaggaaggccaggagtgcgagttttgtcagaggaggaacagggccgaggggttcgaggaagaggccattgcccagctattatgcataccgagtcaagatttttcccagaccgctgatgggaggcgggtgcagattatgcgcaccagcatgaccaccttgacccagatgtggatgacattgctgctcagcaatgtcttgcctagtgataataactccgaccttcctctgccaaagtgtcagctggtatgccacccaccaggcaccctctag

SEQ ID NO: 64622 - DNA, 243 bp, Glycine max
  Peptide Sequence Number=SeqID_156307
atgtaccctcttttgttctcagttacaacaacccaagtagatgtaccttctacttgtaccacaacggatgtacccaccaatgtgttaagacaaagttctcaggcggttagtcctttgaaactttgtgaaagggaaacaaaagatatctcaggagggagaagagagacacaaaaagaatttaggcggttagtccttggcaaattctttttggcaaagggagaagagaatgaaaaagatgaatag

SEQ ID NO: 64623 - DNA, 357 bp, Glycine max
  Peptide Sequence Number=SeqID_156308
atggggagagtttatgagggatccactgttgttcataacactcctttgttgcctggccaagtaaaggtgagtgtggaggaggttacagatgcagatgctccagttcctgtacccactgatgaggtttccttagtggggcaggcacttcacaccttccttgcttggccgacacatctggtcaagtctttatcacagcagtggatgttccctccactagaactgatccataagagatgtaccctctcttgttctcagtcaaacccaagtagatgtaccctctacttgtgccacaaaggatgtaccctccaatgtgttaagacaaagatctcaggctattacacctttgatactttgtga

SEQ ID NO: 64624 - DNA, 207 bp, Glycine max
  Peptide Sequence Number=SeqID_156309
atggggacaaatcaaaccgacaagaggttttaccaagtcaaggttaaaggcctacataccaccagcattaaggaattagggcggttgatggaacctctccaaatgcaagccttccgcaagacttacggaaagatcttagagttgaccatatcagaggtatccatagaagccattgcatcactcacccaatactaccaccggccttag

SEQ ID NO: 64625 - DNA, 429 bp, Glycine max
  Peptide Sequence Number=SeqID_156310
atgagtgatggattttgcggtactcatttgcagatcatggttgggaccagaagattaggtcgtgccttaggtcaggtcactcgcagaggtgtgggcagaggagatcatgatgattccgatgatgctccacagcgtcgacgacctactgcatccgcacggaggcagcgagtcgctgcgactgcggatcacgtcgatgacctagtcatccctgacctagatgttcaggatgacccgatggaggcaccagctgctgtggaggacattcctgcggacgcaggcgcactgaggatcagcctcagggatttccgggagcgtcctgaattgaagttatcctcgcatgggaggaaggtccatagtttaggcaggcctacccctgccattgagggacttatcgctggtacaggactaagtcctctgatcgcgtgttcg

SEQ ID NO: 64626 - DNA, 360 bp, Glycine max
  Peptide Sequence Number=SeqID_156311
atggctaaaaaggcaaagttctgtgaaggttttgacaatgtcgaaggcagcgtcataaatttgagttctaatttgttcaagggtacattgccaagtgtgtctgcaaatgttgaagtgctgaatgttgccaataactcaatttccggaacaatttctccctttttatgtggaaaggaaaatgctactaataagttaagtgtgcttgatttttcaaataatgtcttatatggtgatcttggtcactgttgggtgcattggcaagcattggtgcatttgaacttgggtagtaataatttgtctggtgttattccaaactccatggggtatctatctcaacactgcaaaattgctctacaatga

SEQ ID NO: 64627 - DNA, 177 bp, Glycine max
  Peptide Sequence Number=SeqID_156312
acttatcaaggtaatccttgtggcgtctacccagacttatcttccttcattggaagtggcgtctacccagacttatcttccttaaccggaagtggcgtctacccagacttatcttccttcactggaagtggcgtcatccaaaccttcgtagcctgtatcaaacgatccgccccgtaa

SEQ ID NO: 64628 - DNA, 327 bp, Glycine max
  Peptide Sequence Number=SeqID_156313
atgaatagcacaagttttcaaggtttggaaaaccagaaaacttcagaaagcttttggtacaaagaagaagaagaagttcaaagagattcaaggcttgtaaaggattgtaatgaaatgattggaaaagctttcttcttgagtcttgaattcttcttgattcttgtggaagtgggagagttgatttgcgccatcgctcgatcaccacctaagtggtacctagagatatgtcgcgggagtcaggagaccttggggacgtcaggtggggtgctattgcccaaaaccaagcttgaccaatcccgacccaacccgggcatagttagtcagtga

SEQ ID NO: 64629 - DNA, 414 bp, Glycine max
  Peptide Sequence Number=SeqID_156314
atggaagagtttgaagagatcttgggatgcccactaggaggaagaaagccatatctttattctgggttctatccctccatggtgagaatagccaaggtagtcaaaatctcggcacaagaattggaccgagtgaagcaaaatagaaatggggtggtcggaataccgaggaagcacttgggggagaaggcgaaggctttggtggatcaaggtgaatgggcttcgttaattgatgtcttggcgctattggtatttggagtcatcctctttccaaacatggatgggctagtggacctgatgcaatcctaccccgcaagggcattggatagaagactccaagaagattgggccagagatggaagagaagaccctagggttctcatgagccttagggtagatttcgggcccatgggctaa

SEQ ID NO: 64630 - DNA, 309 bp, Glycine max
  Peptide Sequence Number=SeqID_156315
atggccccgaggaagcttgcctcaaagaggtccaggaaggataaggcggccgaaggaactagttccgctcctgagtatgacagtcaccgctttaggagcgctgtacaccagcagcgcttcgaggccatcaagggagagcgacgcatccagctcagggatgacgagtatactaatttccaggaggagacagggcgccggcggtggacatcactggttacccccatggccaagttcgatccagaaatagtcctcgaattttatgccaaaaaggggccaacagaggagggcgtgcgtgacatgaggtcctgg

SEQ ID NO: 64631 - DNA, 475 bp, Glycine max
  Peptide Sequence Number=SeqID_156316
atggaagcatgtttaacagtagaggacctgttgcaacagatgatagaccaaggccggctggaagtcggcaatgaagggggtgaagagcagcacatatgcatgcagtccgcagatgaggaagtttcgtggaggtatgcgcctccaagcgaaaggaaagaagaagccaccgacatcagctcgttgtcggccaaggtaaccaatatcacggggctgagcggcatgacccgcaacggtcgcatccctgacctgccgacacagcctgcaaatgctaaagggaaggcgaagatagcagaagaacaaaataacaaagtgatccccgctccggatgaggatattccaatgaaagttgacttcaatgccaagctactcaaggtgtacgtagactcagcgcgggtgattcaccagctaagaggggaatgggaaactagagaccacaagctgataccctaccaggcctatatcaaggaattggctg

SEQ ID NO: 64632 - DNA, 470 bp, Glycine max
  Peptide Sequence Number=SeqID_156317
atggaagagggattttcgcatggttcagttccaattattttaggcaggccatttatgaaaatagcccgaaccaagatagatgtttatgctgacacattgtctatggaatttggtgatattgttgttcattttaacattcttgatgccatgaaacatccatctgaggatcattctgttttttgtgctgagataattgatcagattgttaataattatatgtttgattttgattctgttctttatggtaggaaacatccatttttatctgatctgcatacttgtcattccttatgcattgaatctgaatttgtacttgatcatatgtttgaatttgatgctgagagtgaatctaaaattgatattgattacatgtctggtgatgttttacctcttgagattgattttctagagtcagatagaactaaccatgtttcaggaagtgcacatacctctgactttctttatatgag

SEQ ID NO: 64633 - DNA, 216 bp, Glycine max
  Peptide Sequence Number=SeqID_156318
aacatcgatgggttagaacttttgatctgcccctatgttcacttgaggctcaagcacgatgcccctcattgccccagtgtaagtgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 64634 - DNA, 216 bp, Glycine max
  Peptide Sequence Number=SeqID_156319
atggagcttaacttgtatcgttgtagcttagaaacaatgcaagcaaacacaaatgcagatgcaaaaattggagatttttggatgagagaggaagaaggaaaagaaagtgtttgtgcagaatcccacagctgtcctcttccttgggcatttgtcaatgcttggcttagcacgaggatcacaccgcttagcgaggtttgcagatccgaaaaggtgtaa

SEQ ID NO: 64635 - DNA, 605 bp, Glycine max
  Peptide Sequence Number=SeqID_156320
cgatcgatgcttttcttgcttatcatcacacccatgaaagcccgatcattgctatgttggttgacacatatgacatactcgacttgagatgtggacctatttgtcctgtacaaggtcatcgcatgtgtgccgagaaagggaaagcaaattgggaagaactcttggcagggttcccaaatgtccccttgatgggaatgaggggttgtattaattataatcttgtacttgctataagacaactaggttaccctatgagaggggagccatcggaaaagagtattgcgcctttcatcacacgaggttccagtgaccccaatgcaaaaatgcttcaaagagtccgaaaagcatggaaggcggtgcaaagaaaggataaggagcttagaggaagcagcagtggtgttgaagtccctgaggggagcgaagaggtgcaagccttgaaagcggagcttgaaagaacgcgagtagtcaaggaaaagttcaagatgataaccatcagggtcaggaaagagtgtgacgagctaagggatgtcaacatggccacaagcgaaggacgaatcgagggtggaaagtatgaaattagaggacaagttgaaggcttgttaaag

SEQ ID NO: 64636 - DNA, 346 bp, Glycine max
  Peptide Sequence Number=SeqID_156321
atggaagtgagggacaaggttgaactccttccatatagggacctagatgagctagtccaactttgtataagagtggagcaacaacttaaaagaaagccttcttcaaaatcttatggctctcactcttatccaaggaaggaccaagcccatggaattttaggggctgcaccttcaaaacccaaggaagataagggttattaccaagaagaagtttatggtagtcaagaggagactacttcttgcccttcctctagtggaagtgaaatagtaagggatgaagagtctagtgaggaagtctacccccatgaagaaggtgaccttttaatggttagaaggcttcttggag

SEQ ID NO: 64637 - DNA, 222 bp, Glycine max
  Peptide Sequence Number=SeqID_156322
cgatcattcgctaagcgtgatactcagtggctaagcgcaaggaagaatccagaagaagatgagctatcaggttcgctgagcacaccgctccaggtcatcaagtgcaccgcttcagcttattcactaagagagagaagcgcactaagccaaaatccacttatgcgcgctaagcaattcagatttgcactaagcgtgagagcatggaccaacccacttatttaa

SEQ ID NO: 64638 - DNA, 207 bp, Glycine max
  Peptide Sequence Number=SeqID_156323
atggaaaaacttcacggaaacaatttttttcacccaaaacagctgaaatgcatagccaagggggttagagatatttggaacaacctcccttcacctatttataggaaaaagggggaggaggttgccgcccagctctcccaggcgagctgggttgcttcctccataagcaactctgctttgaaaatattcccagattcaaaaatttga

SEQ ID NO: 64639 - DNA, 102 bp, Glycine max
  Peptide Sequence Number=SeqID_156324
atggcaaagacttccaaattgtgccatgccacatgtaaatgcctgcggtcaacacatgaccatcctcagaagaattggacctccattacagtggaaagttga

SEQ ID NO: 64640 - DNA, 615 bp, Glycine max
  Peptide Sequence Number=SeqID_156325
atgtgtggaaatggccccgaggaaacttgcctcaaagagatccaggaagaaataggtcgccgacggtgggcatcactggttacccccatggccaagtttgatccagacatagtcctcgaattttatgccaatgcttggccaacagaggagggcgtgcgtgatatgaggtcctgggtgaggggtcagtggatcccgtttgatgcagatgctatcagccagctcctgggatatcctttagtgctggaagagggtcaggagtgcgagtatggccagaggaggaaccggtccgatgggttcgatgaggaggccatcgcccagttactatgtataccggggcaagattttgcccggactgttgtcgggagacgggtgcggatcatgcgcaccaacatgacctccctgactcagatatggatgactttgctgctcaacaacatcttgcccaccgatcataattccgacctccccctgctgaagtgtcagctggtgtatgtcatcctgacgcggatgagcatccatgtggctcagttaatcgctgatgccatctatatttttgcaggtatggcgcctaccaggcaccctttggacccggataagtccaaggggatcctctag

SEQ ID NO: 64641 - DNA, 909 bp, Glycine max
  Peptide Sequence Number=SeqID_156326
atggaaagtcctaaacaaaaaataaaaacaaaaataacgtgctacaattgtggaaaacaaggccacattagcaaatattgtagactaaaaaagaagttaagaaaccttaacctagaacctgcaattgaagagcaaataaacaatttgctcatagaaacctcggaggaggaaacagaaacagaaacttcatcttccgtgctttccgatgaaaacctaaatctaatccaacaagatgaccaactatcatcaacagatgatgatgggcaaatcaatactctaacgagagaagaagatctcttgtttgaagcaatcaattccatacctgacccccaggaaaagaaggttttcctggaaaaactcaagaaaacattagaggtaaaacctagacaaaatgattttatcacgaacaacaaatttgatgtaagtaacatactcaagagattagaaaattcttcaaccaaaccaacgacaatccaagatctccaaacagagataaacaatctaaaaagagaggtaaaagaacttcgtcaacaacaagaaattaatcagatcattctttctcagcttgaggaagatagtgattctgaaagtgcccacaacagtgaagaaaatcaaccagaaaatttagaagatgacatgtttatgggattaatcaacaagattaaaatccaaaatttttacataaacataaaaataattattaatgatttcgttttagaaacaatggccctatttgacacaggggctgattcaaactgcattttagaaggattaattcctacaaaattctttgagaaaacctcagaaaaattaagtacagcaaacggctcaaaattaaaaattaattttaaactatcaaatgcaatcattgaaaaccaaggtcttaggattaacacaaactttcttctg

SEQ ID NO: 64642 - DNA, 297 bp, Glycine max
  Peptide Sequence Number=SeqID_156327
atggtagtaggaaatgcaactatagaaaaatctaggaaacaatgggatgaagaggaaagaagaagggtacaatataacttaaaggctaaaaatataattacctctgcattgggaatggatgaatactttagagtctcaagttgtaagaatttaaaagaaataatgaatcaaaatgaaaccatacaagatatgcaaaagagattcacacatatagttactaatcttgcatcattaggaaaaatatttcctaatgaggatctcattaacaaagtactaagatgtttaagcagggaatga

SEQ ID NO: 64643 - DNA, 403 bp, Glycine max
  Peptide Sequence Number=SeqID_156328
gaaggccagagggaaaagatctgaagccccttccacagcaccatcagaggcactagcatcttcttcttctacacttcctccctcttcctccacaaagatcccagtgattcctccagcatccacacagattccacttccagctcctctctttgcaggtggtgatgcaagctccattggagcttgtaggcctagggtcttcttcatcaatggattccttagcttcttggaagatgaatggcagcggaatggagaaagggagagagagaggagatgccacttcaaggagaagatgagtctagaagaagctcaccaccataggaggccatggataagagcttggaggaagaaggagatgaatgaagggagagggagagaagagcacgaaattttgtactctaaatga

SEQ ID NO: 64644 - DNA, 236 bp, Glycine max
  Peptide Sequence Number=SeqID_156329
gagaaaattctgagggacattttgcatttaaggaattgaagaatggtggaataatagaaaaaccaaaagtagaattgaagaccttacctgcacatttgaagtatgtgtttttgaaggacaatgactcaaagccagtgattattagtagtctgttgaagaaaatagaagaagatcagctggtgcagattttgaagagacacaaagctgccattggatggcacatatttgacttttaa

SEQ ID NO: 64645 - DNA, 162 bp, Glycine max
  Peptide Sequence Number=SeqID_156330
atggcctcctatggtgtggaatctcctctctctcttccttctccattacgctgccattcatcttccaagaagcaaaggaatccattgatgatgaagatcctaggcctacaagctccaatggagcttacatcatgtggtatcagagcatcttcatctaggtga

SEQ ID NO: 64646 - DNA, 207 bp, Glycine max
  Peptide Sequence Number=SeqID_156331
atggcagcggaatggagaaggaagagagagaggagacgccacttcaaggagaagatgagtctagaagaagctcaccaccataggaggccatggataagagcttggaggaagaaggagatgaatgaagggagagagagagaagagcacgaaattttgtgctcaaaaggagctctgaaatctgaagaattaatgaaacattgggcttaa

SEQ ID NO: 64647 - DNA, 204 bp, Glycine max
  Peptide Sequence Number=SeqID_156332
atgtcacagaacttgacggattgtgcaacaatgcttccttttgacttccggtatgtcacagaacttcacggattgcctaacgatgggtgtcaagtacctcgaagttgtcaaacgagggtcacatcccaacaaacggatggtccccggatgaaattaggcaccaaaccacaagacaatggaggatatacatggagaataagatga

SEQ ID NO: 64648 - DNA, 466 bp, Glycine max
  Peptide Sequence Number=SeqID_156333
atggctgaagatcttttgaagaaaccaaggaaaggtaggactttagaagagattggtcacgagtattttgatgatttggtttcgagatcatttttccatcgttcaagtacaaatagaagtagttggcctcatggcaaatgttttgtgatgcatgacctcatgcatgatctagccacatcactcggtggagatttttattttagatcagaagaacttgggaaagaaacaaagatcaatactaagactcgtcatttgtcatttgccaaattcaattcttcagtcttggacaactttgatgctgttggtagagtaaaatttctgagaactttcttgtccattatcaattttgaagctgctccattcaacaataaggaggcacaatgtatcatagtgtcgaagcttatgtacttgagagttttatcatttcgtgatttccgaagtttggattctttgcctgattcaatag

SEQ ID NO: 64649 - DNA, 84 bp, Glycine max
  Peptide Sequence Number=SeqID_156334
atggagaaaaatgaagaaacaacaatggaggagaagcatgcttgtgaagcttctttggaggctggatctttgagcttcagtgag

SEQ ID NO: 64650 - DNA, 186 bp, Glycine max
  Peptide Sequence Number=SeqID_156335
atgtaccctcgacttgaactgatccacaaagaattctcagacggggaagggaagaatcaaaagaattctcaggtggttagtcctttgaattctattggaaagagagaagggagacacaaaagaattcaggcgattagtccttctattcttttggcaaaggaagaagagaatgaagaaaaagaatag

SEQ ID NO: 64651 - DNA, 598 bp, Glycine max
  Peptide Sequence Number=SeqID_156336
atgagtcttcattcttcatctagtgttaatggtgagggttctactcctaaggaccccttatataagatattagatgaattgagatctcttaatttgtggaaagaaaaacaagagagaaaagaaaaaggaaggcataggtcacatcttagacctcactcccattggggagaaaaggaaagaaagcctcaagaggctaacattaaccacccatacttccatgggaaggataatgtagaggctaacttagattgggaaataatggtagagcaacaacttaaaagaaagtctacttcaaaatcttatggctctcactcttatccaaagaaagaccaaggtcaaggcatcttaggggtgacaccttctaagcccaaagatgataaggggaagacaatagaaaaacaaccccttaaagctagtatgcaagagaagactagctccatgaagtgctttaaatgtcttggaagaggacacattacttctcattaccccactaagaaaaccatgattatgaggggccaagacaaatatagtagccaagatgaggcttctacttcaccttcctcaagtgaaagtgaagaagcaaaaggggaagaatcta

SEQ ID NO: 64652 - DNA, 465 bp, Glycine max
  Peptide Sequence Number=SeqID_156337
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcataattcttggccatcacactcag

SEQ ID NO: 64653 - DNA, 390 bp, Glycine max
  Peptide Sequence Number=SeqID_156338
atgagaggaaatcaaagaagacaaaacttcaaatctaaaagaagaactaaagagtcatctcaaatcccaaaatgctttgagtgcaatcaacccggacatctgagggctgattgtccaatctttaagaagaaaatagagaagcctgaaaagaagactattggagataagaaggcaaagaaggcctatattacatgggatgacaatgacttagaatcttttgatgattctgaaaaagaaatggttaatctatgtctaatgggcaaagattatgaaagcgacgaagaggtaacatcttctaacaaatctatttcttttgttgagttacaagatgcagttgctgaattacatagtgaatcaattaaactagcaaaacttgtctcttcatcttag

SEQ ID NO: 64654 - DNA, 683 bp, Glycine max
  Peptide Sequence Number=SeqID_156339
aagaccaagggcaaggccagttgaggttccttctacatcagcagctctcctccagcacatatgacaacaacaccttctaccctacctcctgcagattttcaacgtttcgaggccatgcttcgaagcatacatcaggggcagattattttactagaaagcctacagctgggactcagcctcctcttcacagggaagacgaagatcctgccgctcaggtaccccatcagtcggaggatgagtcatcaaattctaccactcctgagcccttgatcaggaaaatgagggtagttgtaacccaggaagctgcagccacctctgaaaagtctcttgaagctactctagagcttccggcaccagtggcagataccacttctccacaacaagcagcatacccttccacgcttgaggatcaaactaccctagtcctatctccgaacacctctcttgtagcttctcttgtacttcatttgtcggaagaggaggagggtcagacacaggacacgtacttggcaccctttgttgtgcaatctgtgaaattccgtaacatgccagaaatcaaaaggaagcattgttacgcaatccgtgaaattcctcccacttgggccttccagattcttcctccagaaggcggttgcttctggaggaagcaacctggctcgcctgggcgagctgagcttgcctgg

SEQ ID NO: 64655 - DNA, 198 bp, Glycine max
  Peptide Sequence Number=SeqID_156340
atggatgcaaaattcacagatagatgtctacctaaaaacctacttgaatggcccaacaactacttgaaaggaattattaacagtgctttgaagggattcaacgatattcaaggaagtaaacccaaggctattgctaaatggatattccagttaaatgtaataagcaaagaggaagcattgagtgccgctattatatga

SEQ ID NO: 64656 - DNA, 489 bp, Glycine max
  Peptide Sequence Number=SeqID_156341
atgtcgctaagcggaccatgtctcgctaagcggataatagcttccaaaaagagaaagagtattggtacaaagcccacatctcagtatgatacaaggaggttccacttctttgaggcttggacccgatacacaaataatgttctaggaagacatatactgcctaagaggaaggtagaaatataccacactgagctggacgagtttaaggctgaattggagaggcataacttccataaacgcctcaccaatttagttgaaaacaacatagatctagctttgattgatgcacacagtctcaacacttttctggagacacttgtggtactagttgagggtgaaaccttactcacatattctagatactacaggttgcctgttgatattagagaaattgaggttgccttatgtatcccaggtcgggggtttgttttgaatgtagaaggccatcctgggaagattctcaggaaagatttaacaactcttgctcag

SEQ ID NO: 64657 - DNA, 211 bp, Glycine max
  Peptide Sequence Number=SeqID_156342
atggcttctatggatatctctgctatggtcaactctaaagatctttcccgtaagtcttgcggaaggcttgcatttggagaggcttttaaccttgatttggtaaaacctcttgccggaatgcatatgacacagatgcaatctaggaatgcggggtcccaaggtattgtccccttcttagatacaacgtctaggggtagcaaagggccccaac

SEQ ID NO: 64658 - DNA, 71 bp, Glycine max
  Peptide Sequence Number=SeqID_156343
ggtgttatagtttcaacgacgttatcaacaacaacaacaacctcattttatattctcatattcatcaataa

SEQ ID NO: 64659 - DNA, 264 bp, Glycine max
  Peptide Sequence Number=SeqID_156344
atggctgagtatgaagtgtgtgccctggccatccaggcggcaattgactctaatgtcaaactgctcaaagtatacagggactcagcatcggtgattcaccagctgagaggggcatgggaaactagagaccccaagcgataccctacaaagcctatatcaaagagttggctgactcctttgatgagatctccttccatcacgtcccccgggaggaaaatcaaatggcagatgcacttgccactttggcatccatgttccagctaa

SEQ ID NO: 64660 - DNA, 453 bp, Glycine max
  Peptide Sequence Number=SeqID_156345
atggaagaaggatgggaggctgctccatctgccccatctgatttgtcagactatgaatggaggctcttgtcttttgctgaaattgcatattttggatggtcatttgcctcactaactcttctaaggaaggttgaggaggagcctcagttgctggttgtctttgttgtgattgttgttgttgctactgctgtattggaggaggaacatatggcttgcttggaccaacaacattctgaaaaggaaggacaggctattgttgttgtggaggacttgtccatctcagatttggatgattcctctaacttggattgtatctgttgcttggaagatcataattattctgctgttgttggttttgctgttgaggaagtcaattataaatgtttgcagcataaagctttaggttgctcattgactccagattgctgcaaagaaggacaaagattctgtatg

SEQ ID NO: 64661 - DNA, 281 bp, Glycine max
  Peptide Sequence Number=SeqID_156346
ctagcgctgttcgtgcatcctccaccatcaaatcttattcagagccccatgaattgattgtcattcatgcatcatccaccatcgagtctggagccccacgaattgattgcctagcgctgtttgtgcatcctccatcatcttattcggagccctatgaattgattgtcattcatgcatcctccgttatcaagtacggaacctccgagaaagaagaaggagagacgggaatcacttatttcaaatcgttttgggttggaactattgtgattgagatcaattaa

SEQ ID NO: 64662 - DNA, 429 bp, Glycine max
  Peptide Sequence Number=SeqID_156347
atgactttgctgctcagcaatatccagcccaacgatcataattccgacctccccctgccgaagtgtcagctggtgtacgccatcctgacacggatgagcattcacgtggctcagttaatcgctgatgccatctatctatttgcagtatttcggcatttggttcgccagcaggcggccaaccaccgggcgcatgtacagacccatgattgtctttaccagttgagcctcagcctgcagagccagggttttacttcctttccatgccctactccggatcagttcaaggcagaggtcgcatggcccggagattggcctgaggcccgggcaggagaggcaccaacagagggccccgacgaggcagatgaggcccgcgaggacgaggagatgaccgatttgcttgatttcttgggagggagtggagccacatga

SEQ ID NO: 64663 - DNA, 627 bp, Glycine max
  Peptide Sequence Number=SeqID_156348
atgaccgaccctctcgatgagtcgatctcttgctttctcataagggtgaacccttggggctacacgccctcaccttgggtactagttaccctcaccgttagaggactacacgtcctcgccttgagaggactacacatcctcaccatcagagggctgcacgccctcacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactatacgtcctcgccttgagagggctacacgccctcaccttggaggactacacgtcctcaccttcagagggctacacgccctcgccatcagaggactgcatgtgctcaccttcgtagggctacacgccctcactttgagaggactacacgtcctctccatcagagggctacacgccctcacctccagaggactacacgtcctcaccttgagagggctgcacgccctcacctttagagggctacgtgtcctcatttttagtgtgctcgacatccacaccttaaaagaatttaaggtcctctgcccttaa

SEQ ID NO: 64664 - DNA, 228 bp, Glycine max
  Peptide Sequence Number=SeqID_156349
atgggtatctccttcgtcgccttcttgcagggggtaatcggcataaggagggagtttcccctcgaaggtaggggcttggctcacatcttccagagcggcatggggagtgaagtccggaggcaagccataagggtaagcttgcggactatacctccgaccgaacaccgtcagcacaggttccgcttccctaattgcattggaggcggttgccgtggcattatcctctag

SEQ ID NO: 64665 - DNA, 339 bp, Glycine max
  Peptide Sequence Number=SeqID_156350
atgtcatcttcgtcgtcatcttcatctagtatacacattaaatctgctccaatagatggaaacgttttatggatgcaacctaaacatgtttcagaacatgtttggaatggggaaccagacaaaaaattacatatcagacgagttgtccccatctatcaaggacaagaagaaataccagaggaaattattcctctgcttcgacaatctggattttattggataatgaagatggggtacctaaaaataaattcgtcattaattacagtcttgattgaaagatggaggcccgagacacacacgtttcacttgagatgcgaagaggctacgattactctttaa

SEQ ID NO: 64666 - DNA, 657 bp, Glycine max
  Peptide Sequence Number=SeqID_156351
atgttagccagtgatcatgccatcccgagggacagaacctatcaacccacaaagaatagcctattggagctaacatcacatgatgctttgttggcacagaacaagttgctatctaagcaacttgagatcttaacagaaacacttggttgtaccatgtgtggtgaagctcatgagacaagccaatgcattgccactaacgataacactcaagaaattcatttcatggggaatcagcaaaggcaagggtacactcaaggaggatttttaggcttccagcaaagtccttataatcagcaaggacaatggaggacacacctaggcaaccagttcaataaagaccaaggtggatcctcaaataggccaattcatcaagggccaaacatctttcagagcacaactaagttggaagagaccttgactcagtttatgcaggtaacgatgtcgaatcataagagtactgagtcagcactaaagaaccttgaagtacagatgggacaactggccaagcgaatagctgacaagtcatcaaacagctttagagcaaatacggaaaataatcctaaggaggaatgtaaggctgagatgaccaggagtaaaaggtttgtggaagctgaggataaagaaaatgtggtagacaaggaaccaagtggtgaatag

SEQ ID NO: 64667 - DNA, 316 bp, Glycine max
  Peptide Sequence Number=SeqID_156352
atggacaaaagtatgattggtgcagccagtggaggcactttaatggacaaaactcatgttgttgccaaacaattgatttccaacatggcaacaaactaccagcaatttggtactatagttgttgtactatccagagttgttgcaaatgaagtttctatttctatggttgttgataatcagaggctagagaataaacttatagagttggcatcccttatgagacaactagccattggtcaacatcagaatatgatgacaaccaatcaaccaaggttgtgtggtatctactgtgcttctgatcatccaacagatgcat

SEQ ID NO: 64668 - DNA, 315 bp, Glycine max
  Peptide Sequence Number=SeqID_156353
atggagagaccctcgaaggcaatgcgagaggaacccgcacgcacgcttcagcgcactgtggagtggatattacccacgcctacaccatatcgtctagtggagccagtccaagtgatcgaggtgatgtcatctgaggaagacccagaggagctacctccagagcccgttgtggatgctcttgactttctagagggtgatgaggacccactccctgaggtggactctcccgaggacgtcatgtcggcatctgaggcagactctacggaagatagtggccctggagagatggcgactagtggaggctcttcatcatag

SEQ ID NO: 64669 - DNA, 367 bp, Glycine max
  Peptide Sequence Number=SeqID_156354
gagacgacgttagtctctgcgtgctactggacattgagtctgacggatagcaaaagagtgtgtccgggttaccctatagggcgtctccgcgtgccaatggactcttgggtcatggtaacaaaagatggggtggtcgacaaaagcggggcttttactcctacgtatcctcaatttgtgctgaagaattcagacctgcgtatgcaaggcgaaaaagtcaccgacgcacaggattttggttggcaatcaaagggagaggaccacttcaggcgaggatgggcattctcactctgggtcaaggtttatggtgagttgggattttggctcaaggcttgtagaacggctggacatgatatatgtcagagtgttg

SEQ ID NO: 64670 - DNA, 312 bp, Glycine max
  Peptide Sequence Number=SeqID_156355
gttataccatttgtggtggtgctcatgaatccgaccattgtattccttttgaagaacaaacgcgggaagttagttacatgggaaatcaacagagacaaggatacaatcaaggaggattttcaggattccagcaaggtgggtcaactggccaagctgttagctgagaagtcatccaacagctttggggcaaatactgagaagaatcccaaagaagagtgtaaagctgttgtaacaagatgcaggaagcttgtggcagctgaggatgaggatgttgttgcttttaaggacactactgttaaaaagaagaatgag

SEQ ID NO: 64671 - DNA, 205 bp, Glycine max
  Peptide Sequence Number=SeqID_156356
ccttagtcagcagggccagggttttgttccttttgcgtgccctactccagagcagtttaggactgaggtcgcatggcccggagattggcctgaggcccaagcaggggaggcgcctgcagaggctcccggcgatgcagaggaagcccgcatggatgaggagatgacgggtttgctcggtttcttgggtgggagcggagccacatga

SEQ ID NO: 64672 - DNA, 342 bp, Glycine max
  Peptide Sequence Number=SeqID_156357
atggctccgaggaagctttccacaaagagatctaggaaggacgccgcgaccgaagggactagtgccgctcccgagttcgatagccatcgtttctggagcgctgagcaccagcagcgtttcgaagatatcaagggatattctcgagttttatgccaatgcttggcctacagaggagggcgtgcgggacatgcggtcatgggtaaggggccagtggattcctttcgatgcagacgccctcagtcagttcctgggatacccgctagtattggaggagggcaggagtgcaagtacagtcagagaaggacccgggccgatggatttgacgaaaaggccattgcttag

SEQ ID NO: 64673 - DNA, 489 bp, Glycine max
  Peptide Sequence Number=SeqID_156358
atggagagaagtatgatagatgctgccagtggtggagcccttgaagacatgacccctgctaaagccagaaatttaattgagaagatggcttcaaactcccaggaatttagtgccagaagtgatgctattgtcattagaggagtgcatgaagtagccacgaattcatcttcatcagccgagactaagaagcttgaaggtaaactagatgccttggttaacctgcctgaagcttatgctacaaacatctacaacagacctcctcaacctcagcaacaaaatcagccacaacagaacaattatgacctctctagcaacagaccatacgttcctccaccaatccagcaacaacaacaggaacagccccagaaacaacaaacagttgaggctcctccgcaaccttcccttgaagaacttgtgaggcaaatgactatgcaaaacatgcagtttcaacaagagaccagagcctccattcagagcttaactaattag

SEQ ID NO: 64674 - DNA, 240 bp, Glycine max
  Peptide Sequence Number=SeqID_156359
atgggaaactatcagcacccaagaaatcctaaagagagaatgtaccacacaggctatgacaattataacaacatccttctctttatacatacttatacacacaacaatcctatgaatcagtcacacatccatgctcaagacaagaaggcagaaatacacacaatgtgtgacttaacgtcactccccgaaacctactcccaagtttcagagatacacagcattcacacagcaagaccataa

SEQ ID NO: 64675 - DNA, 552 bp, Glycine max
  Peptide Sequence Number=SeqID_156360
atggttagaacacgaggtctacgtcgtgtggaaggcacaggtagaggcagagaccttagtcaggatgtggctgaggatgttcctcgccgtcgtaggcccactgcctcagcacgtaggcaacgggttacccagagagtcgaggatgttcctcagttggctgaggatgtgcctgatgcgtctaatggtagcccagagaggacaggagccgccgatggtgctgagtctgatcgagtggctagtgatgggacaactgctgatgatgaggggttccttggtgggccacgcgatccatctgttttgatcggatttgctgatcatgtggcacacaacatatggagtggacaggagcgacccgatctcaagttggtctcccacggtaggaaagtagataaatttgggagaccggctgctgagatcaaaggtatgattgaggccaccggattggatccattgatcaggtgttctgtgatcaccactgatcctggactcatatccgcctttgttgagaggtggcatagggagacgagcagcttccacctctcagtaggggag

SEQ ID NO: 64676 - DNA, 381 bp, Glycine max
  Peptide Sequence Number=SeqID_156361
atgaaggccgatctatcggccttaaaagatcaaatggcttccatctcggaagtcatgttaaaactccagaaaaccatagaggataaagccacggcaaccgcctccagtacagttagggaagcggagccggtgctgcagcccgccttgaatccgggccttgacagaaacacggccgtgttcggtggaaggtatagtccgcaagcttattcttatggccagcctccggacttcaccccccgtgccaccccggaagatttaagccaattccctactttcgaggggcaactcccaccttatgaagactatcccgagcaagacgatggggaaggagatacccatcttggccccctgctccacctcaaagatccgtccccgcattaa

SEQ ID NO: 64677 - DNA, 197 bp, Glycine max
  Peptide Sequence Number=SeqID_156362
tcaaaggacctgaaaaaagaggacgtgtgcgttgtcttggcaagcttccacatcaagcaagttcatctcaaagctcttatacaaacaatagaattcaaaagttggagaatttgcttggaaatcttgtagttgtgcttaaagtacgatttgcagaagatccacaaattaatcaagtcttagaagctatagatcaagag

SEQ ID NO: 64678 - DNA, 294 bp, Glycine max
  Peptide Sequence Number=SeqID_156363
atgggcacatggggtgttaatgccttccctatgcgtaaacaactcccgaacccttattttcaaaatttgcaaacctatttttggagcagtcgcgctcagcggaccatttgggctcagcgtgcatccgacgctaagcgcaactttagcgcgcttagcgtgacaagggaatttggcagagcacaagaatcaaggccactcgctaagcacaagattagctcgctaagcgagatgttcatctcttgccaagctcagcgcgtggctggtgctaagcccatatacatttactcacgctaa

SEQ ID NO: 64679 - DNA, 248 bp, Glycine max
  Peptide Sequence Number=SeqID_156364
acgatgaggttaaagcttcggaagaaagtgatgaggttcaagccctaagggcagagcttgaaagagcctgggtagtcgaagagaagttcaagatccacgatgtcggatacaatgtccaggacatcctgcccgaaaatactggagttgctgcacaatgcacaaggcaagataaaagaattgaagctgcaggatccacgatgtcggatacgatgtccaggacatcttgcccgaaaatactggacacataa

SEQ ID NO: 64680 - DNA, 618 bp, Glycine max
  Peptide Sequence Number=SeqID_156365
gcattgcatatgggttctgtcttgatccctactgtaaacaaaccaacggagggtccgtgtcgccttcttaaaaaccttttgtctcactttagtaagcatgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgttaatttttggggtcgtcctctttccaaacgtggatggtttggtagacctagcagcaatcgacgctttccttgcctaccaccatagcaaggaaagtccggtg

SEQ ID NO: 64681 - DNA, 393 bp, Glycine max
  Peptide Sequence Number=SeqID_156366
atgaaagaaatgaaaagagaaaaacatggctcctatagtagtcatgactcttgcaagagtttaagtgaagaacttagcgactattatagagggcgtcatagttcatatagtaaacatcattcccagagaagagaaaaggatagaaggcttcaagaggttaacattagcctcccatatttccatggaaaagataatgttgaggcctacttaaattgggaaatgaaggttgaacaactctttgtttgccatcatattagcgaagagagaaaagttatattggctacccttagctttcaagggtacttggcacccatcgttaggcaattcgtgatgttccgtgacatgtcggaagtcaaaagaaagcgttgtagcacaatctgtgaagttccgtga

SEQ ID NO: 64682 - DNA, 315 bp, Glycine max
  Peptide Sequence Number=SeqID_156367
atgaaaagagaaaaacatgcctcatatagtagtcatgactcttgcaagagtttaagtgaagaacctagcaactattatagaggatgccatagtttacatactaaacatccttcccaaagaagagaaaaggatagaaggcctcaagaggttaacattagcctcccatatttccatggaaaagataatgttgaggcctacttagattgggaaatgaaggttgaacaactctttgcttgccatcatattagtgaagagagaaaagttccattggctaccttgtcgcaacctacccttcggcgggagggcgaagcgtga

SEQ ID NO: 64683 - DNA, 360 bp, Glycine max
  Peptide Sequence Number=SeqID_156368
atggagcattttcttaagcaagtagcctggcttgaagctcaacttccattggtgagacccgacgaggctgctcctgctgagcccacaactacacgggttaaaccaaagccagctgatccacaatctctagtggtgaatccacctttttctcctaagcttgaagtagttctcccatctccacctctgattatcatctctgattccctatctagagaaactattgctccccctgattcaccagctagagaagcagttgatccccctgattccccaattggaaaagctattgatctttcttattcctcatccagagaagctgttgctctctctgattccccagtttttttatctgatagatga

SEQ ID NO: 64684 - DNA, 228 bp, Glycine max
  Peptide Sequence Number=SeqID_156369
atgaagatgctcttgataccacatgatgtaagctccattggagcttcggaatggagaaggaagagagagaggagacgccacttcaaggagaagatgagtctagaagatgctcaccaccatggaaggccatggataatggcttggaggaagaaggcgatgaatgaagggagagggagagaagagcacggaattttgtgctctaaaagagctttgaaatctgaagtttaa

SEQ ID NO: 64685 - DNA, 870 bp, Glycine max
  Peptide Sequence Number=SeqID_156370
atggccgggcagtttatcggcgctcgcgccggttcgcggctggtgctgagtaaagggcagtcgctgattcggccgatgatcgtcatcgtctccgcgcaacaccattatcagcagttagtcgagatcttcgacaagtgcttcgccgatgattttaatacctgtgtgattaaaggcgacgacgaaccgatctatcttcctgcagatagcgaagtgccctataaccggattgtgtttgctcacggcttttacgccagcgcgctgcacgaaatttcccattggtgtatcgccggcaaggcgcggcgcgagcaggtagattttggttactggtactgcccggacggccgcgatgcgatgacgcaaagcaagttcgaagacgtcgaggtcaagccacaggcttttgactggttgttttgcacggcggcgggatttccgtttaacgtcagctgtgacaacctcgaaggcgactttgagcctgaccgcatcgcctttcaacggctattatcaaacgccgccgctgacggcagaacaatttccgtggccggaagacctgcactaaagccacgttctacaaatgaaagaggaaagacgatgatcgcggagtttgaatcacgcattctggcgttaattgacgatatggtagaccacgccagtgatgacgaactgtttgctggcggttatctgcgcggccacctgacgctggcggtggctgagctggaaggggaaggggaacatacggcgcaggcgattaatgataaagtcgccagcagcctggaaaaggccatcagcgcgggcgaactatcgccgccggatcagattctggtgcaagggatgtggaataacctgtaccagcaggcgaaaaatcaggcctga

SEQ ID NO: 64686 - DNA, 504 bp, Glycine max
  Peptide Sequence Number=SeqID_156371
atgacgcctaccaggcaccctctagacccagataagtccaacagggccctgggatttcccgccttgatcacaggactctgccagtcgttcggcgtccccgtcacacctagcaaggtgattcggccgcccatcacccgagcttttattgagaagtactacacgcagagacaggtccagggtgatgcatcacaggccgcggacgcgccgccacctcatcaggctggtccagccggattgtttgatacagagcagtatttacggcatttggttcgccagcaggcgaccaaccaccgagcacatagccagggctttacttcttttccgtgccctactccggaccagttcagggcagaggtcgcatggcctggagattggcccgaggacagggcaggagaggcaccagcaagggcaccagcagaggctcccgacgaggtagatcaggcccgcgaggacgaagagatgaccgatttacttgacttcttaggagggagcggtgccacatga

SEQ ID NO: 64687 - DNA, 570 bp, Glycine max
  Peptide Sequence Number=SeqID_156372
atggttaaggaggagtgtaaggaggtaagtgtctcctccaagaggttagctaagaaggaaagtcattttgcaataaagacaaacattaaagaaacttcccttcttagacaacctccacatcttctcctttgtaaaagaacattttttagcattgccatacctcttgagcttgaggttattcctcaagtaaaggagttgttggataaggctttggtttgtaagagcttaaatccttgtgctttgttcgtgcccaaaataggtattatgaggcaccaaatccctatgatatgtggtatgatgaatgtgttgagtggtacaaccctcttttgtaaaatcatccatgcattcaacatcttcatgattcgcatacatagggactcattaggttggtttgttcttatttttggtttcaatacaaacctaggtgctcatatggcacaccttagtgatcaaagggttcccacgaaccctaagagaataaagtcattcttgagtggcccactccaccaacaccactcaatgagttggggaggaaccatattccctcatgggatgatgccccccaaatga

SEQ ID NO: 64688 - DNA, 429 bp, Glycine max
  Peptide Sequence Number=SeqID_156373
atggataatgaagagggcgtgcaggaacagatgaaggtcgatctatcggccttaaaagatcaaatggcttccatctcggaggtcatgttaaaactccaaaaaactatagaggataaagccacggcaaccggctccagtatagttagggaagcggagccggtactgcagcccgccttaaatctgggccgagacagaaacacggcagtgtttggtctaaggtatagcccgcaagcttacccctatggcttgcctccggacttcactccccgtgccgccccggaagatttaagccaagcccctaccttcgaggggcaactcccaccttatgacgactatcccgggcaagacgatgaggaaggagatacccatctcggcccctgctccacctcaaagatccatccccgcatgaactaccccaaccaaacatag

SEQ ID NO: 64689 - DNA, 609 bp, Glycine max
  Peptide Sequence Number=SeqID_156374
atgaccggaaggcttcttgctggttcattggcttttgaaagtcgcatcctcccttaccttattgttcgcattttgcttcctagatcttcaaaccttgcccaggtttttgaagaagatctcattgtcatgtgcgcctttcatgaaggtttacaaattgattgggcacaccttgttagatatcacatgcataaggcattgcgattgaatgccccattgccttatcctcatcttgttacctttttccttcaacacttcaacatccctcttgattctgaaccctatgttccaatcaagagatcatttcttataggcgcttcagtcatagcatcctttggttatattaaggagcatgatggctcttggataaagaagggtgctagaaatgttggtgaagaaggacatgagggagaagattcatctcttctttcgaagattttggaaaagtttgatggtcttcaaacctttgttggtgaaaggtttgacactttggaattgcaagtggatatgcgcttcaatgaaatggagtcaagaatgacaaaggttgaagaagatgtatcttacattcgttcaagcttcgatcttccaccaccaccgccaccatcatcttag

SEQ ID NO: 64690 - DNA, 348 bp, Glycine max
  Peptide Sequence Number=SeqID_156375
atggagaggagtatgattgatgctgccagtggtagagcccttggtgatatgactcctgctgaggctaggaatttgattgagaagatggcttccaactctcgacaattcagtgcaagaaatgatgttatttttcttagaggagtccatgaggtggccacggattcatctccatctactgaaaataaaaagcttgaaggaaaacttgatgccttggtcaacctagtaactcagcttgccatgaatcaaaaatctgcacctgtcgccagactctgtggtttatgctcctctgccgaccaccacacagacctttgcccttctgtgcaacaatatgaatgcaaaacagcctaa

SEQ ID NO: 64691 - DNA, 351 bp, Glycine max
  Peptide Sequence Number=SeqID_156376
atggaaggctgtagatttttagtgtcaggaaaatatactgccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatcatgatgatgatgattatcttacgaagatgacagcgttgacggtatctctgatacagacgatgaagtcatcgacattcctcaaccagtaa

SEQ ID NO: 64692 - DNA, 696 bp, Glycine max
  Peptide Sequence Number=SeqID_156377
atggccccgaggaaacttgcctcaaagagatccaggaaggataaagcggccgaaggaactagtttcgctcccgagtatgatagtcaccgctttaggagcgctgaacaccagcagcgcttcgaggccatcaagggatggtcatttctccgggagcgacgcgtccagctcagggacgacgagtataccgatttccaggaggagatagttcgccggcggtgggcatcactggtcacccccatggccaagtttgatccagacatagtcctcgaattttatgccaatgcttggcctacagaggagggcgtgcgagatatgaggtcctgggtgaggggtcagtggatcccgtttgatgcagatgctatcggccagttcctgggatatcctttagtgctggaagagggtcaggagtacgagtatggccagaggaggaaccggtccgatgggttcgatgagaagccatcgcccagttgctatgtatggcgcctaccaggcaccctctggacccggataagtccaacagcgcccatcacccgagctctcattgataagtattgcacacagagacaagcccagggggatgccccgcaggccgcagacgcgccgccacctcataaggctggcccagctggatcgtttgatacggagcagtatttgcggcatttggtacgccagcaggcggccaaccaccgggcgcat

SEQ ID NO: 64693 - DNA, 522 bp, Glycine max
  Peptide Sequence Number=SeqID_156378
ctggtgtacgccatcttgacgcggatgagcattcatgtggctcagttaatcgctgatgccatctatatatttgcaggtatggcgcctaccaggcaccctctggacccggataagtccaacagggccctgggatttcccgccttgatcacaggactctgccagtcgttcggcgtccccgtcgcacctagcaaggtgattcggacgcccatcacccgagcttttattgagaagtactgcacgcagagacaggtccagggtgatacaccacaggccgcggacacgccgccaccacatcaggctggtccagccggatcatttgacacagagcagtatttgcggcatttgggttttacttcttttctgtgccctactccggaccagttcagggcagaggtcgcatggcctggagattggcttgaggcccgggcaggagaggcaccagcagaggctcccgacggggcagatgaggcccgcgaggacgaggagatgaccgatttactggatttcttaggagggagcggg

SEQ ID NO: 64694 - DNA, 720 bp, Glycine max
  Peptide Sequence Number=SeqID_156379
atggtcattgaccagtcccttttctatgacttaaccaaattacccagtgacggtgtaccatttgaaggtacactgaatgatgactggaaatttgatttctctgcccatgatgcccgccagttggtttgcaccaacaatgcggatatgaccggatgtcttcttgccgggtcattggcttttgaaagctgcatccttcactatttaattgtgcgtattttgcttccacggtcttccaaccttgcccaggtttctgaggaagatctaattatcatgtgggcctttcatacagggcgtcaacttgactgggcacacttagtcagatatcgcatgcataaggcattgcgattaaatgctccactaccatatccacagcttgtcactctctttttccgccattttcaaattcctcttgattctgaaccttacgttccaatcaagagatcctttttaattggtgctgctgtgattgcttcttttgggtgctccaccgcggatgatgaaggcaaccaaccagttgaagataattcctctcttcttcgaaagcttttggaaaagttcgatggtcttcaaacttttgttggtgacaagtttgataatatggaattgcaagtcgacatgcggtttgatgccatggaatcaaggatcaccaaagttgaagaatatgtctccttcatccgtacttgctttgatccaccaccaccgcctccatcatcctcttag

SEQ ID NO: 64695 - DNA, 366 bp, Glycine max
  Peptide Sequence Number=SeqID_156380
atgggtgaccaagaggaggtacaggaacagatgagagtcgacatgtcggctttgaaagagctaatggcttccatgatggatgccatgctaggaatgaggcaactaatggagaaaaacgcggccaccgctgccgcagttagttcggctgctgaagcagacccaactctcccaactattgcgcaccaccctatcccatacgtggtaggacaagaaagaagcacactagggcacatcaggaacccccatctgggatacaacggagtggcttacccttatggattgccacctaattacacaccactagtcatacgtgatgacgcaggtcatgtccctccccccatccttgaaggggagcctcctcaatag

SEQ ID NO: 64696 - DNA, 390 bp, Glycine max
  Peptide Sequence Number=SeqID_156381
atggtgagggacaatgtagaggctttcttagattgggaaataagggtagagcaacaacttaaaaggaagtctacttcaaaattttatggctctcactattatccaaagcaagacgaaggtcaaggcatcttgagggtgacaccttctaagcccaaagatgataaggggaagacaatagaaaagcaaccccttaaggctaatatgcaagagaagactagctctataaagtgctttaaatgttgtggaagaggatacattacttctcaatgccccaccaagaaaagcatgattataaggctactacttcaccttcctctagtgaaagtgaagaagcaaaaggggaagaatctagtgaagaaatatacccccaagaaaaaggacaacctttaa

SEQ ID NO: 64697 - DNA, 588 bp, Glycine max
  Peptide Sequence Number=SeqID_156382
atggccaagttcgacccagacatagtcctcgagttttatgccaatgcttcgcctacagtggagggtgtacgagatatgcgatcttgggtgaggggtcagtggatcccattcgatgcggatgctctcagccagttcctgggatatcctttagtgctggaggagggccaggagtgcgagtatggccagaggaggaaccaggctgatgggtttgatgaggaggccatcgcccagctactgtgtatactggggcaggattttgcccggactactgctgggagacgagtgcggatcatgcgcaccaacatgaccaccctgaccaagatctggatgaccttgctgctcagcaacatccagcccagcgatcataattccgacctccccctgctgaagtgtcagctagtgtacgccatcctaacacggatgagcattcacgtggctcaattaatcgctgatgccatctatctatttgcaggtatggcgcctaccaggcaccctctggacccggataagtccaacagggccctgggatttcccgccttgatcacaggactctgccagtcgttcggagtccccgtcgcacctaccaag

SEQ ID NO: 64698 - DNA, 316 bp, Glycine max
  Peptide Sequence Number=SeqID_156383
agctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggtcacggcgagacgagccgtttctaa

SEQ ID NO: 64699 - DNA, 204 bp, Glycine max
  Peptide Sequence Number=SeqID_156384
atgggaagagatctcaagaaggcacactgccccacaaatgagtcatggcccgagaagaatgagaagaaaagtcatgaagaaagaagatctaagaaggcgtatattgcttgggatgacaatgactcatccgatggttcggagaaggagatcaaccttctatccaaggactatgagagcaatgagaacatctctcaagaagattaa

SEQ ID NO: 64700 - DNA, 62 bp, Glycine max
  Peptide Sequence Number=SeqID_156385
atggcgtcttctggtactcctactagcttcactaaggggcaagtctcaatgtatgtggccag

SEQ ID NO: 64701 - DNA, 159 bp, Glycine max
  Peptide Sequence Number=SeqID_156386
atggagctggaacggctgatcaaaagactcatagacagtggcattgatgatgctgaggaagaagaagaagcagctgaggaagaagaagaagcagctgaagaagaggaagatgcagcagaggatactgaatcagatgatgattctgaagccaccccatga

SEQ ID NO: 64702 - DNA, 177 bp, Glycine max
  Peptide Sequence Number=SeqID_156387
atggcggatttgcattcgggttttccaatagtggtaaccctaaccattaaagatggtggcctatggatggaatttccttcaggaaacagagaacttgaggaggccatgaatcttgaaattgtgaaactttctacaagatactgtagaaacaagcttcatgatgatgaatcaagttga

SEQ ID NO: 64703 - DNA, 171 bp, Glycine max
  Peptide Sequence Number=SeqID_156388
atgggtattactagtactattagtattgctcaagttgatgttatggatgagtttatacaatttgaagatgaagatatgtcacaagagggtaaatctcaactagatacatatttggaagaggcaaatctttcaaataaatatcatcccaatctagatgttttgcaatattga

SEQ ID NO: 64704 - DNA, 369 bp, Glycine max
  Peptide Sequence Number=SeqID_156389
atgaagataaagctggtgtttgctactcgtgatgatgttctacattgggctcgatttgttgcttatgaaactggatttgtggtggtaattatgaggtcatacacaaataatggtattagaggaaggacctcatttgttttaattggttgtgaaaggagtggtcagtatagggccaagaaagaaaaggatttgtcaatggtaaaaccaagaaatattcttctaatgttgaaggagcacaatgccaatagttatgcaataatcaagcaaatatacaatgcaagaaatgcttaccgttcttccataagaggcagtaatattgaagtgcaacaactaatgaagcttcttgaatgggatcagtatattcattga

SEQ ID NO: 64705 - DNA, 409 bp, Glycine max
  Peptide Sequence Number=SeqID_156390
atggattgcgggcagcttgaagtgtccataggagggaaggaagaaccacaaatttgcatgcagtcggaagagaagaaggttcctctaacccccaaggccctagtgatatgttttactagaaaagggaccggctccacacccatatacccccgggcggcgcccaagccaacaccatttgcatatcaaattaataaggccgtcccgtggaagtatacccctcccgcgtccagcaaaagagttgcaactgaagttgactccctatcagctaaggtaaccaacatcaccggcctcagtggcgtaacccgcagtggtcgggtgttcgcttcccctcactcgatggaattgccctccaaagggaaagcgcccatggtccaagagccctcagacatagcaaccccctcgaaagaga

SEQ ID NO: 64706 - DNA, 456 bp, Glycine max
  Peptide Sequence Number=SeqID_156391
atggcgcccactaggcaccctttggactcatataagtccaacagggccctgggattccccgcactgatcacaggactctgccagtcgttcggagtccccgttgcacctaccaaggcgcgcccaccaccacctcatcaggctggccaggctggggcatttgatatggagcagtatttacggcatttggttcgccagcaggcggccaaccaccgagcacatgtacagacccatgattgtctgtaccagatgagccttagcatgcagagccagggcttcgcttctttttcatgccctactctagaccagttcagggcagaggttgcatggcccagagattggcccgaggcccaagcaggagaggcaccctcagaagctcccagcgatggagaagaggcccacgaggacgaggagatggccgatttgcttgacttcttgggagggagtggagatacgtga

SEQ ID NO: 64707 - DNA, 287 bp, Glycine max
  Peptide Sequence Number=SeqID_156392
tgggttgtttcttagaacgccaagaaagaaggatatttcccaaaaagacacaaaagccagaagtggatcttctggtatcaacacagctggcccaatcagcatccgcaaaggcagtgaggctgagagagttctgagcagggaaaaacaaaccttgtctaggagcagatttgatatactacagaagatgatgaacagcatattgggatccattggtatattggaaggtttgcaggacaagaaacttgtatcttccaaaagacccgcagagtatactttcactggagata

SEQ ID NO: 64708 - DNA, 624 bp, Glycine max
  Peptide Sequence Number=SeqID_156393
gctgaagttgcggagacattacagtatatggtgtcaccgcaagggaggaacacatggaaagtggatgatctcgtgccttatgtggagaagatcacgattttatcagaagagcaagagagaatcactgagccagcggcacatggtccaacatcagagcatcgattcccaccggaggttgtggaagcgcaagaatatgacaaacaaattgaggagcgtggccatggaatgtattacatgccaccaacatttgcggagtatccttcacagatgtatcagtattcgttccaaggtcatcacactgatatgtttgcaagctcacattcgtttggtggtgttgcggaaacacatcctcatttttcatggccgactatggctcctgcacagcaacatgatgccccaatggccacacctgacgccccattagctccgcaatggaatgtacccggagcaatacctgatatgggtgacttattagatgttgatttgcgtcaggagttctttgctgaggctgaggaagtacaagcggcgaggtatcgtggcagaagaaatcctgatcgtcaagcgcgaagatgggatcgaccatgtggcacatcctcacgtcaccacggacatgataatgaatga

SEQ ID NO: 64709 - DNA, 630 bp, Glycine max
  Peptide Sequence Number=SeqID_156394
atgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggatcagatagatgacaggtggatggagtttgcggatcacttactacctgcgggtcagccttgtttagtgtctgggcaggtatctgcggattacattgagtggtttttccgcatatctcaccctttcatgacaccgacccaggcagctgaccagcagagggatgcaccagctgcagaccctgaggactacatacagctgcccagcccccaggatgattacgagggatatgaggcgattgcacagaggttggagcgtgtgctcaaccttaggatagtcactacaggcacagagttatatgacattatgcaggactgcctgacgatcgcgagagggggacccagtgctgatgggacggtcagggctcgtcagagacgccgcacggaccattga

SEQ ID NO: 64710 - DNA, 417 bp, Glycine max
  Peptide Sequence Number=SeqID_156395
atggatttcttttctgatgagagtttcgaatgcattcaagcatttcaaaactccaatctcattccctttatgtctctaaaattgcctgtgtattctgaattggtaaaagctttttattctaatcttgaaattcaagaaagtacattgatttcagaagtttatgggataaagatggtcattgaccaatcctttttctatgatttgactcatttgactagcgaaggtgtaccatttgaaggtacactagatgatgattggaaatttgatttttccatgcatgatgcttgccggttggtttgcactaaccaagcggatatgaccggaagactgcttgccagttcattggctcttgaaagccgcatccttcactatcttattgttcatatcttactcccaagatctttaaaccttgcacag

SEQ ID NO: 64711 - DNA, 483 bp, Glycine max
  Peptide Sequence Number=SeqID_156396
atggcgaaaccattaaagaagcacaagggttctttgagtcgaagccaacggcattccgaggctcaagaaacgcagattccctcctccatttcctcttcctcattgttctcatcagaagaacaacggatacggtacacaaatcttttctcctctcattccattattgatcctaagttcatagacatggatttcttttccaataagagttttgaatgcattcaggcatttcagaactcaaatctcattccttttatgtctttaaaattgcctgtttattctgagttagttaaagctttctattctaacctcgaaattcaagaaagcactttgatttctaaggtttatgggataaaaatggtcattgaccaattcctattctatgacttgacccaattatctagtgaaagtgtaccatttgaagttggtttgcaccaaccaagcggatatgaccggaaggcttcttgttggatcattggcttttga

SEQ ID NO: 64712 - DNA, 216 bp, Glycine max
  Peptide Sequence Number=SeqID_156397
atggcagaagatcgtccacaaaggatgacgctagaggattactctaatcctattatacctcaatacttcaccagcatagtcagactagaggtgcaagcggccaacttctcatatccatattccttgatccagcttattcaagggaacctatttcacggcctaccaagtgaagatccatacgcacacctggccacatacatcgacatttgcaacacg

SEQ ID NO: 64713 - DNA, 362 bp, Glycine max
  Peptide Sequence Number=SeqID_156398
gtattattaggcaccaaatccctatgataggtggtatgatgaatgtgttgagtggtgcaacactcttttgtaaaatcactcatgcacccaacatcttcatgatttttggacatagggactcattaggtaggaataatcaacatgaaaataaagaaaaaggtatgttttattccattacttttcctaactttttaaatagtgatcaagggcttcccatggaccctaagagaacaaaggtcattcctgagtggcctactccaccaagtgttgaggaaagaattcatgagtttcaagaacctctggatttgaggtcaaatccttttcaagggagagggaacatggtgttagctccattggagctt

SEQ ID NO: 64714 - DNA, 123 bp, Glycine max
  Peptide Sequence Number=SeqID_156399
atggcaggaaactctcccaacttctcttctgctctaagacacatgcccttaaaaagtcctccaatgattgaatggtccgttcagtttggccatcagtctgaggatggctctcccaaaatatag

SEQ ID NO: 64715 - DNA, 159 bp, Glycine max
  Peptide Sequence Number=SeqID_156400
atgatgcaatcctatcctctaagggcattggataaaagactccaagaagattgggtcagagatgcaagagaaggtcctaaggttctcatgagccttagggtagggtaccctagaaatgtagaatttttcagcccttgtattttagggcacctagactag

SEQ ID NO: 64716 - DNA, 900 bp, Glycine max
  Peptide Sequence Number=SeqID_156401
atgagtggcggaggaggaggagaagaggaagcaactctggagttcactccgacgtgggttgtggccgccgtttgcacagtcatcgtcgccatatctctcgctgctgagcgcctccttcattatggcggaaagtttctcaaagccaaggaccagaagtcgctctacgaagctctccagaagatcaaagaagagctgatgcttctgggcttcatttccctgcttctcacggttacacaaaacggcattaccaaaatctgcgttcgtcccagtttgacgcgccacatgctcccttgtaatctcgacgccggtgaacactccacgcctgagtccgagtccgccactaaaattggttactgcgtccgcaagaacaaggtacctttattatctttggaagcacttcaccatcttcacatcttcatttttgtcctcgctgtcgtacacgtctccttttccttactcaccgttgtcttcggaggcgccagaatacgtcagtggaaacactgggaagattcaattgctaaacagaactacgaaactggccgagttctcaaaccaaaggtcactcaggtacaccagcatgattttatcaggggtcgttttgccggttttgacaaagactctgctattgtcggttggttgctatcctttttaaagcagttttatggatctgtgacaaaatcagattatgtgacattgcgacatgggttcattatgacccactgcaggacaaatccaaagtttaattttcacaagtacatgattcgtgccctcgaagatgatttcaagcaagttgttggtataagttggtatctttggctctttgtggttatcttcttgttgcttaacatcaatgttaatttaaataacactttttgcggtgaaaaaggaatcgagctttga

SEQ ID NO: 64717 - DNA, 300 bp, Glycine max
  Peptide Sequence Number=SeqID_156402
atggagaccgttaagatgctgaatgttgtcctccccgacgtgcttctgacatcctctaactgtcccgattccatcgatctgtgcccaaagtccgtcgtcctcgagttcctccacttcgttcccatttccttcactcaatccttctggccccaccctttcagcgtcgattctatcgcctttttcttcctcgatttcaccagctacttctcagatgcccatcggaagcaccgatgtggatttgggtttcattttttttatagatctgattgtggagcggatctggttttgattttttggtag

SEQ ID NO: 64718 - DNA, 489 bp, Glycine max
  Peptide Sequence Number=SeqID_156403
atggaatacagaaaaaatcaacacaattttttaaactcgtcttcttcttcgaaccccatcaagcaacacagtgggagacagcaccttcgccgcctcgccgacgcaattgaacattatcaaatccagcaaaaacaacacagaaaatctccagaaacaataacaaagacagaaaatcgccggcgcaacccagatctcggatccgctacccatcaccatcccaaaacccccaccacccacctcttaaaccaacaaccgcgccgccgcggccgtttcgatcttagcaaggacgaagaggaaggattcgtcctcaaaaactcaaccacaatttttgaatgcgaggaagtttctcgaaacagagaaaaaaaaaacgaagagaaacggcaacgattttgtgcgatgttgatattgctgcagttgcgacgcggaggttgtcgaacgccggcggcggcgagaaatcgtgatcgtagcagcacaaaaagaaccgaatga

SEQ ID NO: 64719 - DNA, 864 bp, Glycine max
  Peptide Sequence Number=SeqID_156404
atggccattgaagcacagttgtttcccaacaatgctcctccgtttccgttttatgggtcaaagaatttaatggcagacaattctcaagcagcatatggtcataggcaacaaccagtagaacaacatcatgcctggcagatgaatcagaacatgtctcttgttgatcccaacttttcttgtttttctaattccaatgtccaccactacgccctccataagaacgttattcaacctttagcctcatatcctcaaagcttggctattgtgtttgatcaacagagggagattgatcactgtatcagatcacagaatgaaaaattgagtattttgttgcaagagcaaaggaaacagcatgtgtcagagttattgaagaaggtggaagcgaatgctcttcatttgttgagacagaaagatgaagaaattgcccaagcaacaaagaaaaccactgagttgaaagaatttctgacaaggttggaggtggagaaccaatcatggcggaaggtagccgaggaaaacgaggctatggtactgtctcttcataacaccttagaagagatgaaagaaagagctctgtatagggtgacagcagaggatgcagagtcgtgttgggatgaaaacatgagaaacagggcaatggaagaaggaacgggagaaaacagattgtgccgtggtggtggggtggaagaggttgaacaaattaggaaaaggacaatggattgcaaatgttgtaattctcaaaaatcgtgttttatgattcttccttgcaggcacctctgttcgtgtaaaacttgtgagccttttctgcaagtttgtcctgtctgtagtatgcctaaaaagtccagtatagagactttaattgtatag

SEQ ID NO: 64720 - DNA, 5688 bp, Glycine max
  Peptide Sequence Number=SeqID_156405
atggaaactcgtagtcgtaagcgggcggaggcttcctcagctgccccttcatcatcctcgtccaccaccaccaccaccgcctctcgttccgccaagtgctctcgtctttcttcttcttcttcttccatcccaaacacaactactgctaatacacgttctcgttccgccaggaacaacaacaacaactccgtttctcccatggaccccaccaatgaatcctccggttccagacgtgatcgccgcggcaagaatttcgatagggacaattcggacaaagggaaggagaaagaacatgatgttaggattagggatgcggagcgggagcgagccttggcgttgaacttggaggctgaagatgttggggatgacgacgatgataatgatagtgagggcggtgtcggaattctgcaccagaatttgatttctgccagtacctttcgagggcttcttcggaaacttggtgctggtttggatgatttgcttcctgctacggctatgggcggttctgtgccctcttctcaccagactggcggactcaagcagatattgtctggtttgcgtgccgatggggaagaaggtcgtcaggttgaggcattgacgcatctttgtgacatgctctccattggcactgaagattcattaagtacattttcggttgattcatttgttcctgtgctagtgggcttgcttaatcatgagagcaatcccgatgtcatgcttcttgcggccagggcgctaacccatttatgtgatgtgcttccttcatcctgtgctgctgttgtgcattatggtgcagtctctatcttctgtgcgaggctgcttaccatagagtatatggacttggctgagcagtctcttcaagcactaaagaagatttctcaggagcacccaactgcctgtcttcgagctggagctctgatggctgttctttcttacttggacttcttctcgacaggagttcagcgggtggcattgtctactgctgcaaatatgtgcaagaagcttcctcctgatgcagctgactttgtgatggaagctgttccacttttgacaaacctccttcagtaccacgactccaaggtcctggaacatgcctctgtttgtttgacacgaatagctaaagcgtttgcatcatctccagacaaattagatgaattgtgcaatcatggactggtaacacaagctgcctctctcatttctaccagcggttctggaggtgggcaggcttctctcagcaccccaacatatactggtttgatccgccttctttccacatgtgcaagtgggtctcctcttggagctaaaacgttgcttctccatggagctagtggcatacttaaagatatactatccggttccggtgtttcttctaacacctctgtttcgcctgcattgagtaggccagcggatcagatatttgagattgtgaacctggcaaatgaacttctgcctccattgcctcaaggaaccatttctcttcctgtcagctccaacttgtttgtgaaagagtctgttgtgaaaaaatctcctccttctgggaatcccgggatacaagaagacacaaatggaaatgttcatgaaatatcagctcgtgcaaaattattaaatgataagcctgagttacttaagcaatttgggatggatctcctcccagttttaatgcagatatatggtgctagcgtcaatggtccagttcggcacaaatgtctttctgtcattggaaaattgatgtatttcagcacagctgagatgatccagtctttgttgagtgtaacaaatatatcaagtttcttagctggtgtgttagcatggaaagatccacatgttttggttcctgccttgcaaatttcagaaattcttatggaaaagcttcctggaattttctctaaaatgtttgtcagagaaggtgtggttcatgcagttgaccaacttattttggctggaaatgcaactaatatatctacacaaacatcatctgctgagaaggatactgattctgtatctggaacttcatctcgctctagacgctatcgcctgcgcagtggtaattcaaatcccgatgcgaaccgttcggatgatttgaagagtccagttccagtaaatgttggtttgccaccaagttctgtggaaactccaacaactaattctagtatccgtgcatccattagctcagttgctaatgcttttaaagacaagtactttccttctgatcctgggtctgttgaagtgggtgttagtgatgatcttttgcatctgaaaaatctatgctcgaagttgaacactggtgttgatgaccaaagaagtaaggccaagggaaaagttgaagcttctggatttgatctggatgatgattctactaacacagaagagtatttgattggggtgatatctgacatgctaaaggaacttggcaaaggagatagtgtatctacttttgaatttatcggtagtggtgttgttgaagccttgctaaattatttttcttgtgggtatttctctaaagatcgaatatcagaaaccaatctccccaagcttcgccaacaggcacttacaaggttcaagtcatttgttgctgttgcattacctttgagcattgacaatggggctgttgctcctatgactgtcttggttcagaagcttcaaaatgtgttgtcctccttggagcgtttccctgtaatgctgagtaattcatctcggtcatctagtggaagtggacgtctctcctctgggctaagtgcattatctcagcccataaaattacgtttctgtcgagcccagggtgaaaagtcacttaaggattattcatccagtgtggtactgattgatccgttagcaagtctagcagccatcgaggaatttctatgggctcgtgtccagcgtggtgaatctggtctaaagtctactgtaggcactgaaaattctgaatctggaacaactcctgcaggggctggtgtttcatctccttcctcttatattccctccactgcctttcgttattcaaccggatccagatccagatcatctgttaatataggagatacacctagaaaagaaatatttcaagacaatggcacgagctcatctaagagcaagggtaaagctgtattaaaacctgcgcaggaggaagcacggggaccccaaacaaggaatgcagtgcgcagaagagcagctctagataaagacgctcaaatgaaacctgcaaatggcgactcaacttctgaggatgaagaattggatatatctcctgttgaaattgatgaggctttggtgattgaagatgatgatatttctgatgatgaggatgaagaccgtgaagatgtacggagggattattatcttcctgtctacttgcctgacgaagtgcatgatgtgaaattgggtgactcagctgaggagagtactgttgctcctgcaacaagtgatagccagactaatgcagcttcaggttctagcagcaaagcgggtacagccaggggttgtgactctgctgattttaggagtgggtattcatctagctcaaggggtgcaatgtcatttgctgctgctgctatggctggacttggatatgctaatagcagaggtttcaggggtggcagagataggcatgggcgcctgttgtttggtagttctaatgatcctccaaagttgatttttactgctggtgggaagcatcttaataggaatttgactatatatcaggcaattcaaagacagctcatgctagatgaagatgatgatgagagacttgctggcagtgaccgtgtatctagtgatggaagcagcctgtggggtgatatttacaccatcacttatcaaagggcagaaaaccagccagataaggcatccaatggtggatcaagttcaaatacttcaaaatctgccaaatctgggtctgcattaaattccagctcagaagctaaattgcatcagacatctgttctagacagtatattgcagggagacttgccatgtgatctagagaaatctaatcctacctacaatattttggcactcctgcgtgtgctggagggtttgaaccagcttgcgcctcatttgaggacccaaatggtttctgatagcttcgccaagggaaaaatcttggatttagatgagctaggtgttacaactggtgctagggtgcttccagaggaatttgtgagtggtaagcttactccaaaattggctaggcaaatacaagatgcccttgcactatgcagtggtagtcttcccttatggtgttgccagttgactaaagcatgccctttcttgtttccttttgacacccgacgacagtacttttattctaccgcatttgggttatctcgtgcattgtatcgacttcagcagcagcaaggcgctgatggtcatggatcaacaactgagagggaggtgagagttgggagattgcagcgccaaaaggttcgtgtctctcgaaatcgtgtcttggattctgctgcaaaagttatggggatgtattctagccaaaaagctgtacttgaagtagaatattttggtgaagttgggactggcctgggtcccacccttgagttttatacaattctaagtcatgatttgcaacaagttggattgcaaatgtggagatcttattcttcagaaaaacatcaaatggaaattgatagagatgaaaagaaaaagaaaagtgatggctctgggcctaatttggctggagatggagaacttgttgaagctcctctggggttgtttcctcggccttggcctacaaattctgatgcatcagagggtagccggttttcaaaagtcgttgagtatttccggctgctaggtcgtgttatggctaaagctcttcaagacggacgacttttggacctgccattgtcagtggcattttataagcttgttctcggccaagatcttgatttgcatgacattctgtccattgatgctgagcttgggaagactttgcaagagttcaatgcccttgtttgtcggaaacattatatagaatctattggtggtagctatacagatacaattgttaacttgcattttcatggggtgccaatcgaagatctttgcttagattttacactccctggttatcctgaatacaccttgaagccaggagatgaaattgttgatatcaacaatttggaggagtatatatccttggtggcagatgcaactgtcaagactggaatcatgcggcaaatagaagcatttagagcagggtttaaccaggtttttgacatctcgtctttacaaatttttactcctcaagaactagataatttgctttgcggctgcagggagttgtgggagtctgagacacttgctgatcatataaaattcgaccatgggtacaatgcaaagagccctgccattattaatttacttgaaattatgggagggttcacaccagagcagcaacgtgccttctgtcaatttgttactggtgcacctaggctgccacctggagggctggcagttctaaatccaaaactaacgattgtgaggaagctttcgtcaaccgcagttaatacttcatctaatgggaatggaccttcagaatcagcagatgatgacttgcctagtgtgatgacatgtgctaattacctgaaacttcctccttactctaccaaggaaattatgtacaagaagctactctatgcaatcaacgagggccggggatcctttgatttatcatga

SEQ ID NO: 64721 - DNA, 561 bp, Glycine max
  Peptide Sequence Number=SeqID_156406
atggcggagtggcatagtccttacggtaatggcaacaggatcacattaagcatatctctctctataactattcttcatactcctatctttctcatcctcccattcctcaatcataggtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatga

SEQ ID NO: 64722 - DNA, 1890 bp, Glycine max
  Peptide Sequence Number=SeqID_156407
atgtcgagcatcgtcaaggagatcctggcgagcccgatacaaatggcggaccaggtttcgaagcttgcggaagaggcccagaatttccgacaggaatgtctggaactgaaatccaaaactgagaagctggcgggcctcctccgccaggccgccaggaacagcaacgacctctacgagcgtcccacgcgccgcatcatcgacgacaccgaacaagtcctcgacaaggccctcgttctcgtcaccaaatgtcgcgccaacagcctcatcaagaagctcttcaccatcatccccgccacagccttccgcaagacctccatgcagctcgagaattccgtcggtgacgtccaatggctcctccgcgtctctgcctccgccgacgagcgcgacgacgagtacctcggcctccctcccatcgccgccaacgagcccatcctctgcctcatctgggaacaggtcgccattcttctctccggcgcttccttggacgaacgttccgacgctgccgcttccctcgtctccctcgctcgcgacaacgaccgttacgggaaactcatcatcgaagaaggaggcgtgccaccgctgttgaagcttctcaaggaaggaagaatggacggtcaggaaaacgctgccagagccatcgggttgcttgggaaagatcctgaaagcgtggaacacattgtcaatgctggtgtctgttccgtgtttgccaaggtcctcaaagaaggccacatgaaggttcaaacggttgttgcgtgggctatttctgaactcgccgcgaatcacccgaaatgccaggatcatttttctcagaacaatgccatacgcttgctgcatagcaagtacgccattgcgaacaaacacaaatccattcactcggttttaatggcgagtaacacaacgagcgcgcaggaagaggaagatgataagcagatggtggctcacccgggggcgaatcagtcagccaatctgatgcacaacgtggtttccaacacaatggccataaagggagccatggtggaggaggagaaagccaacaacaagaagcaacaacaacaacagcagcagcagcagcagagtgggaataattcgcaaatgtcaattgcagggacgagtattaaggggagggaatatgaagacgcggggacaaaggcacagatgaaggccatggcagccagagccttatggcaactctcgaggggaaacttgacagtgtgtaggagcataacagagtcaagggctctcttgtgtttcgcggttctgttggaaaaaggaccagacgatgtgcaatcgtattcggcaatggcgttgatggaaatcactgcagtgtcggagcaacattcggagctgaggcgctctgctttcaagccaacttccccggcagccaaggcagtggtggatcaactcctaaaagtaatcgaaaaagaacaaccggacctgctcatagcttgcgtgagatcagtgggaaatttggcgaggacattcagagcaaccgaaacaagactcatagggccgttggtgaggcttctggacgaaagagaggcgcaggttagcatggaagcggccattgcgctcaataaatttgcttgtacggacaactaccttcatgagaatcactgcaacgccatcatagaggcagggggcgccaagcacttgattcaactcgtttactttggggagcaaatggttcagattccttccgtcacgctgctttgttacatagcgctgcacgtccccaaaagcgagactctggcgcaagaagaggtgctcattgttctcgaatggtgcaccaagcaggcacatctcatcgaggaaccctccatccaaccactcttaccagaggccaagagcaggctcgaactctatcaatcaagaggaagaggattccgctga

SEQ ID NO: 64723 - DNA, 1971 bp, Glycine max
  Peptide Sequence Number=SeqID_156408
atggctatgccaggttccctttacatatggtccattgtggttggcatatgctatgcggtgccgcttgccattactctgccaactgcctcggagttatttggcctcaaatattatggtcttatatacaacattctcatttttaaccttccctttggttctttcctcttttctggtctccttgctggcattctctatgatttggaggcaactaccaccgcaggaggaggcgacacttgtgttggagctcattgttacagactagtattcataatcatggctgcagcttgtgttgttggcttcttcttagactttttttttgtcattcagaaggcatgtatgacacttcttgcattgacgagccttttgcacaatggtatcctaatttccattgatgggcccctatatgactccactgcctacactgagtgcaaagagaagccagaggaaccactttatggaggaggacttttcaagactgagcaacactctcgtcgtggcagcattgccaacaacagctatgtgccttcacttgttctgtataatctcactcagggcaccatttactctttttccgcatgggtgagagttaaagattcaagttcagctatgataaggaccactctggaaacggagaaagagacacatgattgcattgggacagtttcggccaagcatagatgctggtcatttctgaagggtggatttgttctgaattggccttcaaatttatccattatcttcttccagaacgctgatggtaaagatatcaatatagatgttgctagcccatcactccagccatttactaagcaacaatggagaatcaatcaacagtatataatcaacactcaaagaaagcgtgccgtcactattcatgtgtcagatagtaacggaaggagattggaaggagcttcgatctgtgtagagcaaatctcaaaagacttcccttttggatctgcaatagcaaagaccattcttggcaacgttccctaccagaattggtttgtgaagcggttcaacgcggcagtgtttgaaaatgagctcaaatggtacgccacagaacctgatcaaggcaaggtcaattacaccatttcagaccagatgctgcaatttgttagaacaaacaacatcatagcgagagggcacaacatattttgggaagaccctaaatacactcctccgtgggttcttaaccttacaggcacccagttacaatctgctgtgaattctcgaatacatagtctcatgagccaatacaaagatgagttcgtacactgggacgtcagcaatgaaatgctccattttgatttctacgaggaaaggcttggacctaatgccacattgcatttctttcagacagcacataaatcggatccattggcaactctgtttatgaatgacttcaatgttgtggaaacatgcagtgatgtaaaatccactgttgacgcctatatctcacgggtaagagaactgcaacgaaatggcatctttatggatggaattggcttggagggtcacttcacaatacccaatcctccccttatcagagccatcctagacaagttggcaacacttggccttcccatttggcttaccgaggtggatataagcaagacacttgatagagatgcacaggcaaattattcggaggaagtgctgagggaaggcttctcacatccctctgtgaatgggataatgctttggacggcattacatccaaatgggtgctaccaaatgtgcctgacagacaataatttcaagaacctcccagcaggtgatgcggtggacaaacttcttcaagagtggcaaacgggtcgtgtagagggagtctcagatgtgcacggttcctatagcttttatgggttcttaggagaatacagaattagtgtcaagtatggcaataacactacaaagtcaacattctccctctctcgaggtgatgaaactagacatttcactattacaatatga

SEQ ID NO: 64724 - DNA, 891 bp, Glycine max
  Peptide Sequence Number=SeqID_156409
atggcttgtgtttacccaggacagcttctcttgttgtgtctgatactgagcgtggttccaatagcagtttccgcaggcaatgacgcagcacccctgaccaaccatgggggacgcttgctgactggaaagttgaacgttggcatcttatggtacggcccaattccaaaggcccaaaagaaagcgattttgtccttcttcaggtccctgaacatgaacacccctgcccctgatgctgctaagcaaccccaagtctcatcatggtggaacattgtggagagctatggagctgcatctggcaataataataatatcccggtgaaggtggtaaaccaagttttcgatccaaactactcttatgggaaagtcttgatcaaagatttcattaagcccctccttcctaaggccactggtggaaacaaaaataccctcgctctcatcatagcctccaagggcgtgacagtgcaagatatgtgtgccggatcatgcgcccaacacggtcttattgaaaaccaaccttatgttgcagtggggaacccagaggaggagtgtcccgcatgtgcatggccattcctgccgagcaagggcaagacaggtgcaataatgaaaccgccaaacgggaatgttggagcagatgccatggtcaagttgttggctggtggtttggccggagcagtcaccaacccattcggagatggcttcttcgcaaatgcacacggaggcgatatcttggaagcaactagcaagtgtcctgatgatctttttgcaacaaccaaggtatccgtggatcttaaaactggtggagcctttaatgctgttggtgacaagggtaccaagttcttgctccctgctatttggaacccaaaaacttcttcctgctggactcccctgtaa

SEQ ID NO: 64725 - DNA, 759 bp, Glycine max
  Peptide Sequence Number=SeqID_156410
atggctgcgcttggggaacaatcagaagaacaagccatggctgcccaacctaaacctcagaaccgacgacccatttctaacatcgtcatcgtcgttggtgtctatgcacaatggtacaggtttccgcgaggggttccttgggttcgttatcaggggacatacaaagatcttaatataagcttgatttggcctggaaaagatccaactttgggggttgatagtgtaggcacgatatcatctgctcttgtaacgtatgctgctattcaagcattacaaccagacttgatcatcaatgcaggcactgctggtggcttcaaggccaaaggagctagtattggtgatgttttcattgtatcagattgtgcttttcatgacagaagaatacccatacctgtttttgatttgtatggagttggtgtacgtaaaacctttgaagcacccaaccttgtaaaggagcttaatctaaaggtgggtaaattgtctactggtgactctttagatatgacacagcaggatgaatcgtcaatcattgcaaacgatgccacagttaaagatatggagggagcagctattgcttatgtttctgaccttttgaaagttcctgcaatgtttgtaaaagctgttactgatatcattgatggtgacaaaccaactgcagaagaattcctgcaaaatctggcagctgtaactgctgcacttgatctggcagttgaacaagttattaattttattaatggaaagtgtgtatctgaactttga

SEQ ID NO: 64726 - DNA, 417 bp, Glycine max
  Peptide Sequence Number=SeqID_156411
atggtgacgacggcgaggagtgcgagcaggaattcgggcggggagagatctacggtgcttggaggtccagcgaacggtggcggcgacgggaaggggaggacagtgatttggaagatggagttgggagctctgacgaagggtggcagcagtgggaaggggatgacgtttatttggccggcagggctccacggcggagggaaggggagcggtggcggagcaacgaagacgttgggtgagttttgcattgtgacagacaaagagaatggagggatggtggggtcgacggtcggaaatctagtcgaagatacgacaaaggagatcagaatcaaatgggtgggagggagggagggagggagggagagatggggacaaagggataaaatggtaaaaggacagaaacaagaaaaagaaaaatag

SEQ ID NO: 64727 - DNA, 459 bp, Glycine max
  Peptide Sequence Number=SeqID_156412
atggcttttcgcttacctggttttagacgttcatcattcagtgcaagccaagcatcttctttcaaggatgaggaagtcccaaaagggtatcttgccgtgtatgttggagaaaaaatgaagaggttcttgattccagtatcatttttgaacgagcttttatttcaagaattgctaagaaaggctgaagaagaatttggttactatcatcctatgggtggtctcacgattcccttcatggaggatgttgcagaagtcccaaaagggtatcttgcagtgtatgttggagagaaaatgaagaggttcttgattccagtatcattcttgaacgagcctttatttcaagaattgcttagccaagctgaagaggagtttggttactgccatcccatgggtggtctcacaattccctgcaaggaggatgtgttcttaaatatagcttctcgcttgaaccggctataa

SEQ ID NO: 64728 - DNA, 87 bp, Glycine max
  Peptide Sequence Number=SeqID_156413
atggataaacctcaactgtcagagattgcgagagtacaagaccaacacggtttgatcaagagagcaaagcatgacaaaacaagctaa

SEQ ID NO: 64729 - DNA, 180 bp, Glycine max
  Peptide Sequence Number=SeqID_156414
atgggtgatgggtgtatttatgaagaggcagagagagacagaagcagagggttcatgtggagtgtgggggcaaagggtagcccacgggtgttttgggttctcccaatgccaacgttgacatggaccctatctcacaccctcactcacaattacatcaactacattcattcacctttataa

SEQ ID NO: 64730 - DNA, 192 bp, Glycine max
  Peptide Sequence Number=SeqID_156415
atgtgtaatactggcttaccgttccaggaggaccagacaagtggagagcatttgagaggctctgatactgcagttgctgaaacttgcatgaaggctctagatatttcttgtcagaaagctgatgaagataatgtgaaagtagaacaaaatactgtgaatgatttggccaaagagacggacctgaagtgttaa

SEQ ID NO: 64731 - DNA, 150 bp, Glycine max
  Peptide Sequence Number=SeqID_156416
atgaagaaagaggggacacaacagagatcagatctacatttcgaaaactctacagcggatgccactatggacattgctaatgataaatggggacaattatttcagataggcaaagaaggcctaaatctactgtggaaaaagttcctctaa

SEQ ID NO: 64732 - DNA, 1521 bp, Glycine max
  Peptide Sequence Number=SeqID_156417
atgaacaacagcagcagcagcagcagcagcagcagcattctcatccaattgttgttttcctcgcctcctgcatgggcaactctaatcgcagctgcatttctcctcctaactctaaccctctccatgtatcttctcttcgagcatctttccgcttacaagaaccccgaggagcaaaagttcctcattggggttatcctaatggttccctgctattcttttgaatcttttgtatcattggtcaatccatcaatcagtgttgattgcgagattctaagggactgctacgaatcctttgccatgtattgctttggaagataccttgttgcctgcctcggtggtgacgaaaggactgttcaatttatggaaagacaggctcgtctctctgttaaagctcctcttctacaactttcttcttctgacaaggccattgtcaaccatccatttcctctcaactacttccttaaaccctggaaacttggtcgcgccttctaccaaattgtaaaatttggcattgttcaatatatgctaaccaaggctttcactgctattctcgctgtaatccttgaagcttttggagtctactgtgaaggagaatttaaagcaggatgtgggtatccttatatggcagtggttctgaatttcagtcagtcatgggctttgtactgcctagttcaattttatacagttacaaaggaagaactggctcatataaagccattggccaaatttttgacatttaaatcaattgtgttcctcacttggtggcaaggtgtggcaattgctctcctatccacctttggtttgttcaaaagtcccattgctcaaggcttgcagtttaagtcaagtgtccaagatttcatcatttgcatcgagctgactgttgtaaggaaacattttgtccaaccattaaccgtgactgactcagttcctggtcctccatggcccagaatgcctgcaaagccttatgagcgaatgggagaccgcttttctggaagtgtttcagttctcggagattactcagctgactgtcctctggaccctgatgagattagggacagtgagagacccacaaaactgcgtcttcctacgccggatgttgataccaagagtgggatgacaattagagagagtgttcgtgatgttgttattggtggtggtggatatattgtaaaagatgtgaagttcactgtccatcaagcagtggagcctgtggaaaagggtatcactagattcaacgaaaaactacacagaatctccgaaaatatgaagaagcatgacaaaaatggaagaagaaccaaggatgatagttgcattgcctcatcatcacctgcaaggagagtaattcggggaatcgatgaccccctcttgaatgggagtgtcagcgatagtgggatgttgagggtgaagaagcaccgccggaaatctggatatacaagtgcagagagtggaggagagagcagtagtgatcaaggttttggtggctaccagattagaggccgtaggtgggttactaaagagtaa

SEQ ID NO: 64733 - DNA, 464 bp, Glycine max
  Peptide Sequence Number=SeqID_156418
gttgtaccatgtgtggtgaagctcatgagacaggccaatgcatccccactgaagaaaacactcgtgaaattcatttcatgggggaattagcagaggcaaggggtggatcctcaaacaagccaattcaacaaaggcctaacatctttcagaggacgactaagttggaagagaccctgactcaatttatgcaggtggggcaactggctaagcaaatagctgacaagtcatccaaaagttttggagtaaatatggaaaataatcctaaggaggaatgcaaggctttgatgaccaggagtaaaaggttggtggaagctgaggatgaagagagtgtggtgtacaaggagcaaatgggtgaaaagaaaggtgttgaggttaaggaaaatgatgggaagggtaaagagaatcaggaaaaagggaagaaagtaatggttcagaataaagagatggagaaccaagaaaaataa

SEQ ID NO: 64734 - DNA, 172 bp, Glycine max
  Peptide Sequence Number=SeqID_156419
gagaatgatagatctcatccagcgcaagttgttgcagcccagatacgcacactgctatttaaacatgaaggctgcacgggtttgagtaccaaccaccttgatgtcaccctaacatcaagtgttggacctgagtgtgtagagttgatctcttttgttcagagagcaatctctg

SEQ ID NO: 64735 - DNA, 573 bp, Glycine max
  Peptide Sequence Number=SeqID_156420
aacactcctttgttgcctggccaagccattttgagtgtggacgaggttaaagatgcagatgttgcagttcctgtacccactgttgaggtttccttagtggggcaggcacttcacaccttccttgcttggccgacacatctgatcaagtctttatcaaagcaggtagttgtgtcttcgccaaaaccacctccgaggcccgatccaaaggtcgatgatccgctttatctgatgacattgaccatcccagagcttttcttgaggccttatcaggttagatgggatgccaccttgttcggggtagttaatccagatttccccctgtacataaagcacgaagacctctccgaaatcgcacacggtggtcaatgtctcaacatatcagtgttacggttgtggattatgcatctcactgaaacatgtatgcgagcggggaattctgatatctatggattcctcgagcctcagtccattcagaggtctgggcaatcgcagtttgaatctgaaagttacataaagagttggatgcaaagttcacaacgcgatgtatatcttggagcctacctaaacgggtaa

SEQ ID NO: 64736 - DNA, 414 bp, Glycine max
  Peptide Sequence Number=SeqID_156421
atgagcagagctgcactgggagagactccacttgtccctccaccacaaattttaacctctggtatagtgttgacgggaccatcccaaccgaatgaatccaaggtcggcctaataagcagttgtaggcaggatttatgtccattacttggaaggagatcgatctccccccttacatcccggcgactgttgtcgaaagcccgcattaccatggagctcggtcttagatacatgcaaggttctattgtgtccccagccctcgacgggtatttcttcatcggtgaaagtaaggtagttgttggtcgtgatgttattgattacaccctcgaaacgctccacggatatgtcttgtgctacatgggcctcgttcaaaatcctgaccaacaactcccgatgaggctcggagttcataagtag

SEQ ID NO: 64737 - DNA, 165 bp, Glycine max
  Peptide Sequence Number=SeqID_156422
atgggagaaaaagaaggaatagtagcttctttggataaaatggcgaactcttttaaccgaatggtggaaaaaatggatggtaaagttgatgatgaagatattcaagaagtattacataaaggcaccgattatggagctaaaactgctatggatgttgatgaagcg

SEQ ID NO: 64738 - DNA, 139 bp, Glycine max
  Peptide Sequence Number=SeqID_156423
gagaatgatagatcttatccagcgcaagttgttgcagcccagatacgcacactgctatataaacatgaaggctgcacgagttttctaccaagtccgagattgaagattgatctctatattgttcagagagcaatctctg

SEQ ID NO: 64739 - DNA, 114 bp, Glycine max
  Peptide Sequence Number=SeqID_156424
atgaagatgctcttgataccacatgatatgaatggaagtggaatggagaaggaagagagagaggagacgccacttcaaggagaagatgagtctagaagaagctcaccaccatag

SEQ ID NO: 64740 - DNA, 264 bp, Glycine max
  Peptide Sequence Number=SeqID_156425
atggctagagccacgctcaatgataatttaacccctaagcacttatgggctgaagtagtaaatttcagtgaaatcatgataccggattttttaaccgttggatcatcttcaaattttgtctggatatccctaagtgagaatggtgcgctaagcgcaattccaaccgaggggaattgcgctgagtggcccaaagctgtgctaagcccaattataattgaggggaattccgctgagcagcccaaaggtgcgctaagcgaacactag

SEQ ID NO: 64741 - DNA, 366 bp, Glycine max
  Peptide Sequence Number=SeqID_156426
atggcggcgcagctaatccgtgatcgagtagagatggagtgcctagagggagcttgggagaccctcgaaggcaacacgaggtgccgatttcggggcactattcgattcacggctacttctttggtgcatccagatgaacctgcacggacgcttcagcgcactgtggagtggatactacccacgcctacaccatatcgtctagtggagcccgtccaagtgatcgagggtaacgccatccgagagggtgatgaggatccacttcttgaggtggattctcccgaggaagtcatgtcggcatctgaggcagactctatggaggatggtggtcctggggagatggcgatcagcggaggctcttcatcctag

SEQ ID NO: 64742 - DNA, 495 bp, Glycine max
  Peptide Sequence Number=SeqID_156427
atgactaggggcaatccaggcgatttaaaaccctttgatcctgaaatagataaaacctttcatagattagttaggcatagtgtgcatcctgatcattttgtgcattttgagcattctgagtattctgttgctagtgattctaaatattctgattttgagcattccactactaatttttatattgagaacatggctcaacctccacctcatgagaggactcttagggagatggctgcacctgatttcacttatgaaagcttgtgcattcaatatcctgatgagggtgttccatatgttctcaagactggactaatacgtttgctgcccaagtttcatggtcttgcaagtgaagatccttataagcatcttaaggagttccatattgtttgtttcaccatgaagccccctgatgtccaagaagatcatatctttctaaaggcttttccttattctctggagggagtggcaaagattggctatactacctgctcccag

SEQ ID NO: 64743 - DNA, 486 bp, Glycine max
  Peptide Sequence Number=SeqID_156428
atggattgctggggatctttggccgattgtccttcagaacaacaatttgatgaatgtctgaagaagctcgaaatagcttgcgcaccttggccaatggttgaatctgctcacttgtctttaaaaagactgttacaaaatagcattggagacttatgcagtgtgtgggatgccgtgaacaacatgattacgttgcagcacacacaaattaaagcatcatttgaacaagtacacatgtcgttggacatgtgttccaaaaaaccttatacaggaggctgcttggaatggtttcaagagcgtgttcactatgctggcaagaatccctcaagttgtggttgcgtgatgagaaccacgcttggtcttccttgtgcttgtgagttatccaaatatgttggtggttgcatcccacttgattcaatccatatgttctggaggagactcagtttttcagaccaaggattatctgagcccaaggtgggcatcaaggac

SEQ ID NO: 64744 - DNA, 210 bp, Glycine max
  Peptide Sequence Number=SeqID_156429
atgcccgtggattcactcggtgggggtcgttccctctacacttcaccaaaaactgaagttcgtagtggaagggcatttggtcattggatcgggggaggaggacatcttgtcttgcctatccgatatagcaatgatggtggcccgggtaaagttggggtatggctacgagcccgaaatgggtttaggcatgaacagcggcgaaccagtctg

SEQ ID NO: 64745 - DNA, 285 bp, Glycine max
  Peptide Sequence Number=SeqID_156430
atggctgggagaccgatggtaatttccaattctaacatagttaatcgtggatctactaatcccacaaggagcagtaatgttagcaacaacgatagcactagtggtggaagaccaaagggtatgtgtttgattgctgataaactactagatgtactctatgattcgggtgccacgcattcgttcatatctcatgcatgtgtggagaggttggggttatgtacgacgaagttaccatatgatatcgtggtgtctactccgactaacaagcctgtaaccacctctcgg

SEQ ID NO: 64746 - DNA, 237 bp, Glycine max
  Peptide Sequence Number=SeqID_156431
atgagagggctgcatgccctcgccttaagagggttacacgacctcgccttcagaggactacacgtcctcgccttcagagggctacacgtcctcaccttcagagggctacaagtcgtgatgcaatcctaccccgcaagggcattggctagaagactccaattagattgggctagagatccaaggaaaggccctagggttctcatgagccttagggtagatttcgagcccatgggctaa

SEQ ID NO: 64747 - DNA, 354 bp, Glycine max
  Peptide Sequence Number=SeqID_156432
atggtaaagtgtcttgtgaagttgcaaaccaaatttcgagaagatccaacggttaacgaaggctgggcagcgtttctaccgaggcagcttcatgtagttttctctagaagcttcattaagaggcttctagcacactccagacatcttctcaaagatcccaatgatcagatgattgacaagtgtcttgtgaagtttaaggccgaatttcgagaagatccaacaattgatgaaggctgggcagcgtttttaccgagacagcttcatgtagctttctctagaagcttcattaagaggcttcctctagaagcttcctcaagagcttctttgagaagctttcttaagaggcttctttga

SEQ ID NO: 64748 - DNA, 870 bp, Glycine max
  Peptide Sequence Number=SeqID_156433
atggtaagcatttgggacctagctagagtagaagtctccatggaaccaattgcatcccttgcccagtattatgtccagcccctaaggtgcttcacatttgaggacttccagctagtgccgactgtggaagagtttgaagaaatcctgggatgcccactaggaggaaggaagccatatcttttctttgggttctatccctccacgacaagagttgccaagtaccaaggaagtgtttggaggaaagggcaaaggccttggaaaatcaaggcaaatgggctttcttttattgacatcttggcgcttttgatctttggagttgtcctctttccgaatatggaagggttagtggacctagcagtgattgacgctttcctcgcctttcatcatggtaaggaaagcccggtcgtcgccattttggccatgatgtctaaaggttcccttgatggaacaaggggttgtattaattataatcccgtcctcgccataagacagcttggctacctcatgagaggagtgccatcagacgaaagcatcacgcctttcatcgcacggggtttcagtgaccacaacgcgagggacagagagcttaggggaagccgtaatgggatcatcggcggctatcataagtggctgagagtccgaacacaaggattggattggctcccaaatctaaagactgtgagagatgatgaggttaaagcttcggaagaaagtgatgaggtacaagccctaaaggcagagcttgaaagagcccgggtagtcgaagagaagttcaaggcagcaatagtgagcccaagctccgaagaggtgaaaggaatcatcacgggtcaaaggcatgatctggaaggacgagctaaaggcttgccttag

SEQ ID NO: 64749 - DNA, 151 bp, Glycine max
  Peptide Sequence Number=SeqID_156434
atgggtgccaagcacctcacaaggaccaaacaaaagttgcatgtcatcaagcaaaggcataatctccataaacgcctcaccaatttggttgatgggagcatagatgtggctttggtgaaaaaattctatgaaaacctatacagctctgagg

SEQ ID NO: 64750 - DNA, 246 bp, Glycine max
  Peptide Sequence Number=SeqID_156435
atgacgaaagacaacgattgtacctcaaagccctacactggggcaatgaaaggccccatgcataaacctcaagcgaacctaggggtcatgacgaaagacaacgattgtacctcaaagccttacactggggcaatgaggggcatcgtgcatgagcctcaagtgaacataagggcagatcaaaagttctcacccgtcgatgtttttaaacaagaaaaaaaagggagacaagccttggaatttcaatag

SEQ ID NO: 64751 - DNA, 564 bp, Glycine max
  Peptide Sequence Number=SeqID_156436
atggcatcgtttagccagatgcagtcccagatgcaatctcagggacttgcactacctcccgagcctctggttggtccctcaggtcctcaagtaagcacaaaggggagttgtattgatcccttaggaaacgatcctgagacgggttactcagataggtgcggcttgtacatcgaagcagatcctgcctgcctggttgccctggggagagtttatgagggatccactgttattcataacactcatttgttgcctggccaagtaaaggtgggtgtggaggaggttatagatgcagatgctccagttcctgtacccactgatgagacaactgtgtctctggcaaaaccacctcaaaagcctgatccggaggttgatgatccgctttatctgatgacattgaccatcccagagcttttcttgaggccttaccaggttacatgggatcccaccgtgttcggggtctttaatccagactttccgctctacataaagcacgaagacctctctgaaattgcacatggtggtcaatgtctcaacatatcagtgttacagttatggattcagtaa

SEQ ID NO: 64752 - DNA, 63 bp, Glycine max
  Peptide Sequence Number=SeqID_156437
atgcatgaaatggcttctgagaaagcttccctgcaagagatccaggaaggacaaagcggctga

SEQ ID NO: 64753 - DNA, 231 bp, Glycine max
  Peptide Sequence Number=SeqID_156438
atggcagtaggaaacgatgtatgcatgattcatgattttgaggggaagtgtctaagtagaatctcctctatcccgactataaactgtttgaaagggggagattctgaagtagaagaagaagctgccgaagaagaggaagaagcagccgaggaagaagaagaagctgctgaggaagaggaagatgcagcagaagagacagaatcagatgatgattctgaagccaccccatga

SEQ ID NO: 64754 - DNA, 267 bp, Glycine max
  Peptide Sequence Number=SeqID_156439
gaacatgaaatggaactccaacgtctcaaccaaaatgaagaaactgacaaaaggaaaagaagcatagcactcaaagcctcttcctcaatgcaagaagaagaagaagaagaggaatctgatgatgaagagcacttctcactctttgtgaagaagtttcataaatttttcaaaaatagaagaatggagagaagccataatttcaacaatgggaaaagatctcaagaagtttctcctacacttaaatgctacaagtgtaatcccttttga

SEQ ID NO: 64755 - DNA, 180 bp, Glycine max
  misc_feature (12)..(12): n is a, c, g, or t
  Peptide Sequence Number=SeqID_156440
atgggaaagaanttgatcagtttcatcaaccgtctggtagtaatgaggttgccattgctaatgaggatggatgtccctaagttgcaggaatatctgaagaagcatttcagagagtttaggcatgtccattgctgtcctttaaagcaggattgggtgaaggatcaagctgctaataaatag

SEQ ID NO: 64756 - DNA, 690 bp, Glycine max
  Peptide Sequence Number=SeqID_156441
atgtcttcatttctgtctgactctgccatcgacatgggtggtaacgattctggggattcaattcaacaacccctgatggaccaggaggttattttcattggcagttcctcgaaggaggatactcgttgcaatgcctccgacaacgaatcctcttctttggagaggttaagggtttcgtgtcatactggtggaggcacctctcgtctccacaggaagacgtggccttccgctacctccccagccagggagcttatcccggtcattgtgattctctccccttcgttttctaagggagcaaggacaagtggtagggacattagggcgtctccccacgtgcgacgtagccatagtgttgggtcgccatcatcctcacctattgttactggatatgattgcgtgagggatgatattttgaagtataagtcctctctcacctttgcggtgagtgtcgctgctatgcaatgccaggtgaagctggcaaatcttgacgactcctggaaggtagtcgtccagccttgcaggagtaatgacttctctttcttgagggcagcatcgggcaattcacccttcttcttcatatacaggtgtctatttgaggtcttggatctcattctccccttgaccgcatcccaatgtgctctgcttaagcatttaaacgtggtcttttctcagctccacccaaacgattga

SEQ ID NO: 64757 - DNA, 222 bp, Glycine max
  Peptide Sequence Number=SeqID_156442
atggatgcagaattcacagagagatgtgtacctaggagcctacttgaatggggattcaaggatagtcaaggaagtaaatccaaggttgctactagatggattatagttaaaagtttggctcacctcgcatggctgagcatttgcttgctacactccattgccacatcatatagtcacactttgtgcatgtccttcatgctttacatgtctcatgacacctaa

SEQ ID NO: 64758 - DNA, 261 bp, Glycine max
  Peptide Sequence Number=SeqID_156443
catcaggttcttcatagtcatccacctattcatctgctcccacgaacacaaggttcgagatcatcaaatgatccaaacacaaatagcacatcgagaggagaccagtcagggtcgcagtattttgcgagaatgctccaactatatgggatcaacataggcttaaaggagcactcaaaccgggtgacccccaaggcctacactccgaagagttcgtcagggcctctccctcctgattcaggtccaacccagaaaacattttag

SEQ ID NO: 64759 - DNA, 411 bp, Glycine max
  Peptide Sequence Number=SeqID_156444
atggaaacgagtccgttgctaccttgtctctctagtgcagccctaatggtggcacgggtaatgctcaggcacggttatgagcccggaatgggtctgggcaaggacagtcacgggaatgccgatgtggtcgacattaggggtaacttgtacaaatatgggttggggtatgaacccgggaagccgggaagaaggaatgcaccgtcaagactccgggcagatagggcatggcccggccatgttagccagtgtttcataagtgccaggataatgttcgaggaagaggtggtggcaataggagaggagtctccacaagatccgccaagtttcgtgcgaccatgccatcccaattcccaagtggggaactggcgcctgatgagccagtcggaagtctattccgctgaaacaatgtaa

SEQ ID NO: 64760 - DNA, 261 bp, Glycine max
  Peptide Sequence Number=SeqID_156445
tacttcttagtccaatagatcttaatgtggttggccccttgcttcttgctcaatttcttcaaggtatgacaccaatcctcctttccaattccctatatggcaactcacaagcaaggaaacatattgcggcagtagggactaccagcaacaatatgttatcaaagagaaaaactctagatgagggttcactgttatcaagcaagtcggagacccagcatgaccacgaattcacctccactccttatgttcccatggacccgg

SEQ ID NO: 64761 - DNA, 868 bp, Glycine max
  Peptide Sequence Number=SeqID_156446
cagaggactacatgtcctcgccttcagaggacttcacgtcctcaccttcagagggctacacgccttcgccttcgtaggacttcatgtcctaaactttacagggctacatgccctcacctttagaggtctacacgtcctcattttcagaggacttcacgtcctcaccttaagagggctgcacgccctcaccttcagagggctacacgccttcgcattcataggactacatgccctctccttcaaaggacttcacgtccttacttttagtgggctacacgccctcaccttcagaggattgcacatcctcaccttcagaggactacacgtcctcacctttaaaggactgtacgtcctcaccttcagaggattgcacgtcctcacctttagagggctacacacgctcgccttcaaaggactacacaggactagatgtcctcgcctgcacgccctcgcctttagaggactagacgccctcgccttcaaaggaattcacgtcctcacttttagagggctacacgccctcaccttcagaggattgcacatcctcaccttcagaggactacacgtcctcaccattaaaggactgtacgtcctcaccttcagaggattgcacgtcctcacctttagagggctacacgtcctcaccttcagaggactacacgtcctcaccttcagagagctgcacgttctcaccttcagaggactacgcgccctcacctttagagggttgcacgccctcgccttcaaaaggcgacacgtcctcgacttcagtgggctgcacgccttcgcctatagacggctatgcgtcctcactttcaatgggctccacatctgcactttaagagaatttaaggtcctctgcccttaa

SEQ ID NO: 64762 - DNA, 228 bp, Glycine max
  Peptide Sequence Number=SeqID_156447
atggcttcctatggtggttattttgatgatgccaaagaatcaagagtcaagaaaaatccaaagattcaagaatcaagtttcaagaatcaagattcaagattcaagaatcaagctttaagtttcaagattcaagattcaagattcaagaatcaagattcaagaataatcaaaagattcaagactcaagattcaagaatcacgagaagactcaatcaagataagtattaa

SEQ ID NO: 64763 - DNA, 393 bp, Glycine max
  Peptide Sequence Number=SeqID_156448
atgaatttttctgagtaccttgcaccggtgggtcagatttgtgttatgtttggacagtgtgcaacatactacatcgactggttctacatgatttctcatcccatcatgagaccagcatggcccgaggatccaactagacatccatctgtcatgcacgatgacacatatgttgaaccggatattcctcaatacccagtggcggcaacaactatggaggaagcacctgcagatgcaccttctcatgatgtttgccaagaaattgttgaaaggttggaatgtttgctgaatctaaggatagtcacagaaggatcgctagaggtatcactgtggaatgctatgtatatgtgcggtcgcgacgaaggcagcgtatggaagacgcctgaagacatttag

SEQ ID NO: 64764 - DNA, 423 bp, Glycine max
  Peptide Sequence Number=SeqID_156449
atgacttggaatggaacttgccctgttatgccctctcccatcagcggggatttcctcttcagcgaaggtgaggtaattgttggctgtgatgttattgacgatcccctcaaagccttctatggagatgtcttgggctacgtgagcttcattcaagacttttaccaacaaagctcagtgaggctccgagctcgtgagcagctccagaagggagactctagacgaggtcttgttgagttgctcaatgactttgactcgctttgttggataatgcggaggaactcgccggcctcctcgagtgatacctctttcttgccgtatccctctcttccctcgggaaattccttcatcggagcatcctcgttcggttcagggatcaccttgacattttatccttcggtcaagcagtatgcccgggtgcattaa

SEQ ID NO: 64765 - DNA, 765 bp, Glycine max
  Peptide Sequence Number=SeqID_156450
atgattcctggtcaagcccctgttcctgaaaaactggttcccaaacgacaacagggagtgaagatttctgaaaaccctagccttgcaacaagtcctagggaagtagacacagagatggataagaagatccgcagtattgtgagtaacattctgaaaaatgcttctgtccctgatgctgatgaagatgttccaacatcgtccaccccaaatgtttctgttcctgatgctgagaaagatgttccaacatcttccaccccaaatgctgaagccctcccttcacccaaggtagaatctgatgaggaacccattgccaacaagttggcacctggcattgcggaaagactacaaagcagaaaaggaaaaacccccgttaagaggtctggacgaatcaagactatggcccagaagaagagcactccaatcactcctaccacatccagaaggagcaaagttgccatcccttccaagaagaggaaagaaatttcctcatctgattctgatgatgatgtcgaactagatgtctcgacatcaaagagggccaagaaatcagggaaaaaggtgcctgaaaatgtccctgatgcaccattggacaacatctcattccactccattggcaatgctgaaaggtggaaattcgtgtatcaacgcagacttgccttggaaagagaactgggaagagctgccttggattgcaaggagatcatggaccctcatcacggctgctggactgctgaagactgtcaccaagttgggagattgctatga

SEQ ID NO: 64766 - DNA, 216 bp, Glycine max
  Peptide Sequence Number=SeqID_156451
atgctctcgggaacggaagcttctagcacactccagacatcttcccaaagatcccaacggtcagatcatggacaagtgtcttgtgaagttgcaaaccaaatgtcgagaagatccaacggtgaacgaaggctgagcagcatttttaccgaggcagcttcatggtgttacaatctacatagattagagcttgaagcaggagccggtttgaaagcttga

SEQ ID NO: 64767 - DNA, 123 bp, Glycine max
  Peptide Sequence Number=SeqID_156452
atgtaccctcctgatgcaatcctccctaggaagggaccaatcactagaaccatgagcaagaggctccaagaagattgggctagagctgctgaagaaggccctagggttctcatgaaccttagg

SEQ ID NO: 64768 - DNA, 537 bp, Glycine max
  Peptide Sequence Number=SeqID_156453
atgacgtctgaggcaacaaaggaaattgctaagaagattgattctttggaggagcaggtgtcacagggttcctttgtcccctatggacgtcaagatctcctgactgttgcaattgggcaaccagaacaccctgaccgtgttcgtactgctggaattggtgtgaccataaagcaatactttggatcggctccacaaacctcccgcacttcttcctccatggctcccgaagaactagagcaactgactcaacaaatcaggggccagctggaggagttgatcacagaaaaagtgactcggcagctaatatgcaatcacagggacttgcactacctccggagcctgaggttggtccctcagctactcgtgtcagcacaaatgggagttgtgttgatccctcagcgatcgatccagacacgggtgactcagacaaatacaggttgtacatcaaagaaaatccttcccgcctggttgccctatgaagagtttatgagggatccacagccattcacaacatctctttgttgcatggccaagtga

SEQ ID NO: 64769 - DNA, 231 bp, Glycine max
  Peptide Sequence Number=SeqID_156454
atggcagcagaatggagaaggaagagagagaggagacgccacttcaaggagaagatgagtctagaagaagctcaccaccataggaggccatggataagagcttggaggaagaaggagatgaatgaagggagagggagagaagaacacaaaattttatgctctaaaagagctctaaaatctgaacccactaatccaagatcaattccaagattctctactaagtgtgcttag

SEQ ID NO: 64770 - DNA, 207 bp, Glycine max
  Peptide Sequence Number=SeqID_156455
atgggggttcaaatagcaaccaggctcacttgggacttccaggatgttcctctagaaggcggttgcttctggaggaagcaacctagcccgcctgggggaaggagggaagaacaaaaatgttcaaccctcctggtatctgagattcacttaaaattagtgagaaaaattgtttccgtgaagaaaatccaagccgaggcgcttccgtaa

SEQ ID NO: 64771 - DNA, 730 bp, Glycine max
  Peptide Sequence Number=SeqID_156456
atgaattcctccatttatattcttgtctttgtccagctttggttgttgagcttaccatgcagagagagtgtgtgcatcccaagtgagcgtgagacacttttgaagtttaagaataatctcaatgatccttcaaataggctttggtcttggaatcataataataccaactgttgccactggtatggagtcctctgccacaaccttacttcccatgttcttcagcttcacctcaacacttcacattctgctttatatctttactactatgatgatggattccaccgtatattcgatgaggaagcttataggagatggagctttggtggagagataagtccttgtttggctgatttaaagcatttgaattacttggacttgagcggcaattatttccttggagaaggtatgtcaattccttctttccttgggacaatgacttccttgactcacctcaacctctctgatactggattccgtgggaagattcctcctcagattgggaatctctctaagcttcgatatcttgacttgagctgcaatgaattccttggagaaggtatgtcaattccttctttcctttgtgcaatgacttccttgactcatctcgacctctcttatactcgattcatggggaagattccatctcagattgggaatctctccaatttgctctatcttggccttggaggtagttatgatctgtttgctgaaaatgtagaatgggtatcaa

SEQ ID NO: 64772 - DNA, 447 bp, Glycine max
  Peptide Sequence Number=SeqID_156457
atggaggatggccagccttgcagaatggcagagttcattgtggggattgtcattggtggagggacctcaggaaaatatatcagcacaatgtattcaagattattcatcaaaacatggcttggaaggcagcagaatgatctcatttcaaacatgggtagcttctaccagaacaattggagatgggatttgaaatggaggagacacttattcgagcatgaggagggagtagttgtggctttcatggaagagatcagtgcttatcctattgagtgtcatctgaaagataactttctgtggaaagctgatcctactgggatgtactctactagatcgacttatagacttctgtcaaatctaaatagttttgccccagatgggaggaactttcaacttatttggaaattaaaaatcccccaaaggctgccattttcacttggaggcttataa

SEQ ID NO: 64773 - DNA, 868 bp, Glycine max
  Peptide Sequence Number=SeqID_156458
atggaaacgctgcttgacctgaccgcgcagatggcgcgcgagggtattcgtcgcctgctggtgctcagcggcgacgaacattggtgtctggcgcaggccgttgagctgcgagagcggctgggcggcgatagtctatgggttggcgcgttgccgcagcaggaaccctgcgtggcgtcgggcgcgctgaaaacgctgctcgggcgcgagttcctgcatgccttcttcgatgctcgtcacggttttgacgtggcggcttttgctgccctcggcggtacgctccgcgccagcagttggttagtgctcctcgcgccggattttgcccgctggcctgagcaggcggatggcgattcgctgcgctggagcgatacgtctgaaccgatcgccacccctaactttgtccatcgctgtcttcaactctttagcgcggatcctgaggtcgcgctgtggcgacagggcgacggcttacggttgccggaggccgcgccgcgcagagactggcacgctgccgatggctacccgcaggccgaacaggccgccattctttcgtcactactgtcatcgcccccggaaattgccgccgtcaccgccgggcgcgggcgcggtaaatcggcgctggcgggaatgttgatccatcagctcgccggctccgccatcgtcaccgcgccgacgcgcgacgcgacagcggtcatcgccgcttttgcgggacagaagatgtgctttatggcgcctgatgccctgctggcaagcgacgcgaaagccgactggctggtggttgatgaggccgccgctatcccggcgccgacgctacgccagctgacggcgcggtttccccatacgctattaacgaccactgttcagggctatgagg

SEQ ID NO: 64774 - DNA, 319 bp, Glycine max
  Peptide Sequence Number=SeqID_156459
tggcctcgaaaaaccaatagaacagtgctcttccttgagtttcattgacagtgatataaccaccatattgttgaacttcaccggatgctgcgcagcagatgatgagagtgatgagcaaaatgatggcgacagcgacgaagtctatttcattgaagcccttaggaagagacgggaccgtgaggcgccatttggcggaggagattccgattgtggtgacgcggaggtaactaaagtcgccgccagcgacgggcatgtcgactacaaacttggtgtagcagaaggcggagtggagggcgcaaaagccggcaatggcaattaa

SEQ ID NO: 64775 - DNA, 1099 bp, Glycine max
  Peptide Sequence Number=SeqID_156460
ggttttgcggttggtcgccgcagaacacactgtgttacgtcaacgcaaaaagtatacgcgatcgaggacgaacgcgcaattccggcacggattttgacggggccgcagttctaccggcgcaatgaagtcctggctgaaacgggtggtgccgtcagtgccttaacccctgaagtgagcacactgtgttacgtcaatccaggtgctggcaacaggcggcggaaagggaatgctatgtcgcgtctgttaattgagcctgttacgcctgatgaaccgggctatatcgccctgaaggcggaaagtatcgcattgaatttcaacatgctgcgcaggctggaagagaactggcagcggggtgaaaaccgctttaacgcgccgggcgaaaagctgctgggggcgtttcttaacggcaagctggtaggcgtatgcggtctcaaccgcgatcccttcagccagcaaccgcgcgccgggcgcattcgccatctctatgttagcgagaagtgtcgcgggttgggcatcggcaaacagcttttaaccgtggtgatggccgatgccagcatctggtttgatttcctgaatacccacgcgccggataccgcgtatgggttctaccgccgggcggcggctccgctacgctattgcgctggtgttgctccccttctctccacagtcttctgctgcaagctggccgtttttagtcggctcctgcgccttactggtggtgtacaccgtgctggtggcgaagacctatcaggtctccgatatgagtcaaacctacccgctgatgcgcggcaccgccccactgctggtggcgctgatcagcgtcctggcgctcggcgatcgtctctcctggctggcctgtcccgtacgagggatctggctggcgctactgagcgcctgtttgatctccggatatacgctggtggacggcaccggggtgcggctctcggacactgcgctgggctacacgctgtggacctcctttatgaccggtttttgcctgctgagctgggcgatggtggcgcgtcggcgttgagcctttggctacctgcgtctgcgctggacacaggggctgctcgggcggcgtcggtaccatgggctc

SEQ ID NO: 64776 - DNA, 399 bp, Glycine max
  Peptide Sequence Number=SeqID_156461
atgaaagctatgtcaagcaagcccacaagaaaaggaaggaagtggtacttgaacacggtgatgatcctgaacatttgaggacaaatgttttccaagaaggagggaatgatgagaatcctgaaattggccaaatacaggctaaaggcccaagtggagaagggcaaaggcccaagtggagaaggataaagcccccgagtaatccttgtggcgtctacccatacttatcttccttcattggaagtggcgtctacccagacttatcttccttaaccggaagtggcgtctacccagacttatcttccttcactggaagtggcgtctaccatgacttatcttccttcactggaaatggcgtcatccaaaccttcgtagcctgtatcaaacgatccgccccgtcag

SEQ ID NO: 64777 - DNA, 432 bp, Glycine max
  Peptide Sequence Number=SeqID_156462
atgaccaagaatagggtgttgaaagagcataacaagactttcctaaattggtttaaagatacaatctttagtgatgataatgcttttgaaacgctaaggaagcacatggttacaccacccagcttccctcctcctcttcctgagtcggcaacaccttcatcgtctatgttgaagaagataataaaagcaacatggctcagatcattggctactagacaagttggggcagagagattagtggttcatagggatcctgccactgggaaagccgatggtccttatagaaagaaattaagaacgtatttggggattgtcgctcacgataaggtggatgttacatatgataatttgaaacaagtccctgcaactcaaaaggatttgatctatgaggatattcaagctgaatttgatgttcctaaagcatccaattga

SEQ ID NO: 64778 - DNA, 739 bp, Glycine max
  Peptide Sequence Number=SeqID_156463
ccttctgggcgccgcagctgcaggtgccggtgatcgcgctgaacgaagactggttcaaccgcggcgggccgcgcatcctgttggcggcgcagcagctgtgccgccagctggcggagatccgctgatgctggtgttctggttggatattctcggtacggcggtgttcgccatctccggcgtactgctggccggcaagttgcgcatggatccgttcggcgtgctggtattgggcgtggtcaccgcggtcggcggcggcaccatccgcgacatggcgctggccaacggcccggtgttctgggtcaaggatcccaccgatctggtggtggcgatgatcacctgcgtcttgacgctgctgctggtgcgccagccgcgccgtctgccgcagtgggtgctgccggtgctggacgccgtcggactggcggtgttcgtcggcatcggcgtcaacaaggccttcgcagccggcaccggcccgctggtggcaatctgcatgggggtgatcaccggcgtcggcggcggcattatccgcgacgtgctggcgcgcgagatcccgatgatcctgcgcaccgaaatttacgccaccgcctgcatcatcggcggcatcgtgcacgccacggcgttttacaccttcagcatgccgctgcaacaggccatgatgctgggcatgatcatcaccctggccattcggttggcggccatccgctggcacctcaaattgcccgcctttattctcgaacgctga

SEQ ID NO: 64779 - DNA, 609 bp, Glycine max
  Peptide Sequence Number=SeqID_156464
atgaatgctgagagagttgaagactctttagatttagagagagttgaagactctacaaatgcggagagggtcgaagattctttagatttagagatagttgaagactctatggatattgagagagctaagtccgcagcgttgttttcccttgaggatcaagcacagttctctttgagttattcctccgactgctccgatagaattcacaaacgtcagagagacggagaagagattaaacctccacttgtactgtcttcatgcgaatcctttttctccctccaagaatattatcttgaaaatcccaacggtggaagtgtgcgcaattacatttcgaacaacatatccaaatttaatgaaaatccaacgctcaaatataatgtcgaaattcccaacggtgagaatgctcggaattgggttgctaacgtggtgctcaaatttcacgacgatccaacggtgaatgagtccgagatcgtcatttttctgagacatgttaggtggcttacgggaaaagagagggctttgggagaaaagagaaaaaaacgaaagtgcgaggcagaggaaggaggccgaggagtcaggctgaaaactgaatcatgttgctatttatag

SEQ ID NO: 64780 - DNA, 406 bp, Glycine max
  Peptide Sequence Number=SeqID_156465
gggattgaacccatagacaacctccaaaggggattgcttagtggttctatgaacccccttgttgtaggcaaattctacatgaggaagatactcatcccaagacttatggttgcctatcagaagagccctaaaaaggaccataaggttttccagaagtggctaaggaaattagcatctctatctgacacaatggtcctaggcaaaccatggagtctcacaacttccctgaaaaagagttttgagatgtgggaagcatcatccaccttgtggcatggtataaagtgtgccttcttgctaaacctatccaccaccatagagatagagtctacaccactttgggttctaggaagcccaaggagaaagtccatactaatgtctacccaaggtgcagatggaatgggtaagg

SEQ ID NO: 64781 - DNA, 994 bp, Glycine max
  Peptide Sequence Number=SeqID_156466
tgaaatataccaccaaatgcttagtgccttcgaaaacttccctcatctgcggactgcatacatatatgctgctcttcactcccctcatcgccgacttccagccggcctcgatctatcatctgttgcaacagataaatctcttggggatcgtcacgtccttcaaaggcttggatctgtgcggcctacccgactcgacgacattaattgctccccctccatgattggcgagcgggcatttttcggtggagtggcccggggttttcccatggtatgcgcaggttgcgtcagggttataccactttggaaaaggaggctagttgatcttctcgggagatatcacagccatctggttggcgatgagggatggcaagaggtcttcgtacgtcattgggatcagggtgaactctggagttggcctcaggggaagttccttatcgcgttgaaaccggcgccaaagttggcgttgccgatgggcgcgggcgctctagattgtacgggtgctgaattggaagagtccccggcgcgagctacgaagctcagttgctccgatcctcctagcgttggtacttgtggaggagacgtaattgaacttccctctcttcaaacctacttcaattctttccctggcgaataccaagtccacgaagctggaaggcatgtccctccatcgctgagcgtactctttaaaggtcttactttcctttttaaccatgttctacagctgagtccgatcgggagccatatcggaattgtactaatattgcctaaggaaggcactaatcagatccttccaagtgcggatgcgggaagcttccagattagtgtaccaaatgaccacggctccagccaagctatcttggaaaaaatctgccatgtccgtgaacggatagtcgccaaagccttcaacagctctcaatctctattcgatgagatcgagtttccttctttcttccgctgccgagcacgtccttctgtggacagtgggatcctctag

SEQ ID NO: 64782 - DNA, 975 bp, Glycine max
  Peptide Sequence Number=SeqID_156467
atggctcaaacatggagtgtcttctcgtactcaaacttagctcctacctctcccactttaaatttgaacatagacagagctaggttgatctatggcttaatcacaaggatggacatgaacattggcggtttgatcactggacaaatgaccatgatggctcagtctaactcttctcacttaggcttccctgctttaatcacaaccttgtgtagatcgaagggaatgagatatgatgcccttaccttctatgaaaacctatggccggtcattgacttagcttatatcataaggaactgttggaatctgaatgaccaaacagttaattttctagaggtaaggaagaccaagctcagagcagttgatgttcccttttcctttgcaccaatagctggcatccctgcatcttctacttcagccccacttccagctttagcaggcttacctgcccagagctctcaaacttcagatgccaaatttcaaagcttgtttgaaggacaaattctcattatacaaagcttgcaggaactagttcagcagaggccaattatgagtgtagagcagttcattgagaagatggcctggcttggagcccaaccttcttttgtgggggataatgaaagttttacagcccaggcacctcaacaacatgagccagaaccagaaaacgatcactcatctgaagccaccatccctggagttgttgattttgccaaaagaagattagagacgagatccaatgaggctgctcatcctggaccagtgccagcatcagctgatgcaccatttcgagtagtggatccatcttcacctcagcatgcagcagacgcttccactcatgtcttagagatacatgagggtcagaccataccagtcctgcccttggatacttctcctcctgctactctaatatggcatctaacagatgagaaggatgttcagatacaggacaaccaggaccagtcacaagaattttaa

SEQ ID NO: 64783 - DNA, 294 bp, Glycine max
  Peptide Sequence Number=SeqID_156468
atgctggtccttgatttcttacgagctaaaggagcttcaaaggatccaactagagttattgccaaagtagtgcagtctgaatacaagcgggtttatgattatttggctgacactactgcctctgttcaaacaagagagagcatcaatgagttcttgacaagtgttaaacaacatgacctagcaaaagttgaggttctgaacatattaaacattgggccagctgctgattttgaactatacctagtaattatcaaaattttgattttcccatttatgttacacctaagcatttag

SEQ ID NO: 64784 - DNA, 75 bp, Glycine max
  Peptide Sequence Number=SeqID_156469
atgaccctgccaaggacatcttaccctgcagtgcatcatactttggatccatgggagccagcaaacaagatggag

SEQ ID NO: 64785 - DNA, 345 bp, Glycine max
  Peptide Sequence Number=SeqID_156470
atgtcattccattgcagcactgtcctgtgggagtgttatgtgagaggtggtatatgtggtagagatggatccaattgtagggttgctgctaataatttgagtcttgcttctgatgtagtctgcaactcaattattcaaaccaaatccagcctaaaactatgctcttggcagttgtcgcaacctacccttttgcgggcgagcgaggcgaggctcacgggtacgtcttccataggaggaaaatgcgcggagtcgccaccaatgtttattgaaaggaaaacgttagaaaaaccaaaggaaaccggtcatgaagaatattccagattcgggagttatctttacgtttga

SEQ ID NO: 64786 - DNA, 1137 bp, Glycine max
  Peptide Sequence Number=SeqID_156471
atgacctctaagaaacataagagtagtgattctagaccacaagatcagaatgatagcaagagatttcaatcagaggaagcctggaaccgatatatcgataatattttagaccgaaggatccttccggaaaggaatgtggaactttatcattctaaatttgacgagtttaaaatagaattggagaggcgaaaccttcacaaacgtttcgccaaccttcaggaaggaagcatagatgtggcagtggttaaggaattctatgccaatttctatagtccagcagatcaagctcctaaatatgctagaataagaggccatttaatcaagatagatgtagacagcttaaatgagttcctccagactccagtgttattagaggagggggaatctaatgtgaatcttacggggcggaacagtgtcttctcgtactcaaacctagcttctacctctcgcacttcagatttgagcacagacagagctaggttgatctatggcttaatcacaaggatggacaagaacattggcagtttgatcactggacaaatgaccatgatggctcagtcaaactcttctcacttaggcttcccaactttaatcacagccttgtgtagatcgaggggagtgggatctgatgcccttacctcctgtgaaaacctatggccgaccatggacttagcttatatcataaggaactgttggaatctgaatgaccaaatagttaattttctagaggtggcctggcttggagccgaaccttcttttgtgggggataatgaaagttttacagcccaggcacctcaacagcatgagccagaaccagaaaacgatcactcatctgaagccaccatccctggagcagttgattttgcaaaaagaagattagagacgagatccaatgaggctgctcatcctggacaagtgccagcatcagctgatgcaccatttccaggagtggatccatcttcacctcaacatgcagcagactcttccactcctgtcttagagatacatgagggccagacaagagaaagtgatgaaaagcgcgaaatcgacctcatcatcgttaaggacaactttgcggaggatgaaggtgatggtagtgccactgataaaggaaaagagattccaatagaggtgtga

SEQ ID NO: 64787 - DNA, 806 bp, Glycine max
  Peptide Sequence Number=SeqID_156472
ctgaggttggtccctcagctgctcgtgttagcacaaaggagagttgtgttgatccctcaccgaccaatccagagacgggtgactcagacaaatgcgggctgtacatcgaagaaaatccttcccgcctggttgccctaggaagagtttatgagggatccacagctgttcacaacatccctttgtttcatggccaggtgaaggttggtgttatggagattaaagatgcagaggcttccattcctgtacccactgacgaggttcaactagtggggcaggcactaaactccttccttgtttggccgacacatctcgtgaagcgtgtatcaaaacatgcagctgtgtatctagcaaagcctccagataggccggatcctgaggtcgatgatcccctgtatctgatgacattgaccatcccacagcttttcttgaagcctctccaggttatgtgggatgctaccgtgtttggggtgtttaatccagacttcctattgtacatcaagcatgaagatctctccgaaattgcacatggtgggaattccgatgtgtatagattcctcaagccacagtccattcagagatctgggcaatcgcagtttgaatcggaaagttacttgaagtgttggatgcagagttcaaaacgcgatgtctaccttggagcctacctgaatgggccagacaactaccttaagggaatagttaacagtgctttgaaaggacttcatgatactccacaacctaaatccaatgctggtgctaggtggattgttgttaagtattttaacgatgttagaccattggaagcatag

SEQ ID NO: 64788 - DNA, 360 bp, Glycine max
  Peptide Sequence Number=SeqID_156473
atgggtttgatcgtggtgagtttaacatcttggttaccagaattgcaccctccatcttgtactcctcagcaactagcatcttgtcaatctctaagagcaaacagttctcaaataggtgtgcttcttatgggactttgcttcttacgcagtggctctactggggtaaggccatgtacaccactttcacaatggtattgttggacactcaaacagtggtggtctacatcgctccataatcatgttctttgtgggcacaaggaggaagaaacggaaaatgcatcttccacatcctccaaagagaacctcaatctaattcaacaagatgaccaaccatcgtctacggacgataatgatatatga

SEQ ID NO: 64789 - DNA, 342 bp, Glycine max
  Peptide Sequence Number=SeqID_156474
ggttttgatgatgccaaagtagaatcaaacaaggttgcttcaacaaacattcaaaggttaaacattgcttcaagattaattcaaggtcaagtaaacaagatcaagcagcaaaatataagggctcaaacaatctcattggttgatcaagctttttcctcaaaacacattgtttccaacatccaaggctctgagactggttgtctcttggattgtgagaattgtaatcaagagacgggttgtctcttggagaatcttgaacacaagggtgaaggatcccaaggtgtgttcaaagtttgtaaaggatttacagagatagtgaaaaatctcaaatggattgcttga

SEQ ID NO: 64790 - DNA, 376 bp, Glycine max
  Peptide Sequence Number=SeqID_156475
atgtggattattcatctagtcttgaagccaaaagcttcaatgccactcaatcctagaagagatgtggaaatagaggaagctataaacacggccagagtggacaagaagaagcagacaatgaccttaggctgtgaatttccctgtggtgatttggttccagcattcgggctggaagttggggctattttagcaacaggaggcaaaggtggctctgccactttagattctattaaggggagaccagtcagggtcacgatgttttgcgagaatgctccaaccatatgggatcagcataggattaaaggagcactcaaacccggtgaccccaaaggactacactccgaagagtccgtcaggcctctccttcctgattcag

SEQ ID NO: 64791 - DNA, 546 bp, Glycine max
  Peptide Sequence Number=SeqID_156476
atgaagacactaaagaccattgtggatggtaaaaatgatcaaggaactcctaagtggattgaagtaaagagtcatgctcaaagcggaggctatgcgtgtggttattatgtgatgtattggatgtggaacatcataagtaggggtttaaagaatgattgcagcttgtggtttgctgatggcacccctagtctccaccatgccaccaatgagaaactatcttccatacaaggtgcccctttgttcacctccaaccaatctatccctgactttatgtactcatcatccaacctcttaaccccttcttgcactttccttatgtggcaagcattttctagctcaatgagatgcctaacacttgctcttgcaaaaccagcattggttccacttttgccttgcagagtgaacaagttgtgtgtttcagtggattttgattactcaaaatgtggatggcttatctttggagggtttcaagctctcagaagtgttctacctgcatttggtactatgatgaggtctccaccgcgtgttaatgctcctaaagattga

SEQ ID NO: 64792 - DNA, 654 bp, Glycine max
  Peptide Sequence Number=SeqID_156477
atgatatgtacaggttcgctaagcgcaccgcttcatctctctaagcgcaccgcttcagttcatctgcttagcgagaaagagagtttggactgggattcagagctttgcatgtctagggtttctagagagagaaaggtccaagttccaaagagttttgagagattttgctgtgtgaagatctgcagagaccagagcttgaagcaggagccggcttcctggtatggaaagctagatcctctgttggatcttccctgtagggctgagttgtcatgctttcacgaggaatcgggatgtgataaattagttgggtatgtatgtcttaatgcggtcctggttgagttcagtcttacaagaggaatctgtgtacgatgcttgatcatgattaggctaaactatgatgaggaatcggggtttagtatctcaggagacaccataagaacaacaatgggagaaggtttcaattacttggaaaaaggactgaaaaataacttagaaaaatattttctaaaaagcagtcctttcgctaagcgcaagcctcgtgctaagcgcatctctgttcatatgctaagctgcgagtctcaagcgcttagtgcccaacccttgcatttgaggctaatttggtccgctaagctggccaaggttgagctaagctaa

SEQ ID NO: 64793 - DNA, 223 bp, Glycine max
  Peptide Sequence Number=SeqID_156478
gaatgaagcgacaattcctccttctgatgacgcatgggcacttatccctgatccaactacaattcgtgcgaaaagtcggccaaaatcaacaaggataaggaatgacatggattggctcgaaccatctgagcaccgacaaaaatgtagtagatgtggagtaaaagggcacaataggcatcgatgtccaatgcaatctgaccgtgggagttgttcatttaattga

SEQ ID NO: 64794 - DNA, 387 bp, Glycine max
  Peptide Sequence Number=SeqID_156479
atggccggtattcgggatgcaaagagcattcttgttaagttagaatggtttttgaattgggtcacctttgtggcaagatctgtacctcacattctcatcacagccaagctcatcaaggatacttacaaatttgaaaagggtatggagctaccactggctctgttgggcatggctgggatgaatttgctcaacattggtcttggcattgatctccttaaagcttttatgagagagaggaggtctcagcaggcatcaagcatgcatcctgataagttgtcatttaccaacctcttcttggttgttccaaaccatgctgagcaagaccaaggaggaagagcagagcaccaacctaccttaaggatttcactagccgttagtgtctgttga

SEQ ID NO: 64795 - DNA, 195 bp, Glycine max
  Peptide Sequence Number=SeqID_156480
atgtcagtgaaaaaccaccctgggcgctcaggagtacataacaagacacaccacacaatgggtttgtcaggcttaaagaagcactcaaacccggtgacccccaaggcctacactccgaagagttcgtcagggcctctccctcctgattcaggtccaacccctaaaatcattttagcacatagacactgctcgtga

SEQ ID NO: 64796 - DNA, 510 bp, Glycine max
  Peptide Sequence Number=SeqID_156481
atgacagatgaaggagaggctaaggttgaaaaaccgatggctgacaaggataagaaatcaatgcttgagaaagcttacagtgcgattatgttgagtgtcggtgataaacaccaaggggttgtgcctgtcgtcgtcttccatacccatgttgttccgacacccacgcgccgccgcctccgttcctgctctagtgcccaccacttctgctgttggcgtcactgctcttcaagcagcggtcgtggtcgctggacgccttccgcaacgaggcgtggctccgccgcaaggggaactggaagaaccgccgcagtaaaagcgtcaccgatgaggacgtggatgagctcaaggcctgcctacatcgaattaggctttggattcgatattcctcccccaaggttgagcgcgatcaacgcctctccgatactctacccgctctcggcctctactacaccgtcaacaaatgctacaacgactcccttatcatacattaatattattgagacaagactctaa

SEQ ID NO: 64797 - DNA, 204 bp, Glycine max
  Peptide Sequence Number=SeqID_156482
atggattttcaaaaagaaagaaggtataaaaggtgtgaacatgacagatttaaagcgagaattgtttcccgaggctttactcaaaaggagggaattgacttcaatgagattggcagatcaaagtggaatggaaatatggggaactgggatcttgttctaagagttcatcctccgttgggcacccttccttctccattcagataa

SEQ ID NO: 64798 - DNA, 222 bp, Glycine max
  Peptide Sequence Number=SeqID_156483
atgaagaaaggttgtcaccagagtgacaactatcaatctaatggtagagggattgaaaagttgagcttagctcatcagtggactaagcgcgcatccactgctaagcacagcttcagcgcacttagcgcgacagaagaatctggtagggcatcatcatcaaggccgcgcgctaagtgcgagatcagtgcgctaagcgcagcagttgtcttcagccaggcttag

SEQ ID NO: 64799 - DNA, 225 bp, Glycine max
  Peptide Sequence Number=SeqID_156484
atgaaacccttcaagtttttaaggagaactggatgtagctcaagagttggggaaaaggacaatcacattcctctagacgctgtgaagaaggcgatcccaatggacaaatggatggatgatcagaaatccaaattttgtctcaactcatgcactagaaatgccttactatgcgctctatcagaagaagaatattccaacgttcacaactttagaagtgccaagtag

SEQ ID NO: 64800 - DNA, 381 bp, Glycine max
  Peptide Sequence Number=SeqID_156485
atgtcagagttggatgagtcctttgcaaaaatgaagatagaagatataattaagtttgttgttgcatccggtcaaaaccaaactgcgcccaacccaccaatggaaaatcatccagaaaaggtcaaagaaccaattagagccaaattgagttgtttgacactagttaccgtgcaaaacaaaagatcattcgatgttttggtcaagggtggcaaagatactaaaagggaggacaaaagggtcttttcagggtttttttctagaccccagctcgcccatgctagcctctggcttgcctgggcccccaaatggcttagggctgaagtaatcagctcgcctgagcgagctgcaagtccaccaactgcccttttttgctataaatag

SEQ ID NO: 64801 - DNA, 351 bp, Glycine max
  Peptide Sequence Number=SeqID_156486
aagcatggacacttcaagtcagactgcccaaaactagagaaatccaaggacaagtacaagtattacaagtccaaggaaaagaagagtttcgtgagcacttgggagaatctgggcgataccacctctaatgaagaaggaaaagaagaagccaacctatgtctgatgcaattttcaccggcaccagtgctaaggatgacgaagaggacaggggcgagagcaagtaggaccaattttttatttggtctcgacagtggtgaaggcaaaggattggaaaatttaagcaacccacctccaaacctaatctccttctgtttaatggcaaggataatttgggtttattacaaaaagtaa

SEQ ID NO: 64802 - DNA, 1440 bp, Glycine max
  Peptide Sequence Number=SeqID_156487
atggctccaaagaagcttcttactaaaaaggctaggaagaccaccgcaggggagggatccattggtttgtctttcctcaaagagagacgggtccaactaagagaaggggagtacacagaattccaggcggagggccaatggatcccctatgatgaagatgctatcaagcagttccttgggcatccgttggtcaaagaggaggggcagcaatgtgagtacagcgagaaaagaagacaggtctcaggatttgatgaggaggctattggccagctactgtgctccctgggacaagactttgcacgaagcgtgacaggaaggcaggtgcgaatcatgcgcactagcatgacaactttgacacaggtctggatgacgcttctcctcagtaacatccttcccagcgaccataattctgatctcccattgcctaaatgccagctggtctacgctatccaaacccatatcagtgttcattccaatagagcactgagattttcagctctgatcacaggtctctgccagttctatggggtgtcgattatgcccccaaagctcatcggacctcccattaataggtctttcattgagaagtactgcatgccaaggcaggcacagcagccggggcaggaccagaataatcctccatctgcatcatctgaagaaggttcccctgttcagattaccagcacaacacccgttaccattcttgttgtcgaagttatgacaaaagacaaggaaccaagagtccgcgtcggacatttctttgatatcaactctccgaaaaatgccaactatgtcattaaagctcatcttttgctttgtggcatcaaccacttctttgaagaccctaaagtgatagtcaacaaagccattatttacaaggaaggatcaaaggacttcttgttcaatgctcacaagttcatcctgtatcatctcatgaagggcatttcctttgaattgccccaaattctcttcaattgctttggtactaaagttatgaatgacaagagcatagggaaggatatataccatagtgtcattctcactaagatgtgcaagacaaaatctacccaagagaacatctctaagatgagactccttaatgatgaatccttccaacaagttcccaatgtgaatgactccatacttgctgaacttcaacaaaagtttggacttaacactggacgagacgatcggttggacacagtctgggaaaaggctactaaagaagagaggatggacaaagaagaagaagttgctccagctaagcaaaggatgaagaaaaggatggacgcaactccgtccaaggctgcgcttcctcaacaacgtccacctcttactctagttgcccccaaggcaataggtgtagtggcaaatgtctccaagaggcctgcaactaagaagcaacaacaaccttctccctctaccaaaggaaaagattag

SEQ ID NO: 64803 - DNA, 795 bp, Glycine max
  Peptide Sequence Number=SeqID_156488
atggttgaacatagccatacttcagttgtggaccatcttgggtcatgtatcgctatatggatccttgaacctcaatcaatacataacgcaaaggacagacgtgggcaatgtgaagaatatattggaaaatggcttaaggaatctcagcaacaagtgtacttaggagcttatctgaatcatgcatttaaggcattaaagacgactgatgatggcaaagttcctcaaactacaccccagtggattgaagttaagagtcacgttcaacaaggaggctatgagtgtaggtattatgtgatgcattggatttggaacataattatcggggagttgaagactgattggagtctggtacctgttgatggttttgaaggaattattgatgaaggtgtcgccaaagttgttgctggtttggctctcaaagtgtctgatagaaataagtcgattgaaaaggctactgaggtgaggcttgggttgccagggtgtgagtcaccagagagagagggtgtgtttaagagtgtggtggtgtctggggccaagaggggtttctctgatgccattgatggaaattgcaatggtggtggatctgaaaaagatgtcgctgccttgttttctccaacttcaaggggtgctgttagtgttagtgttagtgttgccaagtctctcactctcactacacaagactacaccaaccacccaattgctttgggtgcttctgttctttgtgaaactgttccacactctccaaaaccattacatgagaataagccccagatttgtgctccagctgcaaagtaa

SEQ ID NO: 64804 - DNA, 600 bp, Glycine max
  Peptide Sequence Number=SeqID_156489
atgtctgctcctatgatcattgaccctatggtgatatcggcaccagaaactcaatcagcagcagctagcatactagttgcacaaagtgaacttgaatttgctgaggctgttaaggatgaaattgtgaggtttgacaagcttgtttgcatagaagaagcaatggctaagcacatgaacttaaccaataagttaaaggcatcaaggcctcctccaaatccggcattgcacttgatatcagccatgagacagattcttagaaggactttggattctcctaaactgaagagaacatgggacgatgctgcccctgtcgttgaactctgcaaagtctcaaaatttgatcgtggagttcaactaacgttgtttgtattcaaattgattaaacttggtggacacgagctcagagctggcgagggcaacaagaatcgaaggtttaacaatgacccacacacgatagtgatagaaaatccacacgacaacctggactgtataatgaacaccagcgttggaaagccttcacaaggacaagcacgacagtgttggaaagccttcacaatgagaaacaaagcttccagagacaaacgacataaaatgagtgag

SEQ ID NO: 64805 - DNA, 267 bp, Glycine max
  Peptide Sequence Number=SeqID_156490
atgactcgctcagcgaggcagatccggtcagcgagtggcatctgcttagcgaggcatacaacttgcttagcggattgggaaaccctagaagaggataagccaaagatgtgctcgcccaacgcgcagccagcccgcccagcgaggacgttgtctcttctcgcgctcagcacgccctatctcgctaagccaaaaattcacttactctctcttagcgagccagtcttgctaagcgagcctgcggaagctgaaaggtccaagagcctttaa

SEQ ID NO: 64806 - DNA, 480 bp, Glycine max
  Peptide Sequence Number=SeqID_156491
atggaagtaaatgagaagatgaggaaagtagaatgtttcacttgtgaagagaagtataatcctgctcatgtgcgtaagaataaacaatctagattgatgattatggaagaagaggaaggagaccctaagaaaaatcagtgggaggatagggaagaagaggagatgaacacaagattagatgtcaaggaatgtataaatctttacctactgagttgcaagatttacagctcagacaaaattgttatttgtttgagttggggttctgacttggtgttaggagtggaatggttggctggtttgggtgaggttgaagtgaactttgagaaattaaccttagccgtgaaggctgccatcaacatgaagatgatcaggggtaccaagctggaatctgacaagggatttatggtggaattaaaaacgatagagggggagaatagtgaagaagcaattcttgatctagtggtgcaggtgttgaaataa

SEQ ID NO: 64807 - DNA, 210 bp, Glycine max
  Peptide Sequence Number=SeqID_156492
atggaagatggggttcattgccctttggaaggtgttcgacggctggcaagtgcaccggatcgtgcaagtggtataaaacgcctaatccttgtcaagcgtcatcctcagatcccttttgttggactaaacttgaccagaactgcattaagacatacataccaacaactaggttaccgtaccccgatccctcgtgacaatacgataaactag

SEQ ID NO: 64808 - DNA, 360 bp, Glycine max
  Peptide Sequence Number=SeqID_156493
atgacaaaatcagaaatttggcatgctagattaggacatgttcattacaaaagattaaaagatatgtcaaaaacaagtatgattcctccttttgatatgaacattgaaaaatgcaaaacttgcatgttgaccaagaccactaggaaaccttttaaggatgttaaaaatgaagctcttgataaatttaaaatttataagaaagaggtagaacttcatcaaaatgggctaatcaaaactcttcgtacggataggggaggtgcaagaaagaaaatgactacctatataagcatgaagtttagccgcttcaagaagctgggacttggctttgatatgcttatgaaggatagggacacaggctag

SEQ ID NO: 64809 - DNA, 492 bp, Glycine max
  Peptide Sequence Number=SeqID_156494
atgcaacagggtcaggcagatatcctcatagctaggttccctgaccctaactatggtgttaaaacgggtttcgttctctaccgaaactgcaagccaagttggaagattccgctccaatcgacgggttcctctcgttggggagtttcaatggagaacaacaatggtttgtggtggctaatggtggctgtgggtgatggagaaagtgctgggaactttagaaatggctttggaagaaagaaagaagaagaaatgacatttttcctaagctacacgaaagcaaaggctgaacttcgagcacactccagagatctactcaaagatcccaacggtcagatagtggaaaagtgtcttgtgaagctgcagaccaaagttcgagaagatccaacggttaacaaaggctgggcagcgtttttaccgaggcagcttcatgtagctttctctagaagcttcattaagaggcttcctccagaagcttcctcgtggcttctttga

SEQ ID NO: 64810 - DNA, 1653 bp, Glycine max
  Peptide Sequence Number=SeqID_156495
atggggggtgtgagtctgagggaatcatggtgtttctgcaaaggggtgagtaagtctgagagaatgaaagctgctatttttacagggaaggctcaggccatggccacaatcgccgccaccgccgcgcctaatggggcttccggcaccgggtttttgatccacaggaaccttctattgaccactcacgccaatcttccgtcggtggtcgccgctgacaccgccgagatccggctgcacaatggggtggctgccactcttgctcctcagaggtttttcattacaagttctgtattagatcttacgattgtgggtttagatgacggggatggagactcaaatgcacagggtcagtgccctcactacttgaagaccagttgtaaagccaatctggatctgggaagtgcagtgtaccttttaggctacacagagaaacaggagctcactgttggtgaaggaaaggtggtcatagccactgacaatctcataaaactgtcaactgatggaattcaatggagtcctggttctgcaggttttgatgtgcacggcaatctagcttttatgatatgcgatcctatgaaattagccacatcacctaataccaaatcttcttcaacttcaacttcatcatcatcatcctcttggaagaaagaccaccccatgcaatttggcataccaatttctgtcatatgtgattggttaaaccagcattgggaaggcaaccttgatgagcttaacaagccaaaattaccaatcatgcgattgatgtctaccggccaaaagagcgaccattcatgtgcttccttcaccctgaggcaagttttcaagtcaactgagggtgatgatgatggcaccccttcttcatcaaacaacgccttgaaggcaagggatcagggaccaagctcttctgctgctaccaacacagttgaagaagaaagcttgatcactaatcccaatgctgcacatgtacagggaattcccactccagaaatatatgaatcgcctagagtaaccgctggcccactcagaaggaaagaaaacataccattgcagcttttggacatcaattttcctccaaggactgccaaacatgcagtttttccacaattatccaaaccaaagtgtgctgaaaatcttgccaaagaacctttgcccgaaaaccaagtagaaggagaacaaaacaagcacacaaggccaacaactcctattccagatgtttcctcaacaggttctgtcaatggagcagctcaaagcgaggttcagtctagttcgtctcccgtggaagtacacgagatgcaaaatggatacagcagcgaaggcgagaccatgtactcagcagaaaccgcagagtctcgcaactacacaagccctagagagttgaagtttcaacaagtgggaaggagccagagttgtgtgagttacaataggtggggtgctgcaccaagaagccaagttgcacgtgggatgatggtggaaaatcagagaagcttcatgcatgtgaagagaatgtattcacaaggtgcaacaacttctcagagaagcaatgactatttcagccccactgtctcctcaatcatgaaacgtaacagcagttcaagcaagccaccaccccggcagagtgctgttcattctccttcacccagatggatgttttga

SEQ ID NO: 64811 - DNA, 174 bp, Glycine max
  Peptide Sequence Number=SeqID_156496
atgtcgccaaagaaagttgcttattttggttcttttcaggacattgttgaggccaaggaatatctgcaacaaaaaggagttgatgaaacaattagtcatgacttattcatggtagtgactgaggtatctgatgttgattctgacaagggttcgagtttgattccggaatgttaa

SEQ ID NO: 64812 - DNA, 948 bp, Glycine max
  Peptide Sequence Number=SeqID_156497
atggtggttactccaattcctaccccttcttgtgttcgtgaaccatcaaaactcaaaatccaagttgatatgtacaacttcaaaggcttccctggtataggtgacactagcattagtggtgacaatctagtggtttggttttgtcctttgcggaagaagcctgatgctgctatcaagaatgcaagtcatgttcaaacaggaaactacgagtgtggatactatgttatgcactggatatggtgcatcgtaagtgccagattgaaggatgaatggattagctctacttatgctttttacagatacaatgcatatggtcactgcagtgaaggagaagacactcattctggaatgtccaataaggaagctaatgctaagtttatggaagcaatgtatatgactaaatacaggaaggcaaagaaaggaattcaattcctcatcaatggtagcaaagtggggaagattctttgctctctgtcacctttccctccagtgttgaatgaagctattgaagttatgaagagggctgcacctctgatattggaggaggtttcacttcttaatgatgcggtttctcaaattgatgagccattcttactggttatagtgggggaattcaactctggtaaatctactgtgattaatgcgcttcttggagaaagatatctcaaagagatcacatttttacgatatactgacttagatattgaacaacaacattgtgaaaggcatccagatggtcaatatatttgctacattcctgctccaattcttaaggagcaacgtcttacagaggaatttgtaccccgtgcagatttacttctttttgtcatttttgttgatcgccctttaactggaagtgagattgcttttcttcgttattctcaacagtggaaaaagaaagcagtttttgtcttgaataaagctgacatatatcagaataatcatgag

SEQ ID NO: 64813 - DNA, 582 bp, Glycine max
  Peptide Sequence Number=SeqID_156498
atgcagaactatcaacatgcaaagagatctagattctgcaaaagccaggatcaacagaaaacgttcagctctaattttatgactcccttcgaggattgtcaatctccaactaatcagcctgtaatcaacattgaaggatattctgatcttggtgatcaactcatccaatgtagatattgtaatgcacaaatgtggtatgatgaaagaatatcaaaaaataagaattgtcataatccaaggttcagtttatgttgtggagatggaaaagttgaattgtcattattacaaaatctaccccaatatctccaacaacttctatttcatgatgataccattgatagtaaaaattatcaacataacttacgagcatacaacatgatgtttgcctttacttctgctgaaattaagctagataaaacaattaataattcaaaaggacctcctacaatcagaatacaggggcaaccatgccatagaataggcagtctattaccaatgcctgggaaaaaacccaaatttgcacagctatatatctttgacacagaaaatgaagtgcaaaatagaattaatgtcatgaggtag

SEQ ID NO: 64814 - DNA, 984 bp, Glycine max
  Peptide Sequence Number=SeqID_156499
atgtcgccagccccagcagcacctgcgtcaccagcatccagccgcggcgccggcccagcagcggcggcgcatagcggccgtgcccaccagggtcaggaaaccgatctgctgcaagggcacgccggccaccgtggcccacgcctgcagggtgccgctggtcagggccagcggcaatccgctggcgaaccccaggaccagcaggggcgcgacgcggggactggtgtagacgttggatacagcggtaatgacggtctcctgaaacgggccggccgggcgcacggacgggcgcggcgggcttgcggcattttaggcgctggcgcccgggccgtcagccggcgtttcagaatgtcagggcgaggcgaagcggtacaccgccagggtgctgcgccagctggggaaggtcttgatctcgcgcccttcgttgaaagtggcgcgctccaggatgcgcaggcccagctcgccggccagctgttcgaagtcgcgcagcgtgcacaggtggatgttgggcgtgttgtaccactggtagggcatctggcccgtcaccggcatgcgcccgcgcaggatggcccagccgtgcggccagtagccgaagttgggaaacgacaccacgccgtggcgcgccacccgcgccatctcgcgcaggatgtgctcggtgcggtgcatggactgcagcgtctgcgacagcaccacggtgtcgaactgcttgtcgtcgaacagggccaggccgtcttccaggttctgctggatcacctcgaccccgcgccgcacgcaggcgatgacgcaggtgtcgtccagctcgacgcccgcgccgcgcacctggcggtgatcgcgcaggtgcgccagcagcgcgccgtcgccgcaacccaggtccagcacccggctgccgggttcgatccagctggcgatgcgcgccaggtcggggcgcagcgtattgacggcgggacggggagtcacgggattcatgcggagcgtccttcggtctga

SEQ ID NO: 64815 - DNA, 222 bp, Glycine max
  Peptide Sequence Number=SeqID_156500
atgtggtatcatgtaagtgaaaaacctcatttggcgcctaggagtacatggcaagacagaccacacactgggagaccagtcaggatcacgttgttttgtgagaatgcttcaaccatgtgggatcggcataggcttaaaagatcactcaaatcgggtgtatttaccccaaggcctagacttcgaagagtccgtcagggcctctccctccttattcaggtctaa

SEQ ID NO: 64816 - DNA, 360 bp, Glycine max
  Peptide Sequence Number=SeqID_156501
atggttatgaggggtcaagacatttacagtagtcaagaggagactacttttttcccttcctctagtggaagtgaagatgaagtaagggatgaagagtctagtgaggaagtctaccctcaggaagaaggtgacctcctaatggtacctttctccattgggactgtcacaacctacccttcggcgggagggcgaaaaggccaaaacagatgggccaaagcatttgtctccaagggagaaaacaagcggagtcgccttgctgattttcaccctctcgctaagccaatctggtggcttagcgagatatcctctaagcacaacaatcctcagctaagcacgaggaaggatctggaagaaggatga

SEQ ID NO: 64817 - DNA, 327 bp, Glycine max
  Peptide Sequence Number=SeqID_156502
atgactggtttccttcggttttttccgacgttttcaagaaataaacgttggtggcgactccgtgcatttacctcctttggaagatgcacctgtgagcctcgtttcgctcgcccgcaaaagggtagacaatggaggaaagctggagttgctgcacatgatgtccaacgctatgtcaaggaatcagattgggctgcacaatgcacaaggcaagataaaatgtcaaatgaagaattgaagctgcaggatccacgatgtcggatacaatgtccaggacatccttcccgaaaatactggacacataaatctgttatatctttaacagattga

SEQ ID NO: 64818 - DNA, 744 bp, Glycine max
  Peptide Sequence Number=SeqID_156503
tatcaacagcagagacagtggcaaaatcactctggtaaccaattcaacagagaccagggtggtccatcttcaaggccacaacagcagatgccaagtctctatgaccgaaccacaaagctggaagagactctagctcaatttatgcaagtgtcaatgtctacccaaaagagtacggagtctgcaattaagaatctggaagttcaggtgggtcaactttcaaagcagttagctgaaagatcatcaaatagttttacagcaaacacagagaaaaatcctaaggaagagtgtaaagctgtgacgactagaagcagaatggtgattcaagttgaggaaagtagagctgatcagaaggtggaaggatttaaacaacagttggctgctcagccagcactggaaccactggatgattttgttgaacttgaagaagttaatgaggaaactgaagtgaggccaatagagaaaagaaggagtaaactactcctattgaaggcaaggacataccctatccattggtaccttcccggaaagacaaagagagacatttggccagatttcttgatatcttcaagaaactggaaattaccttgccttttcgagaagaacttcagcaaatgcccctctgtcgcaacctaccctttggcgggagggcgacgcgaggctcacaggatgcatcatccattggaggaaaatgcgcggagtcgccaacaacgttcatttgaggaaaacgtcgaaaaaatcggaaag

SEQ ID NO: 64819 - DNA, 259 bp, Glycine max
  Peptide Sequence Number=SeqID_156504
atggatacctcagcgccctacactggggcaatgaaagacaccatgcataaacctcaagcgaacctaggggcagatcagaaactctcacccaataggttccctgctacaagagggctacgcgtcctcgcctctagagggctgcacgtcctcgcctccagagggctatacatgctcgccttcagagggctacacgtcctcaacttcagagggctactcgtcctcgacatcagagggctacacgtcctcgcctccagaggtt

SEQ ID NO: 64820 - DNA, 471 bp, Glycine max
  Peptide Sequence Number=SeqID_156505
atgttcatgtcgtacacatacaggtcctgcgtgacctcactcttgctgggcggtatgcatggggagctgcagggctcgtccatatgtacgatcaacttaatgatgccagtctcagcactagccgatagcttgctggttacatcaccttgttacagtgttggttatacaagcactttcttccagttgcggagtgcaatgttgatccggactacgacgaggtgtcaccactcagatatccctcagaccctggatgattcagccaggtctgatgtcgacgagcccagacatgcaatggaggcttgcgatgccatcgccgagaggttggagcgtcacctcagcctcagggtagtcacaccaggcacattgacacatgaggtcatcaaaaaatgcctcaagattgtcaggagtgtcacccaggaccgcattgtgtacgtgaggtctctacgtaggcgctgcatggatcagccgtag

SEQ ID NO: 64821 - DNA, 615 bp, Glycine max
  Peptide Sequence Number=SeqID_156506
atgcaccgtttacaaaaatttcgggtagaaatttccaggatatcacagcaggcgtcatgcggtttcttcgttgccattgggcgaccagaacaccgtagtcatgtaggtgttgttggagttggtctcacgatcaagaaatactttgggctggctccaaggacctcccgtatgtcttcctccatggctcctgaagacctggagcaactaatgcaacaaattagggaccagttggaggagtcgatcactgaaaaacgactcgcactgcctcctgagcctgaggttggtccttcagctacttgtgccaacactaaagagagttgtgttgatccctcagggaatgatccagacacaggtgacttagacaaatacaggttgtacatcgaagaaaatcctccttgcctggttgccctaggaagagtttatgagggatccataatcgttcacaacattcctttgttgcatgatcaagtcaaggttggtgttgaggaggttagagatgcatatgcttccattcccgtacccactgaagaggttaagttagtggggcaggcacttaacactttttttgctttgccgacacatcttgtcaagggtttatcagaacaggaaaaataa

SEQ ID NO: 64822 - DNA, 945 bp, Glycine max
  Peptide Sequence Number=SeqID_156507
atggggacagatcaaactggcaaaaggttttatcaagtcaagattaagggcctagatatcaccagcattaaggagttggggcggttgatgggacctctccaaatgcaagccttccgcaaggcgtacagaaagatcttagatttgaccatagcagagatatccacagaagccattacatcactcacccaatactataaccagcccttgagatgcttcacatttggagacttccaattagtaccgactgttgaagaatttgaggagattctaggatgtcctcttgggggaaggaaaccatatcttttctccgggtttcttccctccttgagcaaaattgcaattgtggtcagggatttggcgagaggattggaccgcgtaaagcaaactcgaaacggcatagtgggcctaccacagaagtacttagaaggcaaggcgagggatatggagaatcaagaggagtgggttccgtttatggatgtattagcattgctaatctttggggttttcctctttccaaatgtggatggaggcagaatagtcaactggtttccacgatggaaagaaggaaaggagggagttctcttctcatgtgggggctacccaaacatcccgttgataggaatgaggggttgcattaactacaatcccacacttgctataagacagttagggtaccccatgaggggagcaccgacggaagaaagcctgtctcctttccttgtgagagattttggcgcgcaaaatttcaagacgttcggaaagagtgtgccgggttacgagaagaaaatgcagctaccgcaaaagcccttgaacaagaaaccaagagggctcgcaaggaagagcatggccgtgacaaattccgtggagcattgtggggcaacaacagtgagctcaagcttcgaagggaagagagagaccgatcacgagcacatagcatggttttaa

SEQ ID NO: 64823 - DNA, 210 bp, Glycine max
  Peptide Sequence Number=SeqID_156508
atgtctcctccacctccagaacctcacaatcactcacaaactcatctcaagtactcaggaaggcctcctcttcaagctcagttctctgcaggtggcttttttcatgcttgcgcgcttagcgcaactctgatccgcttagcacgaattagtgaatttcggcttagcgcgcgcttttctcactcaacggatgtactgaagcggtgctcttag

SEQ ID NO: 64824 - DNA, 261 bp, Glycine max
  Peptide Sequence Number=SeqID_156509
atgggccccgacgagtgcagagaaactggaacaagaaaggcggcacacaaaccgagaaaaatttcagaagcttttcctcccttccacgttgcttttcttctttcttcttctccaccattgttgcctccattgaagctccaaattcctcttcctttctaccccaaattgcgaggaaaagcccttttcggagtcttggagcatacctctacttcgtggggctttaaatttcagaaaactggtagagatgatggggagagttaa

SEQ ID NO: 64825 - DNA, 468 bp, Glycine max
  Peptide Sequence Number=SeqID_156510
atgatctatgctatcaaaaacttgaggatccctaagtatctggacttagaatggttctctcaacaagggtctaactttcctaatctgctggaagcacaaggaatgtcaaagttagtgcagatgaaaggaacattttatccggagctagtcaaggttttctacacttgtgcacgtgccgaccttgaaggtaatctcttctctactgttaatggagtagaaatggtcattgacgctgaagtgtggaaggaagtagtcggtctggacatgggtggagtctgcaagttcgatgaaacaactaatgggtacagcaagatgcaggcctctaggggagtgcttcttgaccccgcaagaaacttgagaaattgccaaggagtaggtgtcctgactgtagaggacagaatgctagtctacctcattacctacattctcactctgaggtcaagtaatcacgctcaggtattaagatga

SEQ ID NO: 64826 - DNA, 324 bp, Glycine max
  Peptide Sequence Number=SeqID_156511
atgtttaggcatgaaaatcaagggaatgggagcaatgtggcttgccccattactccaaaatacaacctaggcctaaggccatcccccacaacctcccaattcaacaaaaacaagcaacaatccaaggataaatccctcacgtttttgagcaaacatatgcaacttagaacaccaaaatacatcaatggaaagctagagagcccaagaatgaggatactaggctgccttgcagcggcgctttccgtttgtccagagctaggcaagggacgacggcctattggtcgtgatcctagcctctacttgcgtccgtccctaagtacctga

SEQ ID NO: 64827 - DNA, 279 bp, Glycine max
  Peptide Sequence Number=SeqID_156512
atggactcaggaaggttccaagttagtgtaccaggtagcagctaccccaataagactttcttggggcaagtagtccccttgtacttgtcaaagtccagagccgtgaacttgggaatgaccacgttcgggggtatatcaccaactgcttgctcttcactggcatatctgaggcaagactcgaagttggctagattctggtggggcatttcatgtgtctccccatgggtcaagagacatttgcatgatcagattgaggttgttggctctcgatgggtgtag

SEQ ID NO: 64828 - DNA, 186 bp, Glycine max
  Peptide Sequence Number=SeqID_156513
atggaagcgcctcagcttggattttcttcatggaaacaattttcctcagcaatttcaagggaggagcttgccatccagctcgcccaggcgaggcaggttgcttcctctagaagcaaccgccttctggaggaagaatctggaatgcccaagtgggcctggttgctatttgcaccccctttttactaa

SEQ ID NO: 64829 - DNA, 225 bp, Glycine max
  Peptide Sequence Number=SeqID_156514
aaaccaacttgcctgggcgagctgcctttgccccaagtgcccattttcctataaataggcatgctaaggaggttgaggaagggttccaaggttcaaaagtggatggaattgagagaattaagaaagaagaagaaagaagaggaaacgaagccgaggcgctaccgaatcgtgatcgcaatcattccctaaatcgttccttgttcgatgttcttcgtgtgaccgtcg

SEQ ID NO: 64830 - DNA, 420 bp, Glycine max
  Peptide Sequence Number=SeqID_156515
atgctccggctccaagagtttgacttggagatccgtgataggagcggagcacaaaatctagttgctgatcatttgagtcggatcgaacgtgtatctgatgcagattcacctattcgggatgatttcccggatgatcatttgtatatactgtatatgatcaggtcattagacggtgcattccagatcatgagactgactcagtcctgcagttctgtcattcttccgcaccgggaggtcatctgggtgttcaaaggacagctcgcaaagtgcttgattgtggtttttattggcccaccatctttaaagatgcatggaagagctgcagcacttgtgagcagtgtcagagagcaggaaatacacttacatggcgacaacaaatgcctcagcaacctatgctattctgtgaggtgtttgatgtaa

SEQ ID NO: 64831 - DNA, 564 bp, Glycine max
  Peptide Sequence Number=SeqID_156516
atgagtgagcgtggttgtgaaccgaatgttgctacttacaaatcgcttattaagtacatatgcaagatacagcagatggagaaggtttacgagctggtggatgagatggagaagaagaaggggagttgcttgcctaaagttgttacttattgttacttgctcaagagcttgaaggagccgggggagatttgcagggttttggaaaggatggagagaaatggatgtggcatgaatgatgatgtttataacatggtgttgaggttgtacatgaaatgggatgatggggatggagtgagaaaaacatggaaagaaatggagaggaatggatggggaccagataggagatcatataccatcatgattcttgaaaactttgagaaagggagagtaaaggatgccgtgtgttatttagaggagatgatatctaagggaatggtgctagagccaaggacgaagaagctacgggtaccagttcttcagagatttcagagacttgttgagcttttagaaggaaatatggttatggaaatgagtaaaaacactcgctccagtaatggtaattag

SEQ ID NO: 64832 - DNA, 369 bp, Glycine max
  Peptide Sequence Number=SeqID_156517
atgtgggttcaggaagaagaaaagcttgtaatggagatgggtgagagtgcattgctaacaactacttgtgggaagaacaaaacaactaggtctcaagctaataagaaagggaatgataaaataccacctcaagttgatattaagaaggtgacaaagtgtttcttttgtaagaagaagagacacacgaagaagaattgccccaaatttcaaaaatggcttgagaagaaaggtaatgagaattcctctatgttatggccctggagattaggagatatctccattgagaggattaaaaggttagacttgtgtggacttcatgaaagatatggatgcacgtggtcagaaatattttatcacctctatagatga

SEQ ID NO: 64833 - DNA, 114 bp, Glycine max
  Peptide Sequence Number=SeqID_156518
atgtcgcgaaactatgcagattacctaacgttggatgttaagtacctcgaggaggtcaagcaaaggttgcaggccatcaaaaaatggtccccagacaaaattaggggcacctag

SEQ ID NO: 64834 - DNA, 441 bp, Glycine max
  Peptide Sequence Number=SeqID_156519
atgtcatcaagaaagagggctagaaccaacgacatcccttcatcatccatcccagctcctcagccagccgccatagaaccagataacaagccaattgtacctctggagtattttcttgagaaagtagtctggcctgaagctcaacttccattagtgagaaccaatgaggctactccgttggagcccacaccggcacaggttgaaccaatgccagccgagccacgaactccagtggtgaatccacctccttctcctgagcttgaagtagttcccccatctccacctctgattatcatctcttatgcatcatcaaatgaagctgttgccccttctaattcgccagctgaagaaacagttgacccccctgcttccccagttggaggaattgttgatctttctgattcgtcatctggagaagttgttgctctcactgattcccca

SEQ ID NO: 64835 - DNA, 640 bp, Glycine max
  Peptide Sequence Number=SeqID_156520
cacagttaagacagatctcaatggaaaagtcattactaatgacaataataaggagattcctgacgctgttaataccctgatctttacaatagcccaacattttattggagacccgtctctttggaaagataggtttgcagaattattatcgaatcttaagtgtagaactttggcagattttaggtggtatagagatactttcctgactagagtttgcactagagaagatagtcaacaacctttttgtaaagaaaattttctagttggtcttccaagatcattaggagataaggctagagacaaaatccgtagccagtctgttaatggagacattccttatgagagtttaggttacgatcaattaatctcttatgtccaaaaaatggccctaaaaatctgtcaagacgacaagattcaaaggcaattagccaaggaacaggcccaaactaagagagacttgggatctttctgcgaaaaattcggactactagcttgtccaaaacaaaagaaaaaacaaaactctaggaaagaaatccatgagaataaacctgtccacaaaaagagatttccaagaaggagattctcgcacaaatcctcgactagtaaggaactggaaaatcccagacaaaaatcacaataa

SEQ ID NO: 64836 - DNA, 276 bp, Glycine max
  Peptide Sequence Number=SeqID_156521
atggacagtgatataaccaccatattgttgaacttcaccggatgctgcgcaccagatgatgagagtgatgagcaaaatgacggcgacagcgacaaagtctatttcattgaagcccttaggaagagacgggaccgtgaggcgccatttggcggaggagattccgattgtggtgacgtggaggtaactaaagtcgccgccagcgacgggcatgtcgactacaaacttggtgtagcagaaggcggagtggagggcgcaaaagccggcaatggcaattaa

SEQ ID NO: 64837 - DNA, 948 bp, Glycine max
  Peptide Sequence Number=SeqID_156522
atgaccggcctgcattactccgaacagacccaacgcgtgtatgccgccaatggcagcggcgagatcctggtgatcaacccgcgttccaaccgcatcgaaaaacgctggaaaccgttgggagaccaacccgcactgctgctcaatatggcggaggacgaggctaccggtcgtttgttcgtcaccgacaactccaaggcgaagaccacgctggtcttggatattcacaccgggaagttattgaagcggcttgatgtgggcgactctttggctgtcgttttcaatccacggcgcaacgaaatttacatctcgcagcgtgaatccggcaatgtgctgagcctggatgcgacgacctatgcggtgaaacagcgctggccgctgccgccgaatccaaacagcttgctgctgtcggcagacggccagacattgttcgttacggtcaaacagccgtttaacaaagatcattccactcaggggccggacagcgtgggggcgctggccgcagacggcggcgccaagaaaaaccaggaggacaccctggttgtccgggccgaaaaacacggcgatttcaactccggcggcaatgatttggtgcccgcctacctggatggacaggtcgcccacggcggccgcctgggaatgttgggcgaacagaaagcgatggacgttccgttcaacgtcataggttataccgcgaagctggtacaggatcagcaggcgaagaccatcgccgacgtggtcagcaacgacgcgggtgtacaggcggtgcaggggtacggtaacttcgccgaaacctatcgtattcgcggtttccaactggacggcgacgacatgacgatgggcgggctgccgggcgtggtgccgcgccaggtgatggatacccagatgctggagcgggtggagatcttcaaaggggcgaacgccctattgaacggcctggcttccagcggc

SEQ ID NO: 64838 - DNA, 1729 bp, Glycine max
  Peptide Sequence Number=SeqID_156523
atgggtgagcacgcttatcagatccagcgcgtcgtccgccgccgcgatttcgctttcgctgagcgcctgccgttcgatgaagctctcgatggcttccagcagggagaagacgctgatttcatcccctatcttcacgacttcgcaaacgccacgcccgatcgccagacagatggcttcatcaaattcacacgtcatttagggttagcaatccctcatgacctccttgtaacacttgatgcaccagaacgttttctcccccgctgcggcgggggggatgggacaatgaaaaatgatctggcggcggcgatcgcgattggctgtgtgctgttgttcgcattggcgtacctcgctgtaatcttccgcggccccgttcggggccgctcaccgcgcctgtcgccgcgtctgcggatttttgcgccgatcgcctgcccacgcgataaaatcagccaaattgcggttgatgaatcgccatgcccgcccgtcaaacctcgaggagcccgctctgatgctggagatgttattacagtggtaccgccgccgcttcaccgatccgcaggctatcgcgctgctggtgatcctggttgccggcttcctcattctctattttctgcacggcattctgaccccgttgctggtcgccatcgtgctggcctatctgctggagtggccgaccgcgcgcctgcagcgcatcggctgttcgcgcacctgggcggcgagcatcatgctgctggtgttcgcgggcgtcgccatgctgctgcgttacccggcgctggtggatgccggcatcatcgacatgatggcggaaaacctgcgcagccggctgtccggcatgggcgagtcggtggtgaaattctcgctggcgtcgctggtcggcctgctgacgttggctatctacctgatcctggtgccgatgatgatgttcttcctgctgaaagacaaagagcagctgctgaacgcggtgcgccgcgtgctgccgcgcaatcgcggcctggcggggcaggtctggaacgagatgaatcagcagatcaccaactacattcgtggcaaggtgctggagatggtgattgtcggcgtggcgacctacctggtgttcgccgtgctggacatgcgctattcgctgctgctggcggtgctggtgggcttctcggtgctgatcccctacatcggcgcggtgctggtcaccataccggtggtggtggtggcgctgttccagtggggcgtcggcgccgatttctggacgctgatcgtcgcctatctggtggtgcaggggctggacggcaacctgctggtgccgatcctgttctccgaagcggtcaacctgcatccgctggtgattatcctttctgtgatcgtgttcggcgggatgtggggcttttggggggtgtttttcgccattccgctggcgacgctggtgaaggcgttcaaaacgatgtcgtggtgattggtggttttgaaatcatcaaacactttttcaatcttgcctttggcgtcgatcaggaaactgatgcggtgaataccgtcgtaggtcttgcccatgaaggttttctcgccccacacgccaaactgttgcgacacttgatgatcttcatcagacaacagcgtgaagttgagcagctccttttcggcgaagcgcgacagtttttccggtttgtcggtgctgatgcccagcacttcgacgccggcctttttcaattcgtccatgttgtcccgcaggccgcaggcttgcacg

SEQ ID NO: 64839 - DNA, 958 bp, Glycine max
  Peptide Sequence Number=SeqID_156524
gctgtcgcgcgtgcgccacaacggcctggacgacagcccgcagctgcagatcgatatcgatcagcgcaaggcgcaggcgctgggcgtatctatcgacgacatcaacaataccctctctaccgcctggggttcgacctacgtcaacgacttcgtcgatcgcggccgggtgaagagagtttacgtgcaggccgccgcgccgttccgcatgctgccggaagacatcaacaaatgttcacactgggaatacggctcgccgcggctggaacgctataacggcaactcggcgctggaaatcgtcggcgaggcggccaacggcgtcagcaccggcaccgccatggcggaaatggaaaaactggtcagccagttaccgaccggcttcgggctggaatggacggcgctctcctaccaggaacgcttgtccggctcgcaggcgccggcgctgtacgccatctcgctgctggtggtgttcctgtgcctggcggcgctgtatgaaagctggtcgataccgttctcggtgatgctggtggtgccgctgggggtgatcggcgcggtcgccgccacctggctgcgcggcctggagaacgacgtttatttccaggtcggcctgttgaccatcattgggctgtcggcgaaaaacgccattctgatcgtcgaattcgccaacgagctgaaccacaaagggcaggatctgatgtccgcgacgctcgacgcatcacgcatgcgtctgcggccgatcctgatgacttcgctggcgttcatcttcggcgtgctgccgatggccaccagcagcggcgccggttccggcagccagcatgcggtcggcaccggggtgatgggcggcatgatctccgccaccctgctagcgattttcttcgtgccgctgttcttcgtgctggtgcgccgccgcttcccgggcaaagcgcatccggcaggcaatacgacggccgccggggagtga

SEQ ID NO: 64840 - DNA, 3299 bp, Glycine max
  Peptide Sequence Number=SeqID_156525
ccaataacgtgcagaacattctcggcattcagtccatcgacaccggtattctcggcgcggtgattgtcggcattgtggtgttctggctgcacgagcgttttcacaatattcgcctgccggatgcgctggcattcttcggcggcacgcgctttgtgccgattatcaccaccgtggtgatgggtctgctggggctggtggtaccgctgatctggcctttctttgcgcgcgcgatcaccggtcttggctggatgatcaacagcgcgggcgaattcggcccgatgatcttcggcaccggtgaacgtctgctgctgccgtttggcctgcagcatattctggtggcgattattcgcttcaccgatgccggtggcaccatggaggtgtgtggtcacagcgtcagcggcgcgctgaccatcttccaggcgcagctggcgtgtccggaaactcaaggcttcgcggaaagcgctacccgcttcctgtcgcagggtaaaatgccggcattccttggtggcctgccgggagcagcgctggcgatttaccactgcgcacgcccggaaaaccgtcacaaaattaaaggtctgctgatttcaggcgtggttgcctgcgtggttggcggcactactgaaccgatcgagttcctgttcctgtttgtcgcaccggtactgtatctgatccacgcgctgctgaccggtctcggcttcaccgtgatggcaatgcttggcgtgaccatcggtaataccgacggtaacgtgatcgacttcttcgtgtttggcgtgctgcacggcctttctaccaaatggtactgggtgccggtaattgctgccgtgtggtttgtgggttactacgccatcttccgtttcgccatcacccgcttcaacatcaaaacaccaggccgcgaagcagaaaccagccgcgttgagcagcaggtcagccgcgccggcgtgggcaaatccggctacaacacgccagcgattctcgcggcgctgggtggcgttgacaacatcacctcgctggataactgcctgacgcgcctgcgcctgtcggtggccgacatgagcaaggtcgacgatgccgcgctgaaagccaacggcgccatcggcgtggtgcacctgaaccagaccaatctgcaggcgtttaattttgatcgggtggtagatcgccacggcagctggtgcacgcagtgggactttgtcgccgaccgctttggcgtggccgatctgctgcccttcaccatctcggacatggatttcgccaccgctccctgcatcattgacgcgttgcagcagcggctgaatcacggcgtgctgggctacagccgctggcagcacgaggattttctctccgccctgcagcactggatgcgcagccgctttgccagcgagatcgcggcagagtcgctggtgtatggcccgtcggtgatttatatggtggcgcagctgctgcgccactggacgcaggcggaggatgaagtgctgattcatacgcccgcctatgatgcgttttaccagacaatcatcgggaatcagcgcagggtgctggagttaccgttgcagcgcgctggcgacacatggcgctgtgatatggctgagctggaaaccctgctggcgcggccgcgctgtaaggtgatgttattgtgcagcccgcacaatcccaccggcaaagtgtggcagcgcgcagagctgcagcagatggcggcactgtgtgaacggcatggcgtgagcgtgatcagcgatgaaatccatatggatatggtgctgagcgaggcgcgccatacgccgtggtgcgaggtggcacaaggccgctgggcgctgtttacctcggcctcgaagagcttcaatattccggcgctgaccggcgcctggggcattattccggacgcggacgatcgccgggcgtggtttcacgcgctgaagcagcaggacgggctgtcgtcaccggcggtgatggcgctggctgcgactattgccgcctaccgtcacggcgcaccatggctcgacgcgctgcgcgattatctgcgcgccaatatgcagcacattgcgcaacggctcaacgcggcgtttgccgggctcaactggcaaccgccgcaggccacttatctggcatggattgacaccgcgccgctggccattgatgacgtcgcgctgcagcagcggctgatccagcagcataaggtggcgattatgccaggcagcacctacggcagcgccagccgcagctatctgcgtctcaacgctggctgcccgcgcagcaagctggatgacgggctggaccggctgattgccgcactgcaatccgagtgcgacatgattgatgcgaaacttcccctcaccgaccttcaccgccacctcgatggcaatatccgcgcccagaccatccttgatttaggtcgtcagttcaatcttgcgctgcccgccgatacgctggatacgctgcgtccgcacgtgcaggtgaccgccaaccagccggacctggtgagcttcctgcagaagcttgactggggcgtcaaagtgctgggcgatctcgacgcctgccgccgcattgcgctggaaaacgtcgctgacgccgcacaggccggtatccattatgctgagctgcgcttctccccgggctatatggcgatgaaccatcagctgccgattgctggcgtggtggaagcggtgattgatggcgtgcgcgcgggcgtgcagcagtacggcgttgatgtgaagctgattggcatcatgagccgcaccttcggcgaagaagcctgcctgcgcgagctggaaggtctgctggcgcaccgcgacggcatcactgccgtcgatctggccggtgacgaactgggcttcccgggcagcgaattcctcagccactttaaccgcgcccgcgatgccggattccgcatcaccgtacatgccggtgaagccgccggaccggagagcatctggcaggcgatccgcgagctgggcgctgagcgcatcggtcacggtgtcaaagcgattgaagaccgcgcgctgatggatttcctcgccgaacagcgcattggcgttgaatcctgcctgacgtcgaacattcagaccagcaccgtggcctcgctggccagccatccgctgaaggcgttcctgcagcatggcattctggcaaccatcaacactgacgatccggcggtacagggcattgagctggcgcatgaatatgaggtcgctgcgccacaggcgggcctgagcgccgccgagatgcgccaggcgcaggagaacggtattgccatcgcctttttgaccgaggcggagaaagccgcgctgcgccagcgcgtggcggcataa

SEQ ID NO: 64841 - DNA, 981 bp, Glycine max
  Peptide Sequence Number=SeqID_156526
gtcgcgacgctgggggctgcggtagcgcagcgtttcggtgagctgccgtttctgtttaaagtgctgtgcgccgatcagccgttatcgattcaggtgcatcccagtaaaactgccgcagaagccggtttcgcgcgtgaaaacgcggcgggcattccgctcagcgccgccgagcgcaactataaagatgctaaccacaagcccgaactggtgtatgccctgacgccgttccaggcgatgaacggctttcgcgaactgcctgagattgtctcgctgctggagccggtcgcgggcgcgcatccgcagatcgcccatttcctcgaaaacgccagcgaagccgcgctggctaaactgttcgctaccctgctgtcgctgaaagacgaaagcaaaacccgcgcactcggcgtgctgaaatccgcgctgaacgcgcgcgaaggcgaaccgtggcagaccatcaaaacgatcgccaacgactatccggacgataatggcctgttctcaccgctgctgctgaatgtcatcaccctgcaaccgggtgaggcgatgttcctgttcgccgaaacgccgcatgcctatctgaaaggcgtggcgctggaagtgatggccaattcggataacgtgctgcgcgccggcctgacgccgaaattcattgatattccggaactgctggccaacctgaagttcgaggccaaaccggcggcgacgctgctcacacagccgcagacacagggcgacagcctcaacttcccgattccggtagaggattttgccttcgccatccacacgctttcggccacgccgcaaacgctggcacagcacagtgccgccctgctgttctgcattgaaggccaggcggtgattgaaaaggccgggcagcagctggtactgcaaccaggcgaatcctgctttgtcgcagccagcgagtcgccggtgagcgcggcggggaacgtccgtctggcgcgggtgttcaacgcgctgacgtga

SEQ ID NO: 64842 - DNA, 289 bp, Glycine max
  Peptide Sequence Number=SeqID_156527
gccgcggacgcgccgccacctcatcaggctggtccagccggattgtttgatacagagctgtatttgcggcatttggttcgccagcaggcggccaaccaccgggcacatagccagggctttacttcttttccgtgccctactccggaccagttcagggcagaggtcgcatggcctggagattggcccgaggcccaggtaggagaggcaccagcagaggctcccgacgaggcagatgaggcccgcgaggacgaagagatgaccgatttacttgatttcttaggagggagcg

SEQ ID NO: 64843 - DNA, 332 bp, Glycine max
  Peptide Sequence Number=SeqID_156528
gggttcccacggaccttaagagaataaaggtcattcctgagtggctcactccaccaacaccactcgttgagttggtgaggaaccatgttccctcatgggaagatgctcagaaaaagggtgtcgatggaagaagcccagagtttcaagaacctctagatttgagagatgcaggagaaagccttggggttctcatgagccttaagggctgtgtgtttccatggggtgaacttaactattggaggggtgtaacacttgcttcccaaggaagcttctcaaggaaactttcttccttcatgtattttggcatgagagtgagcttagctattggaggg

SEQ ID NO: 64844 - DNA, 117 bp, Glycine max
  Peptide Sequence Number=SeqID_156529
atgagactacaatctagaacttcaaccgaagaggtgactcaggtcaggccagaccaggctttgaaaggcctaagcctagcctacgatgaatctttgaggcctgagtctggcctatag

SEQ ID NO: 64845 - DNA, 1494 bp, Glycine max
  Peptide Sequence Number=SeqID_156530
atgggttgttttcttcattgctttggttcctccaaaagcacaaaacctaggcgcaaggcacaacatcaccaccatcgaattgctagagacaggttggagcaacctacggcgtgttgttctgttcaggattactccgaaacagtggtacttagcactgcatcacaagaagtccaggctaaacctttggagcagataaacgtgagccctaaaaagaaagtaacttttgatgtcaatgtgaaaacgtacgagcccgagcctgatgaagttgctgattaccaacttgtgagaagtgaagagggtagagaggaaagtgcttttgttgaaaagttaagccaaacaaagtcttactctgaagtaagttcggtgacttcagcgaggtcttaccctacaaaccataggtaccacagttgcacgtgtagtgatgatgaagatggagcaatggagtattgggatagtgatgttactgatgaggatgaggatgatgatgatgatggtgatagtgacatgggagaagagtatgatgaagtggaagaggattttgaagatggaatagtgtactcaaggtcaagaaatggtgctaatcaagtggttgttggagaggtggaaagtccaattccaatgcatgataaggatctgaagtcaattgggttgaactccaatgttcgagataggagtgtgtatgttaatcctttgctgaaccctgtggagaacctcactcaatggaaaacagttaaagctaaaagggcacccccattggtgtctcagaaggagaatttggttttgaatcaagagtctagagctgcatttggagcagaaacagaaacaccaaagaagttgaaccgggaaattgcagttgatgctagcctttcgaattggttgggttcatcagaaactacacctgttgttagcaagggtttgtatgcgggtaccccggagaggagcagcagcagttcacaaggctcaaattcagtggtgagccatgaagataggcctattttaggtgcattgacagttgaagagctcaaacatttttcggcttcttctttgccaagaaaatcaccaagggatgagatgatgcccattataggcagtgttgggagctactggaattgtgggggctatgctgaggattctggctcagcaaaccgagtaagatcaagaaaaggtgtgagtgcactctgttttgggtataaagatttgacaatgggcattgataatagtttagatattgaaatcgtgttgatgtctggtcacatcaatcttattgtgcaccacaagggtagattagaaagggatgatcatggcacattggaatatgtggacaatgagttttacgtttgggagaattgtgaagtggatttgatgacattgtggattgttcttgacttgtgtaaatctcgtgggggtattgctcaccatgataaagatgtgcatgtctactttgagcatatagtggatgatttcccaaatcttgtaggtggtgaatcaaattga

SEQ ID NO: 64846 - DNA, 1734 bp, Glycine max
  Peptide Sequence Number=SeqID_156531
atggcagtggtagaagaaaagggctttgcaagtggaagagaggattacacccaagatggcacagtggacctcaaaggtagacccgttttaagatcaaatactggaagatggagagcttgttccttcatagtagggtatgaaatgattgaaagaatggcatattatgcgatagcatcaaacctagtgcagtatctaacaaagaagctccacgagggcactgtgaaatcttcaaacaacgttaccaactggtctggtacagtgtggattatgccagctgcaggggcttacatagccgatgcctatcttggccgttattggacctttgtaatagcatcagccatttaccttctgggaatgtgtttgttgactctagcagtgtcactaccagcattgagaccgccaccatgtgctcccggcatagcagacaaggattgccaacgagcatcgtcgtttcaagtgggaattttcttctttgccttgtacatcattgcagcaggcacagggggaaccaagcccaacatttccacaatgggagcagaccaatttgatgagtttgagcccaaggagaggtcccaaaagctttccttctacaactgcccaactctcttggtttacatacaagacaaggttggttttggacttggttatggaatcccaaccattgggctagccgtttcagttttggtgtttcttttaggaactccactttataggcatagattgccctcaggaagccctttaacaaggatggttcaggtcttggtggcagctatgaggaagtggaaggtacatgtcccacatgatctaaatgagctacatgagttgagcatggaagacttccttgacaaagctgcggtaaagacaggccaaacatcaccgtggatgctttgcactgtgactcaagttgaggaaaccaagcaaatgatgaaaatgattccaattttgattactacatgcattccaagcaccataatagctcaaaccaccacactcttcatcagacaaggcaccacacttgacaggaacatgggaccccattttgaaatccctccagcatgtctcatagcatttgtaaacatcttcatgctgacaagtgttgtgatctacgaccgccttttcgttcccgcgatccggcgctacacaaagaactccagagggatctccttgctgcagagacttggaattggccttgtgctacatgttattataatgctcactgcatgctttgttgagaggaagagactcagtgttgcaagagaaaaacacctcttaggtgcgcaagatacaattcctcttactattttcatcctcctccctcagtttgctttgacagggattgctgatacctttgttgatgttgctaagttggagttcttctatgatcaagcaccagaagccatgaaaagtttgggaacatcatatttcacaaccaccataagcattggaaattttcttaacagttttcttctttcaactgtttctgatctcacccttagacatggtcataagggttggatcttggataatctaaatgtctcccatttagattattactatgcattcttggccgtgctaagctctaccaacttactttgctttgtggttgttgccaagttatatgtctacaatgatgatgtaacacaaaccaaaatggagttgggtatgaaccatgcttcatctaagggcaatactggaataagtttaagtagcccacaaccagatgacaagtcctag

SEQ ID NO: 64847 - DNA, 1629 bp, Glycine max
  Peptide Sequence Number=SeqID_156532
atggattctgcgagaagttggttacaaaaatttcaaccacgtgataaattgagggcctctacaaggaacaaagatgatactaatggcacaaatgaaattccaaatgtgcctatggatgatacatctctttccaatgtcacaaaacaaaaggttacggcagccaaacaatacattgagaaccactacaaggaacaaatgaaaagccttcaagagaggaaggagcgtcgaaccatcttggaaaagaagttggctgacgctgatgtctccgaggaagatcaaaataacctacttaaatttttagagaaaaaagaaactgaatatatgcgtcttcaaaggcacaaaatgggtgttgacgattttgagttactaactatgattggaaaaggtgcatttggggaggttagagtctgtaaggaaaaggctacggatcatgtatatgcaatgaaaaagttaaagaaatcagaaatgcttcgtagaggccaggtagaacatgttagagctgaaaggaatctcctagcagaggttgacagcaattgcatagttaaactttattgttcttttcaagatgacgaatatttgtatcttattatggaatatctaccgggtggagatatgatgactctactcatgagaaaggataccttgactgaagatgaagctcgattttatgtaggagaaacaattttagctattgaatctatacataaacacaattatatacatagggatattaagcctgacaacttgttacttgataaatatggacatttgagactatcagactttggactatgtaaaccattagactgtagtacacttgaagaaacagatttcactacaggtcaaaatgcgaatgggtctacacaaaataatgaacatgtagctccaaaacgcacacaacaagaaaaattgcaacattggcagaaaaatagaaggacacttgcgtattctactgttggtacaccagattatattgctccagaagttctattgaaaaagggttatgggatggaatgtgattggtggtcacttggagctattatgtatgaaatgttagtgggatatccacctttttattctgatgatccaatgtcaacatgcaggaagatagtaaattggaaatctcacttaagatttcctgaagaagcaaggttatctccagaagctaaagatcttataagtaagcttttgtgtgatgttaatcagaggttgggttcaaatggtgcagatgaaataaaggctcatccattcttcaacggtgttgaatgggataaattgtatcaaatggaagctgcctttattcctgaggtcaatgatgagttagatactcaaaattttgaaaagtttgaagagtctgagagtcaaactcactcatcatcaagagttagtccatggaggaagatgttttcttctaaagacttgaattttgttggatacacatacaagaactttgaaattgtcaacgactatcaagttcccggaatggctgaattgaggaagaaaaattcaaaagcaaagaagccatctgtcaagtccttatttgatggtgaaagtgaggcatttgaggcttcagaatcaactacaagcataactaggaagtatgatgatctacctcccatgtcagaatag

SEQ ID NO: 64848 - DNA, 1143 bp, Glycine max
  Peptide Sequence Number=SeqID_156533
atgcaaacggtcaaatccctcactgaaaaaggccttgaagtcactgaagataaaaggcagaacctatacaaggtcaaatgtgatgttgtgattatggggtcaggttgtgatggaggagttgcagctgcagttcttgcaaactctgctcataaactatacgaatcggggggcattatgccaagtcttgatgggaagatgatgatcctggctggctcaacagttggtggaggttctgctgtaaacaggtctgcaagcatcagaacacctgattctgttctgagggaatggtccaaaaaatataaaattccactctttgcaagctctgattaccaatctgccatggaatcagtgtgcagaaggattggtgtgacagagaagtgcaagaaggaaagctttcaggatcagattctcatacaaggatgtgagaaaatgagctcgaaagtagattcagtggctataaattcctcagaagatcactattgtggttcatgctgttatggttgtagaacaggagataagaagggcactgactctacttggttggttgatgctgtaggaaatggtgcagtgatcctcactggcggtatcataacttcgatccacaaggaatatgcagtggattccaccccaagattcatcatagaaacactttctctaggaccaggatcatttttggcgtttgtcccgtggctttcaggagaagtgaaggctgaagggagagttacttacagacttgaccaagcagacaaagaaagccttagagttggactgaggatggcattgaggattttggttgcagcaggtgctgtggaagtgggaacatacagaagtgatggccaaagaatcaaggaggaagaattggaggagtttcttgacactgtgacaattgttgggggtccaaagtcaaggaatgaagtgtggacagtgtttgccactgcacatcagatgacaagttgtagaatggttgccactgaagaagaaggtgcacttgatgagaatggtgagagttgggaagcaaaaggcttgtatgtgtgtgatggcagtgttttgccaagtgcagttggtgtcaaccccatggtaaccattcagtctacttcttactgtattgccactaagattgcagaatcacttagcaaaccatga

SEQ ID NO: 64849 - DNA, 2199 bp, Glycine max
  Peptide Sequence Number=SeqID_156534
atggcccgaaacctaggaggattactggcgctacttttcgctgtttcgatctgcggagccgtcacgattcccggccccgtctccgatgctcaccgttccgccgcgttagagctcttcgatggatcgttttcaagtttagaagaggcctatgaggcactaagagtttttgagattcttacgattgggaataagcctgatgtgagcacaacgacttgcaagaaagtagtggaaaaccttgggtcgtcatcgcctgtgaaggatttgttctatgcgttaaaggttaatgacatattaaaatgcaaggttaatggggatgttttcaaggatattgctttgagacttaaagccactgtcaatgatgcgagtactttggttgagatgtactattcaataggaagtttggttcttataaaggaccaggcttctgatgttgatgtgcttcttactgatgccgatggatccttccattcaatcaaggctctgagccaaagtgatggaaggtggcgttatagttctaataatccagagtctagtacctatgctgctggattagcacttgaagcacttgctggagtgatctcattagcatcttctgaaattgatcagtctagggaatcttggcacttctatcgatatcttatatcagttcctttttgtcaggtgaatacagtgaaaaatgatatattgaagcttttcgacagcattgagaaatatgatgatggaacattctattttgatgagaaatttgttggtggacgtgagcatcagggttctctttccacaacttcttctgttgttcgaggggttacagcatttgctgctgtaacttctggaaaaataaatcttccaggggataaaatattgggtttagcaaattttttcctgggaattggaatcccaggagatgccaaggacttcttcaatcaagttgaatcattagctcttctagagaacaacaagcaaggtttcgatcccattggtactgtcacttcctgcaacggtttattcattatccaaaaaagatcagctcaagcacctgtcaaaattcagtgttgttttctggttctcaattacacttgggaaaacatgacaaatttctatttccaaatgaatcaggttagggtgaacactgtacttggttcagctgcaccacctttaacagttaagcttgtgcaagctttccgctctaacgctaaagattcagctattgagagcaaggagctccaatatgatcaaaataatggaattcatttcttggaagctttcccagacaatgtagatgtgggaacttatgtgtttgtttttgagattgcacttcacgattctgctggtgaaaaagtttatgctactggaggccaaattcatgtaccaatatatgtcactggcattattaaagtcagcaatgctgaaattgctgttcttgacagtgatcttggaagtgttgaaacccagaaaacgctagatttggctggaaatgatgatgtttcactctcagctaaccacttgcaaaagttgcgcttttctttccagttgacaacacctcacggtcatgcttttaagcctcatcaggcatttttcaagttgaagcatgagacaaagcatgaacacatctttgtggttggaaatactggcaggaagtttgagattattcttgattttcttggtttggtggagaaattttattacctctctggcagatatgacattgagctgactgttggggatactgtcatggagaactctttcttacggctgcttggtgaagttgatttagatcttcccgaagcacctgagaaggcagcccgtcttcctccactccctgtcgatccttactcaagatatgggcccaaagccgagatagcccacttattcagggctccagaaaagcgaccaccccaggaactctctcttactttcttgggtttgatccttctgccatttattggctttttagttgggctgttacgcctgggagtgaacttgaagaattttccttcttcagctgtacctgctacatatgccttcttattccatcttggcattgctgcagttctattgctttatgtacttttctggttgaagctggacttgttcactacactcaaaactgtaggatttttgggagcttttctgttgtttgtgggacacagaattctttcccatctcgcttcaacatcatctaagttgaagtctgcatga

SEQ ID NO: 64850 - DNA, 4365 bp, Glycine max
  Peptide Sequence Number=SeqID_156535
atggggacaatcctaatgtccttctcgaagcccgtcgcacctccgacgacgaatctcaccgtcgtcgtcgtcgacacccaggaagcaacacggtcgattagccttattggcggtgacagagaaggggttgccaaaggtattggcggtgagcttcgtcggagaaggtgcgaggctgtggttgccaatcctgtagttgggtcccatatttgggtggaggatcctgatgtcgcttggatagatagtgaggtcttggaggttaaaggagaagaaattaaagtcctttgcacttcagggaagacgacttacaccgggaatatattaattgctgtgaaccctttcataaagcttcctcatttatatgatagccatatgatggcccaatataaaggagcagcttttggtgagctaaatccacatccctttgctgttgcagatgcagcatataggcttatgataaatgagggaatcagccagtcaatattggttagtggtgaaagtggagctggtaaaacagaaagtaccaagttgctcatgaggtatcttgcttacatgggtgggagagctgctgttgctgaaggtagaactgttgagcaaaaggtcttggagtccaatcctgttctagaagcctttggcaatgcaaagactgttaggaacaataattcaagtcgttttggtaagtttgtggagattcaatttgaccagagtggaagaatatcaggggctgctatcaggacttatctgcttgaaagatcacgtgtttgccaggtgtcagatccagagaggaactatcattgtttctacatgctctgtgctgcacctccagaggatattaaaaagtacaaattaggagatccaagaatgtttcattatctgaatcaatcaaattgctttgagttggaagggtttgatgaatctaaagaatatagggatacaaggagagcaatggatattgttggaataagttctgaggagcaggatgcaatatttaaagttgttgctgcaattttgcatcttggcaacattgaatttgccaaagggaaggagatagactcatctgtgcccaaagatgaaaaatcttggttccatctacagactgctgctgagcttttcatgtgtgatgcaaaggcacttgaagattctctttgcaaacgtgtaattgttactcgtgatgaaacaattacaaaatggctggatccggaagctgctgcacttagccgagatgccttggctaagattgtgtatacaagattgtttgactggttggttgataaaattaataattctattggtcaagaccccgagtctaaatccttaattggcgtgctggatatttatggttttgagagtttcaaaactaacagtatgtttcctagatctacacatgaaacttttgcccaaaagctgtatcagaccttcaaaaatcacaaaaggtttagcaagcctaaattatcacgtagtgacttcacaatttgccattatgcaggagatgtcacttatcaaactgaattgttcctcgacaagaacaaggattatgttgttgcagagcaccaggcccttctttatgcttccaaatgcccctttgtatcaggcttgtttcccccttctcccgaagaatcttctaaacaatcaaagttctcttcaatcggttcacgatttaagcaacaattgcaatctttacttgaaactctcagtgccactgagccacactacattcgttgtgtaaaacccaataatcttcttaagccatcaatttttgagaataaaaatgttctgctgcaactacgttgtgggggagttatggaagcaattaggataagctgtgctgggtatcctactagaaaaacctttgatgaatttgtggatcgatttagccttctttcacctgaagcattgactggaagttctgatgaggtcactgcttgcaagaggattctaaagaatgttggactcgaaggctatcagattggtaagacaaaggtgtttcttcgagctggtcagatggcagagctagatacccgtagaagtgaaatcttaggaaggtcagcaagcattattcagagaaaagtccgttcctatttggcccgccaaagtttcatcttgcttcgtttgtctactgtgcagattcaagctgcgtgcagaggacaacttgctcggcaagtttatgagggaatgcggcaggaggcttctagtttggtgattcagaggtgcttccgcatgcatattgctcggaaggcatacaaagatttgtatacctctgctgtttctatccagactggtatgcaggggatggctgctcgttctgagctacactttagaaggcagactaaagcagcaattgccattcagagccactgccggaaatacttggcagaacttcattttgcaaaattgaagaaggcagcaattgcaacgcaatgtgcatggagaggaaaagttgctcagcgagaattgcgaaagctcaagatggctgcaagagaaactggagctctccaagctgccaaaaataagcttgaaaagcaagttgaagaccttacattgagattgcagctggaaaaacgtttgagggttgacattgaagaagcaaaagcacaagaaaatcaaagattacaatctgctttgcaagagatgcaacttcagtttaaagaaactaagttccttcttgaaaaggagaaggaggctacaaaaagagcagcagagagagtgcctgtcatacaggaagttccagttgttgacaatgctttgttggaaaagctcagaagtgagaatgagaaactcaagaacatggtgagttcattggaaaagaaaattgatgaaacggaaaaaaggtatgaagaggcaaacaaagttggtgaagaaaggttgaagcaagctttggatgcagaatcaaaagtaatccagttgaagactgctatgcaaaggcttgaagagaaattcatagacatggaatctgcaaaccatattcttcagaaacaatctcttttaaactcatctgtgaaaacaatagcagagcacttgtcttccccattggatgagaagttagaaaatggtcaccatgcagcagaagagaagaaagctgttgatacatttgttacacctgtgaaacaatttggtactgaatcagacagtaaattgagaagatcttacattgaacgacaacatgagagtgttgattcacttgtcaattgtgttatgaaaaatattggcttcaaccatggaaaacccattgctgcattcaccatttacaaatgtcttctccactggaaatcatttgaagctgaaagaactagtgtatttgatcgccttatccaaatgattggttccgaaattgagaatcaagacgacaatgatcatatggcctattggctgtcaaatacatctgcgttattgtttttacttgaacaaagcctgaaatctgggagttcagcaaatgctaccccagctagaaaaccgcctaatccgacatctctctttggaagaatgaccatgagttttctttcatcaccttcttctgccaaccttgctgcccctccagcagatgttgtacgcaaggtagaggctaaataccctgctttgcttttcaagcaacagctcacagcctattttgagaaaatatatggcatcattcgggataatttgaagaaggatttaacaccgattcttgcattatgcatccaggcaccaagaacatcaaaaggagggttacgttctaaccgatcccttgctaaggattccccaatggttcactggcagagtattattgaatccctcaatatgctcctctgtacactgaaagagaactttgtgccccccgttcttatccaaaagatctttagtcaaacattctcatatattaacgtgcaactcttcaatagcaatggggaatatgtgaaagctggattagctgaattagagttgtggtgctgccaagcaaaggaagagctccaactgatagcgttgagcacaaacttgcagtatgcagggtcatcttgggatgagcttaagcacataagacaggctgttggattcttggttattcatcagaagtataggatttcctatgatgaaatcatcaatgatttgtgccctatcttgagtgtccagcagctgtatagaatatgtacactttactgggatgctaactacaatactcgaagtgtatctccagatgtcctttcaagcatgaggatgctaatggctgaggactccaacaatgctcagagtgattctttcttgttggatgacagttccagcatccccttctcagtggatgatctctctacatcactgcaagagaaggacttctctgacatgaaaccagcagacgagcttctcgagaatccagccttccaattcttaaacgagtag

SEQ ID NO: 64851 - DNA, 1050 bp, Glycine max
  Peptide Sequence Number=SeqID_156536
atgtcccgtgactgtgattcccttcctgaaaacaccattgttgtgagtcctctcggctctctctactctgcgcctacccttttcatttttcaagctgaaaatggaatctttgtttgtaactgtgtctgtgtgcaggtggggtgtggggcggcgggtgtggatttcttagctaccgttgcaacttatcccaagccagatgacaaaatcagaagcacttccttcaagattcaaggaggtggcaatgcaggtaatgcgttaacctgcaccgcacgcttaggcctcaaaccaagaatcatctccaaggttgcagatgacactcaaggcagggaaatattacatgagctagaggttgatgggccagatgatcttccagagtcaaatttgctaactgcattgaacggagcaagaattgtttatttggatgggagattgcatgaaactgctctagttgttgcacatgaggcagttaagaagaatatacctatcttaatagatgcagaaaggctgagagaagggttggatgatctcataaaattagctgattatgtcgcatggacagaggcatcaacagtttctaaagcacttgtttgtatgcttttaaggttgcccaacatcaaatttgtgattgcaactttgggaaaagatggttgcataatgcttgagagatgtgttaatgaggatccttccgctgaagaagtggttgttgacaaattactggaatctctggagatgagaaagaatggaagcacacacatcccaacctgcatatcatcgccagtgacaaaattgcatgcagaaggtataggaacagtttgcagcaggttatacattggaacagccaagaacataccaccatcagagcttattgatacaactggtgctggagatgcatttattggagccgttctctatgctatctgtgccaacttcgagccagagaaaatgctgtgctttgctgctactgtggcagcttccaagtgcagagctcttggagcaagaagtggtctcccttaccgcatagatccatgcttggcatccttcatgcagtag

SEQ ID NO: 64852 - DNA, 270 bp, Glycine max
  Peptide Sequence Number=SeqID_156537
atggaggatgggggtagtgtcaaagcagcaggcagtactactatgagtagtttcaggattgggagtagatcagttcggagcaacagtggtgtggaaatctttgccaactcctctttccaccaagaagaccacgaagaggcactgaggtcgatgttcatcaacttgggtcgcaataaaggcgaggtttgcttgagagaccggccagaatcgccgaagaggacaatgagaagttcatgctcgatcaagcttagggatcgcattgatagatga

SEQ ID NO: 64853 - DNA, 576 bp, Glycine max
  Peptide Sequence Number=SeqID_156538
atggaggaggaaggtgacatatacgacggtgctccagctcagttccctatctcattcgggaagcaatcgaagcctcaaacccctcttgaagccatccacactgcgacacgtcgttccaattccaatcccaaaaccgccaacgaccttccttctatctcctcctcttccagggaatgcctcttggttgatcatgacttcaaattcttggaacacaagaaatcaacatccatggattcacagggccagacaacttcattgcagagacttcagaatgtagaaaagagaattgtgaaggttttggagcttgcaggaggagtcatggatgagcttgcaagccctgttggtcctaggaaggatgtggtccaaaaccactgccttgagttcatgcaattaatcaaggacattcaggttgcattgcgtgatgaaatcaaaagtgcttgtgaatatcgtccatttgagaaatgtgattatggttcaagaatagccaatgagatttgtcacaagaaagtggaatttattatgtcccagttggatgctataaaacaaactgtagatgagtatcatgtagcagtttga

SEQ ID NO: 64854 - DNA, 117 bp, Glycine max
  Peptide Sequence Number=SeqID_156539
atgagggaaatgaacgggaatcgcgaggaatcgagaatagatcatgaggagggttatggtgattgcgttaagagaaaggaacggagtgtgcagaggttggagaataacaatttttaa

SEQ ID NO: 64855 - DNA, 570 bp, Glycine max
  Peptide Sequence Number=SeqID_156540
atgtctaaagatgacaactcttcttcactggattcttcttcttctgaccttcaattatctctctctttaacactctctccctatgccaccacttcttctccttcatctatttctcattcctgttctgctgctcttgccaccgctgccagtcaagttgttggatggcctccccttggagcatatagaatgaatatctataatagccaggcaaaatcaccagccacagaagtattcaattctacagttgacaacaaaagagcaagcaatagtactggggttaggaagactgcagatggtggcagtgatagtagcaacattattttcaaagaaaaaggaaacctcaggagttccctgtttgtgaaagtaaaaatggatgggataccaattggaaggaaggttgatttaggtgctcatggttcctatgaaaccttagctcaaaccttggaggatatgtttgatgaatcagctacagtcctcactcacaaaggtggaaaaggagccccgcaaaatccaactggtgggttttaccagccgatatccattggaatggatatttttggcatgacatga

SEQ ID NO: 64856 - DNA, 4278 bp, Glycine max
  Peptide Sequence Number=SeqID_156541
atggagggtgggggtagtagttttaggattggaagttcatccatttggaggaacagcgacgcggcggagatcttctcaaactctttccaccaagagaatgatgaagaggctcttaaatgggctgccattcagaaacttcctacagttgcgcgtttgaggaaagctttgatcacttcacccgatggcgagtccaatgagatcgatgtaaagaaacttgggttgcaagaaaagaaagctttgcttgaaagactggtgaaaactgctcaagaggacaatgagaagtttttgctcaagctcaaggacagaattgatagagttggaattgatcttcctaccatagaggttcggtttgagaacctgagcatcgaagcagaagctcgtgcaggaactagagctttgcctacattcactaacttcatcgttaatatactggagggcttgttgaactctcttcatgtacttccaaacagaaaacaacatttaaacattctagaggatgttagcggaataataaagcctggaagaatgacattgcttttaggccctccaagttctgggaaaaccacactcctactagccttggctggaaaacttgatccaaaattaaagttctctggaaaggtaacttataatggtcacgggatgaatgagtttgtaccccaaaggactgctgcttatgtcaatcaaaatgatcttcacgttgcagaattgacggtcagagaaaccttggccttctcagccagggtccaaggagttggacctcgttacgacttgctggcggaattgtccagaagagaaaaagaggcaaatatcaagcctgatccagatattgatgcctatatgaaggctgtagcatctgaaggacagaaggcaaatatgataacagattatatcctgaggattttgggactagaggtttgtgctgatactgttgtaggaaatgcaatgttaagaggtatctctggtggacaaaggaaacgtgttacaacaggggagatgctagttggaccagctaaagctcttttcatggatgaaatatccacaggtttggatagctcaacgacttttcagattgtgaattcactaaagcaatatgtccacattctcaaaggaaccacagtcatctcactcctgcagccagcaccagagacttacaatctttttgatgacatcattctactctctgatagtcacattgtgtatcagggtcctcgtgaacacgtgcttgaatttttcgaattaatgggttttaaatgtccccagaggaaaggtgtggcagactttttgcaagaagttacatcaaggaaagatcaggagcagtactgggcacacaaagatcagccttatagatttgtcacagccaaagagttctcggaggcacataagtcatttcatattgggagaagtcttggtgaagaacttgctactgaatttgacaagtctaagagccacccagccgcattgacaaccaaaatgtatggagtgggaaaatgggagctgttaaaagcttgcttatcgagggaatatttacttatgaagcgcaattcattcgtctacaccttcaaactttgccaacttgctgtattagcaattattgccatgaccattttcctccggaccgagatgcacagagattcagtgactcatggaggcatatatgtgggtgcattgttctatggtgttgttgtgattatgttcaatggattggctgaactttccatggtcgtttcacggcttcctgttttctacaagcaaagggactatctcttcttcccttcatgggtatatgcacttcctgcatggatcctaaaaatccccttgacttttgtggaagtgggtgtttgggtattcctcacctactatgccattggttttgatccatatgttggaagattgtttaggcaataccttgttcttgtactagtaaatcaaatggcatcggcattgttccgattagttgcagcagttgggagggaaatgacagtggctctaacacttgggtcgtttacactggccatcctatttgctatgagtggttttgtcctatcaaaagaaaatattaaaaaatggtggctatggggcttctggatctcacctatgatgtatggacaaaatgccatggtaaataatgagttccttgggaagagatggagacattttctacctaactcaaccgaggcactaggagttgaaattttgaaatcccgtggattcttcactcagtcatactggtactggataggtgttggggctttgattggatatacattacttttcaactttggctacatccttgctctcacatacttaaatccacttgggaaacatcaagctgttatatcagaggaacctcaaatcaatgaccagagtggtgatagtaaaaagggaactaatgtgttgaagaacatacaacgtagcttctctcagcactcaaatagagtgagaaatggcaaaagtttaagtggaagcacctctcccgagacaaaccataacaggacaagaggaatgattcttccttctgaacctcattccatcacctttgatgatgtaacatattctgtcgacatgcctgtggaaatgaggaatagaggtgttgttgaggataaattggctctattgaagggtgtcagtggagctttcaggccaggtgttctcactgctctaatgggtgtcacaggtgcaggcaaaacaactctgatggatgtactcgctggtagaaaaactgggggatatattggggggaatatcacaatctctggttatccaaagaagcaagaaacatttgcacggatttctggatactgcgagcaaaatgatatccactctcctcatgttactgtatatgaatctttgctttactcagcatggcttcgactgtccccagaaatcaatgctgacaccaggaagatgttcatcgaggaagttatggaacttgtggaactgaaagcactaaggaacgcattagttggattgcctggtattaatggtctctcaacagagcaacgcaaaaggttgactattgcagttgaacttgtggcaaatccttctataatatttatggatgagccaacttctgggctagatgcaagagctgctgctattgtcatgagaacagttaggaacacagtagacaccggaagaacagttgtctgtaccatccatcagccaagcatagacatatttgaatcttttgatgagcttttgctaatgaagcaaggaggccaagaaatatatgtggggccacttggacatcattcttcccatttaattaattactttgagggaatccaaggtgtcaataagattaaagatggctataatccggcaacatggatgctggaagtctcgacttcagcaaaagaaatggaattggggattgattttgctgaggtgtacaaaaattcagagttatacaggagaaacaaagcacttattaaagaattgagtactccagctcctggttcaaaagacctttatttcccatcacagtactcaacctccttcctcactcaatgcatggcttgcttatggaaacaacattggtcttactggcgcaatcctctatacactgctataagatttctttactcaactgctgtagctgctgtgcttggtagcatgttctgggaccttggctccaaaattgacaaacaacaagatcttttcaatgccatgggctccatgtatgctgctgttctccttattggcattaagaatgctaatgcagtgcagccagtggttgctgttgagcgaacagttctaattgagctcccatatgttctagtacaagctgtggtatatggcattataatttatgccatgattggttttgagtggactgtaactaaagttttctggtacctattcttcatgtacttcaccttcctgaccttcacctactatggcatgatgtcagtagcagtgaccccaaaccaacacatttcttctatagtttcctctgcattctatgcagtgtggaatctcttctcaggattcatagtcccacgaccgagaattccagtgtggtggagatggtacagttgggcaaatcctgtagcatggagtttgtatggattggtggcttcacaatatggagatataaagcaaagcatggaatccagcgacgggagaacgacagtggaaggctttgtaagaagctactttggtttcaagcatgattttctgggagtggttgcagctgtgattgttgcattcccagtagtctttgcattggtctttgccatatcagtgaagatgttcaatttccaacggcgttaa

SEQ ID NO: 64857 - DNA, 354 bp, Glycine max
  Peptide Sequence Number=SeqID_156542
atgcctgcgacacttggaaaaacaggtaataaggagcctaaatcctgcgccctcatctcatttgtgatccccgggacctccggtttgctggtgctcggggcgttggcgtcaaccagtatcgcatcatctgcagcgtctgcgctggctcggcgccgaacgagtgctgcgcagccagctattcctgcgccgtcacggcggttgggcggtattctttggccgctttctgtcgccgctgcgagcaacgttaccgctggttaccggtgccagcggtacgccgctatggcgttttcaggtggccaacgttgcatcgggtttactctggccattgatcctgctggcgccgggagcatttag

SEQ ID NO: 64858 - DNA, 204 bp, Glycine max
  Peptide Sequence Number=SeqID_156543
atgtttatttccttgttacacttaaacgatgcaaatccgaagacgagtcccgtgaagcaagaagcgagtcagacggaggatgaagaagatgaagatgtaggacttcccccagagctagagaggataattgctcaggaggatcgagagatgaggccgcatcaagaagagacaaagctcatagacttaggtgtcgatagtgaatag

SEQ ID NO: 64859 - DNA, 150 bp, Glycine max
  Peptide Sequence Number=SeqID_156544
atgtcgcggaacttcacggattgcctaacgatgggtgtcaagtaccttgaagtggtcaagcgagggtcgcatcccaacaaacagatgatccccggacgaaatcaggcaaaacaccaactgaatcagtcgctaaacatggaacacgaatga

SEQ ID NO: 64860 - DNA, 291 bp, Glycine max
  Peptide Sequence Number=SeqID_156545
atgacgaggggcaatacaggtgatttacaaccctttgatcctgaaatagatagaacctttcatagattagttaggcatagtgtgcatcctagtcattttgtgcattttgagcatcctgatcattttgagcattctgttgctggtgattctgaatattctgatttcgagcattcagctgttaattttcatactaagaacatggctcaacctccacctcgtgagaggactcttagggagatggatgcacttgatttcacttatgaaagcttgtgcattcaatatcctgattag

SEQ ID NO: 64861 - DNA, 612 bp, Glycine max
  Peptide Sequence Number=SeqID_156546
atgagacatcctgtagaggagcattttgttttccttgttgatatcattgatgatgcaataaatggtgtagatatttgtacaaatttactttatgatttttctattttttatgactttgatcttcgttcttttgactgtacctgtgatgattctgatgagtctgctactgtatatagtatttgtgcaaagatttctcttccattaattgtcaaccttcctttgccttccaccatccagtcaccttccttggagctgaaaccattacttgatcaccttaagtatgcatatttagatgatgctcagaagctcccagtcatcatatctaacaacctttcacttgagcatgaggatacattgttgcatgttttgagaggcctaaaaaaggccattaggtggacactttttgaccttcttgtagaagcaagcttcatgatgatgaatcaagttgattcaagtatttttgatgataaaaaaaagcccaagacaatgatttcaagattgagtcaacaagttcaagatcaagattacatcaagattaatttcaagattcaagaaatgacatcaagaagaatcaagattcaagagaagatgatttcacaagggaagtattga

SEQ ID NO: 64862 - DNA, 717 bp, Glycine max
  Peptide Sequence Number=SeqID_156547
atgttggtgcgcatgatccgcactcgtctctttgcggcggcacgggtgaaatcttgccccggtatgcatagtagctgtgtgatagcctccctctctggttgtgctcgcacagttggccctcctccaatatcagggggtggcccaggaaccgtgcggatgtggagcacactgaaaatgaggacacgtagccctctaaaggtgagggcgtgcagcgctctcaaggcgaggatgtgtagtcctctagaggtgggggcgtgcagccctctgttggcgaggacgtgtagtcctctcaaggtgagggcgtgtagccctacgaaggtgagcacatgcagtcctctgatggcgagggcgtgtagccctctgaaggtgaggacgtgtggtcctctaaaggtgaggagtagccctctcaaggcgaggacatgtagtcctctagaggtgaggacgtgtagccctctcaaggcgaggacatgtagtcctctagaggtgagggcgtgcaaccctctgatggtgagggcgaggacatgtagtcctctagaggtgagggcgtgcagccctctgatggtgaggacgtgtagtcctctcaaggcgaggacgtgtagtcctctcaacggtgagggtgataggtacaagtacccaagggtccacccttatgagaaagcaagagatcgactcatcgagagggccggtcatcccaaatccacaagatttggacattag

SEQ ID NO: 64863 - DNA, 507 bp, Glycine max
  Peptide Sequence Number=SeqID_156548
atgaagctaacagacctcaatgaaaaaggccccatcacagactgccatgcagacgcggaaaaaggaatagagggggaacacgaaaaagcattgcctcttgaggtatctatgcctcacaacaacattttgaatatcacgaatcccagcatggtctatgctgcctctggtcaacacgacttaaaagtggcatctgaggaaatgggccaacagacatgtggcccaactctttctgccacaaaggtttatgtgagaagaaaggaggtgttgaggagtaatagcaaggcccaacagtttgagaaatcaattgtggacttcaacccaacctctataactgaccctctgccttcattacacgaggactttatagagctgcaatgtgcccttttgaaggaaatgggcttgacttatggggaagatgataacaaggttaaggggctgttgctggatatggagaataaggataatatgatggcagcagagaagggaattaaaattcaacaattatga

SEQ ID NO: 64864 - DNA, 126 bp, Glycine max
  Peptide Sequence Number=SeqID_156549
atgggtgccaagtacctcgaagtggtcaaaagagggtcgcatcccaacaacgaatggtccccagacgaaattaggatgtccatggtgggggaaaatagagtggttaaagagtttaaacatctctaa

SEQ ID NO: 64865 - DNA, 375 bp, Glycine max
  Peptide Sequence Number=SeqID_156550
atgggagattgcttggaggatatgattcgtgaccttggacaagagtcttttcagcaagcacatgcccctatgtatgaaggattgcaaagtgattcaaagaatcctttgtatacggggtgcaagaattatttgatgctgttgtcggtagtgttaagtctgattgattcaaggtgttttgatgataacaaagatgatgacaaaaatcccatgagaatgatttcaagattgagtcaagaacaattcaagaatcaagagaagtttcaagtttcaagttttcaagaatcaagaacaatcaatatcaagattcaagaatcaagaaaaggctcaatcaagataagtacaaaaaagtttttcaaaacattgagtagcacatga

SEQ ID NO: 64866 - DNA, 426 bp, Glycine max
  Peptide Sequence Number=SeqID_156551
atggcaactagtgatcacgccattcttcgtgatcacacatatgcaccaacaaagagaagccttctagaactcaccactcaagatgcaacctcagctcagaacaagctattgtcccgaaaaatagaagccctaatagagaccctcaaccagcttccacaacaattacaagcggtagggggatgccacatatgtggaggaacacacaagcctgggcaatgcgtagtccaacaagatccttcgagggaaataggccaactagctgagccagttgctgaaaggcccactgaaacctttgtggtaaatactgagatgaagcccaaagaggattgcaaggtgcttctagaatacatgagtttcatggcgtctctagctaagaggcgaaaatgcaaggaagatgtgttctacatgaccttcatgccaccttga

SEQ ID NO: 64867 - DNA, 675 bp, Glycine max
  Peptide Sequence Number=SeqID_156552
atgtataggctttcagaattgggcattgagatccgctcagttttcacacgtcgttcccagtggagttcacagccttcaggttctgctcagttatcatcaagggagacattcatttccaagtcagaggcaaagaccatttctgagataaacaacctttgtgaagagtttgtttgtgttactgttggtacaatcatgagggttgttatggacaatcattcatggtgttatgcagcttgcattcagtgccataagaaaacagatgtctatacagaaccgtttgtgtgcccatgtggcaaacataatgatctagctgtgcttagatatagagttgaagtgatgatcaattataaagatgaaagcacaaaatttctcctgtgggatcgtgaatgcactgaattgattgggcagtcagctgatgaagtcaataccctcaaaatagaagatggtgatctagatttaaatgcctccccaaaagcacttgataaactactgggtcatctactcgccttcaaagtcaaaatccagccgcagtataaaaattctgctgttttgaaattctcaactgacttaactttaattaatgatgttctggacatgttgcctgatgttgagacatgttcaaagattaaagttacaacaccgtttgattccaatgatcctgtccactatgaatct

SEQ ID NO: 64868 - DNA, 1503 bp, Glycine max
  Peptide Sequence Number=SeqID_156553
atgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgggtatggcgtcctcaagatatgttttcagatacggctatacaattacaaccggtctttgctcaatggatacaaaatacccatgctttagcaccaggcacaacagccccaggtgcaacaacaagtaccagtttgacttgggggggtgataatttagtagcagtgggcggtaaagttgctttgttacctattccgttaggaactgcggattttttggtccatcatattcatgcatttacaattcat

SEQ ID NO: 64869 - DNA, 601 bp, Glycine max
  Peptide Sequence Number=SeqID_156554
taagttgccaactcagcttcattctgcacaaacttcacattcttctattttgcaggttgcaggatgtacaatttatggtggagctcatgaatctagatgttgtatccctaatgaagaacaatttgctcaagaagtcaattatatggggaatcatcctagaggcaattttaatgcagatggatttttcggattccataatcgccagcagtatcaacagcagagacaatggcaaaatcatcctggtaaccaattcaacagagaccagggtagttcatctacaaggccacaacaacagacacctagtctttatgaccgaaccacaaagctggaagagactctagctcaattcatgcaagtttcaatgtctaatcagaagagcacggagtccgccattaagaatttggagaaaaatcccaaggaagagtgtaaggctatgatgactagaagcagaatgacaatacaagttgaggaaggaagagctgatcaaaaggtagagggatttaaacaacaactggctgctcagctagcactagaaccagttgatacttttgttgaacttgaagaaattgttgaggaagcggaagatgataaagaagaatag

SEQ ID NO: 64870 - DNA, 845 bp, Glycine max
  Peptide Sequence Number=SeqID_156555
atggtgaaagttgggacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaaattggacttgcttgttcagtgcaatcaccaagagaaagaatgaatatggtttatgtcactagagagctaagcaaaatcagaaaattctttctcgctgcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacatggaa

SEQ ID NO: 64871 - DNA, 243 bp, Glycine max
  Peptide Sequence Number=SeqID_156556
atggctgatgagccaagacgagtgaccctagaagattactcaagtacttctgtgtcacaattcttcactagcattgcgcggccggaggttcaagcacagaacataacctatccatattcattaattcagttgattcagaacaatttgtttcatggtttgcccaatgaagacccgtatgcacatctagccacttatattaagatttgcaacattgttagattggctagtgtgcctgaggatgct

SEQ ID NO: 64872 - DNA, 509 bp, Glycine max
  Peptide Sequence Number=SeqID_156557
atggggagtcaacaaaagtatttatggcactgttgccggggatctaaactaagaccttctgtaggtgatttgatccccattgatttggagattaacgccacttgtagaaggcgtaatcaagagagaattagaaaaaatttgcaagacttagaggtagtagcaattccagaggaagaacctcaatcttccgaggcatcttctagttttcctattgtagaacattctcatttagatcctagtgaagactacatcatggctgaagagccaagaagagttactctggaagattattcaagttctaatgtgccacaattttttaccagcattgcacaaccagaagttcaagcacaaaccattacttatccaccatcattgattcagttgattcaaaataatttgtttcatggattaccaaatgaagacccatatgcacacttagccacttacatagaaatatgcaatactattaggttggctggagtgcctgaagatgcaatccgactgagctt

SEQ ID NO: 64873 - DNA, 327 bp, Glycine max
  Peptide Sequence Number=SeqID_156558
atgacaagaataccatacaacttccagccttctatcatactcaatgggcaccaaactatcctgagatggttttatgaaaaactcccccattgtacagaagttcctcttagagcttgcggcaaccacatgacagtcttaaggcggcatggccccccactgcaatggaaagttgaaacgctgaatcctgccattggtggaaaaggtgttgtccaaccatggtatgattttcttcaagaaatggattttgatgatggagatgaaatctctatttattataggtattatgaaaaattttgggatatcataatcaggaggcaggaagattag

SEQ ID NO: 64874 - DNA, 444 bp, Glycine max
  Peptide Sequence Number=SeqID_156559
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaaagacatgcaaaagcaccactgggcagcagccactg

SEQ ID NO: 64875 - DNA, 390 bp, Glycine max
  Peptide Sequence Number=SeqID_156560
atggtgagtctcatggatagaaacatccttgactccttattccttaacatccactttcatggcctagatatgaaggagggttcaattccagcagccttaatctatagaatccagtataaggtcatgaacacttgtgcatcgagggttcttctcaaaccacaaaaaggagaaacgactttgtttatcactaatatgacaaaggctaatatttctctcccaagaactataaaatgggatgagatcaaagatggtgaggtaatccaattggaattacctcccaaaacccaataccaattgccaaaggccaaggaaaacagtgataaacctgtcatggccacaccatttaagacaaaggatgtcgacaaagaaataacccccgaaggatattag

SEQ ID NO: 64876 - DNA, 141 bp, Glycine max
  Peptide Sequence Number=SeqID_156561
atgtgtgcagttaagaagaggtatcatccccttcgaaaaacatattgcggcagtagggactaccagcaacaacatgttatcaaagagaaaaactctagattagggttcactgttatcaagcaagtcggagacccagcatga

SEQ ID NO: 64877 - DNA, 276 bp, Glycine max
  Peptide Sequence Number=SeqID_156562
atggagtcgccatttgtcgcaacctacccttcggcgggagggcgacgcgagggctcacgggtgcgtcttccacgggaggaaggcacacggagtcgccaccaacgtttatttgaggaaaaagtcggaaaaagtggaaagaaacgtcaaggcattggaccattaacgatctcttggggtggtcgacaaaagcggggcttttgctcctacgtattctcaattgcgatgaggaaatcagacctacgtagttcttgcaaaaacggtaaagttacatgttga

SEQ ID NO: 64878 - DNA, 761 bp, Glycine max
  Peptide Sequence Number=SeqID_156563
aattacccgtcgaagactatgagggtggagttgctgaagaagttggggttgtcagatcggcagttgtagatgtggttttgtcaccagcggttgaaggacaagaaggagttgccggcaaagaagccacgaaatgcagcggcgttgctggattctccgatggaggagcccaagttggttatcatgggtcaagctactgtgtagaggcatatgcagctgccaagtttgctggtgcatgcctctgtggcttaaaaggagaagttggggtcaccgagggaagtaatagatctagttccattccaaaggttctttttcaaatgtatagaaggtttgaaaaattctatttacttcttgtcttggctactggagaggattattccatggaacctgctgagagcaggaggccattttgtgctctccttgacgttggtcttattaggactacaactggtaaccatgtgtttggtgcccttaagggagctctggatgggggtttggatattcctcacagtgacaagaggtttgttgggttttataaggagaagaaggagcttgatgcagagaatggtattgaggcactgtataagaaggttcatgctgccatccaggctgatcctactctcaagaaatctgataagcagcccccgaaggagcacaagaggtacaacttgaagaagctgacctatgaggacaggaaggctaagtttatttcacgcgtggcgactctcaactctactgccgataacaatgaagatgatgagtga

SEQ ID NO: 64879 - DNA, 138 bp, Glycine max
  Peptide Sequence Number=SeqID_156564
atggctggtatatttttgaaagagcaaaatagtttagagggacaccacacagagtatgaagaacctcaagatttgaggtcaaatcctttccaaggtggagggaatgatgcaatcctaccccgcaagggcattggatag

SEQ ID NO: 64880 - DNA, 123 bp, Glycine max
  Peptide Sequence Number=SeqID_156565
ggaagacacaggatactaggctgcctcccagctgtgcttcccgcttgtccggagctgggtgtgggacgacgatccatcgatcatgggcctagcatctacttgcgttcatccctaagtacctga

SEQ ID NO: 64881 - DNA, 201 bp, Glycine max
  Peptide Sequence Number=SeqID_156566
atgagactttttcacagtctcgcggaagacactgacatctccgggaaaggtgcacaacacgaggacgactctcggtcgaaagacactgacatctctaggaaaggtgcagatgacgatctgaaagaggctgacatctccgggaaaggtgtcgatgacgacgttagtcactgcatgctaccggactttgagtctgctggatag

SEQ ID NO: 64882 - DNA, 162 bp, Glycine max
  Peptide Sequence Number=SeqID_156567
atgattccacttaaactgttacaagaacacaataagggattagaccaaacatacctacgtgaggtggcgaaggagaagaagcacagacttctgacgatactcgagtgcgacgaacacgatgctcagatgcaaacaaggaccttgaaggtagacggagattag

SEQ ID NO: 64883 - DNA, 759 bp, Glycine max
  Peptide Sequence Number=SeqID_156568
atgacacatgcacaacccggaccagttgatggctctttgttgtgcttacaagacaaccatatttcaaatcaagcttttacccacttggatcgaatagataatcgggtaaaaaatctaatcaccttaactggtttcggtcatgttataaatgttggaaaagttgatattaaccagcatttggcattactaggggaaactccacctgataagtattcaaagggtaaaatgatttacctaagttggttgcgacaaaattttcagcaacttctcattgatgttgatgatgttgccattgcacaacatgctagagctcatatcatgatgctcataagcggctatttgatgccagatacatcagaacccaatgtacctcctgtgcatgttcctggatttatgtcccaacatcatccatcacaagcacaatatcaatcgacaaacttctctggatacgcgtctcaaggatgtcaacaaagttttcaaccagtagggttctcattgtgtatgcctcaatactcatttcaagtcccttctacctcaaatgttttttgtggcccttcacaaatgtttgccaccactttcaacattccatcatctacatataatttaccaccatcaacttcttgttatcatccatcattatctactcaaatgtgtggcatgggtcatgaggatgaggaggaggatgatgatgataacaactataacgatgatgatggtgatgatgatgacaacggtagtgattatgttcctcaacaataa

SEQ ID NO: 64884 - DNA, 234 bp, Glycine max
  Peptide Sequence Number=SeqID_156569
atgccacatcctatcagagcgttgtgtcccgacgtccttcagcacatgggagaccagtcagggtcacgatattttgtgagaatgctccaaccatatgggatcagcataggcttaaaggagcactcaaacccggtgacccccaaggcctacactccgaagagtccgtcagggcctctccctcctaattcaagtccaacccctaaaatcattttagcacatagacattgctcatga

SEQ ID NO: 64885 - DNA, 2100 bp, Glycine max
  Peptide Sequence Number=SeqID_156570
atgccaaatacatatttcccactaaggtgggagagcactggggaccaatggtggtatgcatcaccaatagattgtgctgctgcaaatggccactatgacttggttcgtgagctgctaagaattgacaacaaccaccttttcaagctcacttcccttcgccgaattcgccgcctcgaagtcgtgtgggacggtgaagaagaacaacagttcagtgatgttgcaaagtgccgctctcaggtggcacagaagctgcttcttgagtgtgagtccaagagagggagcagcagcagcagcaagaactctctcatccgtgcagggtatggagggtggctaatgtacactgctgcatcagctggggacttgagttttgtgcagctacttcttgagaggaatcctttgttggtgtttggagaaggagaatataatgtcactgacatcttttatgctgcttcaaggggcaggaattgtgaggtttttaggctggtttttgattttgcagtttctccaaggtttatcactggcaaaggtggggttttggaggagcacgttggtggggatgttcctcctgtttacaagtgggagatgagtaatagggctgttcatgctgctgctagagggggtagtgtggagattttggtggagtatcttgctaattgctctgatgttttggcttatagagatgctcagggatctactctcttgcattctgctgctggcagagggcaggttgaggtggtcaaatatctcacatcatcctttgatataataaactccacagatcatcagggaaacactgctttgcatgttgctgcttacaggggccaattagctgcagttgagactatagtttctgcatctcctgcattgatttctctgcaaaacaacgcaggagaaactttcctccataaggccgtgtctggttttcagtctacctcattcagaagattggacagacaggttgagcttttgaggcagttagtaagtggcaaaaaatttcacatagaggaagtcatcaatgcaaagaacactgatggaagaactgcactccacattgccacaatagggaaaattcacactgatcttgttaagctcctgatgactgctccatcaataaatgtgaatgtgagtgatgctaatggcatgaccccacttgattaccttaagcaaaatcccaacccagcagcatcaaatgtgctaattagaaaattgattgctgctggtggaatgttccatcatcacagttcaagaaaagccatagcctcacacatgaaaatgcatagtattggaggcagtcctggaacatcattcagaatctcagacactcagatatttttgtacacaggagttgagaatgcatcagatgcaagcactgatcagggaagtgcaggaatgagttcaacttcatcagaacacactgcatatgactcagcagcagagaacagaccctcaacaacaagcaaaaggccttcagtggccgccggattgaaacgagtccttcagtggccactggtgaaggacaagaaatctgagggtatcaggaaatcaatcgatgagggttcattggactcatgcaggaaatgggacatcagtgatgaaattccaaccccacttagacaaaaattctttaggcattcagcacttcctaacaacaaaaggaacctttctgtgaggagttaccagtcaagtccaaatgctaagaagagatttgcttcaggactggtacatgtaaaggtttcaagaagatcaagctctagttccttttccatatcctcattttcatcacctagatcaatagataataagcaaaagggtttttgtgttgacaatgatgttgctggaccatcttgctcaagtcataaaaatgataaatcaacaaattcagggaagagagcttctgttagcaaaaagctaaggggccattatttctgtttctccaaagcctcagtggacaaggagcaagaaagccactgttacaaggatcatgatgtttttgcaggctattgtcaaatacagaagaggaaaaggtgccgcatcaatgcaaaactacactgtagggatttgagggcgtctagtgcattcattgtttgcaagtttttttag

SEQ ID NO: 64886 - DNA, 222 bp, Glycine max
  Peptide Sequence Number=SeqID_156571
atggcacaacatggcttgatcaaataccaagggagcaatggaccttggcatgggatgatggaaaatgccttggtcagagccacgtatgacaagttaaacaaatattttgttgactgtgggactcaggctgatgcaatgattgcctctggaaaagtttacacacttattgcatccaaattcatcaccgaaggagaaactaagtcaaacactcacttcgtttaa

SEQ ID NO: 64887 - DNA, 414 bp, Glycine max
  Peptide Sequence Number=SeqID_156572
atggtttccgaattgtggaccaagaagaatgctgttggaaaacaggaagtggccaaattagtggatgacatgtttagggttgtgattggctatgatgaaggaacaattatggtcaaacttggtcgagaagtacctgtggctagcatgaacaacagtgggaaaattatttggtttaagcataatgaaattcagactgtcaatataaaaagtgtaggagcatatgtagaggttgccgaccgagaaaggttacctttagctgttaaggagttgggcacctgtgatctctacccccaaaatttaaagcacaatccaaatggaaggttagttgttgtatgtggagagggcgaatacatcatatacactgcattggcatggagaaataggtcatttggttcagcactggatattcaataa

SEQ ID NO: 64888 - DNA, 159 bp, Glycine max
  Peptide Sequence Number=SeqID_156573
atgccgcctagtcgtagaaagggtagaaagaaaagcaacagcgatgccgccgcctgccagcagtttaagctcggcgatctcgtgctcgctaaggttaagggattccctgcttggcctacgatggctcccagaggagccgtggagaaggtcaaagactag

SEQ ID NO: 64889 - DNA, 198 bp, Glycine max
  Peptide Sequence Number=SeqID_156574
atggaactattgctaagtacaaggcaaggaagcaatgaaggaaagatcaatgaattcaaaggatgtatgatggctgaatttgaaatgtctgatttagggagcttacctacttactgggaaatgaaattattccaacaaataaaggaatgtgcatgcaccagaaaaggtagaccaaagaaggcgatgaagatcctatga

SEQ ID NO: 64890 - DNA, 591 bp, Glycine max
  Peptide Sequence Number=SeqID_156575
atggctatcgtgcataccatcctcactcgggacctcaccgaagacctcgtccctgtcgacaccaacgccaacaagcttcgcggcgagatgctcgatctccaacatgtcattctattttggaattcttttatgggtgcgcatggtggaggaggagggagaagttgtgcaaagaaaacatggataagggttttgatatttgaagcctcagctagtggaaatctagaggcagagcgtctacacaagcaaatgtgttgtcattgtgttgattctctctttctccttattcttctctttctcaaaaacattatctttgtctctgttcctgcaagtgttcctccaccgcccccgtgtccaccaccacctacgaggttaagaaaatgtcagttatccgtggaggatgatcagaaggagggggggaggttgaattggttccgcaagttggaaactgccattgctgatgagatgactacttttaaagaagagtgggaagctgttctggatgaccttgaaatcgaaagtgcccacttactggagcttcggagttttaaaaatgctagtgatttttatctcacccttgtgccttgtatttga

SEQ ID NO: 64891 - DNA, 508 bp, Glycine max
  Peptide Sequence Number=SeqID_156576
gcctcctagcaagactcgtcagaagaatcttgcaaaagggttctcctcctgtggctctgactctgacaaggtcctcctcattcatagatggatcctcctaaatagatgtttctcctccaaatcctcttcttcgtccttaggcacaagatccaccaaatctaccatggatggtacacaagactcgggtaataccgatcgtggagaaatcagagcaagccttcatggtcttacgcaatatatggatgacaattgggatgacacttcacatgttggtataggacatgatgctctttttctagcatatattactcacgacatcctattccaaagaactagttctcacacagttcttgtcttgggcctaacactgccactaagcctcttaagccttcatggtcttacgcaatatatggatgacaattgggatgacacttcacatgttggtacaagacatgatgctcttacaaaccatggatacaactctgctctagtcaagaatgtcaagtaa

SEQ ID NO: 64892 - DNA, 222 bp, Glycine max
  Peptide Sequence Number=SeqID_156577
ttcctaggaaagagatatggtgatgcaatcctccctaagaagggactagtcactagagccatgagcaagaggctccaagaggattgggctagagctactgaagaaggccctagggttctcatgatcctcaggggaccagtcactagaaccatgagcaagaggctccaagaagattgggctagagctgctgaagaaggccctagggttctcatgaaccttagg

SEQ ID NO: 64893 - DNA, 435 bp, Glycine max
  Peptide Sequence Number=SeqID_156578
atggagacattgctggtgttctactatgagaaaatggtaggttacatgccttcaagttttgtagatctagtgtttgttggcaagagaattgaagcaggtttgaggaaaggaacatttagttatgttgcttctgtaaatcctggtaatgaaggacccgagaggagtggcgagaggaagaaggagggagaatctcatgttgtggttgtagttcccgcgtggccaaacttttcattagccccttataatcccatcttgtttgctcaagtgagctgcgctccagagttgatctccaagtctgcccaatcaaaaatgtcgtgttccacacgtttggttgcggtgccttatctttcaagaacctacatagtttctttcatttcttcttgctacaaggacgtgacaaacgacaacagcggatacctccgaaccctacactag

SEQ ID NO: 64894 - DNA, 267 bp, Glycine max
  Peptide Sequence Number=SeqID_156579
atgcaacaccgacacaatggtggcacggaggaggcgcaatggtgcaaacgaaaaaagaaagtagaaacgaaggtgataagggcccgtagtgccaccgacgaagggcccgaagtcaccacaggggtaacgacgaatggttgcgacggcttagatagaggcaccacgacaatgaagtgccaggcttcaccagaaaatgaaaaaaagatggaagaaagagaggaaaataagaagaggatgatggaatgcgaaaacaaaataaaacattaa

SEQ ID NO: 64895 - DNA, 225 bp, Glycine max
  Peptide Sequence Number=SeqID_156580
atgaattttgcatggcaatctaagattccatttgaacctcgcgaaggtggatcgcttcatgacgacggtgatggaggacacaagagagagccggttgtgcacgcagctggagaaggcacggagggtggtggtggtcgttggaggcagaggaggcgggttggcgaggtattcaggatggatgggtttggtgcaatgttgggtgttgtagaagaaggattgatttag

SEQ ID NO: 64896 - DNA, 174 bp, Glycine max
  Peptide Sequence Number=SeqID_156581
atgcacctagttgatcaaccatcaacgcaagtcatccatgggaagcgatggggatcaacacatccacttggcaccctgacaccaatatcaattgttagtcaaatatataatctcattatgcgtaatcaaccaggaaaaatccccgaaagagatataccatccgctccatcataa

SEQ ID NO: 64897 - DNA, 294 bp, Glycine max
  Peptide Sequence Number=SeqID_156582
atgaaacatccatctgaggatcattctgtttttcgtgctgagatacttgatcagattgttaatgattatatgtttgattttgattctcttcatggaagtacatatacttttgacttgctttatgaggtacaggctgaggaaccctcctcttcttctcctaccctggttcctcccactgttcagccactacccacaccagagttgaagcccttatcagtaaacctcaagtatgcttacttagaagacaaggaaaaattttcagtgatcatctctgcctcccttgctgttgagtaa

SEQ ID NO: 64898 - DNA, 768 bp, Glycine max
  Peptide Sequence Number=SeqID_156583
atgcttaactgcacaaagcccaacatgagtataaagacagcaacaaagaggaaaaacaagaagtatagaaataccaaaacagaggccaagcttgctgctgtgaaagaaagatttggacgagagatccatgtttttgaaacatcagttgtttctttatcttcaaaggctgcattatccaatggagaggagactgatgacttctatgagtttactgctgaagattattacaggcttttggctactaaaaaggaagataaattcttgaagactcgaaaaatccgagaagcagaagaggcagctcgtaggtcaagaataaccaaagctgtaattagagttcgcttccccgataatcacacgttggaggttaccttccacccatccgaaacaatccagagtttaattgatctcctcactaaagttattgcacagccagagcaaccattttatatatacactactccgcctaagaaggtgatcaatgacatgtctcgggatttttacactgctggcttttgtcctggtgccattgtgtacttctcatacaatgtcccaaaaggtgatagcacagtgggtgaccatactagtccttacctccaagaagagatattgtctttgaaggatttgcacgatgcaattgatcaaggccagcaatctgagcctgtagtacagtcagaaccagaacctgcagtggcaactcatccccatcccgtcgaagaacgcaaacctgctgagaaaaaggttgttaaaccaaagtggctaaaaatgtga

SEQ ID NO: 64899 - DNA, 231 bp, Glycine max
  Peptide Sequence Number=SeqID_156584
atgcagtgccctttgttgtgcaaagaattcatcatagatgcatggcaactctactatgctcgaactaaaggtgcagatgtagtccttttaattgctgttgttttacctgatcttgacatcaaatacatgattaagatatgcaaattactcggattgactgcacttgttgagtggcataacgcagtttgttttatggagatgatccggtcaggagaaaggacaatcacttag

SEQ ID NO: 64900 - DNA, 2620 bp, Glycine max
  Peptide Sequence Number=SeqID_156585
atggcaaagagtaggctgtctgggggctattttggaaatgcactagatactgctggtgaatctgagggttctggtagctcgggaagaatagatactgaaattacggtttcggaggattcgagtatccccgcgaggaaatgtattagtttgaattcgagtcgccacgatgtgtttggtgctcccgtgcaagttgttcccttgtcgaatatgccactctctcatagaaaagatctggggcaaaggttgaggtccgagcttgagcagattcggctgcttcagaagaaaattgaacagcagaggacgactgctgttgtgttgtcctcctccagtgatattcttagctgtagtaatgggaataatgggcatcgagtggaaagggataaaaagccggcgatgtccagttctgcaccaaggaataaagcgaagccgggtaataagaatcagaagcctcgtggatggaaccggggttcttctgggaagtttgagtctgcggtccagtctgcttcaccatccactgcgaatgctatgttgatgaaagattgtgagttgctgttgaaacggttgatgaatcaccagtatgcttgggttttcaacacccctgtggatgtggtgaagttgaatcttccagattatttcactattattaagcgtcccatggatttgggaacagtaaaaaacaagttggcttctggagaatatgctggcccactggaatttgctgatgatgtgaagcttacattttcaaacgcaatggactacaatccatctgggaatgatgtccatctcatggctgataccctcaataaatattttgagttgagatggaaagcaattgagaagaaattgcaaaaaagtgattttctgccattacctgcaaaccctgacaatagtgaaggtgtaaaaactaaaagacaagcacctctttcaaaaaagaggaaaattgcctcattaccccctcaacctgaagttatgccacctacaaagaaggttatgtcggatcaagagaagcatgatctaggtcgagaattggaatctcagctgggagaaatgcctatgcatataattgatttcttaaaagaacatagttcaaatggtagagaatgtggtgatgacgagattgagattgatattgatgatctcagtgatgataccctattcacattacgcaagcttttggacgactttttgcaaaaaaagcaaaagaacaaagcaaaagttgaagcgtgtgaagtagaggtgttgaatgattctggaccaagcaattcctcattgcaaccatttaaaggtaatgatccagcggatgaagaggtggacattggtggaaatgagccccctgtgtcaagctatcctcatgtggagattgaaaaggatacaacttatggaatgaacaaaagcctaagcccaggcagctcaaatggtaatgtggatttcatattcactaaggtttatgagctcattttcatacaatggtgttctactgtcaaccccatcccagatgtaggcatgttcaataatcaaatagctgctttccccatctcagatggagtgttgttaaatggtggcaccatggatgctatggcggaatgcatggtggatttttttgccaatcgccgtattccaccatccgccattgataacattggagaggttgttctactctcctctaaacaaatgttgatggtgtttctcttggtgtattggctggcactccctgaggatatggctctttccctcatcaatagttctttatgggtagtgctagcttatgatactgttgcattgtgttttagggccaaagtaatttctaggaatacggactctgatagttcttctgatagtgaagctgatgatgttaaagcaagaccagcaaatgcagcaaaggcaccagaaaatctgggttctgaagctcagttggatgaaatgaccatggctgctgctagtcttgaaagaaatcaatctgttagtggcttagatcaacttgatgataactctcagcataagccaagttcttttgattctgattgccaacaagatggggacagtgctgcaactgagagacagttctcccctgataaactttatcgagctgctgtattgaagaaacgatttcttgataccatcttgaaagctcgagaaaagacactgacacagggtgaaaagggggatcctgagaaattgcgccaggaaagggagaaactggagatggagcaaaagaaaggtgatttaggcatcgtacttgctaggctacaagcagaagcaaaggcagctgaagatgctcgaaagcaggcagaggaagaagctgctgcagaagccagacgaaaaagggagcttgagagagaagctgcacggcaagcattgctccagatggaaaagactgttgaaatcaatgagaattctcgaattcttgaagatttggaactgcttagagctgtacccactgagcaattgccaagttctgtagatgagacgagtcctgcacactctcaggatggtctgggtagtttcaagtttgggagtagtaaccccttggaacaactaggattatatatcaaagccgatgatgaagaggaggaaggagagccaccctgtattccaaatcctgtaaatgatgtagaagagg

SEQ ID NO: 64901 - DNA, 369 bp, Glycine max
  Peptide Sequence Number=SeqID_156586
atgtttcaggctctgtatgaggagttaactagaaaagttgtcactttggtggcagagaatgaaaacctaaagagggagaaagaattggctttgaaagagtatgagtctttggagactacaaataagaacttgaagacacagatagccaagtcaataaacactgaagtggagaaaactcctgttgagcctgtgtcatctgtggctgagataacaccttcatccgaagaagataagaaagcttttgaaatgactgagtcaaaagaggcaacattgcttgaagcagagaagatttcctgtcgtaaatctgaagtggatttcaagaaattggacgatctgatggtgcaacttctccagcagttgaggctttaa

SEQ ID NO: 64902 - DNA, 117 bp, Glycine max
  Peptide Sequence Number=SeqID_156587
atgaagaagatcctaggcctacaagctccaatggagcttacaccatgtgcgagaaagttccattggctacccttagcttcaaagggtatccctctattggtggacttcccttgttag

SEQ ID NO: 64903 - DNA, 207 bp, Glycine max
  Peptide Sequence Number=SeqID_156588
atcaaactaaagacacttgatgaagctatggagttgattgaaaatatggcagccagtgaccatgccatccttcgtgatcgagtcaacacacctataaagaagagtcttctcgagctcacatcacaagacgcattactagccctaaacaagctcctagccaagcaactagagaccctcatagagacgttgagcaaacttcctcaataa

SEQ ID NO: 64904 - DNA, 651 bp, Glycine max
  Peptide Sequence Number=SeqID_156589
atgaaatttgttgttagaaaagaagtgacttggaatctgaatccaaatttgatgggttatcttcaatttggcagacatggtgttaagcagatcattagatttagagatgccagttatgataatgttgtggacatagataagctgggaaaggcaggtgatactgtcaaagttgcccctggatattttcgcaaccacctaatgcccaagctccttgctttccctaacatcgataagtttgcttatctcctcaatgagcagcgcaagatctatcaaccaactgaagaagaaaatcaagaagatgttactctagttaaagagtcaaaggaagatatgatgaaagagtatgaaaaggcagcattacgtcttgataaagctaagctggtcttgcggaggttaattaatgttcaaaaagccaagtcacgtgaatcaaaagaagatcccttggagttacgttatcctgtgacaaaagatattcttgtggctgaggtggcaagacaactctgtgtaaacgttgcacccgataacctgcatcttccatcacctttatccacattgggagaatatgaggtgccactgcgtttaccaaggtccatccccttgccagagggcaaggttaactggagtttgaaagttaaaatcaggagtaaataa

SEQ ID NO: 64905 - DNA, 255 bp, Glycine max
  Peptide Sequence Number=SeqID_156590
atggagatgtccaatttcgcatcgaaactcaagtcacttaagttagagcttggtgaagacctactcatgcacttggttttgatctcgcttcctgcacactttgggcaattcaaaaataagaaaaggaagaagactaagggtgttgcggaagggacttctcagcaaaagaaacaaaagaaggacgagaaatttacctattacttatgcaagaagtcaagacatatgaagaaagagtgtcccaagtatgccgcatga

SEQ ID NO: 64906 - DNA, 138 bp, Glycine max
  Peptide Sequence Number=SeqID_156591
atgcccatgactgagagcttgacacgtggcacatttgttgaaggtcatggcaaacagggtgggtggcacctgcttttcgaggaacctggtcatgggtatgcgatttctcggtccagcatgcagttacattgttggtga

SEQ ID NO: 64907 - DNA, 360 bp, Glycine max
  Peptide Sequence Number=SeqID_156592
atggcattagaagaggggaaggtgaagatcaagaagttcgatggcacagatttcaacttttggaagatgcagatagaggattatctatatcagaagaagctgtatcagcccttatcaagggttaagccagacgacatgaagcaagaagaatggaacttgctggatcgacagactcttggcgtgatcatattgacattagccaagaacattgcgttcaacatcgtaaacaagaagaagactactataggcttaatgaaggcgcaatcagatatgtatgagaagccgtcggcaaccaacaaagtatacttgatgcgtcagttgttcgacctcaagatggggagaaagtatctccgtaactga

SEQ ID NO: 64908 - DNA, 900 bp, Glycine max
  Peptide Sequence Number=SeqID_156593
ctgatcggcattgcgctggcgaatccgagaacccgccaagaacgtgccccgcgccgtgcgccaggtgttctggcgcattttgctgttctacgtcctggccatcctggtcatcagcctgctgatcccctacaccgatccgcaactgctcaagaacgacctgggcgacatcagcgtgagccccttcaccctggtcttcgagcgcgcgggcctgctgtcggccgccgccgtgatgaacgccgtggtgctgacctcggtgctgtcggccggcaactcgggcatgtacgcctccacgcgcatgctctatacgctggcctgccagcgcatggcgccgcgcatgttctcgtacgtcaacaagcgcggcgtgcccacgatggccctgctggccaccacggtcgtggctgcgctgtgctttctgaccaacatcttcagcccccagctggtctacatctggctgctgaatctgtcgggcatgacgggcttcatcgcctggctgggcatcgccatcagccactaccgcttccgcaagggctacgaggcccagggcctggacctgaaccggctgccctaccgtgcatcgtggttcccgttcggccccatcttcgccttcgtgctgtgcatggtgatcacgctgggccagaactacgaggccttcatggcagaccgcatcgactggaccggcgtggtcgccacctatatcggcctgccgttgttcctgctgatctggggcggctaccgcctggtcaagggcacgcacatcgtgaagtacaaggacatgcaactgggctccaacgtcgattgacgcccggcccggtccccatgaaaaacagcccgcagatgcgggctgttgctttcaggcatcggccgaccacacggccagctcgtagccgtccggatcggtga

SEQ ID NO: 64909 - DNA, 411 bp, Glycine max
  Peptide Sequence Number=SeqID_156594
atgtttcttcttcatccgttgctcctctataacaattttttcctcctccttttgttgatgggcaggctttttggtttggacctttcccttctactccctaaggatccttttaaccttcatagcaaggccaaaagtttccaaagccttgtctttattagcaatagccttggccagtttcttctgcctcttttgctgaatgtcatcctagtttacaacactgaagtgttgttatctagtgatgaagctgcccttgttgataatggactgctaggagtcatcatccattcctttgaagacatggaagacttagtattccaaaagaactttgttgatgagggcggcatagtagatgtcatccactcctcccaaagtcttcatattcctcaagatgttgatttagattgtgtgtaa

SEQ ID NO: 64910 - DNA, 545 bp, Glycine max
  Peptide Sequence Number=SeqID_156595
atggggcagctccagcggcaagctttttgcaaagcttacggtaaaatctgggacctagccatggtagaagtctccacagagaccattgcctcccttgcccagtattatgatcaaccactgaggtgcttcacctttggggacttccagctgtcacccatggtagaagaatttgaagagatcctaggatctcctctaaggagaaggagaccatacctcttctcagggttgtatccctcattagctagaatttctaagatagtccaaatcttggcgcaggaattagaccacaggaagcaagtcgaaaatggggtggttggaataccgataaaatgtttggaggcaaaagcaagaaacttggcaggcaaaggcaaatgggccccattcatagacattctcacactgttgatcttcggaggagtcctctttccaaatgtggatgggttggtggacctagcagcaatcaacgcttttctcgcctatcatgaccacaaggaaagcccggttgtcgctatgctagccgacctgtatgacaccttcgaccgaag

SEQ ID NO: 64911 - DNA, 300 bp, Glycine max
  Peptide Sequence Number=SeqID_156596
atggctaacactgtggccagacaagaggaagaacgtgtagatactgaaacgtatcaagaaagcatttttcaagttacctccatccatcatcagatgaccactgaagaggaaatgtctgaagtctccagtactccagaatactcctgctcggccgctgctggctatgttagaggaatagagaaaggtagattggaactcactatagaggatcgaaaagtctcttttgacctctttgaggccatgaaacattcagatatgggtgatgcttgttctgaggaggaagaggtggaacaggaaata

SEQ ID NO: 64912 - DNA, 165 bp, Glycine max
  Peptide Sequence Number=SeqID_156597
atggcttcctatggtgacctgaagaacacaaaggaatccattgatgaagaagatccaaggcctacaagctccacatggagctacatcatgtggtatcaagagcatcttcatctaggtgatgttcttttgcttcctctctctttttgttcggtcaattcactttaa

SEQ ID NO: 64913 - DNA, 642 bp, Glycine max
  Peptide Sequence Number=SeqID_156598
atggcagaggtctccacggaggccatttcctctctcgcccaatattatgaccagcctttgaggtgcttcacctttggggacttccagttaacacccatgatggaagagtttgaagagatcctgggatgccctctgggaggaaggaaaccatatctcttctcgggattttatccctccttagctagaatttctaaaatagtcaaaatctcgacacaggaattgaactgcgggaagcaagtcgaaaatggggtggttggggtaccaaggaaatgtttggaagtaaaggcgagagtcttggcaagtcaagacgaatgggacccgttcatggacatcatggcacttttgatcttcggggtggtcctctttccaaatgtggatgggttggtggaccggacagcgattgacgtttttctcgccttttacgaccgcaaggaaagcccggttgtcgctatcttagccgatctatatgacacattcaaccgaagatgtgagaagaacaatgcaaggatcatttgctgtacaccggctctctacatatggttggtttcgcacttctttcgccaagagatgagacacgtttgcccgctagaacgccaccgctcatgcaccgagaaaaagaggcaaactgggaccgactcttag

SEQ ID NO: 64914 - DNA, 177 bp, Glycine max
  Peptide Sequence Number=SeqID_156599
atgaagcttgcttctacagtgagttgttacgggccctatacccaggtccatgggaacataggaagtggagtgaaacctcatctagagttttttctctttgatgatacgttgttgctggtagtccctaccatcgcaatgcttgatatcaaaggggatgatatctctagaaacctttga

SEQ ID NO: 64915 - DNA, 129 bp, Glycine max
  Peptide Sequence Number=SeqID_156600
atgccccccccccccccctcttatgggatactgggctgccttgcagcgacgttctccgctggcccagcgtcgggaaggggtgacgattggtcggtcgtggccctatcctccatttgcctccacccctaa

SEQ ID NO: 64916 - DNA, 540 bp, Glycine max
  Peptide Sequence Number=SeqID_156601
atggagaggagtatgattgatgcttccagtggtggagctcttggtgatatgactcctgttgaggctaggaatctgattgagaagatagcttccaactcccaacaattcagtgcaagaaatgatgctattgtccttagaggagtccatgatatggccacaaattcatcttcatctgctaaaaataagaagcttgagggaaaacttgatgccttggtcaacctagtaactcagcttgccataaatcagaaaactgcatctgcacctgttactgttgcaagagtctgtggtctatgtttttctgctgatcaccatacagatctctatccttctttgcagcaatctggagtcaatgagcaacctgaagcctatgctgcaaacatttataatagaccccctcagcagcaaaacaacaacagcagaataattatgatctttcaagcaacagatacaatccagcaacaacagcctgtccctcccttccagaatgctactggtccaagcaggccatatgttcctcctgcaatgcagcagcagcagtag

SEQ ID NO: 64917 - DNA, 654 bp, Glycine max
  Peptide Sequence Number=SeqID_156602
atgagtatcgacagaacgcagcctttaaaaccggtgagcactgtacaaacccgtgacagcagcgacaaccaggcaaaagtgcgtcagaacagcgcaccggccgccagcaccagccagaatggtgcagaagtgacgctgagtcccgctcaggcgcagctgatgcagccgggcagcaaagatattaacacagcgcgcgtagagcagctgaagaccgccattcgtaatggtgaactgaaaatggataccggtaagatcgccgatgcgctgatcgccgataccagggcgtttttagaggagcagcagcaactttctgccggacggattaatggcaacctgctgcagcgcattacagaagataaaagcgcgctgctgacgacgttgaattatctggacgagatgcgccgcaaaaccgagctgtcgctgggtaccaaagcgccttatcgtggtcacattgatattgcacgccgctggcacagcattcagcaacatacccagcgtctgcgcgacgccaatcagcacaatggcatgctgttgcagcatcagatgacctttactgaacaggcgctgtcggtgctgaaaccgcatcagacccagtcgttctacggtccggacggtcgtggtttagggcaggccacgctgagccgcaaaggctaa

SEQ ID NO: 64918 - DNA, 3354 bp, Glycine max
  Peptide Sequence Number=SeqID_156603
atggacgtcatcgccaacaacctggcgaacgtcagcactaacggctttaagcgttcacgcgcggtgttcgaagacctgatgtaccagaccctgcgtcagccgggtgcgcagtcgtcagaacagacgacgctgccgtcgggcctgcagatcggtaccggtgtgcgtccggtgaccaccgaacgtctgcacaatcagggcaacctgtcgcagaccagcaactcaaaagatgtggcgattaatggtcagggctatttccaggtgcagatgccggacggtacgtcggcgtatacccgcgacggctcgttccaggtggatcagaacggtcagctggtgaccaacgccggtttcccggtgcagccaggcatcactattccggcgaacgccaccagcatcaccattgcgcgtgacggcgtggtgacggtgacacagcaggggcagacgcagccggcgcaggttggccagctgacgctcagcaccttcatgaacgatgccggactggatagcgtcggggaaaacctctatcaggaaacccaggcctccggtgcgccgaccgaaagcacgccgggtcagaacggggccggtctgctgtatcagggttacgtggaaacctccaacgtcaacgtggcggaagagctggtgaccatgatccagacgcagcgcgcttatgagatcaacagcaaagcgatcagcacctccgatcagatgctgcagaagttaacccagctgtcagaactccgtggcgaagcaagtgattctcaagcctgggcattgggtgcgacgacggctgagccgacgccatccgcaccgccggtggtgaacggttccatttttcagggcgtggcgccgctcaactacggctatcagccgctgtttgaggatcgtcgtccacgtaatattggtgacaccctgaccattacgctgcaggaaaacgtcagcgccagcaaaagctcttcagccaatgccagccgcgacggcagcaacagctttggcctgagcgccatcccaaccggcctggccggactggtgggtgccggcggcgaaaaagccgcgcttgatgccaacggcaaaaacgatttcgctggcaaaggtggcgcaaccgccaacaacacctttaccggcaccatcaccgtcaccgttaaccaggtgctctcgaacggcaacctgcgcgtggtcggcgagaaacagattgaaatcaaccagggcaccgaatttattcgcttctctggcgtagtgaacccgcgcaccatcagcgccagcaacgcggtgctgtcaacgcaggtcgccgatgcacgtattgagtacgtcggtaacggttatatcaatgaggcgcagaccatgggctggttccagcgcttcttcctgaacgtctcgccgatcctgatggcgcaggccgatcgcatccgcgatctcaccagcgtgcagggcgtacgcgataaccagctgattggttacggtctggtggttggccttgacggcaccggtgaccagaccacccagacgccgttcaccacgcaaacggtgagtaacatgctgtcgcagctgggcatcaccgtgcctgctggcaccaacatgcagctgaaaaacgtggcggcggtgatggtcaccgccaaactgccgtcgtttgcccgtcagggacagacggttgacgtggtggtgtcctctctgggtaacgccaaaagcttgcgcggcggtacgctgctgatgacgccgctgaagggcgtcgataaccaggtttacgcgctggcgcagggtaacattctggtcggcggggcgggcgcctcggccggtggcagcagcgtgcaggttaaccagctcaacggcggccgcattaccggtggcgccaccgtggagcgcgagctgcagagcaacttcggcagccagaacaccatcaacctgcagcttaacaacgaagatttcaccatggcgcagcgcattgctgatgccatcaacagccgtggcgtggggtcagcgctgccgctggacgcccgtaccgtgcaaatccgcgtgtcgccaaataacagctcgcaggtacgtctgctggcggagatccagaacatcgacgtgtcggtaccgctggaagacgccaaagtgatcattaactcgcgcaccggttcggtggtgatgaatcgcgaagtgacgctcaacacctgtgcggtggcgcagggcaacctgtcggtcacggttaaccagcagcagaacgtcagccagccggatacgccgtttgccggtggtcagacggttgccaccacgcaaacgcagatcgatctgcgtcagagcggtggcgcgctgcagcgggttaacgccagtgccaacctgaacaacgtagtgcgggcgctgaatgcgctggctgatgtcgattctgcaatcgatggagagcgcgggctgcctgcgcgcgaagctggaaattatctgatgaccgatacgcaatcgctgatgaacgcggcgtatgacagccgctcgctgaacgaactgaaacgccaggctgccgtggacccgaaaggcaaagcgctgcaggtggcgaagcaggtcgaagggatgttcgtgcagatgatgctgaagagcatgcgtgaagcgctgccgcaggatggcatgctgagcaacgatcagacgcggctttacacctcgctgtacgatcagcagattgcgcaggaaatcggcaagcgcgggctgggtctggccgacaccattgtcaaacagatgcagccggcgcaggcaccggacgaaagcgccggtaccgtgccgatgaaactggataacagcttcatctatagcagcatggcgcccacgcagctggagcagatggtgcgcaaagcggtgccgcgtctgccggtctcgccggccagcctgcccggtgacagcaatgagtttatcgcccagctggcgcagccggcgaaagtagccagccagcagagcggcattcctcaccatctgattctggcgcaagcggcactggagtccggctggggccagcggcagatcctgacgcgcgacggtaagccgagctacaacgtgttcgggatcaaagccagcggcgactggaagggcgaaaccaccgacatcatgaccacggaatacgagggcggtgaggcgaagaaagtgcgcgccaccttccgcgtttatggctcctatttcgaagcgctcagcgactacgtgcggttgatttccagtaacccgcgctatgcggcagtggcgaacgcaccgagcgccgagcagggcgcgcgcgcgctgcaggcggccggctacgcgactgacccgaaatatgcgcagaaactggtaggaatgatccagcaattcaaaaacatgggcgaaaaagtggttaaggcttacagccaggatttcaccgatctgttctga

SEQ ID NO: 64919 - DNA, 890 bp, Glycine max
  Peptide Sequence Number=SeqID_156604
cgggtgaacaactgtcaaccggtcgccgcgtgaccaatccgtctgacgatccgatcgccgcttcgcgcgccgtggtgctgtcgcagacgcaggcgcgcgacagccagttcgcgctggcgcgttcgttcgcgaatcagggcctgtcgctggaagagagcacgctgagtgatgtcacgacggcgattcagtcggcgcaatccacgctgatcagcgccggtaacggctcgctgagtgacgatgaccgcgcgtcttatgctacccagctggagggcattcgctcgcagctgctcaacctggctaacagcaaagacggcaacggccgctacctgtttgccggctatgcgtccgacaagccgccgttcaccgaagatgccagcggtaaaatcatctatagcggtggcagcgacgcgatcacccagaaagtcgacagcgaacgcaccatgacggtgggccataccggtaattcaatttttgaccagctgaccagcaacgccaagccggagccggatggcagcgccagccagactaacctgttcgatatgctggatgacgccattgcggcgctgaaagtgccgcagaatgacgctgacgatgccactaaacagaccttcagcgcggcgatggacaaagccaaccgtggcttcagcaactcgctgaacaacgtgctggcggtgcgttctgagattggtacccagctggacgaactggatacgctggatgcaaaaggtgacgaccgcaaggtgacgctgaaagatcagatgagcacgctggttaacgtcgattacaccgaagccatttctacctataccatgcagcagcagctgctgcaggcgtcgtacaccaccttcagcgatatgtcgaagatgtcgttgttccagatgaataaataa

SEQ ID NO: 64920 - DNA, 279 bp, Glycine max
  Peptide Sequence Number=SeqID_156605
atgtatcaatatcctttcgaaggtcatgacactgatatgtctgcaagcgaacattcgtttggtggtgttgcagaaacacatcctcatttttcatggccgaccatgacctcttcacagcaacatgatggcccaatggcaacacctaatgccccattaggtccgcaatgggatggcggagacagcgcgcaagaagaaatccagatcgtcaagcccgaaggtgggatcgaccatgtggcacatcctcacgccaccacggacaccataatgactgatttcgat

SEQ ID NO: 64921 - DNA, 245 bp, Glycine max
  Peptide Sequence Number=SeqID_156606
gaagaataggtgctgtgggtgctccggatggtccgtggcggcgatgggcagcaacagcggtggtggaggatgatccctttctcttcttcgatggttctgccattttgatgaagtttcattggatttcaatcggtggaagtgaaagaggagtgaaaaagaggaagattaggctttacgggacgcgatttggtgaagatttgagtaagatacgaagtttggaagatttaggtatggaggagacgtga

SEQ ID NO: 64922 - DNA, 642 bp, Glycine max
  Peptide Sequence Number=SeqID_156607
atgatccaagaacagactatgctgaacgtcgccgacaactccggtgcacgtcgcgtaatgtgtatcaaggttctgggtggctcgcaccgtcgctacgcaggcgtcggcgatatcatcaaagtgaccatcaaggaagcaattccgcgtggcaaggtgaaaaaaggtgatgtcctgaaagcggtagtggtgcgcaccaggaagggtgttcgtcgcccggacggttctgtcattcgcttcgatggtaatgcatgcgttattctgaacaataacagcgagcagcctatcggaacgcgtatttttgggccgaagtactctaaggagcgaacaatggcagcgaaaatccgtcgtaacgacgaagttatcgtgcttaccggtaaagacaaaggtaaacgcggtaaagtaaagaatgtcctgacttctggtaaggtcatcgttgaaggtatcaacctggttaagaaacaccagaagccggttccggctctgaaccaaccaggcggcatcgttgaaaaagaagctgctattcaggtttctaacgttgcaatcttcaatgcggcaaccggcaaggctgaccgtgtaggctttagattcgaagacggtaaaaaagtccgtttcttcaagtctaacagcgaaactatcaagtaa

SEQ ID NO: 64923 - DNA, 303 bp, Glycine max
  Peptide Sequence Number=SeqID_156608
ccgtttggccagttcgcgcgcctcgctgtcatcaggatcgagttcgcgaagcagatcgctcagtgccagtgcgtcgcggcgcatctccagttccggtgggagataaccggcgtttttcagcagtcgccaggcactgcgcaattccgccggcacaccactgtcatcgtccagcgtgagcggcgcaccttcaccaggcagattgctcagctcgcccttttcctgagcggcgcggatgtgttgctcagccagctgatcgataagccacatagaaacctcctgcaggcatgtctgccaacagcatag

SEQ ID NO: 64924 - DNA, 1028 bp, Glycine max
  Peptide Sequence Number=SeqID_156609
tccggcaggcggtgctgttcccgtattagtggaatggtatgggactaacctgcgcaatatcgctgccggcgctgcagcagcgctttggccgacgatcagggctggctgtggctgccctgagccagatattcatctttccagccgacataattactggccgaataaagcagcgtttaccgggtggcaccaggctgccggcgccaatcatcacctcatcttcgacgatcgcgccatccagcaggatcgagcccatacccaccagcacgcggttgccaatggtgcagccgtgcagcattgctttatggcccaccgtcacgtcttcaccgatgatcaatggaaagccatcgggattactgctggatttatgcgtaacgtgcagcacgctgccatcctggatattgctgcgtttaccaatcaccactttattcacgtcaccgcggattgctaccagtggccagatgctgacatcatcagccagctcgacttcgccaacgaccacgctactgctatccaccatcacacgctcgccggtatgaggaatatgttgcttataagggcgcagggctacagacattctatttctccttttctgatgtttcccgctagcctgcggcttccggtgcgggaaagcgtaatatacgccacctcgcgacagcaggccgaacgccgcgtcgcaccgctctttaacaatttatcagacaatctattgaacgctggcggcaggcctaacacatgcaagtcgaacggcagcacagaagagcttgctctttgggtggcgagtggcggacgggtgagtaatgtctgggaaactgcccgatggagggggataactactggaaacgccacactggaactgagacacggtccagactcctacgggaggcagcagtggggaatattgcacaatgggcgcaagcctgatgcagccatgccgcaagaagcaccggctaactccgtgccagcagccgcggtaatacggagggtgcaagcgttaatcggaattactgggcgtaaagcgcacgcaggcg

SEQ ID NO: 64925 - DNA, 324 bp, Glycine max
  Peptide Sequence Number=SeqID_156610
atgtctaggaatgaagtgcagcgatctagtccatattatgctgtagacttaattacttcttgtatgcgaggtaactcttcagcagggaatttagctccattagatttggagatagaagccacttgcaggagaaacaacgtagagaaaaggagaaaatttttgcaggaaaggacaacacaaccaagttcggtggaagttcaatcatcttcagcatttccagagttaagagactttgaagtaggtgcatctgaagctcatatcatggttgaagatcaaccacgaaggctgactcttgaagactattctagttcgatcatgtcgtaa

SEQ ID NO: 64926 - DNA, 482 bp, Glycine max
  Peptide Sequence Number=SeqID_156611
atgttgacatcttcggaaagggcacagacgaccacattggtcttcgcttatcaatcagaattgggatctccaaatgatgaggatggggtggtcaacaaaagcggggcttttgctcctacgtatcctcaatttgagatgaggaacttagacctacgtagttcttacaaagcgatgaccacattggcctctgcttgtcaatcagacttggggtctccgaatgacaaggtgcggataaccgtaaggtgtctccgtatgctaccggactctcaagtcatgatagcaaaaggtgggtctcgactggaagatgctgacatcttcggaaagggtgtagatgaccacattggtctctacgtgtcaatcggtcttggggatagcaaaaagtatgcacggataaccatcgggtgtctccgtgtgccaccggactcacaggttacgatagcaaaaggtggggtggtcgacaaaagcggggcttttgctcctac

SEQ ID NO: 64927 - DNA, 522 bp, Glycine max
  Peptide Sequence Number=SeqID_156612
atgagcgcgttcgatcactcgtcagatgacacccaggaaactatcggcaacagcctgcgccgacgcccactggcgcgcaaaaagttgtctgaaatggtggaagaagagttggagcagatgattcgtcgcggcgagtttggcgaaggtggacagcttccctccgaacgtgagctgatggcgttttttaacgtcgggcgcccgtcggtacgtgaagcgctggctgcgctcaagcgtaagggcctggtgcaaatcaacaatggcgaacgtgcgcgagtctcgagaccgtcggcggacaccatcatttccgagctttccgggctggcgaaggattttctctccgcgcctggcggtatcgcgcatttcgagcagttacgtctttttttcgaatcaagcctggtgcgctatgcggctgagaacgccacggatgagcagatttccctgttaagcaaggcgttggagattaacggccagtcgctggatgataacgcgcaatttattcgctcagacgtcgatttccaccgc

SEQ ID NO: 64928 - DNA, 442 bp, Glycine max
  Peptide Sequence Number=SeqID_156613
ggatcgaggttagagcaattttggtgcctattggacaagggagttcacaggtttcaggctcatctcaattatcatcaaaagatgcgtttctgtcaaagactgaagagtttgtttgtgttactgtcgccaagattacaaccatagtgatggacaactattcatggtgctatccggcttgtggtcaatgttataaaaaagctgacatgcaaactgtgtcgttcacatgtccgtgtggcaaagagaatgatcaacctgtactgagggtgaacaaaccaaatttttttatctgggatcgtgaatgtgcacaattaattggtcagtcagcggatgaagtcaacaggctcaaaatagaagatgggggtgttgatttaaatgcctatcctcaagcactagataggctattgggttgtttccttgcattcaaagtgaaggtgcaagcaag

SEQ ID NO: 64929 - DNA, 324 bp, Glycine max
  Peptide Sequence Number=SeqID_156614
atgcacacacgaagctttacaaatccacaattccttaaaagtaggcctaactcacaaaaagtccccagtggagtcgccaactatcgcaacgtgcccttcgcgggcgagcgagggcgaggctcacggatgcgctttccaaaggaggaaaggtgcgcggagtcgccaccaacgtttatctgtggaaaacgtcgggaaaaccaaaggaaaccggtcaaaatgagaattctaagttcgggagttgtatttacgcttgaggaaggtcgacaaaagcggggcttttgctcctacgtaccctcctttggagaggaaatcagacctacgtag

SEQ ID NO: 64930 - DNA, 159 bp, Glycine max
  Peptide Sequence Number=SeqID_156615
atgggattgaggagcagaatcatcttaagcaatggtcaaatgtcgggccagatccaaaggcagagaccaatcaaggtaaacggtaacgcggccactgtttgtcgcacaatgtcgtttcctactttcaagtacttagggatggacgcaagtagaggctag

SEQ ID NO: 64931 - DNA, 885 bp, Glycine max
  Peptide Sequence Number=SeqID_156616
atggcatctaagaagaggaaagcaccctctacacctacccaagctagatttgatagatccaggaatgtcattctccatcactcagatttcgatgaatttactgaagaactcaagtgtagaaactggcacaaggagttgaaaaactttgtggatggcagtattgatgtggccatcgtaaaggagttttacgcaaacctctatgaccctaaggataaaccacctaaggggagaactttccagtatactccaggttctgtcattcaaagccagaaccacaggaactggcagctcgattatgcatccctggaaggttctgatggactgccattaaagatcttactgaagaatctgaccacactcgctcagacatggagcgttctttctttttctaacctggtccctacctctcacacctctgatatcacattagacagggccaggcttgggtttccagccttaatcactactctgtgcaaggccaggggagtcgtttctaattcattgacattggagagccttggtctagctattaatgtggcttatgaaaagaaaaactactggaacctagatgacctctcagttaccttcagagggccacgcaaggccaaggggaagaggcctgaggctcccccatcttctgagattcccttttcctcaactccaacaccaattccagctgccccatctacatctacatttgttcttccaggcttgggctttccatccatcatgagcatggaggagtttaatgcacaggtggcctggccaggagcccagtcttctccttctggagggggtggggcctctatagcccaggagcctgcttttgaggagccagcaatagcagcaacagcagagggggaggatgagctcacctctccttag

SEQ ID NO: 64932 - DNA, 154 bp, Glycine max
  Peptide Sequence Number=SeqID_156617
ctccatatggagcttgtaggccttggatcttcttcatcaatggatttcttggcttcttgaggtctgatttcagcggaatggagaaggagaaagatgaatggagacactatttgcttccgacaagtgcaccgaatcgcacaagtagtataaaacg

SEQ ID NO: 64933 - DNA, 588 bp, Glycine max
  Peptide Sequence Number=SeqID_156618
atggtgagcaacccctctagagctcagaagaaagccaagacttccaagaggaagcaaggtgaatggtctcaagatgctctcaacaggttggatacatggttcaccgatgaaagcaagaagaatgactataagatgatttatgctatgaagaatgtgagaatatccaagtatctggacttggaatggttctctcaacaaggtttcaacttctctaatctgttggaagctcaaggtttgtccaaactagtgcagatgaaaggaatattttatccgaaactagtgaaagtcttttacacttgcgcacacgctgacctagaaggtaatctcttttctattgtcaatggagtagaaatggttattgacactgaagtatggaaggaagtagccggactggacatgggtggagtctgtgaattcgaagaaacaactaatgggtacaacaagatgcagaccaatgggggaatgcttcttgacccaacaaggaatttgaggaatcacctaggagtaggtggtatgtcaacagaggaaaaaatgcttgtgtacctcattacctacattcttagtctgaggtcaagtaatcatgctcag

SEQ ID NO: 64934 - DNA, 239 bp, Glycine max
  Peptide Sequence Number=SeqID_156619
tggcttcaaataaaatccctgaagcatgtaggctttctgatggtcctactgggtctgttgtggttcactttgttgttatgttctccatgttcctcatagtccaggttgctatcagaaacgtgatgaaggttcaccatcagaaagcctatgtcacacaagcaagaacagcagcaacagaaacaacaaagagctatgtcacacacgcagattgcagcaaaatgaaagggagagagatatga

SEQ ID NO: 64935 - DNA, 504 bp, Glycine max
  Peptide Sequence Number=SeqID_156620
atggcctctggtaatcgattaccaagggtgggtaatcgattaaaaggcttaaaaatggagacaggaggcaaagatggtctctggcttgaaaacgaagtcaggaaactaagggagcctctgagggatgggtcactggtaatcgattaccagatcgtgatggcggcgcagctaatccgtgatcgagtagagatggagtgcctagagggagtttgggagaccctcgaaggcaacacgaggtgccgatttcggggcaccattcgattcacggctacttctttgcccgtccaagtgatcgaggtaacgtcatccgaggaagaccctgaggaggatcccgaggagctacctcctgagcctgctgtggatgctcttgactttctagagggcgatgaagacccacttcctgaggtggattctcccgaggaagtcatgtcggcatctgaggcagattctacggaggatagtggcccgggggagatggcgatcagcggaggctcttcatcctag

SEQ ID NO: 64936 - DNA, 207 bp, Glycine max
  Peptide Sequence Number=SeqID_156621
atgcatatgacacagatgcaatttcatgaatacgggagcctgggaaactgcctccttcttagatacaatgtttggggcagcacggcgcccgacgtatgcattttagaaggtgacacggaccctccgatggtttgccaaagcgaggggatcaagacgaaacccgcgcatgatgcatatgcgaaaggcacaacacggggatgtacatag

SEQ ID NO: 64937 - DNA, 198 bp, Glycine max
  Peptide Sequence Number=SeqID_156622
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagattgtaaccacgagggttgggtctag

SEQ ID NO: 64938 - DNA, 363 bp, Glycine max
  Peptide Sequence Number=SeqID_156623
atgccagaagtcgaaagggagcattgtcgcacaatccgtaaagttccgcaacattctggaagtcaaagaggggatggttgcgtaatcgcgttgcttctagaggaagcaaccttgggcgagctcggtggcaacctcctccccctttttcctataaaaaggcaaaagggggttgttccaagggtcccggatccccctagctatgcatttcagctattttgggtgaaaaaaaattgttttcgtgaagaaaatccaagccgaggtgcttccgtaacgcttccgagatgtttccgtgagcaaatccgtgaaggtttttcgtcgttcttcatctgttcttcgttcgttcttcgttcttcaacgctttaa

SEQ ID NO: 64939 - DNA, 522 bp, Glycine max
  Peptide Sequence Number=SeqID_156624
caccctctagacttggataagtccaacagggccatgggattttccgcattgatcacaggactctgccagtcgttcggcgtccccgtcgcacctagcaaggtgattcggctgcccatcacccgagcttttattgagaagtactgcacgcagagacaggtccagggtgatgcaccacaggctgcggacgcgccgccacctcatcaggctggtccagccggatcgtttgatacggagcagtatttgtggcatttggttcgccagcaggcggccaaccaccgggcacatgtacagactcatgattgtctttatcagatgagtctcagcctgcagagccagggctttacttcttttccgtgccctactccggaccagttcagggcagaggtcgcatggcctggagattggcctgaggcccaggcaggagaggcaccagcagaggctcccgacgaggcagatgaggcccgcgaggacgaggagatgaccgatttacttgatttcttaggaggaagcggggccacatga

SEQ ID NO: 64940 - DNA, 591 bp, Glycine max
  Peptide Sequence Number=SeqID_156625
atggccactttcaatggcttcgtcgacggcactccctcggaatctgcattgatctttctcggcaccggttgttcgagcatggttcccaacctcatgtgcctccttcagccttccgaccctccctgccccgtctgcgtccagtcattgtccatccctcccgaacgaaaccctaattacaggtgcaatacgtctctcctaattgactacggcgccgccgccgccaacggtggcgatcgcaagtatatattgatcgatgtcggcaagacgttcagggagaccgtgcttaggtggttcgttgcccatcggattcccagaattgattctattattttaactcatgaacatgccgatgcagtccttggattggatgatatacgtgctgtgcaggcttttagtccaacaaatgatattgatcccacacccatatacttgagtcagcattcaatggatagtaaattaacacaaaaggaagaagttgtaccactagctgtgatggtcagtcagttaaaacttagaaggctctctattgatcagtatggctctttgattttcaatatggatgatgtgattcaagttgctatcacaggataa

SEQ ID NO: 64941 - DNA, 1902 bp, Glycine max
  Peptide Sequence Number=SeqID_156626
atgtccaagtctctgccctactccaccaaagatgttgactacgacaacgccaagtttcgcccccgttctttcttcaaggttgctactcagaacttactcaccagtaacctaaggcgtgattgtggtagctgtagtacagggaagtttctgtttttgatattgatctttggtgttgcttatcttatgctggcacatacgagttcaggcggtgtagtttctgatgatgaagcaattgtgaatagaaacagttacgcaaatagcagcattgttaatggtgctggcaaaataaagaggttctggagacggccgccgaggcttcctcctagattatcgccggatgaaaagggaagtggtaatggaaatgaccatgtatcggggaatccggatgttgttaggtcaatgtggattgctaggcaaaagaaagtcaaggaagctttcgttcatgcttggtctggatacaagaaatttgccatgggttacgatgaacttatgccgctcagccagcatggaattgatggattaggagggttgggtgctacggtggtggatgctctcgacacggctatgatcatgggtcttgatgaggttgtggctgaagctggatcctgggttgaagaacacctttctgagagaattagtaaaaagggtcaagtgaatttatttgaaaccacgatacgggttttgggtgggcttttaagtgcgtaccatctaagtggtggggagaaaggaacgaacttaactcatgcaggacctaaaccagcagtttatctagaaactgctaaggatttggctgaccgtctgctatctgcttttacggccagtccaactgctattccgtttagtgatgttattctgcatgaaaagtcagcccatccagctcccggaggactgagtagcacatcggaagtttccactttacagcttgagtttaattatctcagtcagatatctggtgatcagaaatatagtttggaagcaatgaaagtcatggagcacatgaagactcttccaaagattgaaggactagttcctatctacattagccctcattctggtgagtttagtggagaaaatattagactgggatctcgtggggacagttactatgagtacttaatcaaagtatggcttcagagtggagcaagtagcaatagtaatacatcatacctatatgaaatgtataatgaagcaatgaatggtgttagacatcttcttgttcggaaatcaattccaaatggactagtttttgtcggagaattgccttatggatctaacagtaatttcagcccaaaaatggatcacctggtgtgtttcctacctggtacacttgcaattggtgccactaaaggccttacaaagaaacaggcaatgaaaaacaatatgcttaactttgaagacctagaaaatttgaagctagcagaagatctgactaaaacatgctttgaaatgtatgcagtaacttcaactggtcttgctcctgaaattgcttactttcatactgaggaattttctgaacaaggtcatgatggaggaaataagagctcggaatttgttaatgacatcattataaaacctgctgaccgtcacaatcttttgagacctgagactgtggagtcattgtttgttttgtaccgtatcacagaagatccaaaatatcgtgaatggggttggcaaatctttgaagcttttgaaaagcacacaaaggttgatactggtggatattgttctctggacgatgtaactattgttcctcctcatagaagagacaaaatggagactttctttctaggagaaacacttaagtatttttacttgcttttcgcggacagctctcttattcctttggataaatttgtttttaacacagaagcacatcctataccaatcaatttgaagaaatga

SEQ ID NO: 64942 - DNA, 2070 bp, Glycine max
  Peptide Sequence Number=SeqID_156627
atgtcgcaagataaattcaatagattgaaggtccaactttctgatactacccagggaactagaagtcccatcaggcaccataagcgaaatggtgatagagttgcagggacaagtggccattctgaggaaattgattgcccgctttcgtctgcagcacctgagatgcatacttgtacagcaggcagctcagagaactggatggtgttgtcaattgcagggaataagcccactcctagatcccatcatgctgcagctgtcattcagaataaaatgatagtggttggtggtgaatctggaagtggattgttagacggcgtacaggtgctaaattttgacagattttcatggaccacggcatcgtctaaactttacttgtcaccaagcagtcttccactaaagattccggcttgcaaggggcattgtttggtttcttgggggaaaaaggcactcctcattggagggaaaacagatccagcaagcgacaaaatttctgtatgggcgtttgatacagagacagagtgctggtcactcatggaagcaaagggagacataccagttgctcgcagtggtcacactgttgttatggctaactctgttttaatattgtttggaggagaagatgcaaaaaggaggaaactgaatgatctacatatgtttgatctcaaatccttgacatggcttcctctccactgcacgggagcagcaccttgtccaagattcaaccatgtggcagctctttatgatggtaaaattctttttatatttggaggagcatcaaaatctaggaccttgaatgacttgtattcacttgactttgaaacaatggcatggtcaagaataaaaatacatggtttccatccatcaccaagagctggttgctgtggtgttttatgtggcactaaatggtatattacagggggtggaagcaagaaaaaacgacatggggagactttggtatatgatgttgtaaaaagtgaatggtctgtggcaattacgtcacctccatcttctattactaccaacaagggttttagcgtagcacttgtgcaacacaaggataaagatttccttgttgcatttgggggatccaaaaaggagccatcaaatcaggtggaagtgttgataacagaaaaaattgaatcagtcctgggaagacgaccaacttctaccaaagatccaagatctatacttcttgaaaaacattcattatctgctggattggcttctcaacttaaaaatgattcttcgcaacatttgattaactctgttgctcgacaaaatcttgcgtctgtaattgaacatagttctgaaagaaaatctctctcagaatccctacttgtacaagattccaattctctccctaccaacatctcccttcgcaggcaatttgatcatgatgaagaatgcaatgcagatgtcaggattgacaagcattcagaagatgaaagttctttccctcggaattcacttcaggcagctgatcacaaaacaaatcaaaatgaccctcgaaatcacatgagcagaagtggagccaaaaccaacatggaggaacaggtgtcagtatctagaagttcaaatcagaaaaacctcggttttggaaaccccgtgctagaaagtgatgatgtgtcattccctgaaaacagtaaatcaggatcactgtccgctgcttcagacatccatcattactatgaaactaaagtggcttccctaatgagaaaatttggcattctggagggacaattggcagttgcattagcaagcagagaagcttctgagaaaagcttagcatctgcctttaaaagcaggcaggagatggagagaaaattggctgacacactgaaggagatggaattactgagagagaagctggtgagtgcagagttagttcaagaagaagctaacaacctatccaacatggtccatgctgacaatgtaaggcttgagcatgacgtggctttcctcaaggctgttttagatgatactcaaaaggttgaagtttttcatctcaaacagagacttcaatcaatggaaaaacgagcccctactcccaggaaaccttttcaagtgtag

SEQ ID NO: 64943 - DNA, 504 bp, Glycine max
  Peptide Sequence Number=SeqID_156628
atgggggagggatattgtacgcagccttacccttgcatatgcaaagaggctgtttccggattcgaacccatgaccaacaagtcaccaaggcacaactttaccgctgcaccagggctcgccctcgtccatatgcacaaatgttccaggaaaatattatataggggaaagggaaaccaaaccatgatacaccagaattgtcagacgagtcatgccataccttcttcatctgataagcagcagaataaatggtcattgagtgcatattatggaaatgcaacaaaatattatagaaaagcttcatcaaggattgcagtgaatagaaatgctgaagagaaacaaaagacacacctctccaacaattactgtgtccccttcctttacaccaagtttcatgagagacttgtacacaccacaagcctcaagaacacgttggaatcttctctccaaatcaatgtacccgttaaagatccacaaatctcaatgaaactagacatgaatgggtag

SEQ ID NO: 64944 - DNA, 381 bp, Glycine max
  Peptide Sequence Number=SeqID_156629
atgtgttcgcaaaaatattggtttgtgacatatgagaagcagtctggtggtaatgttctcttgggttatgtactaattaggatgcatgataatgatgttagaaccttgattaaagttcgtcacatggcaaagcttaagaaaaatcttgtatttatgggtgtcatggattttaaaagagttccatcattagaggtatggtctaacaatccaactgaatactcaatgttgaaggtgtatggatgtttgacatactattatgcaagtgaagttggaagacaacacttcaacactacaaaaatagagtacatgactctcgtagaagcatcaaaggaaggaatgtggttgaaagatcttattaacaatgttgggtttacacaataa

SEQ ID NO: 64945 - DNA, 4389 bp, Glycine max
  Peptide Sequence Number=SeqID_156630
atggcttttgagccattgaattggtattgtcggccagttgcaaatggagtatggacaaaatcagtggagaatgcctttggtgcttacactccttgtgcggttgactctctggtcatctccgtttccaacttgatacttcttggcctgtgcatttaccgcatatggttgattatgaaggatttcacagtcaagaggttctgtttaaggtcaaacctttacaattatattctgggattgctagctttatattgtgtggcagagccattatacagattgatcatgggaatatcagttctaaatttagatgggcagactcaacttgctccatttgaggctcttgcttggtgctctatacttattttgattgggattgaaactaaagtctacatccgagaattccgatggtttgtcagatttggtttgatttatgctattgtaggggatgctgtaatgttcaatctcatcatttctgcgaaggagttctatagcagctctgtgctatacttttacatcagtgaggttgttggccaggttttgtttggaatactattgcttgtgtatgttcctactttggatccttatccaggttatacccccattgggactgagatgattactgatgctacatatgatgaactccctggaggagatatgatatgtcccgagaggagtgccaacatattgtcaagaataatgttttcttggatgaatcccatcatgaaactaggatatgagagaccactaactgagaaagatatatggaaattagatacatgggaacggacagagacactgatcaataagttccagaaatgttgggttgaggagtctcggaagtcaaaaccttggcttttaagagcattaaatgcaagtcttggaggaaggttttggtggggaggcttttgcaaggtctttggggtgttatgtgaagctcaatattttcagaatgtcatgcgtgttggttaccggttaagatcaacattggttgtcaaagagctacttgactcgatcatacttaaccaccttgtgtcagcaggagtggcagtgcaagtggctgctgtatttcgcaagtccctaaggcttactcatgaagcacgaaagcaatttgcaactggaaaaataaccaacttaatgactactgatgctgaggcacttcagcaaatatgccagtcacttcacactctctggtcagctccagtacgaattgttgttgctatggttcttctttaccaacaacttggtgttgcttcccttcttggtgctttgatgctagttcttatgttcccattacagtgtaatggatttattctaaatagcattccagtttttgtaactgtgattacatttggagtattcaccttgcttggaggggatctgacacctgcaagagcttttacatcactttctctgttttctgtgcttcgatttcctctcttcatgcttcctaatactataactcaggtggttaatgcaaacgtatcgttgaagcgactagaagatttactcttagcagaagagagagtacttctaccaaatccacctattgagccaggattaccagccatctcgatcaagaatggatacttttcttgggatgcgaaggcagagagggcctcattgtcaaacataaatctggatatacctgttggttgcctagttgcagttgttggcagtacaggagaagggaagacatcactagtatctgcaatgcttggagaacttccaccaatggcagattcatctgttgttttgagaggaacagttgcttatgtaccccaagtttcctggatttttaatgcaactgtacgggataacattttgtttggttctgtctttgacccagcaagatatcaaagggcaataaatgtgactgaactgcagcatgaccttgagttactgccgggtggtgatcttactgaaattggtgaaagaggggtaaacatcagcggtggccaaaagcagagagtatccatggctagagctgtctactccaattctgatgtgtacatctttgatgatcccctaagtgctctggatgcgcatgtggctagacagtgttctaactcaaaagtaatttgctatggcattgtttttggtcatctgagggcgagccctggtgcagcggtaaagttgtgccttggtgacttgttggtcatgggttcgaatccggaaacagcctctttgcatatgcaaggaatcattttggtccatgaaggtatggtgaaggaggagggaacttttgaggaactctctaaccatggaccgctgtttcaaaagcttatggaaaatgcgggaaagatggaggagtatgaagaagaagaaaaggtagatactgaaaccacagatcagaagccctcttcgaaaccagtggccaatggagcaattaatgatcatgcaaagagtggaagtaaaccaaaagaaggaaaatctgtccttattaaacaagaagaacgagcaacaggggttgtcagcttgaatgttctaacgaggtacaaaagtgcattaggagggttttgggtggttttcgtactctttgcatgctatgtctcaacagaaacgttacgaatatcaagtagcacatggttaagccattggactgatcagagtgctacggagggttacaaccctgtcttctataatatgatatatgcagctctatcatttggacaggttttggtgactttaacaaattcttattggttaatcatatcaagtctttatgctgctagaaggttgcacgaagccatgcttagctccatattacgagctcccatggtgtttttccaaacaaatccactcggaagagttatcaacaggtttgcgaaggatctaggtgacattgatcgtaatgttgctccatttgtgaatatgtttctaggtcaagtgtcccagcttctttcaaccttcatcctcataggcattgtcagcacaatgtccttgtgggcgatactgccattgttggtgttgttttacgtagcatatctatactatcagagcaccgctcgtgaagtgaaacgcttagactcaattagcagatctcctgtttacgcacagtttggagaagcactgaatggcttatcaacgattcgtgcttacaaagcgtatgatcgaatggcagatataaatgggaaatccatggacaacaacatccgattcacgctggtgaacatgagtggaaaccgatggctcgcaatccgattggaaacattgggaggccttatgatatggttgactgcaacttttgctgtcatgcagaacgggagagcggagaaccagcaagaattcgcatccaccatggggttactacttagctatgctctgaacattactagtttgcttactggtgtgctgaggcttgcaagtttggctgagaatagtttaaatgcagttgaacggattggcacttacatagatttgccctcggaggctccctctgtcatcgataataatcgccctcctcctggctggccttctttaggctcaattagatttgaagatgttgttcttcgctacagacctgagcttcctcctgtgttgcatggcttgtctttcaccattttcccgagtgataaggttggcattgttggaaggactggtgcaggaaaatccagcatgcttaatgctttgtttcgaattgtagaattggaacaaggaagaatattaattgatgattatgatgttgcaaagtttgggcttgctgatttgcgtaaagttcttggcattataccacaatctcctgttctcttttcaggaactgtgagatttaatctcgatccattcaatgaacacaatgatgctgacctctgggaggctctggagagggcacatttgaaggatgtgatacggaggaattctttggggctggatgctgaggttcttgaatacgatacccctgaggagctgctgtcaaatgaaggtagtgctttctctaagatggtccaaagcacaggagctgcaaattcccagtatttacgcagcttagcacttggtggggataagtcagaaagagaagagaacaaacatctagatgcccggagaaaatggctggcttcttctcgatgggctgctgcagcccaatttgctctcgctgttagtctcacctcatcccataatgaccttcaacgattggaagtggaagacgagaatagtattctgaagaagacaaaggatgctctgataactttgcagggggttctggaaaggaagcacgataaagaaattgaggaatctttagagcagcgccaaatatccccagacggatggtggtcatcgctttataaaatgattgaaggtcttgctatcatgagcagattgaccgtgaacaggttccatcaatcagacttcggttttgaggacagatcaattaactttgatcaggttgatatgtag

SEQ ID NO: 64946 - DNA, 1536 bp, Glycine max
  Peptide Sequence Number=SeqID_156631
atggaggaggatgagattcaagcatgtaagttccctagagttggaaatggtaggagtagtgaccaataccaagaggaggaagaagagggtgacctaagaagaaaaggtgttggtggtggtggtggaagtgatgctagcacaaaccacttccaccaaagtagttggcactactcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgtggagtggctaatcaaagctgcttcagaagctatctctgagcttccttctctcaacaaccctttccctgatacccctaagcagcctagtgatgagaaaaggcctaccagtggtggtggtcaacaacaacaacaacaaggctttgatgatgcagatggagacacaaattaccaacaaaaccaaagccagaatctttctctctccaagtctgcttgtagcagcacttccgagacaagcaagggctcaggcttgtccctctcaaggtctgagatccgtgtgaaccgtgtgaaggcaagggagagggcaagggagagagcagcaaaagagaaggagaaggagaaagagaaagagagtgattttaacattgcacaccaccatcaccaccacaatgtgaacaacatgtctcacactgcttccttcactgagcttctcactggtgggattgggagcacggtaacagttaaccccaacacaacaacaacaacaacaacaacagcaacaagtcctaatggatcatcggttcatcagatccatgagggtcatgatcatgaggctaatctattcaacaagggaagtcaacaacagcaacagcaacaacatcaccattggtctcaaacagtgacacctatggactacttcagcgcaggcctcttggtaggaccttcatcatctgcaagtactcaacaacaccaatcttcaggacagttccaactgggacatggacatgcacatgcacatgctctttcaatctcaccatttagtggagaaaaccactcggagcaaatgcagcatttttccttcatgccagaccatctcaacaacatgccatcttctgctgcttctgcttctcaacacagcgagggtgacaataacaactacaacctcaacttcagcatctcttcgtcgggccttgctggttacaatagggggacccttcagtccaattctccgtcttcctcgtttttgcctctccttcagaggtttcaacctttagtcgacggatcctccaatctacctttctttataggagctgctcctccttcttctgctcctccaaccatggacaacaacaacagcaacaacagcaacaaccatcaccaccttcagttctcacccatctttgatggccgcttgcaactttgctatggcgatggaacaaggcagcattctgatcacaaggggaagggaaagaactaa

SEQ ID NO: 64947 - DNA, 528 bp, Glycine max
  Peptide Sequence Number=SeqID_156632
atgtctggcggaggcggcgatgagggagcttatggtccaaacgacgcgcagtttgaggccgccgttggtgtagaaggagtcagggatgcttccattgtcgtcgtttgcgttgcaattggtggtggtgggctcgccgctggggagctcgatccggaggaggcgaatctcgttgaagttcttgaggacttgggttggggagtggtgggtgacgccgccgtcagagtcttcgtcggaaccgacggcgagggaggaggtggaggaaggggatgtggcggcggtggcggtagcggcggcggaggaggaggggcgtttggggccgagaaactggccgagggtttgaatgggtttcacgattccgccgaagacgaggcggaggaggttccagaaggggccgcgggacttgtcggaggcggcggaggaggaggaagagtcgtcgtcggagatgacgcagtcgacgcggacgacgacgttttcgacctgcgggacgagggagtggaagcggcgcgagacgacgcagcagcggcctag

SEQ ID NO: 64948 - DNA, 771 bp, Glycine max
  Peptide Sequence Number=SeqID_156633
atggccaaaccactatatctagaggaagattacaaaccaaaagattatacccctaaagccaaaagtctatccttctttgcctctattttctcccttttcatctacatatgtgtattctacaccttcaacctatctccctattctctcctcaaaaacaacatcttttggtttttcatgtccaacaccctcattctcatcattgctgctgactatggagcattctcttcatccaaaaagaaacaaaacctctatgaagagtatgttcaacacagtcaagcaagaaactatgttccctcatcatacgtgcccaaatattatgaacaagttgataaacaatgcattaatcccaaacaagagctaggttgtgagctgttagagaaaaagaaagaaactatctctgatcaagatatcccagaacgtgtacttgaaattgtgacagtactcaatcaacctaagaaacctagtgagtgctccaatgtgaaaaagccaacacttcacttgcaagtagatgatggcagtgaaaaaattgaggagatcaaagcagtgcctgccagaatttacccgcgaagtaaatctgatagacccaatagagtcaagtatgtggtgaatgaggagagggtgaacaaggtgcaaagatcagagactatgatcaaggtagatgcaaatgttgttgaagaagaaaatgagttttctacgatgtcaaatgaggatcttaataggaggatagaggagtttattcagaaatttagatctcaggcaactagaaattaa

SEQ ID NO: 64949 - DNA, 1218 bp, Glycine max
  Peptide Sequence Number=SeqID_156634
atgcagcgtgttagattttcatctcagcaggcaccagtacacaagctaggagatcctcaaatgacattatctcccaagtttaggttagctgtgatccaatcttctttggcaaatccatcacctgagttagagctttctctcagagaagaacccttaattcctggccttcctgatgatgttgctctcaattgtcttctccggcttccggttcagagtcactcatcttgtagagctgtgtgcaagaggtggcatatgctacttggtaacaaagagaggtttttcaccaataggaagcaatttggtttgaaagatccttggctttttgtttttgcctaccacaagtgcactgggaagatcaagtggcaggtgcttgacctcacacacttttcttggcacactatccctgcaatgccttgtaaggacaaggtttgccctcatggttttaggtgtgtttcgatcccctgcgacggcacactgtttgtttgtggtggcatggtctctgatgtggattgccctcttgacttggtgttgaaatatgagatgcagaagaataggtggactgtaatgaataggatgatcactgccaggtcattttttgccagtggagtgattgatgggatgatatatgtagctgggggaaatagtactgatctttatgagcttgattctgctgaggtgttggatcctctcaatgggagttggcgccctattgccaacatgggaacaaatatggcatcttatgatgctgcagttctcaatgggaaacttctggtgactgaagggtggttgtggcctttttatgtctctccaagaggccaggtctatgatccaagaactaataactgggaaaatatggctgttggactcagagaagggtggacaggttcgagtgtggttgtttacgggcacttatttgttgtttctgagctcgaaagaatgaagctaaaggtctatgaccctgaaaccgattcctgggaagccatagaagggcttcctttgcccgagcaaatacgcaagccttttgctgtgaatgcttgtgattgtcatatttatgttgtgggtcaaaatcttgtggttggtgttggccatatcactagactgaacccaaaagaaagttgtaaggaaaaatggaacttcagtgttcgatggcatgtaatagatgcaccagaaagtgtgtctgatctgactccttcaagctctcaggtgctgtttgcttag

SEQ ID NO: 64950 - DNA, 1401 bp, Glycine max
  Peptide Sequence Number=SeqID_156635
atggtcaagaccggtctcgacaacgttcctttcactctgagcaagctcctcgcagcttcgatcatagacatggactacgcagcttccattttcagttacattcaaaccccaaatctcttcatgttcaacgcaatgctcagaggctattctttaagcaatttccccaacaaagctttgccctttttcaacgaactgaggaatcgtgcaatttggttggaccagttctctttcatcacggttctcaaggcttgtggtcgagtttcagaagttggggtggggcaagggattcatggggtagcagtgaagtcagggaatagggtgtttgttgatgtgaagaatgcccttttgcatttttattgtgtttgcaagagaattgaagatgcacgtaagcttttcgatgaatttcctgagggaaatgacttggtgtcttggaacactttgatgggcgggtgtgtttctgtttctcagccttgtttggtttttggtttgttccggaagatgtgttgggttgggcttgaagccagtgttgccactgtcttgagtcttttgtcagctgcgggttacatagggaactttggtgtagggaagtctctccatggatactgcatcaaaattggatttagttctaatttgaatgacattactgcattgattgatttgtatgcaaaggtggggaattatgcaagaaatggaatggttggagaagcactggcttcattcgagcaaatgagtgttcgaggaatgaaacctaattcttctaccttgtcagggctgctctctgcttgccctgcgtctggatcagtacaagtagttcgtcatgtcgctagttttgttgaagagcagaaagtaaaactggatgcggttcttggaacggctcttgttgatgtgtatgctaaatgtggctttctagatgaggctatggacatatttgagaggatggaagataaagatgtgaaatcttggactgccatgatttcgggcctcggagttcatgggcagccaaaaaatgccattaggcttttcaataggatggaaaaggaggggtttaaaccaaatgaagtcacgtttttggcaattctgactgcttgtagtcatggagggcttgtggttgaggggatggaagtttttaagctcatggttcaggaatatgggttttcaccacaggttgagcattatggatgtcttattgatctcttgggtcgagcaggaatgctacatgaagcacataaactaattgatagcttgccaataaagggtgatgctactgcttggcgtacactgctttctgcttgcagaatctatggagatgttaaattagggaagtgtgtgaaagatgtgctaaagagcatttatgcagagcatttatgcagagcatcctacagattccctcctcatttctag

SEQ ID NO: 64951 - DNA, 360 bp, Glycine max
  Peptide Sequence Number=SeqID_156636
atggatgggttctacatgatttcacacccattcatgagtccgacacagccaagggatcctcctagagtttcgccggttcaagaatatgacacatttgttgaaccagatgtgcatcagcaaccggtggaggcagcgacacctgatgaggtagacgctgatgtgcatcatcttggacatgcagtggatgcttttgcggcaattgctgataagttggagaggctactaaaactgaggatcctgaccgaaggaacaaaagcttgtattgttgctgaagaatatgtgggcatcgtaagaagattcattcgccaaccaactgtagatcacagatcgaggtgtaggcggcgtatggacgatcattga

SEQ ID NO: 64952 - DNA, 750 bp, Glycine max
  Peptide Sequence Number=SeqID_156637
atgctcaatcaattgatgaatgatctcaaacatgtgaatgtcttcagtaacattattggatccactcttcttaatgatcagaaccagaatggtgcacactttcaggttcaagatgaattaaagcactatcttgattgcaggtctatgtttgtctgtccattcactaggtatgtgtctcccccagaagcatgttggaaaatttttgcattcccaatgcacggacattcaccggcagttgaacgcctttatttccaccttgaaaatcaacagccagtttactggacagatagtcaacaaattggtgcagttctatcaaagagcacaatcaaagaatcaatgttcacagcctggatgcattctaacaaaatatacccttatggacgggatcttacttatcctcaatatgtgtcaaaatttgtttatgttgcatgcaaaagatgctggcaaccaagaaaacaaggaaatacaataggcatgttcatatgggtcccaccttcaagtggcgaattgttttacctcagaatgatgctttcctctgctaaaggtccacagtcttacaaagacattagaacagttgataatgtggtgtatgatacatttaggaaagcatgctttgcaaaaggatttctaggaagtgatcaagaatttattagtgctttacgagaggctaacagttggggcactgcacactaccttagaaagttatttgtgaagcttttatttatgaacaccatggacaaaccagaatat

SEQ ID NO: 64953 - DNA, 348 bp, Glycine max
  Peptide Sequence Number=SeqID_156638
atggacgaagatgagtggatgtatgaaataatgtctaaacaagcggatatggattatgaaaatgaagaagcatgtggtgtgaatgaaccacatgttgattgttccgatgcattcaatacttctcaggctcgatccgttgctcatgaaaacggatttgtggaggtgattttaaggtcgaacacaaacacaggtagtagaggaaggactacatttgtgttaattggttgtgaaaagagtggcgagtataggtgtaggaaaaaagaatttatcagaagagacattgggactaggaaatgtgggtgtcccttcaagcttcgttgcaagccagtggttggaggagaaggttag

SEQ ID NO: 64954 - DNA, 388 bp, Glycine max
  Peptide Sequence Number=SeqID_156639
cgctattcatgcatcctccaccaaggagtttggagccccgcgaagttattgcgtagcgctgttcgccaattctccattctccaatcttattcggagacccatgaatttgttgcctagcgctgttcatgtgtcctccgttatcaagcgcggagcctctggtgactgggaaatatgtttttctccggatcgtaaaaaagaaggagtagagacgagagtcgtcatcacggaaagggcaggacggacgaaatcagtgtcttatctttgctttcctcttatctccgatgagagatacttggcaccctttgttgcacaatatgtgaagtcccgagacgtgccgaaaatcaaaaggaagcaggcttacgcgatccgtgaaaattccgtaatgtga

SEQ ID NO: 64955 - DNA, 570 bp, Glycine max
  Peptide Sequence Number=SeqID_156640
atgaagttcgttttctgcgttttttctagaaaacgcgacgaactcgctaagcgcgtctgctgcgctaagcgaattcatcaaaagtgtttgaatatgacatctaggaaaaggaaaagaaccgcttccagacctcaagctcagtatgataccaggagatttcaatccttggaagcctggaatcggtacacaaataacattctgaaccggaggatccttctggaaaggaatgttaagatttatcataccgaatttgacgagtttaaggcagagttggagaggcgtaacttacacaaacgtctcgccaatctccaagatggaagcatagatgtagctatggtgaaggagttttatgctaacttatacagctcggaagaccagagccctaagcaagtgagggtaagaggacattcaattaagattgatgctgacagcctgaacaccttcttagagaccccaatagttttggaggagggtgagacactgcctacctattcaagatttacgaggatgaggattgatcctcaagagttgctgcccatctctgcatccctggtaggggttttgttctga

SEQ ID NO: 64956 - DNA, 73 bp, Glycine max
  Peptide Sequence Number=SeqID_156641
atggcggtttccaaaatcagaaatgatgaaaaggtttcctctcggtgtggggttacaatggagaacaatggcg

SEQ ID NO: 64957 - DNA, 231 bp, Glycine max
  Peptide Sequence Number=SeqID_156642
atgttggaaattgggttgcttaaggaggaagcaactgcgcggcaagctcctccacgttttttgaaaaatggtttccagggcttccgtggcttccgtaaaatttccgaaaaccttggcgattatgtggaaattcttcatcattcttcaccgttcttcattcgttcttcgtcgttcttcagtcttcaaccgttaaatttcgcttactttcagttttcttttcttccgctttaa

SEQ ID NO: 64958 - DNA, 210 bp, Glycine max
  Peptide Sequence Number=SeqID_156643
atgaagaagatccaaggcctacaagctccacatggagctacatcacccaagacctacactctgaagagtccgtcagggcctctccctcctgattcagccgaaattactaaacctcgatccctcgttagaccgaatcaatccaagcttcgtcctcagatccctcttgttggactaggcccaattgagatagccctcttaggtctagactaa

SEQ ID NO: 64959 - DNA, 516 bp, Glycine max
  Peptide Sequence Number=SeqID_156644
atggaggccatgaaagagcaaatggccacaatgatggaggccatgatgagcatgaagaagataatggaagccaatgcagttgcagttgccgctaccagcgctgttgctaaggtgaaccggatgcccccatctggcctcaaccaaatgaatcatccaacctcagctagggtaggcaaagatttgggaagtacgggcgacccccattatgcgcaaattcaaaacaagcatgccttcccaccatatggcttgcctcccaactatacaccacccaatgtggcatacactcccaatgaggatgaaattccccaccacaatctagccgacttcaagccttgcctcggatatcccactgaaaggcaagcagttggtggtatacccttgcatttcacagcaggtaaaatccctcagtttcgcccccaaccacaacctttgcatttcacagtaggtaaaatccctcctattatggaaggaaagggaaaagttggatcatctggaggaaaggctcaaggccattga

SEQ ID NO: 64960 - DNA, 910 bp, Glycine max
  Peptide Sequence Number=SeqID_156645
cgtcgctgttcaacatcgcggtcgatcccgcgttccagcgccgcggctatgcgcgtcagctgctacagcagctgattaccgaactggagcagcgtgcggtgatgacgctgtggctggaggtacgcgcctccaatcagcccgccattgcgctgtatcagcagctggattttcatcaggtcagcgtgcggccaaactactatcccaccgccagcgggcgcgaggatgccatcatcatggcgctcacgctctgacgttattcaaaaggggcactatgttaaacgactgggactgcatcctgttcgatgcggatgacacacttttccactttgacgccttcgccggcctgcagcgcatgtttgccagctacgacgtgcacttcagcgatcaggattacgctgattatcaggccgtcaacaaaccgctgtgggtcgattaccagaacggcactatttcagcgttacagctccagacgcgccgcttcacgctgtggggcgaaaaactgcgcgtggcgccggaagtgcttaacagcgactttcttaatgcgatggccgagatctgcctgccgcttgatggcgcagcccgcctgctggatacgctcaagggcaaggtaaaaatcgccatcatcaccaacggttttacggcgctgcagcaggcgcgccttgaacgcaccggtttccgtgactactttgacgcgctggtgatctccgaacaggtgggcgtacccaagccggacgcggcgatttttgaccatacgctgcagctgctgggcaatcccgatcgccgccgggtattaatggtcggcgacacgccggaatcggatattctcggtggtatgaatgccggcgtgaaaacctgctggatcgatcacggcacgcgtccgctgccggcgcacatcacgcccacctggcag

SEQ ID NO: 64961 - DNA, 225 bp, Glycine max
  Peptide Sequence Number=SeqID_156646
atgttggctactggtaatcgattactgccttctggtaatcgattaccagagagtaaaactcttggtgttgagggaaggatcccagagtatgatgaacctcaggatttgaggtcaaatcctttccaaggtggagggatgatgcaatcctaccccccaagggtatggatagaagactccaagaggcttgggctagaactactaaagaaggccctagggttctcatga

SEQ ID NO: 64962 - DNA, 183 bp, Glycine max
  Peptide Sequence Number=SeqID_156647
atgtactatctatgcaatcaaggcagaacaccacactacaagcatacacagaccaataggccaaagaagagaaggttcacgcagctaatgactcgcttagcgaggtggatctactcagcaagtgacatctgcttagcgaggcatccagctcgcttagcggatgagaaccctagaagaggataa

SEQ ID NO: 64963 - DNA, 301 bp, Glycine max
  Peptide Sequence Number=SeqID_156648
gaccattcgtggtgaaaagagctttttctgggggtgctctgatactcaccaacatggatggcgaggagctgccctcgcccttgttctcgttctttttggtttcctcttgggattcccattcactgtatttgtctcggccttcttaggtcacagttacaagtcaagacaagttgactgcgaaaatcaaccaagggctgttcatgtgtcctccactttcgagtttggagttgtgtttcatgattgcctaagtgcggaccctcaaggcaatcctccattctcaccctttttcggagccccatga

SEQ ID NO: 64964 - DNA, 591 bp, Glycine max
  Peptide Sequence Number=SeqID_156649
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggacgacgagctgcgttccattctggagcgtgtggaaagcgagaaggacagtgaaacgttcaggctagtctgcaagcaatggctccaggtgcagagcacggaaaggaagaagctcgccgcatgtgcgggtcctcacatgctctga

SEQ ID NO: 64965 - DNA, 228 bp, Glycine max
  Peptide Sequence Number=SeqID_156650
atgactctaagacaacatggaataagctccttcttccatggcttattccctagtggatggcgcctcctctcacctcttctcttttgtcttccgctgcatctccatggtggaaaatcaccattaaaggacctcattgaagctcaaagatccagcctccatagaagccccacaagcaagcttcaatcacttcaaggggaagatgagtcaagtacaagctcaccaccataa

SEQ ID NO: 64966 - DNA, 606 bp, Glycine max
  Peptide Sequence Number=SeqID_156651
atggctaagtatgaccctgagatagtcatggagttctatgcaaacacctggctcactaaagaaagagtcatggataaacgctcctgggtacggggccaatggatcccctatgatgaagatgctatcaaccaattcctgggacatgcattggtcctagaaaaggggcagcattgtgaatacactaaaagaagaagccaggtcttaggttttgatgaagaggccataggccagcaattgtgcttcccaggacaggattttgcgcggagcgtgactggaaggcgggtgcggatcatgcgcactagtatgaccactttgacccaaatttggatgacgcttctgctcagcaacatccttcctagtgaccataattttgatctcctgttgcctgaatgccagttgcttatctcggatgtcatctaccagtttgtaggtattgcacctccaagacacccagtggacccagagaagttcaacagggcactaggatttccagcgttgatcacaggcctctgccagttctacaaggtatcagtctcacccacaaagctcatctggccccctattaacagggccttcattgagaagtaccgcatgcccagatgttag

SEQ ID NO: 64967 - DNA, 608 bp, Glycine max
  Peptide Sequence Number=SeqID_156652
atggcattaaagaagagaaaggaacctgccataccttcccaagtccaatatgaccgatccaggctcacttctcctgaggcctgggaaaggtacacagatattgtggtaaccaggaaggtactccctgagcggaatgtggtaatctaccacattgagtttgatgagttcaaggaagaactggagcgaagaaaatgggataaggagttgactagttttgatgaaggcagcattgatgttgccattgtgaaagagttttatgctaacctctacgatctcgaggataaatcacctaagcaagtgagggtgagaggccatttggtgaagtttgatgcagacactctgaacactttcttgaagacccttgtgataattgaggagggagaagagcttcctgcctactccaggtttgcactcttgaggcttgatcctcaagagttggctgccaagctctgcatcctagggaggggatttgagcttaatgctgatggtcagcctttgaagatcctcaggaagaacatgaccacgctcgctcagacttggagtgttctttcttactccaacttggtccctacctcccacacttccgacatcacactggatcgagccaa

SEQ ID NO: 64968 - DNA, 528 bp, Glycine max
  Peptide Sequence Number=SeqID_156653
atgtcagccagtgatcatgccattctatgcggcagaacccatcaacccacaaagaaaagcttgttagaactatcatcacatgacgctttattggcacaaaataagttacaggttgtaccacctgtggtgaggctcatgaaacagaccgatgtattcccattgaagaaaacactcaagaaattcattatatgggaaatcaacaacgacaagggtatactcaaggaggattttcaggcttctagcagggtccttataatcaacaaggacagtggaggtcacacactggcaatcagttcaacaaagaccaaggtaacaatgtcaaatcataaaagcattgagtcagcactgaagaaccttgaggttcaggtgggacaactagccaagcagatagctgacaagtcatccaacaattttgtggaaaatacagaaaagaatcccaacgaggaatgcgaagctgtgatgacaaggaataagaggcttgtggaggctgaggatgaggagtgttgtgcacaagaagaaagctgctga

SEQ ID NO: 64969 - DNA, 714 bp, Glycine max
  Peptide Sequence Number=SeqID_156654
atgaccggtttccttcggtttttcagacgttttccacaaataaacgttggtggcgactccgcgcattttcctcctttggaaaacgcacccgtgagcctcgcctcgctcgcccgcaaaagggcatgttgcgacaccatgaatcagaaatttgcacttgttgcaagacaatctggagtcaatgagcaacctgaagcttatgctgccaacacttataatagaccccctcagcagcaaaaccaacaacaacagaataattatgatctttcaagcaacagatacaatccaggttggagaaatcatctaaatctgagatgggcaagtcctccacaacaacaacaacctgtccctcttttccagaatgttgctggtccaagcaagccatatgttcctcctccaatacagcaacaacaacaacaacagtcacaacaaagacaacaagcaactgaggctcctcctcaaccttccttagaagaattagtgaggcaaatgaccatccagaatatgaaatttcagcaagagacaagagcctccattcagagtctgacaaatcagatggggcagatggctactcagttgaaccaagctcagtcccaaaattctaacaaattgccttcacaaactgtgcaaattcgaaaaaacgggagtgccatcaccttgtggtcaggcaaccaaattcaagttgctccaacagtagcagcacctgcacctgaacct

SEQ ID NO: 64970 - DNA, 150 bp, Glycine max
  Peptide Sequence Number=SeqID_156655
atgcactggatgtccaccatcattttaggaagtttcaggaataactgggaagcgtattttaatgatcctagaccattggagccagagagattaaaggccatacagatccagtgggcacaatattatctccgaattagagctaagagctag

SEQ ID NO: 64971 - DNA, 444 bp, Glycine max
  Peptide Sequence Number=SeqID_156656
atgggtcgtcgtcccttgcctagctctggaaaaatggaaagcgccgctgcaaggcagcctatgggttcgagtgagcaacattctgcccagtgtgtctttaaaggatcgcgcccacaagacacgcagtggacccggagaagcccaacaaggccctggggtttccagctctggttacgggcctctgtcactcctatagggtgcccgtcccccccagcaaggtcatgccatcgtgacatagggatcgcgcctgcaagactgctagtggacccggagaagtccaatagggtcttagggtttccaactctgattacgggcctctgtcagttctacagagtgcttgtcgcccccaacaaggtcatcaggcccctattaacagggctttcatcgagaagtactgcgcccccaggtaggtgtagggcaaggcatcacgacaacgggcaatag

SEQ ID NO: 64972 - DNA, 723 bp, Glycine max
  Peptide Sequence Number=SeqID_156657
ggtgacgttgtggagactctacagtatatggtgtcaccacaagggaggaacacatggacagttgatgatctcgcgccttatgtggataagttagcgattatatcagaagagcaagagagaatcactgagccagtgtcacatggtccagcatcagagcgtgaatttccagcacaagagtttcacattcttcagtcaagtgttgaaactcggggcataggcagacgaagggagcttgttgaagcagaacaatattcccaacaaatgatggagcgtggtcatggaatgtattacatgccagcaacattttccgaatatccttcacagatgtatcagtatccttttgaaggtcatcacactgatacttctgcgagcgaacattcgttcggtggtgttgcggaaacacaagctcatttttcatggcccactatgactccttcgcagcagcacgatgcccccatggcaacacctaacaccccatttgctccgcaatggaatgtacccggagcaatacctgatatgggcgacttattaggtgttgatttgcgtcaggagttttctgctgaggctgagcaagcagaagcggggagacaacacggcagaagaaatcctgatcgtcaagcgcgaagatgggatcgaccatgggctagggttttcgggggtttaagggttagtgttttggattatgggttagggttagcttttagggttagggttaaggcttag

SEQ ID NO: 64973 - DNA, 456 bp, Glycine max
  Peptide Sequence Number=SeqID_156658
atgggtcaacttcaacggcaagcctttcgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatctttttctctgggttctatccctccacgacaaagagttgccaagtgtcctctttccgaatatggaagggttagtggacctagcagtgattgacgctttcctcgcctttcatcatggcaaggaaagcccggtcgtcgccattttggccatgtatgacacgttcgaccggggatgtgaaaaagagcagcgcaagaattgtttgttgtgcaccaactcttggctagcatggaggggcgtctgttaa

SEQ ID NO: 64974 - DNA, 738 bp, Glycine max
  Peptide Sequence Number=SeqID_156659
atgtccatcctccgtggtaaacagccacggcttggtgctgccgtcaacgcgctcgtacagaatcgcccgatgctgcagcaactcactctcgctggtcggtctgcctgcgcgcgccagatagtccggcgcggcgcaaaacaccatacgctcgcggcccatcggccggtagccgagcgaggcgggcagatctggcgaaccgccgatgcgcaccgcgacatcaataccctcatcaaacagatcaataaagcggtcagaaaaggtcaggctgagttccacatccggatgctgctgacagaacggaatcagcagcggcatcacgccgagccggccataggtattcggcactgccagccgcaatcgcccggaaggaatggtgcgctgcgccgccagcactgcttcggcttccgccagctcctccataatgcgcaggcaggtctgataataggcgctgccggcgtcggtgagcgtcaggctgcgggtggtgcgctccagcaggcgagagccgagccgcgcttccagccgcgtcacgcttttgctgatggcggaaccggtcaggtgcagacgctcagcggcagcggcaaaactgccgctttcaacactggcgacaaaaggaacgatgtctttcagacgctgatcgtgcataggagattcgacatgcaaaaacaggcgttaatcgtggggatcagcggggttatcggtcgtgcgctggcggaaaggctgcaaagcgagggctggcag

SEQ ID NO: 64975 - DNA, 150 bp, Glycine max
  Peptide Sequence Number=SeqID_156660
atgaagttggaaaaatcaagaggggagcatggattggaacgtagagagcataatagaggcacaaaacagagcaaggaagccaaaaacctcagctttcaagaggatctttggttaataactgaaaggtgttgccttgtgatggaaggctaa

SEQ ID NO: 64976 - DNA, 234 bp, Glycine max
  Peptide Sequence Number=SeqID_156661
atggcggtagcaacacctgataaggcagttgatgtgcatcatcttcgacatgcagtggatggttatgtagcaattgctggcaagttggagaggctactgaacttgaggatcctgactgaagaaacagaagcctatattgttgctgaagaatgtctgggcatcgcaagaagctacattaggcaaccaactgtaggtcacagatcgaggcataggcggcgtacagacgggcattga

SEQ ID NO: 64977 - DNA, 491 bp, Glycine max
  Peptide Sequence Number=SeqID_156662
atgtggaaatcttgcataaagaggttgaaaaagtatcagatgagtgctctaatgaagagcatgatcttattcgttggaggtcggccatgctcatcccaaaacaccctaaccgactacaagaagaagaatggccatgctgcctccaaagttcaaattttgagttgcccgctcaatgagaacagttgtgctcttcaacaacatgatcatgctcttgtctacgtcactaggcatagtgtgagagctttattgaactggggagcatgtgagaaggattatgaaggctttgaagtgcttgcagctggtgtctcgctaagcgaggcttgtgcgcttagcaagaatcatgcactaagcgaggcactcagcctgcttagcgagttgggagaatctggaggagaatctaagaagcatttgcatgctcagcacgtcatcagctcgctcagcgaggtgtttgtctcttcccgttctaagtgcgcccagctcgctcagcagat

SEQ ID NO: 64978 - DNA, 258 bp, Glycine max
  Peptide Sequence Number=SeqID_156663
atgttgcctggactggcaggggtgccaatgttgaagattacaaagttctccttgagaatgactgcccaggaaagagaaattggaacaactccttgttgtgatgaggcaaatgtgaagagaggaccatggtcaacagaagatgactccaagctgaaggagtacatcaataagtatggcatcagaggcaattggattggtctacctctgaaagctgtagagagcctgaatcaaatgaggcatttgaggggtgttcactag

SEQ ID NO: 64979 - DNA, 132 bp, Glycine max
  Peptide Sequence Number=SeqID_156664
atgacggtgatgacgatgagtgtgacggcgaagacaaccgtgacgattgatggcagtgacaacaactggttgaggaggataatcgcagcgatgagagtggttagtgtagctccagctgatcctgatttttga

SEQ ID NO: 64980 - DNA, 525 bp, Glycine max
  Peptide Sequence Number=SeqID_156665
atggagcatgcaactggtgaaatagatagggagctgatgcttcccttcctcttcaatacgccggtgctagtgactggtgaggtccctactaagccgcatgcattgcccgggtttaggatcaagttgtacttggtagacgaccagggctcaaatttgagacacttcgtccatagtcatgaattgagtgccttcagcagttatgagacatctgatggtgaagctcctggagagcttaccttgaccaaaggtggtcatcaagtccacgtaccctttggtctctgctctctcacctacaaagccgaggaatggaccggagtgaggatggacggtgttggtttagacctcgagtctctagaaggttttctagtacaggatatcaattggattgctcttattgatgagggccttggacattatgaagttcgcaatgatgatggagacaaccatagggtcgtccttgttgacagggttgatgcccttgaagtccctgtccgtgaaggtgataggagggagacttcgctataa

SEQ ID NO: 64981 - DNA, 132 bp, Glycine max
  Peptide Sequence Number=SeqID_156666
atgaagttctcttctctccgattcaccagtgtgaaaggtgaagaagcaaggcttgtaatggagatatgtgagagtgcattgttgacaactgcttgtgggaagaacaaagtaactaagtctcaagctaattag

SEQ ID NO: 64982 - DNA, 318 bp, Glycine max
  Peptide Sequence Number=SeqID_156667
atgacggaagggtgtggtgaagggttttgccttgcaaaccttcccgtttgcggggctgcttggtttagccattgcttaagtttttccatgtgcccggtggtcggttttggcccgtggctaggtcttggcaagccgttggttgaaattttgccccccggtcaaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaa

SEQ ID NO: 64983 - DNA, 57 bp, Glycine max
  Peptide Sequence Number=SeqID_156668
atggctactgagacttctgcatctgatcatgcttctactattgatgagaggacctag

SEQ ID NO: 64984 - DNA, 894 bp, Glycine max
  Peptide Sequence Number=SeqID_156669
atgagtgatggattttgcggtactcatttgcagatcatggttaggaccagaggattaggtcgtgccttaggtcaggtcactcgcagaggtgtgggcagaggagatcatgatgattccggtgatgctccacagcgtcgacgacctactacatccgcacggaggcagcgagtcgttgtgactgcggatcacgtcgatgagccagtcattcctgacccagacgttcaggatgacccgatggaggcaccagctactgtggaggacattcctgcgggcgcaggcgcagaggcggctgaggatcagcctcagggattttcgggtggtccgagcgacccatctgtgctgacagcgtatgcggatcacgttgcttgcagcgagcgtcctgaattgaagttatcctcgcatgggaggaaggtccatagtttaggcaggcctatccttgccattgagggacttatcgttggtacaggactaagtcctctgatcgcgtgttcggtagacaccgacgatcagggacttttgtctgcatttgtggagcggtggcaccgggagacgtctagtttccatctcccggtgggtgagctcaccatcacattggacgacgtctcctctcttctccatcttcccgttataggcaattttcacgcatttgagcccttgcacgtggatgatgcggttcagatgctggtggacttgttgatggtgtctccagagtctgctagggctaagatagtccagtgtcgcggaccgtacgtacgcctgcaatgggtacgtgaagtatatcagcgccgatgccagacagttcattggacagctgcggctcgtgcatatcttcttcacctgttgggttgcactctgtttgctaacaagagtgcaaccaatgtccatgttgtctag

SEQ ID NO: 64985 - DNA, 537 bp, Glycine max
  Peptide Sequence Number=SeqID_156670
atgagattagacaagagctttcattcaattattgctgatgtcagaggatacgaaaagtttcctagtagtgagagagatgctaggaactatattgctaagaaaagacatgcaattgacaaaggtggtgatggtaaggtagttaaaggctatttagctaggatgatccaatataaggtcatgaacacttgtgcgtctaaagtcctgttaaaacctcaaagaggaaatacaactttgtttatcaccgatatgacaaaggttaatgtttctctcccaagaacaataaagtgggatgaaataactcttcccaaaaaatgggttatggataaggcaacactgtctgttcctcgacccgctccaaccatagaacaaattaagcaagataactctggcaaggtagaaataacctttaataggagaaattctttttcatcaagaatagaagcctctaagtctgaatatgagtcagccagaaggtctttttcggttagaacccgttcaattccagtaggactaaccagatctgaatcacacaactag

SEQ ID NO: 64986 - DNA, 267 bp, Glycine max
  Peptide Sequence Number=SeqID_156671
atggttggagcattctcgcaatatagtgtgaccctgactgatctccctataattttacctagtgaccgtcacgagctgtcgttgcttgtcgtcagaccactgcaaggagaagaacagtttaatcaaagtagaattctcaaaactcaactcgaggatttggtagagaatagagcctccaatccttccttcacggtttcttcaaggctctacgtttggatgaacagccgtgaacctaagagatctcagaacaacgccgcaagaaactaa

SEQ ID NO: 64987 - DNA, 579 bp, Glycine max
  Peptide Sequence Number=SeqID_156672
atgagaaaagatacgccactaaaggaacattttgatgagctaaactctattctgatggagttatgcgacattgatttcaagatggaagacaaagatctaacaatgattctgttagcctctcttcctcactcctatgagaattttgtgagttctcttagtgtaggcaaaggctccattacccttgaagaggcatctgggaatggtgatgaagcctctatgtccggattattggtgactaattctactaaggcaaaggtggtaagaagagcaaagctggtcctaaggacatttgaaattactacaacaaaccagaaatcacttgattgtcatcatcaaaaagggggagaatgtgaatgtatgatgattttgatgatgccaaagaagaatcaaacaaggccacttcaaaggataagcatttgcttcaagattgcttcaaaaaacaaagccttgtttcaagattcactaaagatcaagccttgcctcaaaacaaagggtttcaaagtcatgcaaggctctggtaatcgattaccaggaagtgtaatcgattaccagaagggaaggttgaaaaagagctattga

SEQ ID NO: 64988 - DNA, 369 bp, Glycine max
  Peptide Sequence Number=SeqID_156673
atgaaagataaatggaatgtgcatgaattgcacaatgtgttagttcaggaagaaacgaggcttaagaatcaaggaagtcactcggttcattatgtaagccaccaagggaatcaaggagttgaaaagaaatttataaagaagcatggtaaaggaaaacacccattaaagatcaatgacgactctttgctaatccataaaaagggattccttacaatccaaaccataagcccaaatgagaagtttgtcttcatgagaaatagagtgaaagcttcagtagaagtagtcgggacttatcgtttaaaactcgacactggacatcatttagatttaatggaaacttttatgtacctagtttatctaggaatttaa

SEQ ID NO: 64989 - DNA, 177 bp, Glycine max
  Peptide Sequence Number=SeqID_156674
atgcaaatgattgacgaagtggcccttcatatcaaaattggtcacaatgtctatatcaaagtttcaatacatcctggcataatccaaattgaagctttacccggtctgtttgttgtcaaacaaccactgcataatgaaccaatgcaatgcatgcagtccatatgtatgaattgttaa

SEQ ID NO: 64990 - DNA, 405 bp, Glycine max
  Peptide Sequence Number=SeqID_156675
atggcaatgatgactggtggtaaatacttgatagacactgctaccaagttcatttttgatgaagaagctaaggctaacttgtaccatgtgcttgagtttgatcaacaaaatacatttttcttagtggaagaatcctttcatccttcggagtggcttttgccaaaaaaaaaatacgatgtagaccttgcaaaacaatgtttggttgtgcatgaggaatcagatattgaagcattcgacgacgaagatgtatttgatgatagtgataatgattgcagtgaaaaagacaataaagtgtttgaagcatgtaatcagaacacaagacacagagttgcttgcttgagctgcattccttggtggcagacaaaagaagtggacaaaacagaagcatgtgcatgcattctgtaa

SEQ ID NO: 64991 - DNA, 426 bp, Glycine max
  Peptide Sequence Number=SeqID_156676
atgaagggcaagtatattgttcaaagcttgttaaagaacttagaaaaaatcaagaacaagcttgttcgcacattgttcgcgtgtatgacatccactccacaagcttgtggttacgtgagcctgaactactaccaatatatagatgttgtttatacaaatgagcacatcttaaaagcttactccccacaatggtggcctcttgggaatgaagcggctattcctccttctaatgacgcatggacacttatccctgacccaactacaattcgtgcgaaaggtcggccaaaatcaacaaggataaggaatgagatggattgggtcgaaccatctgaccaccgaaaaaaatgcagtagatgtggagccgaagggcataacaggcgtcgctgtccaatgcaatctgagcgtgggagttgttcaaatcattga

SEQ ID NO: 64992 - DNA, 993 bp, Glycine max
  Peptide Sequence Number=SeqID_156677
atggttagaactagaggtttaggtcgtgttttagatagagttataggaaaagccttggggagagaagataatcatgattttgataaagtttcccagcggcgaaggcccacagcatctgcacataggcaatgtgaagctatcgctattgctgaggatgctcctcacgtggctgacgcagctgaagaggtcttccaacaacttgaagaagtagttgttgatgcccaaggttttccaggcaggctacacaacacattagttctgactgtctatgctgatcatgaacgtcctgaattgaagttatcctcccatggaaggaaggttcagaaattcgggaggcctactgctgaaattgaagggttagtagctgccacaggattaacgatcgaggacttatatcggcttttgtggagaggtgacataaggaaactagcagtaggagaggtcaccatcactctcgatgaagtggcctctttgcttcatttgcccatcataggcacattccccagcttcgagactcttcatgtcgacaaagcagtgttgatgttagtggagttacttgaagtcagtggagatgaagccagagctaagataatgaaatttgtgcagtgttggatttataagcagtttccatctattgttgtggcttttacggatgaagactacgatgaaaggtcaccacgtgcctatcgttggacctctacgaaggcattaccaacgtcgacatattgcaagcatctagatcgattgataactactgataagattcctccatattctccgggttcaagattatgcttggaagatattgacgacagatggatgcatttctcttactaccttgcaccaatgggaaatatttatgttgtgcctggacaatgtgcaccagactacatggactggttctacatgatttctcatccattcttgaggctgacacaacccgaggatccacccagacatccacctgtcgtgcaagatgagacatatgtctaa

SEQ ID NO: 64993 - DNA, 384 bp, Glycine max
  Peptide Sequence Number=SeqID_156678
atggtcaaccacaaggaggaaagcacaaaatttttgctctgggaccgcgaatgcactgagctgattggacaatcaacaaatgaagagggtgatgttgatttaaatgtttctcctcaagcccttgataagttgttgagttatgtccttgcatttaaagtcaaagttcaacccaagtttaacaatgttgttgttcttagatactcaaatgacatagatttgatcaatgctgtggtggacatgttgcctgatgctgaggcaatttccaaggttcatggtcctatttttgattccgataatcctccgatgatccttcccaacttgaatctaatcttatttaaaaactccatcgcctctaattccaaatttagtttattgatcagttag

SEQ ID NO: 64994 - DNA, 498 bp, Glycine max
  Peptide Sequence Number=SeqID_156679
atgtgtttagggttttgcatttcttcatcgggttcactttttggcccagcggagtgtcttttcaatggaccttgggtcgtgcttttttttgctgggcgggtccggggtcggggtcggggcagatacaataatcccatacccgtactcttacccgacctttggacatcgggaaaaacccaaacccgaacccatacccggtcaactcggatattacccatcaaagtcgggacagattcgggcgggtacccacggactagatcatggcaccttagaaagaaaggatacactattggaaggcttatatgggtcctaccaacgacaggagaattgttttatttgaggatgatgcttattggatgcaaaggagcaacttcatttgaggatattagaactgttacaaatattcaataccctacatatagagaagcatgctttgccatggggtttttacaagatgacagagaattcattgaagcaatcaaagaggtaaaggactag

SEQ ID NO: 64995 - DNA, 1008 bp, Glycine max
  Peptide Sequence Number=SeqID_156680
atgttgcttcaagaagttggtgttgttgtgtcagtgttacttggttttgcacctccttccaccttttttgctgccagctcatccaaggttcttgaaatcattcatgatgttttgtttttgctggaagttaatggaatcaacgctcatggaaaaattgtccaggataatccaatgttcggaaattcattttggagtacaaatttagataaagttgccattgaatttccagatgaaactgatgtttctgtggtttctttggatgagcaactggaagactggactgacaaagaaattagtgatttttcatctttgataggtgggtcatatgctcctgatgcccttgagccattaaatggagtgcttaccattccattgacaaatggtgcctcagtgaatctccatatgtcaaagaaagcagaaaggaagtttatcgtaggtcttatgtctctcacacataatgtccaaagcgcaattcaaatgcatggcaatttatcacagagtgcaaagggtcctgctgagttgttaacaggatgctttaatggctttaagggatgcaaatccagaggtattaaactttgtgggccacttgctgcaacaggaatgattgctgcatggacctctaaatgccttcctaattatcaaagagagaagtatgatgcatggacctctagtcatagtgagcagaatgctgaacattctacatcggttattaggacaatcgatgttgaatgcttcattgtggacgggtctaaagatcaacccgtcttagaatgggtagacttctacatcggttgtcctaataaccgatgtagaatgtcaaaattccacagcggtcgctcaaccgttgtagtaagacaatggactttcaacatcgccggaacctattgcaccctccattgccttaatggtgcattgcctgttgaggaagcacttggtttttatgtaaggtatgttcaatcccttttgtataatgcaaaaccttggggaggtgatagtcccatcccgtaa

SEQ ID NO: 64996 - DNA, 594 bp, Glycine max
  Peptide Sequence Number=SeqID_156681
atggcatcgttggtgacccatttttgcctattctcttcctcattcctctaccttcacaacccctctcacttccactccaaactttggtacttctccgacccaaagtggaagacccttgatctctacgctctgcttatcgcccaccccatcttctcctttgccaagttttccctcttcttctccttctctggccactaccccacttacaaattctccttcttccaccaaccaatgacgcttttggccttctggtattttgtgatgagaaaaagggtttcaagtcttgttggctctgtgtatggtttcttgggagggttgactctgggcacttggttgttgcaggtgggattttctttgtacactgatgtttttgggttgaaggggtgtggaaagatcacttttttggggaaggagagtgttgatgtgcagtgtgatcttaatgaggatattttgaggggtgttgctttgatgcattttttgttcattgtgcatgccattggggtgatggttttggctattggggggcctttgttggttgaggtggaatctgctagctcacggatgctggcacttgcggatctggagatggggtga

SEQ ID NO: 64997 - DNA, 411 bp, Glycine max
  Peptide Sequence Number=SeqID_156682
atggctacttcactttcagcaactgggtgtgttggaacttccttctatggaagttggggcacttcaattgttggggaggattacaccatgctggccaagtcagtgccatcacaagttcgtatggggaggggaaagccagtgagattgcagcctatgatgaagaatgtcaatgaagggaaaggtatctttgcacctcttgtggtgatcactcgcaacatcgttggcaagaagcgtttcaaccagcttagaggcaaagcaattgctttacactcccagaggttggtgtctacaatgtctgaaaaaggttcaagaacaagaaacccagcgggtgcagcagcgggaaaagatggaggggagttcaaaaagggaacctggaaagtgaacatatggaggaagctttttgatggatag

SEQ ID NO: 64998 - DNA, 135 bp, Glycine max
  Peptide Sequence Number=SeqID_156683
atggaagggagactagcggaatggagaaggaagagagagaggagacaccacttcaaggataagatgggtctagaagaagctcaccaccataggaggccatggataagagctttggaggaagaaggagatgaatga

SEQ ID NO: 64999 - DNA, 157 bp, Glycine max
  Peptide Sequence Number=SeqID_156684
atggggaagggtgttgcccttgctcctacgtatcctcaggcaaatggtcactttggggcagttgcagctggcctaggcaagctgaaacttagtgctgaagcaatgagcttgcccaggcgagctggtttcttcaccatgaagctatttggtggctcag

SEQ ID NO: 65000 - DNA, 213 bp, Glycine max
  Peptide Sequence Number=SeqID_156685
atgaggtcctttaatggtgattttccaccatggagaagaggtgagaggaggcaccatccactagggaataagccatggaagaaggagcttcaccaccaagatcagccttggataagaagcttggaaggatgcttcaatggaggaaaagaaagagggagagaaagagagatgggggagcacgaaattgaaggaataaaagagggagagaagtga

SEQ ID NO: 65001 - DNA, 192 bp, Glycine max
  Peptide Sequence Number=SeqID_156686
atgactcatgagaatcctagggccttctcttgcatctctggtccaatcttcttggagtcttctatccaatgcccttgggggctctccatgagtagcaattgctgttacagccaccaagaattctctttcaccgaaaatttttggataattgagccagttagaaaacttcgtcaagtcatcatgaacctctaa

SEQ ID NO: 65002 - DNA, 579 bp, Glycine max
  Peptide Sequence Number=SeqID_156687
atggaagatgttccctctttggatctcatgactggctccttcgtcgttttgagagctcttccaaaccttacaagcgtcttattgttattggaaaatggttatcaattgctttttctcagtgctcgttcaatttctcaagcctatattacacgacaattcttacttaaccttaaacaggatggaaaagttttaccagatggtccttttgttatttcccctgatggactttttccctctctagatcgagaagctaataagagggttccacatgaattcaaaattgcatgcttagaggacatcaaggcacattttcctttttatagcagtccattctatgttggttttggtaatagggatacggatgaaataagctaccttaaggttggaattcccctaggaaaaattttcactattaatcccaagggagaggtggttataaaccaccatgttgacacaaaatcatatacttctctgcatgctcttgtgaatggaatgttcccccctacgagctcttctgagcaggaggactttaattcatggaatttctggaaactaccccctcctgccatagatatttga

SEQ ID NO: 65003 - DNA, 270 bp, Glycine max
  Peptide Sequence Number=SeqID_156688
atggcagtgaaggaacaaatgatgagaagattcagtgaaagagtggcagaggctacacctggaggccaaaacgcaaccccttttggagaattggtcattcatgggcattcgctgaaacagataaggaaaggaggctgtaatgaggaaggggaattagcaaaatctcaaagatgggacaatccaagcaccagtgttagagtgcctctgaacattagcgttcttgaattcgaagaggaagctcacaaattgcaaagttctctgtggtcttaa

SEQ ID NO: 65004 - DNA, 222 bp, Glycine max
  Peptide Sequence Number=SeqID_156689
atggataccctccaacaaatggtagcagacatacttaataatgcccaagtggtgaaggatgaaggcccagaggtagaggcactactaagaatattaattgttgcagtggacaatgttggacccaagcaacacaaaatggatgggcagaacagaattgagggagtaaaactcaatgtacctcctttcaagagcaggagtgatccagatgcctaccttgattaa

SEQ ID NO: 65005 - DNA, 711 bp, Glycine max
  Peptide Sequence Number=SeqID_156690
atgacaagacgtaccaagacgatccttaagcctaggtggagagctagggaagtcaaattcaaatatgaaaggcttgaagccttctgctactattgtggtcttcttggccataatgatgacagctgcaagaaactttttcccatgcaactagatgatggttttcgagcatggggtctagatatttgggcggataccagaaactctggtggtcttgacggcttgaagtggctatgcgaggaaggagccaccataaaccatggtcatgtgccttacaacttcagtcttgatagctcaacaaagaatgttaagaacataacaaaccataataatcatggggcaatcatagaggaggaccaaaaaaggaatgatttgcttttgttggtttctaaaaatccatgccttttattccctcaattagctaaatcaggaaataatgtccccattaatgacaatgatgagattcaacaaatcaatggcgacaacatggataccgacctgattgtgacggacaaaaagagaaagcatgacagggaaggaaactggcaccaccagcttcggtcagagttccaccattgccagccacacttcaccaacaataaccgcaacctcgaagcattttttattgacagagcttggcagccaggcctaccaaaagccatgagtctgttagcatggaattgtcggggtctaggcaacccccagagatggtag

SEQ ID NO: 65006 - DNA, 339 bp, Glycine max
  Peptide Sequence Number=SeqID_156691
atgtgcacaggctgcatcaacagcatctgtgcaaaagaccacaagaagaagaagaagaaacagaaagaagaagcagaatgcaaagaaggtgagggtttcagagtgaggctcagaaacgcctttactcaggcaagagacagaagagaagagcctcaccatagctgcatcatcagcatctgtataaaggaccatgctggtcttgacaaacagaaactgcattacctagccaggactaaggctcttactcaatgtccattatctgatctaaacgctgaaaacatcatcactgcctcctttctgtgtactatccaggacaaaaacaaagtgggtcaaacataa

SEQ ID NO: 65007 - DNA, 918 bp, Glycine max
  Peptide Sequence Number=SeqID_156692
atggaagatgccaatacctgtggaggagaagaagggaaccaaatttcaaagcgcgaaagaagaagcttgttatctaatacacagaagacgaaggaagaagacgaacctttttggaaggagaagaacgaaaccaaggaagaagaagcttgcggggaggttgctgggaagttcattcaattgctgggtgcacctagcaacagtcctacaatcgagggcgttgcactttggctgagggtgatgttggatctagacaggggtggggtgagtgtggtggtgttggaggatggggtgggatcacacaacaatgttagaggatggggatggagtcgagcttggaaggaggtgagtgtctcgagcctagctaggttgaggtctgatcataacccaattctagtcaaatttgacaccaaaatgaggaatgtgagaaggaaagaaagattgtacagatttcaacagatgtggcaaaatgaaagtgaatgtgatgatgtcgtatctcactcatgcaagaaaggaggaaatctgattgctaatattgatcgaattggagccaaccttgagatgaaagcctctcagaggaggaagatcaacactattgattacctaaaggatgatgaaggtgtcctttatgatgatgaggaggagatagcagatgtattgactgcttgtttgatggatgactttaaatcagagaaagtggtggttgccctcaaacagatgcaccccaccaaaggcccgagcccaaatggaactcctgctcttttctataagcattcctgggagattgtaggtaggtccaaaactcaaatcttgaaggttgtccgtgtgtggaagaagctgaaaggttggaaggagagggttctctctaaagctggaagagaagtgttgattaagtatgtgatgagattcctagttacgtga

SEQ ID NO: 65008 - DNA, 939 bp, Glycine max
  Peptide Sequence Number=SeqID_156693
atgagtaagacccataccctacaatccagacttgctaacaatatttctcatatcgatctctctctgcagcagtacaaacttcagagggacgccgtgaactcattcattggatggcccagacatctagtgaaacctttatcttatgattctgaccttaatgtgcggaagccagttgaacatagtagtgatgcaaagcttgcaggtgaatccgatccattgggagagttgatgaagatattgttttatgtgtaccagaatccagtggaagtgccgtgggaggcgaaccaatttggacttcctgagattggggcaaaattttacatcacacatgcagatctagcagaaataatatcaggtgacaagtgtttaaacatagcgatactacaattgtggaccatatttatgaatgagtgcggtagaagcaaagctgatcagtcactatatggtttgctggagcctcaatctatacaaaatgctaaggaaagacgtcaacaatgccaacaatacattgaaacatgggtcaaggaatcacaaaggcagttgtatttaggagcttacttgaatcaggcacattggcaactatttgttctccacccaagggaaaacacgatcgtttggttttgttctctgaggaagaagcctgatattaacatcaaaggcgcaattaacagtgcaatgaagacaataaccagttcttttgaaggcatgtctaatcaagttgcacctcggtgggttgaacccaagactaatgtacaaagtggagggtttgagtgcggatattatgtcatgcactggatgtggtgcatcgtgactgccggtttgaaagatgactggcacaagtggttctctgatggttcatcgttagacgtggaggccatcacatcagttagacaaaaatgggcaacttactttttatcttttaggaaaagcagttgctaa

SEQ ID NO: 65009 - DNA, 150 bp, Glycine max
  Peptide Sequence Number=SeqID_156694
atgaggaaagatattaatattagaacatgggcactattggcagacatagagagcagcttgaaggccaaggaagcggttaacaaaacgagtagtgtaaaccttagtaacatcgactattggaaagttttgtggagtggaccaagaacctaa

SEQ ID NO: 65010 - DNA, 1089 bp, Glycine max
  Peptide Sequence Number=SeqID_156695
atgaatggaagtggatccaattcaagtggtggagatacaactatgggtggctcttcttcggttgctagaagtaaatacaaaaatgcccctgggaacaagactgatattgggtggaaacatgggattgatgttggtggcaatggtaagaaagtcaaatgcaagtattgttcaaagattgtgagtggtggagttttcatattcaagcgccatcttgctgggactagagaatattctaagtcttgtgctacggtgctggatgagatcaaattgttgatgatgaaaattgttgctgaatctaaagcagcaaaagaaaagaaaaatagattgaatagtattgatgaagatgaagaaagtgctgagggggcgaaggcaaccaactttgtcattccattcaatgctattaaaaatcctgcatttttaaagatgtgtgaaatgatcgggaaatatggacttggctataaaactctgtcttgtcatgatgttagagagaagatgttgaaacaagcagtgcagaaaactgatgatagtttgcaagagtttagggatgagtggaagagaactaatacttctaacatctcaaaaacaactgacaaagtttttaagatgttagatgacattgtcacatttgttggagaagagaatgtagttcagttgattactgataatgacttggagaaacatttgaaggttcatgaagttactataaagcagggaagaaagataaccacttatatatatggtagaacaatgcttatcggcatgctcaagaagtacacaaatgggaggaacttggttagacctgatatggaatctgatgatgagtggataacagaagagggagatgagattttttatgaagataatctccgagttgagcaaaagcaacctttaggggaaagaggtagtggaagtaatattgacttggttggaggaagtttaaccgacccaactttggatgcatttgatattgacaatttggtattgaatgacaatgtggaagatcacttctcaactgaggaaaagcttgaagatgatggtggcggtggtgatattggagatgattttattagaggattgatggacatttaa

SEQ ID NO: 65011 - DNA, 288 bp, Glycine max
  Peptide Sequence Number=SeqID_156696
atgagaaagtattctgacattcaattgaggctaatggagagacccatacttcaacctgaagtaactataaccgatttgatgaacatgaggcaaatggttcatgaatcaacaatagacttcatagaaaggtttagaaaggctggaagtcgttgctcagtgaaattgccggaagtagaatgtgcagttatggcaactggaattatgcatcctgaattaaaaaagacattggtggctcaggagtatggtgaccttagccaattagtgtctaaagctaatcgaatagaatag

SEQ ID NO: 65012 - DNA, 120 bp, Glycine max
  Peptide Sequence Number=SeqID_156697
atggcagtttgttgctacactgttggagttgttgttgttgtggtccgagcttgtttccattgggataagaactgcatggctaaagagacaacaactattcgagctcaagtgtctacgtga

SEQ ID NO: 65013 - DNA, 897 bp, Glycine max
  Peptide Sequence Number=SeqID_156698
atggatgattttagtaaggatgaggatcaacggttctttgatcacatcaatcaccaaagcgataatgagggtgttggtggaccaacatcacctccattgcaatatcaccaacctaggtgtccagtggacttgaaccttgaccacctaccacactacattgatcgacaccatttcattcaacaacaacataatatacaaccaccaactggtgcactcgagtttggcatggccttcgatgaaaaagcacaatgtattcgagcagtcaaagaatacaacatcataaatcattttgattgcaaaacaatatattctaaccaaaaaaggctaaactttgagtgtgaatcacatgaaaatggttgtacatggagcctagagatcaaaccattcatgaattataccccatcctacaaaaagacatggttagcaagagcgttggagataattcatagaaactgggaagaatcatatgccaagctgccaaaacttttgggagctttgcaatcttgtgttcccgggactgtgatcgctgctcaaacagaatccgtgtgtttgaagggggagaaatcgtatcgggcaaaagaatgcttaaaggtgtcttttggtcatttggcccatagtacaagtagatggtactttacgggaaatagaaacccctcgattataagtgcctacaacaacccaagtaacttatgggttcaggacacatcccatttcttctacctacgccacattgcacaaaattttcttcgcggttacgtatacacggagaagatgcactgtcgacatatcttagggatattcgtgcgaataagacaagtgcagttgaatgactggatcagttacccaaaaaaaattgggtacaatgcttcgatgtggggaaacgttggagacatatga

SEQ ID NO: 65014 - DNA, 603 bp, Glycine max
  Peptide Sequence Number=SeqID_156699
atgtggagcatgcaaaattgcaaccttatgatcatagggattgtcaatccatacagtgtgtatagattgtcaatccttattgtggaggatgttacgaatgtggacaatgctgccgatgagcctcatgaggagcctcaagatcctattaaggaggatgaacgtattgagttgaagttggcctttcatgggaggaagatggagaaatttggaaggcatgcacctgagattaaagacataagaggtggcacaaggaaactagaagtttccatctacccatctcgatggcttcagttttctcaataccttgctctggttgaagagttttgtagttttcatggtcagtgtgcagcaggctacatggagtggttttatatgatatctcacccattcatgagttcgccacagcttggggagcctcctagacctccacccatgtccactagcgaaaagatagcagaaagcttgcaacacatgataaatatgaggatggtcactgctagaacttatgcatacactataattgagcactatttaacattagtcagggttgtcactgagcaagaaaatgtttatgtttgcttaagacgaaggagggatacataa

SEQ ID NO: 65015 - DNA, 408 bp, Glycine max
  Peptide Sequence Number=SeqID_156700
atggacaaccaatatttacaaaataaaaattctaagaatctcactaacgaccaagggttcattgacaagttgaaagaatcaacaaaacaacaaaaaaaagagaagaaagaaggggaggaagagagaaggaaagaaaaagaaaagagaaagaaagaaaggaatgagatgaaaggaatgagaggatacctgaatgtcctttcccctttcctagctatagtgtcaaacaatgcgatggatgacagtcaactcatagaagaaggatacacatatgcagaggacggagacacattcacagaagaaggaggagacacgttcgcaaaagaaggaggagacatgcataaggttgattttgacaagttggagagtgtgttgtgtcttctgaaaaccacctgttgcatttgccattga

SEQ ID NO: 65016 - DNA, 765 bp, Glycine max
  Peptide Sequence Number=SeqID_156701
atgacaacaaaatcaattggacataaaaacattggtggacttgagaacccaacaaaaaatgatcatttgggacaagaaactgaacaagttaatattgtgatgaatttgtgtggtttagtgatgaaatttgtggtagacatttgcagatcatggcctacagcatcggcacgtaggcaacaggaagctgcccctgttgccgaggatgagcctatggtcactgaagatgagcctgtggtcactacagatgagcctgtggtagctgtagacgtacatgcacctggtgcagacgctgctgatgatgtagacggttttctaggtgggccacgtgacccatcagtgcttacggagtatgctgaccatgttgtagttagggtatggaacgaagaggaccgtcttgaattgaagttatcctcccatgggaggaaggtgcaaaaatttgataggcctgctcttgagattgaggacctagttgctgccacaggactaagtcatttgatcgcgtgttcagtagacactggcgatcggagacttatatcctcgtttatggagaggtggcacagggagactagcagtttcctttttaccgtgggggaggttagtatcaccctggatgatgtggcgtctcttcttcatcttcccattgttggtgccttccatacattccagcctctgcacatcgacgaggcggtgttgatgttggttgagttactagaggtctctggagaggaagccagggccgagatagcacattgtcatggaccatac

SEQ ID NO: 65017 - DNA, 507 bp, Glycine max
  Peptide Sequence Number=SeqID_156702
atgttgcagtcagcgtatggaaccgagaggcctgctcctgaaattgagggcctagttgctgccacaggactaagtcctttgatcacgtgttcagtagacactggcaattggggacttatatctgcattcgtggagaggtggcacagggaaactagcagtttccatcttcctgtgggggaggttagcatcaccctagatgatgtggcgtctctgcttcatcttctcattgttggcgccttccatacatttgagcctctccatgtcgatgaggccgtgttgatgttggttgagttactagaggtctccggagaggtagccagagctgagacagcacagtgtcatggaccatattgtaggatatatgagcactttccgtcacttgtggagtgtatggctgatccggactatgatgaggtgtcaccacgtctatgtcggtggattgctatgaaggcgattgcgaaagttcatatccacagtgacatacaggcagcgtctgcatcgacttag

SEQ ID NO: 65018 - DNA, 528 bp, Glycine max
  Peptide Sequence Number=SeqID_156703
attcaagggactaaccgcctaagaattctttgtcttaacacattggagcgtacatcctttgtggtacaagtagaacgtacatctacttggattgttatactgaaacaagagagggtacatctcttgtggatcagttcaagtggagtgtacatccacttggttgttcaaagagaacaagggagggtacatcccttgtggatctttgcttgtaaaggattttacaaggttattggaaatctcaagaaccgatgtctgagaccacttgatccaacacgtatccctcaggtcccagagccagcaacaacatcgacacatgcccattcttatgtggagcagcccagacatgcagtggaggcttgccatgcgattgctgaaaggttggagtgtcatctcaaccttaggatagtcaaggcaggcacagagacacacgaggtcatggaagaatgcattaggattgccaggggtgtcacagaagactgcattgtgtatgcgaggtctcgacgtaggcggcgcacagatgaggcatag

SEQ ID NO: 65019 - DNA, 753 bp, Glycine max
  Peptide Sequence Number=SeqID_156704
atgagaaccacgcatggtcttccttgtgcttgtgagctatctaaatatgttgttggttgcatcccactggattcaatccatatgttctggaagagacttagttttttagaccaagggttatctgagcccgaagtgaccatcaaggaagagatggaaaccatatctaaaagatttgaagaacttgatctttgggaaattgcataccatgatcaaaattcgatgtgtcctcctccaacaaaggttaacataaaagtgaggcgtagtacatcatcttctgagaagcccaatccaagaaggatcatgcctatgttggatcaatttcagccatttatccatgacttcattgataacattgttgatgtcaaacttgatggaaactgtggatatcggttggttgccgatttatcaagtatgggtgaagactcttggttgttggtgactatggataagtggatggatataaccgacatgggatatgtcattgcatcaaggtataatgtaacttttgtatccttgtctcaacaacaaagcatgacgttctttcctcttagaactcagccaccgccagattcttcaatgcatcgcataatttgtatcgatcatgtgtataacaatcatttcgttcagcattgttatggtctagcaattgtcatcctcaggcgaagcagtggccaactccaaatattagtagaatgcagcattatagaagcttcacgatgttcaaaagagactgttgacataaatgatgactga

SEQ ID NO: 65020 - DNA, 261 bp, Glycine max
  Peptide Sequence Number=SeqID_156705
atgttgaatatgttggtgtggttcaatgtttactttttggtgaacaagttcaagcaattgtgtaaaggttatgcccttgttgaccatgaaagtttttgtattgttactaatgaaggtggtgccttcattagtgttacagatttggctgttgtagtaaacacaaatatatacagttgggtgacacattgtggtagaggtgttcattgtgcagtcacatgcattggtaaatggcatgtgagtctgtctagtacatggccttga

SEQ ID NO: 65021 - DNA, 540 bp, Glycine max
  Peptide Sequence Number=SeqID_156706
atgtctcttgcaactctttttgggaaacttcaagaacatcaaatggaacttatgagactcaatcaacatgaagaaaatgacaagaaaaagaaaggaattgcacttaaagcctcatcttcaattcaagaagaaagtgacaaaaaggacttgaatgaaatagaagaaggagaagattcatcttctattccaaagtgttatgaatgtaatcaacctggacatctgagagtttattgtcctagtttcaagaaaagaagggaaaaatctgacaggaaaaccctcaatgataagaaagcaaagaaagcttacatcacttgggaagataacggtatggattcatcaagtgattcagaaaatgaaatcataaatctgggcctcatggccaaagactatgaaagcgaaaaagagacgccacttcaaggagaagatgactcaagaacaagctcaccaccatatgaagccacggataagagcttaaaggtaggagaagataagtggagggagatagagaaaaggggaggacaaaatttatgcctcaaatga

SEQ ID NO: 65022 - DNA, 456 bp, Glycine max
  Peptide Sequence Number=SeqID_156707
atgggggcccattgtcgtgagacaccgaccaaagagggtcatgcaacaattcggatacgttcagagtattcctgcagaggctacaggttcaggttgtcatttgaaaaattgacgacaggtggatgcactactcagactatcttgcaccagcagggcagatttgtgttgtgccaggacaatgacacatatgtggagccacatatccctgaggtcccagtggcaccatcagcagcactggcacatgccccttctgatgtggagcagcctagacatgcagtggaggcttgccaagcgatcgctgaaaggttgaagtgtttgctcaacctaaggatagtcacgacaggcacaaaaatacacgaggtcatggaagactgcatcaggatcgctaggggtgtcacaccagatggcaatgtctatgtgaggttgcgacgaaggcgacgcacggatcaactatag

SEQ ID NO: 65023 - DNA, 651 bp, Glycine max
  Peptide Sequence Number=SeqID_156708
atgcgttatgctaaaatttctggacaggtttttgtaaggaaattagattacataaactctatagtgtgtgcttgtgctccaagactaattgaggaggagatgtttgggattggcaacttatgttggatctctacaaaggcaacattagaagcttcaaagcgtgcagagtttttaattatgcaaacaggcatgacttcttttgggaaagcatattacaaaaactatagtggccttgtgcccaatagttttgtacagcttgcaatgaagcttgaagcacttcgagatgagtatatgcgttatgctacagagaagtgctcatatatgctaaaagagtaccatttggctgttgagacaatcacaggtctggggcaaatcaaagttgaggagatttgggacatttataggggtgctccttgtgtagctcagcccataatacaaggaagtgccacattggctgaaccatcagggaaagctggagttgctgcacatgatgtccaacgttatgtcaaggaatcagattgggctgcacaatgcacaaggcaagataaaatgtcaaatgaagaattgaagctgcaggatccacgatgtcggatacaatgtcctgacatcctgcccgaaaatactggacacataaatctgttatatctttaa

SEQ ID NO: 65024 - DNA, 264 bp, Glycine max
  Peptide Sequence Number=SeqID_156709
atgggtggacgaacttctacagaggttaaggttaatgcataccttattgaggtaactaggaggtggccccatgtctttggagatttcatggatatgttcgtccttgagcttgtgcgtgtaatttttactgttgatgacttccttgttagagcaattgtagtggataacataagtgttctcatcagaaaggttgatgttgacattgatttgctggagtgtgtcattggtgggggtgggggtcacaggcgaggaagtgtggcgtga

SEQ ID NO: 65025 - DNA, 906 bp, Glycine max
  Peptide Sequence Number=SeqID_156710
atggctaacgatttctccttttctacaaatggtttgaatggctctagttccgaaaaagatcctcctgacggtggaggggtggtggaaaagttgaacatgattgagtacaagaatgggaatcctttaaatccaatgattcacattgttgattgggtttatgaaggtctgtgtgccccatggcaagatgctttggtgatcaagcttttggggaggaatttagggtttcaaatcctacatgagagactgacacggttatggaagttatttgctggttttgaaatgcttgatatctataatggcaccgccacccgtctcctcctcctccaccacccctccgccctcctccactactgggagctcgaccccgccatcatccaggtcgcccgcgagtacttcaacctcgcctgcctcgagagggactaccaagaccgcctcttcatctacgttgacgacgccctcaacaccaccgtccccaacggcttctccgggggagggaggatcatggtgaacgttggagggagctgcgtggaggcagagaataggctcagagatgggaaggttgttatggaagagactctcggagcgatgaaggaggttttcggaaagaaggtttttgttctgagtcttgggaatcgtaaggatgatagctcacttactctcactggggatttgcctcaccttgaggaatggaagaaactccttcctggtcccttcaaatgttatgctaacatagtaaattcatttttggcaacaaaattttacgaggttagtggtgattgtgttggtggcactgataacagatgtgactgtggagtttatgctaaggagacgtgctctgtggaaatgagtcgaacgatatcgcacacttgggtattctacaagattggtttggcatcaactggttga

SEQ ID NO: 65026 - DNA, 465 bp, Glycine max
  Peptide Sequence Number=SeqID_156711
atggtttctatattgtacagtgttcagctaggtcaagtacccggcatgcccctggtatttggccatgccgaatacctggacattgctatcaccttgtccttccaagttggatcatgctggtatcaggtattcagccacgccaaatacacgagcatttccgtcctatcctttaatacttattttcctcttatactagtagcaggtgctcagtcatgtcaaatgcccgagtaccatatttattacacatggaacctaaaacatagtgttcaggtaagactattgttgattcccatttattacccttattattgctctcaattgagaccttacttgagcattgacgtgcattttgcagagaagaggatggttgctaccaaatcaatgatggaggcacaacaagcagttcaacaactgacaactgaacaggatccaaaggttagaactccctccccacatctcaactaa

SEQ ID NO: 65027 - DNA, 839 bp, Glycine max
  Peptide Sequence Number=SeqID_156712
gtacgacctcgatcagtagttttgttccccatggtcgtgaagacatactcaatattgtcattgggcgatcagagcatccaggtcgtgtttgtgtagcggggtctagtatcacaatcagtcaatactatggaagggcatcacgtggctccaatagttcctctacatcaatcactcaacaacagttggctgagataattggaagccttaaggaagagtggaggaatgagattatcggaaacctcaaggaagaagtcgggaatgagattgaagaagaaaacaagcagagtttagagaaaatgaaacaggagttgaaggatgccatcaaaattgattttttccaaagaggatcacagtactcaccattgattgaggtagatatacagacattaggtgcacgtgtcagcataaaagggagcaatgttgaaactgttgtgaacccattagatgaagaacatgatggtcatgtcataccgactatggggttatatgtgcaacgtgaaaattgtacacacttggtggccttgggaaaaatatatgagggggggtctagcattcatagagtggcttatgccaatgatgtggattcacatattagtccaaagaaactgtttgaacctgttcaaaggctgaataatgtttctacaggtttaggatgtagaagcaaatgtctttggtgttttgatgatgatcatgatgatttgatgcaaatgatgcaaatgggcttttcaagtttaaattcaagacagagattcaagaatacacgtcacaacatcaagatgatcactagtattttaggaagggaattcctaattgatttagcaaaaggtttggccaagtaa

SEQ ID NO: 65028 - DNA, 1344 bp, Glycine max
  Peptide Sequence Number=SeqID_156713
atggttaggaccagaggattaggttgtgccttaggtcatgttactggcagagtacctataactactgcggacgatgaaccagtggtccctgcgacaaaggctgacggagcttcgattgtggctaaggtatatgtggatgagccaatggcaggaggtgacgtacaggacactggagcagacactcttgcagacgcaagcgcacaggctgctgaggatgagcctgagagatttttgggtggtctgagcgacccatctgtgttgaccgagtatgtagatcacgttacaggcagcgtatggacagaagaggagcgtcctgagttaaagttatcctctcacgggaggaaggtgcacagtttaggcaggcctatccttgccattgaggggctagttgctgggacaggactaagtcctctgatcgagacttctagtttccatctccctgtgggagaggtgacgatcacgctagacgatgtcgcgtctcttctgcatctgcccgctgccaaggctgagacagggcagtgtcatggaccgtatgtacgcatgcaatgggtaggtgatatctatgagtatcgataccaggcaggacattggacaactgcagctcacgcgtttcttcttcatcttctgggttgcactcttttcgctaacaagagtgcaacccatgttcatgttgtgtttttggaggcccttcgtgacctcggtcagactgggagccgacagcttggtggttacatcacgctattgcagtgctggatatacaagcactttcccttagtggcggagtccactgctgatccgaactacgcgcctagaccgaccctagatttcggatttttgttggatcccatatggggagcaccaactggtccgggacttccatatgatttcatgctattctggtctgctatgttgggggcccattgctgtgtattatcgaccagagagggtcatgcgacagtttggatacacccagaccattcctgctccgcccgccgattcatggtgtgcaacgactacagggactggttcttctgcatttcgcatccattcatgacaccaggccagccatcagatcctcaggcagatggtcatgctacacaacccagagttgcccctcaagatccaggcacagatgtccgtccggtcacggagccagcagcactatcaacatcggtttcgacatctgcaatcgatgtcgacgagccgagacatgcagtggaagcttgctatgcgattgcagagaggttggagtgccatctcaacctaggggtgatcacaccaggcacattgacacatgaggcggcgcacggatcagtcgtagtttatttacacattttatattga

SEQ ID NO: 65029 - DNA, 633 bp, Glycine max
  Peptide Sequence Number=SeqID_156714
atgtcgcttttacaaagaaactgtcatgagtggatctttattatcttgtggttccaggtagtctcgcactttattcctttcctctcttctccttgtgtctgttcctctcctcgagtatttttcgtttcaacttttcattcccttgcattcgttccactcttctccttgcatccttccactccgctgcgtccccttttcgaatctgatccaccactccacagagaaagagtgacattggatcacgctctgctagcgttgagaaaaagagcaaaagagagggaatcagatgatgtggtgcgcagggacttgttgtcctactcgagaagcggtgagatggtttcggttcggtcggaggccatggacatcatcccaagttctcgtcagcaaagccactcctctggctcgacttttcaacagggaaacattgattccttagaggagaatgatggatattgttcgaagaaagttgatggtttggacagagcaacaactttatctgatggtgagatttgtggtggttcaaattccaaggttaacaaagatgtagggaaactggacacagaggttcttgtcaaggatacaccttccactgggaatggttcttctctcaagagcaaatatgtaagggtctga

SEQ ID NO: 65030 - DNA, 648 bp, Glycine max
  Peptide Sequence Number=SeqID_156715
atgcaggcgattccggctccatgcccgcaagtattttccgctatggccgaagaatttatgaatggctttgttcatcaaaacggcatcgctgtcataacccacaatcccctaaaggcgattccggctccacgcccgcaagttgctgaggacgagtttttaccgcaacacattcacctcaagcgattccgactccatgcccgcaagttgctgaggacgagtttttaccgcaacacattcacctcagtatttttcgctatggccgaagaatttgtgaatggctttgttcatcaaaacggcatcgctgtcataacccataatccccccaaaggtgatggggagaaaaagaccaaaatttggataatattggctgttgtggtggggctgatctgccttggaatccatatatttctggtatggaggtttaagagaaaacctaaagcaatttcatcagcttttggttataacaacaatatcgaaacttgcttttcatcgtggcatgaaactttcttttcatcgaatagccgcaaaggaaaggagacacgtgacatgaacgatgaaccacacacacaccgcgttctcctattgccattgggtcggtggtcaacttttcattcttactctaaggaatattgcatcttcctattatag

SEQ ID NO: 65031 - DNA, 528 bp, Glycine max
  Peptide Sequence Number=SeqID_156716
atggaagaacatgatttatccctgtcttcaaatacatgttctatctctggttcgaccccactagaaacttccacgcttattctatcatttggaagcgccagcacatcatgtagacctatgttttggaaaataaagaagcacggatctacggaagatttctcaagccttccttacatttgcacattgcttaattgctccttatggacttactatggaatcataaaggctagagagtacctcgtggctactgtcgatggctttggcattgtggtggagacaatctatgttattctatttctcatatatgctccaaaagggataaggggtagaactctcattttggctgtgattttggatgtggcaatttcggcagtagcagtagttactactcaattagcattgcaaagagaagctcatggtggtgttgttggtgttatgggagcaggcttaaacattgttatgtatttctcacctctctctgccatggtgcttaaattagtctttaagtttgaaaacaaggtcgaatga

SEQ ID NO: 65032 - DNA, 630 bp, Glycine max
  Peptide Sequence Number=SeqID_156717
atggcagaatcctcgaagaaaagaaagggatcctcctccaccactactgctgcaggccaatgccgccacggcacatccggtgactcaccaacaccaaatcctccttccttttcatctcccgagtcattaactctgttttcttcttatgaccagcatcaaagtcatgatgcttgtaaaatggtctacaatgaccatgctgatatgaccggtagattgcttgctgggtcattcaccattaagtgtcgcatcatgcattatgtcctttgtcgagttctgcttcccaagtccaccaatcttgctcaagtctctgaggaggattcaatcttgttatgggcttttcaaaccggtcgtcaaattgactgggcccatcttgttaggtaccgagtgcataaggcattatgggccaatgcacctcttctgtatcctcatcttgttaccttgtttcttcagcatttcaatgttcctttaaaggatgaaccttttgttaaggttaaaagatcttttgctattggtgttggtgctgttacttctttcggataccgaaaaaatatggatggtcaatgggtgcataagcaagacctaccacctctcattcccaatgaatgcacaccgtctccaccaccgcaatga

SEQ ID NO: 65033 - DNA, 231 bp, Glycine max
  Peptide Sequence Number=SeqID_156718
atgcatctacatgatcaaggaagcctcctttacaacaaagagaagaacaagatgaaagattgcaaaaatacaagtggtgaggatgtctccttcacctctaggatctcacaaccactcacaaactcatctcaagctctcaaaacagcttcctcttcaagctctggtctctgcagatcttcacaaagcaaaatctctcaaaactctctagaactaggacctttctctctctag

SEQ ID NO: 65034 - DNA, 1613 bp, Glycine max
  Peptide Sequence Number=SeqID_156719
atggaagatgtttatggcaatgttgagaaaactcatagatttagcaccaccttcaatactatgtatattctaatagctacagtgtttgcttcattgaaggtgaggattcataagttcctagaaaagactagaagtcacccgagtaaaccgaggctggtgatcaagacatgttttgatgctccttccttggagcattgcatctgtaacctgcctaagagaggatcactcaccgtcatcactgtaggaggtgtgggggaatcttttgtggcagttgtactcaacaaagaatggttttacgtggacaaggtgattcgcctgcctgggaaaggaagcttgaaatcagcacctagagatgaaaatgaagttttgaaccacattcttggtcaagccagtgacaaagttcccagcagacaaagatcatttggcatttcatcttcttcgataaaggacgatcttacttccgaacttagagagctgggatggtctgatatggatctacataatgaagacaaaaagtcatcaaacttgagtttagagggtgaattctcatcaccgattggagaagcctttacaaaaactggtgaacaaaaggacaacaagattgacaagtcccaagttgttgctctgaaaaaaaaaaatgctctaatgctgaagcgcaaggctatcagcattaattgtagcatgaataatgataaagaattatcaaatatgcacgatcatagggatggttttgattttgaacaccttttggccattgttgatgaccttcatggtaattttgaagtgaccgatgaggatatgatggaccccgcaatagctagtaatgtcgaagaagcaatgaaattcttgaaaaaggcaaagttattagaaaggggtcttaacaactctggacctgaagattataatactatgtcacaaaaatccactgttgtaaggaaaggtgtgagttttgaaattgctggtactagatcagactccattcaactagataagagaaatactagtgccactaataatgttgcttccagagtcgcaccaaaaagcagattgatgattcaaagagagcttttgagtttgaaaaagaaggctctcacattgagaagggaaggaaaaatgaatgaagcagaaaaagaaatgcaaaagggtgcagctcttgaatgtcaactgatggagatggacaaggctatgaatgaaggaagcgaagatgacgtaacagatcaagatatgtctgatccaacacatctttcactccttagggacttgggttggaatgatgacaataatgatgtttctaattctctaagcaagcctttgaagaaatatgatgatcattttgtgccattcaatgatgcttccttaagtaaacattctacaaatatcttggttcaagcgccaagaagtaaagctgaaattcagaaggaacttttaggtttaaagagaaaggcccttgctttcagacgtgaagggaaagttgaagatgttgaggaagttcttaaaatggccaaagcatcagaagcccaaatagtagagatggacactgcaaagagtaaagcacgggttgagattgttgtcatgaaagacagacttttcaatcctctagttgatgaagaaag

SEQ ID NO: 65035 - DNA, 984 bp, Glycine max
  Peptide Sequence Number=SeqID_156720
atggcctccaaaaagagaaaatcatccatctccagacctcaagagccatatgacacgactagattcatttccgaggtcgcctgggaacggtatgagcaaaacatgcattccagaaacatcctccttgagaggaatgttgatttgtatgtgacccagtatgatgagttccgtaaggagctcgagaggcagagatggcataaaaccttgaccatgcagcctgatggtcacatagatgtggccctagtcaaggagttttatgctaatttatacaatccagaggacaagtcccctcgacagtgcagagtgaggggcaagcttataaagtttgacgcagagaagttgaatgcattcgaggagatccccgtgtttttggagccaggggtgcgctactccacatactccaggtttttccgcacgcacccggatcctcaggagctcactgccagactctgtattccagggcatggttttgttttgaatgctaaagaaaacccgaatgatcccacgatcacttttctgggtactcacaagactcgggctcggggagcttctaacgcctccacctctgctccaacttctacttcagcaccagctcctactcctgcacctccacaaatcacagcaccctccagcccctccgctcagagctcagacgttctggtgtcaatgctgcagagcctccaccacagcttatgcctggtgatgcaaagtatccacgacctagctcaacatcggcccatccttagcatggaggactttatggcccaggtggcctggccaggagtccaaccttctcctacggggggaggtgaggctcctatagcccaagagccacacctagagttggaggacacaccagatgagacaccagaagacattcttgctgccacgcctttggaggccacagaggaaggagatggtgctacagacactgattatgctgcaaagcagcgcaaagcacctgggacccttggcccactctag

SEQ ID NO: 65036 - DNA, 264 bp, Glycine max
  Peptide Sequence Number=SeqID_156721
atggattatgcactatggaattggcaaacaagcaggggacaagattgtcaggagtttaagggaagagagattgcaaactcagatttatactggttcggtcacacccttgtgcctacgtccagtccccaagcaacccgcttgagagttccactatcttgtaaaagcctattacaagatctgaaccacacaaggacaacccttcctttgtgttcagatttctttacaacaagagaccctcggtctcttaatcctttttcagaataa

SEQ ID NO: 65037 - DNA, 570 bp, Glycine max
  Peptide Sequence Number=SeqID_156722
atgacattgagactatccccctcattcaaaggaaaactaattgctcctcaacatgaaggagtatcattaatgtctagaaggatactcagaggtatggtatcaggttcacttatattgttgttcatggtccattggtgtaaatcttcccggtatttaccccttcaatttcccaacactcctgaagaactacttgagtccaagtttattgttgaagataaccagtatgactcctcctatggagaggaaactgacttacacctccttatagattgtggagtggtgcaacaaatttggaagcctgctcagagacattctgtacttcctagcagatggcatattttgtttggtgctactatttggagtatttggaaagggaggaattcgaaagtttttaagaataatgagaaactacacttggaagaatgtgggttggattgccctactaatggtatgctcaagttaaatgtggacgggtcgattatccaaggaggtagaaagggttgcgcttatgggcatcctgatagggctgagattggcttgggaaaagggtttcaggaatgtttggttgga

SEQ ID NO: 65038 - DNA, 1662 bp, Glycine max
  Peptide Sequence Number=SeqID_156723
atgctggcaaccaagagaacaaggaaatacaataggcagacttatatgggtcccaccttcaactggcgaattgttttacctcagaatgatgttttcctctgcataagggaagcatgctttgcaaaaggatttctaggtagtgatcaagaatttattggcgctttacgaaaggctaatagctggggcattgcacactacctcagaaaattatttgtcaagcttttatttacaaacaccatggacataccagaatacgtctggcaacaaacatggcaatggagggggcagatgatattaaattcaatcatagaaaacaaggtgtttagcttactgaaaaggaaacaatccatctatgctggactgaaattgaaaatttgttgcaagccaacagaaaaagcctacgagattttccttccatatgagcaaaagtctattgttgataccattatacgtgtggttgacactcaatcaccaggagtttacttcctgtatggatatggtggaactggcaagatgtttgtctggagaacattatcatttgctatatgctccaatggtggtattgtttgtacagttgcttcgagtgggattgcatcattactattacctggtggtagaacaacacattctaaatttgctataccagtgcctgcaacacagaattcaacatgcaatattcatcaaggtagtgacttggctgaattattgaaaattacaaaacagatagtctgggataaagctccaatgtgtcacaaattcacttttgaggcactcgataaaagccttaaggacatcatgcacaacaacctaccttttggaggaaaagttattgttttcggcggtgatttccgtcaaatactacctattgttccaagagctgatgatggatgttctgaaatcaccatcccagataagttccttataaaggactatactgatcctatccaagctattgttgaagcaacatatcccaacttgatacataactatagcaacacaaattacttgcaaaaaagagttgttcttgcctctaaaaaagatattgttgaaaaaataaatgattatgtcttatcactggtacccaatgaccaaaaggagtattgtagtgcagatagtgttgataaatcagatgaactactcaatcctgctttcggattactgacacctgaatttctaaactcattgcaaacatcaggaatacctaatcataaattaaaacttaaggttggtactccaattatgttggtacggaatttggaccaagctgatggattgtgcaatggaactaggcttattgttaccaaacttggttctaatgtagttgagacagaggtcattactggacctaatacaggagatagaacatacatacccagaatgaatatgtctccatctgattctctatggccatttaaacttattaggagacaatttccatttatattttcttatgctatgactataaacaagtctcagggtccatcattagaacatgtgggattgtatttgccgcacccgatttttagccatggccaattatatgttgccctttcaagagttaagagcaaaaaaggactacatattcttattcatgacaatcaaggtattccaaaaaatcttaccactaatgttgtatacaaagaagtgtttgccaacttatga

SEQ ID NO: 65039 - DNA, 198 bp, Glycine max
  Peptide Sequence Number=SeqID_156724
atgaagatcgcacaaacacctttacaccaacacgtcacacaaggaaatgactatcgattaccaagaaaatttcatgatgcaatccttcctacgaagggaccagtcactagagccatgagcaagaggctccaacaggattgggctagaactgttgaagaaggccttaggatactcatgaacctcagggtagatttctaa

SEQ ID NO: 65040 - DNA, 507 bp, Glycine max
  Peptide Sequence Number=SeqID_156725
atgagggggactgagtttggctccatcttaggaaggatagattccctactaaaaggaaatccaagcttagtcctagaggttatggaccttttcaggtcttggagagaatcaataacaatggctataggttggacatccaagaagagtggagctgatactgaggtggaggaaccaacagatttgaggtcaaatcctcttcaagggggaggggatgatgcaatcctccctaggaagggaccagtcactggtgccatgagcaagaggttccaagaggattgggctagagctgctaaagaaggccctatggttctcatgaaccttagggtttatagggtaccctacaaattaaggcttcctcctaagcttcttatccaaggcactttcttggaggtgaagcttctccttccatggcttattctccagcggatggcgcctcctatcacctcttctcctttatctttcactgcaactccatggctaaaaatcactattgaaggaccttattga

SEQ ID NO: 65041 - DNA, 330 bp, Glycine max
  Peptide Sequence Number=SeqID_156726
atggactacctcactcctaccttgggggaagccaataccattcccgatctacctgagggagtcacatttgactttaagcatgggttcttacaaatgctagagaataacctgttcagtggcgttgcccataaagatcctaggcagcacctaaggaagttcatcaagttgacctacatagtgagacgaaaccaagtaccaacagagtacattagactctatgttttcctttctctctcaatgggaagacatgggatcgactgtgctcactacctgagaacagtatcactacatggaactagtgcacaagtgtcttcttacaaaggtatataa

SEQ ID NO: 65042 - DNA, 399 bp, Glycine max
  Peptide Sequence Number=SeqID_156727
atgggaggaagattaagttctctgattacatgttcgctggacactggtgatagggaactttcatatgcttttgcaaagaggtggcacaaggaaactagtagtttccatctacctgttggagaggtgactataaccctcgatgatgtggcatcattgttacatcttcccattacaagtgccttccataccttcgatgctcttgacgtacaccaagtcgtggagttgttagttgagatgcttgaagttagtacacaagaagcaaaagatgagactgagcaatgcagaggggcggttggatctacgagcatttccctacaattgtttccattgttgctgataaggattaccatgaaagaaaaccacgtgcttgttgatggaagtctgggaaggcattactag

SEQ ID NO: 65043 - DNA, 1546 bp, Glycine max
  Peptide Sequence Number=SeqID_156728
tgttagggctttgaagggtttttccattttcttcaatggccacgccctttcccattcccgtcaccgcagctcaggttcttcttcttcctctcttcttgttggaacgtacttcgtaggacagtactatcaggtgcttcagagccaacccgagttcgtgcaccagttttactccgatgctagcaccatgctccgtatcgacggcaacgccagagaaactgcagcggcaatgctttgtgctgttgttgtgttgagtgaaacgagtgatgtggtcgttcgcgtcgggggcaaattggtttccaaatacgcatgggatttgtgtggcggtgtcgtttacgctagaattgaaatcaagactgcacagtctctagaatcttggagtggtggtgttcttgtgatggtttctggatctgtgcaagttaaggactacagccggaggaggaaatttatgcagacattcttccttgctccccaagagaaaggcttttttgtgctcaatgatatttttcactttgttgaagaggatccagttcaccaacaacaaccagtcttgttacctcagagcaatcttgattcaaaattgaatgcttcaagtgcaaccaataaacctgtgtccaactacctgctgggtggagatatccaagctagggactacgttgctacaaatgaggtcaaagaaaatggtgtagttgataattatggattttcagagcaaagaatgcagcgggcccctgatactgagcatattagggaggataatactgttgaagagtcaaatggttcacttcaatcttcagtgaatgcagtgcaagaccatgtacctgtttctcctgatgaacctgctggggagccacaaaagcacacttatgcttccattttacgggttgctaaaggactatctacgccagtagcgtctcagccttctcataagaatgtgtccccttcagaatgggatcatgctccacatagtagtagtcagcaacagcaaacgattgcttctgcaaatgcatttgaaaggtctgaaacggatgcagtggaggagtttcctgcaacagaagatgaagatgaaatcaagtctgtttatgtgagaaacttgtcacctgcagtgtctccttctgaaattgaagacgaattcaagaattttggtagaatcaggcctgatggtgttgttgttagaagtcgcaaggatgtcggtgtttgttatgcatttgttgaatttgaagatatgactggcgttcataatgcagtcaaggcaggatctgttcaaatagcaggaagacaagtatacattgaagaacgaagaccaaacagtaacatcccttctcgaggaggaagacggggtagaggcagaggtagctatcagtcagatgcaccaagagggcgtttcaattcaaggaactttggcaggggaaatggccaagatggcggtgatagggattataacaaatcgaaaggaaatggtttctatcgaccaagtccccaccaagagaggggacattcagggcatcatcaagtaccgagaaatgggcagaatcttgctgagtcctga

SEQ ID NO: 65044 - DNA, 774 bp, Glycine max
  Peptide Sequence Number=SeqID_156729
atggcagattttcgtcctccgtattcgatatcaaatcttcctccagatgcaataccagaacttgcatgttacaattcaacagtggatctttccgacaatatctggaagcgtggtaatgtcattggagaagctgttcctcttttgtctattcaaattgcctacattgtcctgctttctagtatttttcatcgcatcttcaagccatttcacctgcctcttatggtttcccagatacttaatgacatcgttctaagatcaagcaagaaggctataaccattgctcttgtttgcattctcattccaatgttggcgggtgctagttttcttgctctagagcatagagtatcaggaggttcaccaaaccctactgtttccactaaggtccttgctaggctcctatcagggctcaagatcctctacagaaggcttggcaaagatgccttaactgcaaccatgttaattgatgcatatgggtggattatgttcacaatcttgattccttattcccatgatggcggaaaaccactcctctcagcaatatgcacctttttgttcattgtgttttgcttctgcgtggttcatcccaccctgactcgggtgatcgaacgcaaaatcaggttggagacatgggactcctcaagtttgctggatgttatgattggactttttatttgttcatggatcatagatttgcttggcgcacaccatgttgttggggcctttgtgtatggactaattttgactagtgggaaatttgttgttggaaacctttga

SEQ ID NO: 65045 - DNA, 300 bp, Glycine max
  Peptide Sequence Number=SeqID_156730
atgaggcgggcgttgaggtcgggtgacgggaggaagtggaagaaagttaggcaggagagaggggggggagggtggggggatcaaggagtggtggagtttggaataggggttgttgaggagggtaaggattatggtgtgggcgagttggaggtgttgtggggttggaggagggaaggaggtgaatttgctgaggattctcgagagggtcttccggggatgggaacacattggttttctttctctttacagaagagaaaaggtggtggaaaaataatgggaaaaagggttcaagaattttag

SEQ ID NO: 65046 - DNA, 354 bp, Glycine max
  Peptide Sequence Number=SeqID_156731
atgtcagataggcacattcgtgccagaattggaggatgccaaggacaaaatcatgaagctcttagaagattaagtccttcagactcgttcagatctcgagagagtgtaaacgacagaccgtattgtgttagagtttgtggtcttagttcctttgtcccacatcgcttagtctgtaaaacttgtgtggtcttagtcccacatcgcttgtttagaggaggcagtgggagcaatggcattagaagaggggaaggtgaagatcgagaagttcgatggcagagatttcagcttttggaagatgcagatagaggattatctatatcagaagaagctgtatcagcccttatcaggggttaa

SEQ ID NO: 65047 - DNA, 459 bp, Glycine max
  Peptide Sequence Number=SeqID_156732
atgcggacctttgttgaccaaattgagatgcttaacactcatcgccgcataatccataaagtttcgctacatttcggaaggaaatcagccaaaaaacacaaaatgaggggtgaactcagtttaggggggaccttagtgaagctcaaagatccagcctcagtagaagcttctcaagcaagcttccatcaggaatgtgaagtgatacttacaagaagcaaaattacagagggccttgttggtgatgagttaatggagggtgtagtagaagataagttgaagatcaccattccttttggtgaaactcttcaacatatgccaatgtacacaaagttcttaaaagacctcctcaccaagaaaggaaaatacatcaacaatgagagcatagtagtggaagacaattgtagtgttgtgattcaaaaaaatttgcctaacaaacattcaaagcccccggaagtgtga

SEQ ID NO: 65048 - DNA, 324 bp, Glycine max
  Peptide Sequence Number=SeqID_156733
atgaggcttaacctttatgagtcatccaaacaatacaagcagaagatgaaagcttaccatgataaagaagcttgtgaggaagagtttccagccaaaccaacaagttctgttattcaactcaaggctcaaattgtttcatggcaagatcaaagcagcttttacaaaacacttatgtccctttctcttcttctgacgcacaagaatcctaacagagcaactggaggaggagctctagagagcaccagagacgccacaattgctaatggagaacgatcgagggactacatcgaggtaagggatgagttattcacgcttggggattag

SEQ ID NO: 65049 - DNA, 144 bp, Glycine max
  Peptide Sequence Number=SeqID_156734
atgtatgagaaagaagggggtagcgtgaagtggagaggagggggagggaggaaggagaaggaagaagaacatggaagggaggagaagaagaaagttggcttcactgaggtctgcaaaccccatattctccttcagcctccttaa

SEQ ID NO: 65050 - DNA, 242 bp, Glycine max
  Peptide Sequence Number=SeqID_156735
atggagctcacaactgaccaaaacggtgctgcttaccaacactcacttcccgttcccgaggacaaagttcttgtccctgtcgaggtaaccctaaaaccttcaagcacaactaaaatcgacgatgttggttccgccgttgagggtgaggaagggccatgtgaggatataagctctgatgaccaatcttccagcttcaatgaatggattcttcctgcaaaagaatttgatggcctgtgggaaag

SEQ ID NO: 65051 - DNA, 1071 bp, Glycine max
  Peptide Sequence Number=SeqID_156736
atgtgcaatcacaggcctagttataaacagaagtttgcagtgttgttggtgaaggaccctcaccaaaggttccgcatggtcgcaaatctcgccaaacacagacatgtagcagggcattgcagctcaattttagcttttaatacgaagaatccaacaacttcgagtgagtctccttcatcaccacttttattggtaccatacactccattacctcctgctagaacctcctcttccaaatcttatattgcaattgatacaagagatgtagaagaatgcattaggagtgatattgctcgaattgtgaaggaccaggacttaatgcatgattgcatcaacttccatccaaaagacaaacttctcatgatacagttcttgcaagagaaaggtaaggtggttgcattcattggaacaaggttgattactagttatatttcaattctaaaggtagctgatgtggggatagttcttgattctgtgagcaggatagtggacagagatagttctgacataactatcaaacgtttcaatgcattggaaccaattctgatggctggcagaagtaaataccacaatattcaaaacttcattcaacttcatctgacatttaccatatcagggttagtcataacattgattacaacaatatgtactggagatttcccccttgcacaattccagttgatttgggtgaatgttttggtgtgcattctgggtggtctaatgatggtaatgaagttaacccacgaggaacagcttgccaagcaacaatctgctcataggaaccatccaattataaccacagaaatttggaaaagcattgttattcaggttttatatcaggcttctgtgtcgatgatacttgagtttgggggacatgtcacagctgacagattgtgcctgcttttcaatctgctcaacatcatgcagttgttgaaaaaggaagttttgaaggtggttgttcagagcttctgtttcttgggggctttaggtggttgttttcttatgcaagtgctgctgattgagtatgctaaaggccgagcagattgcatgcggctgaatgctacgagatag

SEQ ID NO: 65052 - DNA, 513 bp, Glycine max
  Peptide Sequence Number=SeqID_156737
atggttagaataaaaggattgtgtcaggctttaggtagagttttaggcagagctttaggtagagaggttagtggtgatgaggaagaagctcctctacgtcaaagactgacaccattggcacatagacaatgggcaactgtagctgttgtcgaggatattgaacatgtggatgatgttgctggcaaagctcatgaggactctcacgatctaggttttccaggtgagccccaagatacattagtgttggcatcatatgttgatcatgtgacagccaaagtgttggcaggaaaggaatgtactgagttgaagttagcctctcatgagaggaaggtcgagaaattaggaatgtctacacctaaaattgaaggtttagtggttggtgccttccatacctatgatgcaatagatgtagaccaggctgcgaagtttttagttgagttgcttggagtgactacacaagaagtaatagacaagacaaagcaatgtagaggagcatatgtttgccttatctga

SEQ ID NO: 65053 - DNA, 486 bp, Glycine max
  Peptide Sequence Number=SeqID_156738
atgggctataaacaaatcactttcaaagagggtgtctctctcaaccgacctctattgtttaagggagaacacttctcattttggcaaaaaagaatagaaatctttattcagtcaatcaatcccagtgcatggaatgctattgttaaaggatcatttataccaactaaagaagtgaatggtgaattggtgcctaaagaatgggatgagatgaaaaatgatgagaaaagaaaaaatggagaagccaatttagaacttcaaacaagattcacccatattgtgaatcaccttcttggtcttggaaaaatgtttgaagatgatgagctaaacatcaaaatcctcaactatcttacaagaacttgggaccccaagatcacaatgatctatgaatctgatgacttagcatcaatgtcgatggaagctctcttcagaaaactacttgcatatgaacatgagttgattcaacaatctcatgctgaagaaacataa

SEQ ID NO: 65054 - DNA, 171 bp, Glycine max
  Peptide Sequence Number=SeqID_156739
atgaacaagatcagaggtcataggcgttggggttacagtcaatccttcggggttgattaccaagaaacctttgcaccagttgcaaagggttacactcaatcctttggggttgattaccaagaaacctttgcaccagttgcaaagctcaatacaatgagggtgttattatga

SEQ ID NO: 65055 - DNA, 690 bp, Glycine max
  Peptide Sequence Number=SeqID_156740
atgtacaacttcacaatgtttgatgacattgtaagtggctcaatcagcactaactttttaatagatgttattggtgaggttgttgagattgggcaggggaatctgcatggcaagccaaagaaagttgtatttgcaatgaaaaatggatggtttcgcgtggatatcaaagttggtcaacctaatgagtctataatttttacactatgggatcgagaatgttatgctttgataaaggagactacatatgagattaggcaaaaaatgattaatgaggatggagtatttgatgcaagagatataccggaagaacttgatcgtgttttgggcaaaagattagctttcaaatttaaggttgtccttggaaatacatgccattctgtgtctcagttatctaatgatgatgatttaatcaactttgttctttcaaagcttccaaccttacaacatcaggatgaagcttcgccttttgtatcgatgatgcaagagattaatgatgttggtgatagtcaatgtttatcagccactgctgagtctgatccaacactcttgggatccatcacaccggctaagcgcatttttccattgtctcacagtcaactggatggaataccattcgaagatttatcatccatacaactatcctcaactaggctgggcaaaaagcatatcaagactgaattatcaccatga

SEQ ID NO: 65056 - DNA, 483 bp, Glycine max
  Peptide Sequence Number=SeqID_156741
atgtaccctcccttgttctctttgaatctagtggatgtaccctccactagaactaatccacaagagatgtaccctctcttgttctcagtcaacaacccaagtagatgtaccctctacttggaaagggaagaatcaaaagaattctcagactgtgtcgttttgaattctttgacaagggagaagggagacacaaaagaattcaggcagttagtcctttgttcttttggaaaagggagaagagagacacaaaaagaattcaggcggttagtccttggcaaattctttttggcaaagggagaaaggaatgaaaagatgaatagcacaagttttcaagggttgaaaaaccataaaactttagaaagattttggtacaaagaagaagaaaaagttcaaagagattcaaggcttgtaaaggattgtaagaaattgattggaaaagtattcaagattattgaaatgcaaaacaaagccttgcttttataa

SEQ ID NO: 65057 - DNA, 645 bp, Glycine max
  Peptide Sequence Number=SeqID_156742
atgaagacagagcctagcttggaagatgaagatggttcgtctcacgcgcaacgacaacgccctgctccaccaacgccactgcttaccactgtcaacttgacaactaacacatgtgcaaccaccacgcctgttgaattgaacatcggttttttgagaaaccgacgttaccttgttgaagttaacattggtttttacaaaaccgatgttaacagattcatcctaacatcgattatccttaaaaaaccgatgttgaacctcttatcgaagaaaagtcgaagaaaaccctacattgctgttggaattgtgggtcgaagaaaaccctatactgctcttggaacaaccgtgggtgctcaaagctcaaagctttctacgctgccagttaacaagttgattgtgctttatgtggttttcaagcttgacgagagttacacgccgagcaaagtttccatccttgccggtgatggttttcacaacttgaagaagcaaggcttcatggtgaatgtgattcaaagaacatctcaagagaatcaagagttcaagaatcaagaagaattcaagactcatgaagaaagcctagaatcaagaatcaagattcaagatctcaagaatcaagatcaagattcaagactcaagattcaagaatga

SEQ ID NO: 65058 - DNA, 957 bp, Glycine max
  Peptide Sequence Number=SeqID_156743
atggtggattggacaacagaaataacatctgatacagaaaacaacagaggtgtgggcagaggagatcgtgatgattccgatgatgctccgcagcgtcgatggcccaccacatccacacacaggcagagagtagttgtcactgctgagcacgatgagccagtggtccctacggtagaggctgacgtatttccagatgagccgatggcaggaggtgatgtagaggacactggggtagacattcctgcacatacaggcgcacaggctgctgagaatgagcctgagggatttccaggtggtccgagcgacccatccgtgctaacccagtatgcggatcacgttgcaggcagcgagtgtcctgagttgaagttatcctctcacgggaggaaggtccatagtttaggcaggcatgtccctgccattgagggcctagttcctgggataggactaagtcctctgatcgcgtgttcggtagacactggcgatcggggacttttgtcattgtttatcgagcggtggcaccgggagacgtcaggtctccatctccctatgggagaggtgatgatcgtgctggacgacgtctcgtctcttctgcatctgcccgtggttggtgacttgcatgcctttcagccattgcacgtggatgatgcgaggctgccagggctgagacagtgcattgtcgtggatcgtatgtacgcctgcaatgggtatgtgatatctatgagcgccgatgccaggcaggcccttcgtgacctcagtcagaccgggaggtacgcctggggagtagctacgctggtccatatgtacgaccacctcaacgatgcttctatcagcaccagccgaagcttagcgtgctggatacacgagcactttccctcggtcgcgaagtcactgctgatccggactacgactaggattcaccgcgcgcctgtaggtggattgctacgaagaagatcgtga

SEQ ID NO: 65059 - DNA, 1278 bp, Glycine max
  Peptide Sequence Number=SeqID_156744
atgagaacggggaacctcttctggcttggcattgttgcagcacttgttttcagcttctgggttgatgccttttcagccaatcaatattacccccaccaccacttcaatgaaaccgagttctcttcgttggagtctcaagaacaggcacattcatccctccttgggaggactcctctcatggttggactcacccttattcaaagtgctgctgccaaaggagcagtttgcttggatggaacattgcctggttatcatttgcatcggggatatggatcaggagcaaacagctgggtcgttaatttagagggaggtgggtggtgtaatgacgttagatcatgtgtttatcgcaagaaaacacggcgtgggtcatcaacattcatggaaaaacagataccttttacaggaatattaagcaacagtgctgaagataatccagattttttcaactggaacagagtgaaaattcgttattgtgatggtgcctcttttgctggggatggtgaagataaggtggcgcaactgcaatttagaggacagcgtatttggttggctgcaatggaagatttgaagtcaaagggaatgcgatttgccaagcaggctcttctttctggatgctcggctggtggtctggctactattatacactgtgatgaattcagaggttttttcccagagactaccaaagtgaagtgtcttagtgatgcaggattatttcttgatgcgattgatgtctccaggggacataccatcaagaatttattcagtggtgttgtaaggctacagggagtgcaaaagaatctgccgcacttttgtactaatcaccttgatcccacttcgtgcttcttccctcagaatttgattgccggtattagaaccccactattcattcttaatacagcctatgactcatggcaggtccaaacaagcttagctccttcatcagcagatccccatggcttttggcatgattgtagattaaatcatgctaaatgtacttcttcacaaatccaatatttgcaaggtggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaaggcaattgctcttgctgttggagactggtatttcgaccgagcagttgttaaggccattgattgtccttacccttgtgataatacatgtcaccatcttgtcttcagatga

SEQ ID NO: 65060 - DNA, 975 bp, Glycine max
  Peptide Sequence Number=SeqID_156745
atggccttacattcactggctcagagttcggtagaaggtggatataatgattggtgggctgcgatggaggtaatgaagatgatgattggaaaaagggaggtctgtcggggtaatgtggatatggaaatatgcattggcttcatctttttgaaacaatcggtgaagttgtggtgggatgatgagatggagagaagaccactgtacgccgaggacaagttgtgggtactccccccatccactaagatcaccactggttgcaaggcaatgtggcccaccaggcgtaatgtttcaggggctagggttgtcttcaaaaggctcttcatcgtccgcaatgagcaaaaaggccttggaggcacactagtggctacgatgaaatttttcatcgcatttgaaaatagaggccacattcacgtctcaagggagaaggagacactggaactggggaggaaggaaatggaggtggtctactacggaaggaatgacaaccatccaccagtttctcctcttgcaaacgcgccaagcccgccgcctggaccagggtcagaggttgcagagcttgtacctcctggcgaatgccctagtagggtcgtcatactgggagggggtgaacctggtctgaagtgtctaaaggaacgcgggccaagaagtgaattgaccattacgggtcatccactgaaaccacgccaaagctctaccttccatgtagcaggaagctatagtaaggcattcatgtgcgcagaagatggagagacaaggattagaatagcagtggataatgagggtatggagtttgtgaatgagctcatcgagcttaagggtcatggaatgcaaggtttcactgagggatacttggtggctctcaacgagagcaccataaatgttaggcatagagggttagagctggacttcagagggccagcaagcaagggacaaggttgccaagtcagcatcaaggccgttagaggtagtccttga

SEQ ID NO: 65061 - DNA, 588 bp, Glycine max
  Peptide Sequence Number=SeqID_156746
atggattcggcaattggaattggcaggcaagcaggggacaaggttgccaagtcagcatcaaggccgttagaggtagtccttgagggtttcttgccgaaggtcaactcgtatggcgagattcctgaacctaaatgtatcgaggaatctcgccaattgtgtcccataggcacccatgtggcctcctatgggggacgagtgatactctgtgagcaggctaggaataaacgaagaccccaggggcaaccaaatgcgaccacctttaagactacgatggtctgtaagaatggtgaaaaggtgacccagaagatattgtcaccatttctttaccgcgacagtaatggcgaagagttcccgcacataagtggaagcttgaaggagtttggggataacacggcgcccatgccggcaccagatgcgtcagtctacaatgtaaaagtgagggtgaaatccaataaatgtagaacaggagcagtggtcagcgccttctttaattccttgaaagcaagttctgtcgcggagggctgcaatggaagcatagtcgcgaataaaccgacgataaaactcggtgaggccgaggaaactacgtaa

SEQ ID NO: 65062 - DNA, 105 bp, Glycine max
  Peptide Sequence Number=SeqID_156747
atgacgatgaaaccgacagacaatgatgaaagtgacggcatcacagtgggtataactaaactgaccttcaatgacaatgctatggcagcgaagcagttggtgtaa

SEQ ID NO: 65063 - DNA, 249 bp, Glycine max
  Peptide Sequence Number=SeqID_156748
atggcagattaccaacaacattttgagaagctctctaatcatgcctttggactaaatggtgaaaccttacttaattgctttcttttcatattagctcttgatattcgacgcaaactacttattcataaacttttttccatccatcaagccattggcctagccaaactggtggaagctaaaatcaaagacacaaaacctaaaccttctgccaaattccttaacccagctacgccctcagctacctcttag

SEQ ID NO: 65064 - DNA, 176 bp, Glycine max
  Peptide Sequence Number=SeqID_156749
atgacttctcatctaaaaggtgttgcaaaatcaactatgtcagatcaaatacgtaagaagttgtgcgagtacaagaaagataatcctgcaagcacacaaaaagacttgcagagatggcttgagggaaaatttgagttgaaagttagtcaaggaacaatatcaaacacacttaagcg

SEQ ID NO: 65065 - DNA, 348 bp, Glycine max
  Peptide Sequence Number=SeqID_156750
atggtcttttcattgaattttctggaccctagctcgcctaagctagcctatggctcgcctggacccccaaattactttaggatgaaggaaccaactcacttgggagagccagttacttcaggagtaagcatcaactcgcttgggcgagctaccattgccccaactgcccattttcctataaataggcgtgctagggaggctgaggggagggtccaaggttcaggaattgagggaattgagacaagagagaaagaagaggaaacgaagtcgaggcgctaccgaatcgcgaccgcgattattccctacatcgttttcttgttctgtgttcttcgtgcgaccgttggttag

SEQ ID NO: 65066 - DNA, 387 bp, Glycine max
  Peptide Sequence Number=SeqID_156751
atgatccgtaaaaagcacaacagcttcccgatagcggtttccgccatcgctggcaacaatggtggaaaaaaaaaggttcacggcgcttacctcgactatggacggtcacgaagctccctcgacggtggacggcgaagacgaagcagaaacgcgaagaagaagcaccacgacacgcgaagaagaagcagaagaatggcgacaatggcagcaatggcttgggaggcgaaacgcgaagttcacttgggaggtccgaggaggttcacgacaacaatcacgacaagaatgaagaagacgctgaaaatgcagaagaatgaagaagcacaaaggttcgaggaagaagaagcatgcggcgcgggagagagagaggcgagagttatttttttttaa

SEQ ID NO: 65067 - DNA, 1380 bp, Glycine max
  Peptide Sequence Number=SeqID_156752
atggcgactgtggtgccaacctccgaagaagacgctgcactctccgtcgttcgattcgcctctgaacttgcctgggccgatgccggtcccgaggttactttcttcctctttcttctctctaacccttttctggcctttttcttggctctaactggtttgtcggtgctagattattttcttttattgctgctctgtgcactaatgcatcttgttatattgtttcccatcttggtttgtcaggttgctgagccccaagttagcagactctgcgtggaggctgaagaattcattgttatgggaaagtggttggagctagcatcattgatgattacctctgctgaattgattttctcgaaggtttctgaaaaagatatagagtccatcttcactatcatctgcaatcttgttacaaagaccgaaaatccagatgaagtgatggagattgtaaaagttataactacaaaaatactccagcagccaaatgaaaagcctgctgtgcgattgaagattatgatcagcctgtacaaccttttggagactccatactgccagttttatgtctacatgaagttactgaatttagctgttgatgggaaagtcacagaacacattataccttcattcaataagattgataacttcttgaaagactggaaaattgggataccagaacagagagagctctttcttgctgtctctaatattttgaaggaaaataaaagcatgtcaaaggatgcttttaagttcctgaccagttatctggcaactttttcgggagatgactcacatgttttgagtgaagccaaggaggaggctgcacgtgcaattgtggaatttgtgagggcacctgacgtatttcagtgtgatttactagacttgcctgctgttacacaactggagaaggatgccaaatatgctctgttatatcagcttcttaagatttttcttacccagaggctggatgcatacttagactatcatgctgccaattccaccttgttgaaaagttatggccttgtgcatgaagaatgcattgccaaaatgaggcttttgtcattggtggatcttagctctgatggatctggccaaattccatatgaacttattagggacacacttcagatcagtgatgatgaggtggaactatgggtagttagaggattaactgctaacttaattgactgtaagatggaccaaatgaatcaagttgtagttgtcagtcatcctactgagcgtgtgtttggtcagcaccaatggcaagcactgagaacaaagctagtgacatggaggggaaacattgcaaatgtgatcagtaccattcaggccaacaaaataacggaggatgggtcccaggcagcccaaggcttggtagttcggtga

SEQ ID NO: 65068 - DNA, 189 bp, Glycine max
  Peptide Sequence Number=SeqID_156753
atggggttagtcttagggttgaatcccaatacttggcttctgtacatgatgacaatccccgtctggcgtccatgtcttactttggagtcattgaagaaatttgggaacttaactatgttaaattcacggcacatgactacaccaccaagctcccctcctcctcctaccttcttcgccgaagaagactag

SEQ ID NO: 65069 - DNA, 366 bp, Glycine max
  Peptide Sequence Number=SeqID_156754
atgggactactggacagcaggctaaagggtaagcacatcatgaaggaggcaaataaacaaatatatgataaggaagacagagctgaacaacaggctaagtccatacaatgtgggcctcagttgggccagctaacagatttgccttatgaacctcaaacttacttggaccataccccctctactcataaaaaacctacgggaggtaattggcaggtatattcccggggaagctggtctaataggagacatcaaaggagtggaagctttgaaggaaaccatatgccactaagtatcatacagcagagcagcagcagaaatagttcaggaaccgcaacaggaaatatcagtatagatctacaacagtag

SEQ ID NO: 65070 - DNA, 243 bp, Glycine max
  Peptide Sequence Number=SeqID_156755
atggattgtttagccctccatggtcatgaagggctaaaatatataaaaggtttaaaagatgaagggataaggaatgaaggttctctaagctacttcttcgcgctgagcagacactctcccgctaagcgacacagctcgctaagcgagcttgacttgctgagtgcgaactatcaggcttcaacttctctctctatcccttgcctgtatatctgcaaaataaaatcatcaaacagtatgaattag

SEQ ID NO: 65071 - DNA, 189 bp, Glycine max
  Peptide Sequence Number=SeqID_156756
atggggaacaacaagcgtcgtcaatcgcactcaactgcaaagcaaattatgatgaagggtgctacctcaggttcaggcaaggtgctcataaaaaaggcagggacaagttctgtaaaaactgatgatgtcgcacaccaagtgtttgataatttgtcggaatgcagtgctgaagctgaatcttccccaaag

SEQ ID NO: 65072 - DNA, 426 bp, Glycine max
  Peptide Sequence Number=SeqID_156757
atgaaggacaagtatattgttctaagcttgttaaagaacttagaaaaaatcaagaacaagcttgttcgcacatcgttcgcgtgtatgatatccactcaacaagcttgtggttacgtgagcatgaactactaccaatatatagatgttgtttacacaaatgagcacatcttaaaagcttactctacacaatggtggcctcttgggaatgaagcggcaattcctccttctgatgatgcatggacacttatccctgacccaactacaattcgtgcgaaaggtcggccaaaatcaacaaggataaggaatgagatggattggctagaaccatctgaccaccgacaaaaatgtagtagatgtggagcagaagggcacaacaggcgccgatgtccaatgcaatctgaccgtgggagttgttcatttaattga

SEQ ID NO: 65073 - DNA, 585 bp, Glycine max
  Peptide Sequence Number=SeqID_156758
atgtgcagtgcaaccgattataaaactaaatcaatcggaggtatgtgcatcttaatacaaatgtgggcatgggaacgatgtataactttggctccaaagaggactcctcccctagtagaaaataaaccactcgggcacaggtggctgcaacatggaaatcaacatatcggcaatgatgatttgagagtttttcgtcgcaagttagatattatgaaacgtcatgagtttgtgtggaagccttacacaacaaattggaacaatcaagttgattttagggtcaacggttatccccgacaagagggtctattgagctctaactccgactacatggtctggtataggcgaaaaacaaagatgattgttgacccacaaaatgcaaacacagctacattggctgaagttgcggagacattacaatacatggtgtctcctcaagagaagaatatatggatagttgatgatctcgtgccttatgtggagaaaataacgattttatcgaaagaacaagagagaatcacagagccagtgtcacatggtccagcaacagagcatcaatttccagcacaagagtttcacatgctgtag

SEQ ID NO: 65074 - DNA, 216 bp, Glycine max
  Peptide Sequence Number=SeqID_156759
atgaaagagattgccttgaatcaactggaagagaaaatgtggataagtgatgttggcagcttaaacttcaggctgggctatgcttgtgaagtattaaggtgtagaggtactaaagtagtcctccaaggtgatcctccgtggctgatcttctgccatgatgtttcttcaaagttgggatgtggaaaagatgatgatatagagaatgatggttcttga

SEQ ID NO: 65075 - DNA, 405 bp, Glycine max
  Peptide Sequence Number=SeqID_156760
atggaaaggaatctcttggaaaatttgatgcaaaagccaatgaggcaattttttcttggttattcattacaatgcaaggcatatagagtgtttaatatgagaacattgtgtgtggaagaatttgtatgtgtgtgtgatgaaactaactttcttgttcaagaaaatgctttgcaagatgaaaatgttggttttcaggataaggacactacacttgaagatgaaatcaaggttaaggatcttgaacaaagcaaggaaatcactgccacacctcctaaagacctctcaatggaatggagagctcaaagatacctttccttggacaacaccataggtgaaatatctaagggagtatccactcgctctagacttagaactctatgcaataacatggcttttgtttcttaa

SEQ ID NO: 65076 - DNA, 525 bp, Glycine max
  Peptide Sequence Number=SeqID_156761
atggctgatacctttctcttttttgctgtatttgcaagtgtgagcaccgaaattgacattccaggtgatgctgttgcttgtcaagagaacaccaagaagaggttctgtgacttgagctctgttttggagccagggagacctgtgagaacagataaaccagctatacttgatgatgctatcagagtcttgagccaacttaaaaccgaagcccaggagctcaaaaaaacaaatgaaaaattactagaggaaataaaatgtttaaaggcagagaaaaacgaactacgcgaagagaaacttgttctgaaagcagataaggaaaggattgagaagcagttgaaggccttgcccgttgcaccagcagggtttatggctccacctgtagctgctgctgctgcagcatatcaagcaggggtgaacaagatggccgtatatccaaactatggctacatcccaatgtggcaatatcttcctcaatctgtcagagacacatcacatgatcatgagctcaggcctccagctgcatag

SEQ ID NO: 65077 - DNA, 228 bp, Glycine max
  Peptide Sequence Number=SeqID_156762
atgccagcagaggcagaagctgctgctagagatagtgttgctgttaactgtggagaatgtacagtggtcaagaggaaaacttgtgaaatgataaacatcataactatacaagttctactgggtgcaagtgggcaacggttatccaaacatgcactaattaggaagttgggaagagtaaaggttcacttagaaactaacccaatctccaactacaaagaggctaattag

SEQ ID NO: 65078 - DNA, 1584 bp, Glycine max
  Peptide Sequence Number=SeqID_156763
atgaagctctccatcggcgaaggctcacagcatccgcacgtaggcaatgagaagttgtcgttgttgttgaggatgctcctcacttggatggcgcaactgaagaggccgtgtgacacatcagttctaactgcctatgctgatcatgttgcaatcattgtttggaatggaaagaaattcgggaggcctattgctgacattgaagggttagtcgatgccacaagattaagtcttttgatcacatatccattggacactggcgatcagggacttatatcgacttttatggagagacgacataaggaaactagcagtttccattttctagtaggagaggtcaccatcaccctcgatgatgtggcctctttacttcatctgcccatcatatgcgtattccatagcttcaagactctttatgacgacgaagcggtgttgatggtagtggagatgaagccaaagctgagacactacattgtcatggggcatatgtacaactatcttggttacgagatatttattatagcaaatgtgagtgcaacacacgtacatgtggtgttcttggatgcctttcgagacctcaatcagagtggaagctacgcatggggaactgccgccctagttcatatgtacgataatttgaatgatgcttgtaagagcagcaacaaacaacttgatggatatatcacactattacaatgttggatttatgaatattttccatctattgctgaggtttttacgaatgaagactatgatgaaaggccaccccatgattgtcgttggacctctacgaaggcctctatgaaggcattatcagtgtcaacgtatcggaagcgtctagatcggctgacaactgctgatgtttgttggataccttacggtgaccaccgtgcagttagagagttcaacctaatttcatgtttttatggacatatccaatggggtcccgttgaccagagagggttgtgcggtagtttgggtatgttcagacgattcctccacactatccaggttaaagattatgctttgaagatattgacaacagatgaatgcatttctttgactaccttgcactggccaacacagctcggggatccacccagacatccacctgtcgtgcaagatgagacatatattgaaccagatatgcctcagtatccagtggtggcagcaactatagaggaagcacctgcgcatgcagtggtaacatatatattcatcttactcttaatgtcaatagctgaaaggttggagcggttgctcaacctaaggatagtgattgaaggcacaaaaacatatgatgtcatgcaagactgcctaaggatcgctagaggtgtcattgtggatcacaatgtatatgtgcgcccaccaaaccagtctcagaaaaacgacgatcttgaacccgttcaccgttggatcgtcgtgaaatttgagtatcatgttcgcaacacaactccgagccttctaaccgttgggaatttcgatatcatggagaaaaatgaatcgcatgaagatagcacaagtggaggtttcaatctcttctccgtctctctgacgtttgggaattctatcggagcagtcggatga

SEQ ID NO: 65079 - DNA, 348 bp, Glycine max
  Peptide Sequence Number=SeqID_156764
atgggacgacaacgtatatggtgggagcagtggcactcattggcagcacgacgcagatggagggacgaatggcggcctcttgatgacactgaaatgaagaaggagaacaacaatggagaaaggatcacaaattttgcctatgtcgtacctttgtgcaaagagaatggctatccagtcctagaaagccaagaagaattggctacgtggacagcagcaaagcaaaaggagaacaagcaaaacaagcaacatgatgctaaggctctactattcatccaacaaggagttagtaggagatctttccaagaatcatgcaagcaaaaaatacaaagaagatgtgggagactctga

SEQ ID NO: 65080 - DNA, 615 bp, Glycine max
  Peptide Sequence Number=SeqID_156765
atggccaaatcatcgaaaaagcgaaagggatcttcctccaccaccgccgccgctgctggccatcgccgccatggaccatctggagcactaacagcaccaattcatccttcattgtcatctcctagatcacctaccttattctcgtcagatgatcaacgtcaaagtcaaggtgttccttttgagggcaccattgttgatgactggaagttcaattattcaagtcatgatactcactgtatggtctgcaatgaccaggctgatatgaccggcaaattgtttgctgggtcattaacctttgattgtcgcatcatgcactacataattgttagaattttgctaccccgttcatttaatcttgctcaagcctctgaggaggacttgattctaatgtgggcttttgataccggtcgtcagatcgactgggcctacttggttaggtaccgaatgcataaggcattacgggtcaatgcacctcttccttatcctcagttggtcactctttttcttcatcacttccaaattcctttgaatgatgaaccttttgttcaagttaagaggtcttttgcaattggtgttggagtggtaacttcttttgggtaccgtatcacaacttga

SEQ ID NO: 65081 - DNA, 231 bp, Glycine max
  Peptide Sequence Number=SeqID_156766
atggctccgtggaccctggcgtcgcagtcgagagagaatggctacgagagtggggtcattcagacacagtttcttggagaaaagcaaagagaggctcctctcaataaggactacgaatactttgttggcttcaacggcgatgacaatgcctcccccaagcgttccttcctcgacgcgctctctgatccagagactgaggaaagtttgcaggagaaaaacaacaacaaatga

SEQ ID NO: 65082 - DNA, 276 bp, Glycine max
  Peptide Sequence Number=SeqID_156767
atgcatgatgatcaaattcacattcttctgctgctctcttgtcagggatcttcatctgcaaaatatacaattcatttacccactggctacttcttcctgaaggacaaaaatgaagatgactggattagaagatacttctttgctggagcaactgtgccttcagcaaatctacttctttatttccaaagtcctatcaaattttgctatgttcttaaagataaagatgaaggaaaattctataggaaaaaagatgacgttacagtcatcaaccattga

SEQ ID NO: 65083 - DNA, 225 bp, Glycine max
  Peptide Sequence Number=SeqID_156768
atgtggaacacattagctttgacgtatgaaggattgtcgcaactaaaatgcaacaagctcagcttcttgacacccaaaccatcttcaacatacaaggaatcttcatccagacctacatccagaagctcatccaaagctgtcaacattgatacaccttctaatgatcagtccaatggtgaaggctcatatgaagatgatcagttagtcttcatcatgaggaagtaa

SEQ ID NO: 65084 - DNA, 331 bp, Glycine max
  Peptide Sequence Number=SeqID_156769
cgccaggaaggatggcgacatcctcgaagccaagtcgccagcacggacgacgacttccccgtcaaaggctgcacccgctacagcacctgagcacctcagcttacgcctaaagcctacgcctgcaatgcttgaagtcgccgtggcgacatgccacgtgtcaagccacaaggaaagcaccaatggagctggcgtttttgcatgccctccacataaaaaaacagcaccctcatggaataactttcaaaacaaccctagttcaggaataagtttgaaaaaggcaccaaactggtcaatttgccgcatagtgatgacaatgggtgaagtgaagtag

SEQ ID NO: 65085 - DNA, 489 bp, Glycine max
  Peptide Sequence Number=SeqID_156770
atggcaagcagaaacaaaaatgtccctgtcatagtctactacgatgcctatgtagccgactgtgacgagggcgttgagtttaagggcagaaacaatgtacttgtttcaatgagaagaggcatgaccttgaatgccttgaaaacaaaaatccaatgcctatcttctttcgcaccaatcccgtacacgatcaccaatgattattacgtccctcattttgaatccactgaatttgatacccgcattagttcatacacacaactgtttggtgggtcatcaaactattgtgaggcgactccccaactaaatgagccctcccacctaaatgtcgacccaactactgatatccatgttgttcagtctaaaagaaatgaaatgtcacatgactatcatgctcaaaatgggttgccggatgaagtagttggtgacttcagtgacgatgaagacgaaattttggcggacaacaatgacaacagcgataatgacacatag

SEQ ID NO: 65086 - DNA, 3237 bp, Glycine max
  Peptide Sequence Number=SeqID_156771
atggcggaagaagaaccttccataacatcgccaccggcaagaacgttacacaagttcctctcccgcagcggcaagaccgtcatcgccgcgcaacctctggcggtggttcgcgccaccaccagcaccggcggcgcgcgcgttctcgccgcgccgccgaactcgaacgacgatccaacaccaccgcaggaagaagaaggagaaggcgaaaccggcttcgatgcttctcatcatcatgaacggatattgttgcagagagagctaacggtttcgttcgacgagtttctcgaggtcaccaacacgaaggtcgccaccgaagaggaggctctgaaatcagtgatggcgccgttggaagaagaaactgaagaaggagaggaagccgaatcgtcacaggctcaatcagcgcaaccggttcaaccggtgccgaggggaccgcaactgtttcgaccggtgcagaagaagaaagcggttaccggtgatgacgtggaggtggtggaggtgcggaagcctgtggaaaagaagaacattccgaatatttcgaatctcgaggacggtgagtttccggaggagtctgggtggttccttctcgggaggaaggttgaggtcgcagtttcgacggccaggggagtgaacaggttggtggataatgaaatcgttcatttcaattttcctattccgagttactcgagtaagtctcagtggatcgttcgagcgtcaaccaagcgttctggagaggttgggaggatgccaatggaatgggctgaggctatgattacggttatgcaatctggaagggttaaggttcgaggccggtgcattgctgtgccagataaactacaaatgatgcaagagattatgtttttagtgagcttttatgttcaccactctgtatttgctgagcgtgttgatacttcttggaggctggaggcttgtggtaaaattgatgatactgtttatccacttcttgccctattaaaaatgctagagatcaagccaagtcaaaaggctgatccagatgaagctgcagcattgcctttgatcaagcgaagaaagggcggtgagccccttcctgagcaaaataatgatgaacaagctctttcagagtcagctttgaataaacttgttggagcggcagaaatctatgacctcaaggagaaggaagccccagagacacttgtgtgtaatttaaagccttaccagaagcaggctttacactggatgactgaaatagagaaagggatggatattgagagtgtagaaagaaatctgcatccctgctggtcagcctacactatatgcaagggaaggacaatttatttgaatatttttactggagaggcctctaaaaaatttccaaaagcaacgcagatggcaagaggaggaattctagcggatgcaatgggacttggaaagactgttatgacaattgctttgatactcagtaacccaggcaggggtaactcagaaaacaatgatgtggagaatggagatgataattttatcacaaataaaagaaagaatgctaataccttacataaatttgagggtggcactcttattgtttgtcccatggctttgttaagtcaatggaaggatgagcttgaaacacattcaaaggaaggtagtatatccatatttgttcattatggtggagcaagaaccactgatccctggatgatctcaggccatgatgttgtcttgacaacgtatggtgtcctacaagctgcatacaaaaatgatggagagaatagcatctacaacaaggtcaagtggtacagggtggtgctagatgaagctcataatataaaagcccatcggaatcagactgcccagtctgcttttgttctgtcctcacacagccgctggtgtttaactggaaccccacttcagaatagcttggaagacctatacagtctcttgcgtttcatgcgtgttgaaccttggtgtaacttggcatggtggcagaagttgattcaaaggccttatgagaatggtgatccaagatccctgaagttggtcaaggccattttgaggatgctgatgttaagaagaacaaaggaaacgaaggataagaaaggaaggccgatacttttcctgcctccaattgattttcagttgattgagtgtgaacaatcagaatctgaacgggacttttatgaagccctgtttgagagatctaaagttcaatttgatcagtatgtcgcacaaggaaaggttcttcaccattatgcaaatatccttgacctactaatgcagttgaggcggtgttgtaaccatccatttttagttatgtgcggaagcgatacccagaaacgtgcagatttaagcagactcgcaagaaaattctttcagactaatactgaattccccgatgaaagcaatcaaaatgatccacggcagcaagcagagttgaacaaacttgcaagtagattacttctaaaatctgcttcttctttgcactcggttcaacctcatgcatacattgccgaggttttggagaatattcaaaagggtgacatcatagaatgctctatatgtatggaatctccagaagatcctgtgtttacaccatgtgcgcataagttttgtagagaatgtctatttagttgctggggcacctcagtgggtggcaaatgtccaatctgtcgtcaattgctccagaaagacgatctgattacttattcatctgaaagcccattcaaggtcgatattaagaacaatgtgacagagtcttcaaaggtttcgaagctatttgaattcctgcaacgtattctgaacacatcaagtgaaaagagtatcgtcttcagtcagtggacatcattttttgatctgttggagaatccattgaggaggagaggaattggttttttgagatatgatgggaagttgactcagaagcagagggagaaagttctggatgaattcaatgagacaagagagaaaagggttttgttaatgtcactaaaagctggtggtgtgggtttgaacttaactgcagcctcaaatgttttcattatggatccatggtggaaccctgcagttgaggagcaagcaataatgagaattcatcgcataggacaaaaccgaagagttgtagtgagaagattcatcgttaaggacacagtggaagatcgattgcaacaagttcaagctaggaaacaaaggatgatatctggtaccctcaccgacgatgaggttcggactgctaggattcaagacctcaaaatgcttttcacatga

SEQ ID NO: 65087 - DNA, 543 bp, Glycine max
  Peptide Sequence Number=SeqID_156772
atgtgtgaacaatgtttgggtgttgtaccgccaaagggagaagtaatagtaggctctgccattaagcttaagtggttgcaagataatatgtcgtcgcttcccgcagaaccaacacaacaagttttaatgctagacaagacgagaaatcgggttcatttgatgtacctcactgtgttggctgatctcaaccaagttaggtggtatagttggggtcctgcttgtctggcaatgctgtatagggaaatgtgttgggccactgacgctgatgccaaaaccatggtcggttatgcgtcattgttgcaatcttgggtatggtatcgcatgcccttcattgcaacaagagttaatcggacaccatcgtatccattggttacaagatggagtggtggtggattaagctttactggtacaccacatggagatgtcatcggttatcgaatgagattaaaccacatgacaactgaacagaatggaaccaagcggatagagttaaacttcaattccacctccgacaagacatatcagatcccccatgaaacatag

SEQ ID NO: 65088 - DNA, 270 bp, Glycine max
  Peptide Sequence Number=SeqID_156773
atggctccattcttattcttgatggtgttgaagggcttagccgacttggtgagacaagctttggctagtgggaagctgaaagggatccaaattggtaaggataatgtagatggagttggagtaatgggatgttggagtgtaaatttctttgatggaggcaatggtttgcctggcaagtgcccttggtggaagatttcctataaaagatgcacttggtcatgttacatgaacatgtccaagatgttgtcacctagaaatgtagctcaataa

SEQ ID NO: 65089 - DNA, 258 bp, Glycine max
  Peptide Sequence Number=SeqID_156774
atggtgagctattttgtacaggaatttaaaaagaagaacaaaatgggcattagtgagaaccctaaggaggttgagaactggatgagaattgaagagaggcctatggatcaggttaccaaattcgttagcgaggatgatattgaggatgacttcatggcatatgacatacatagtggagacaagaaaaagccagcaaagtcaacagaagaccatgtaaaaccaaagaagaaagagggtcctaaagttgtgaacttttaa

SEQ ID NO: 65090 - DNA, 2604 bp, Glycine max
  Peptide Sequence Number=SeqID_156775
atgcagtcccagtttcagtcacagatgcaatcacagagacttgcactgcctccggagcctgaggttggtccctcaactgcttgtgccagcacaaaggagagttgtgttgatccctcagggaacgatccagacacgggtgactcagacaaatgcgggttatacatcgaagaaaatcctcctcacttagttgccttaggaagagtttatgagggatccacaaccgttcgcaacatccctttgttgcatgatcaagtgaaggttggtgttgaggaggttaaagatgaagatgctcccattcctgtacccactgatgagggagctgtgggaccagcaaaacttgcaaatagactggatcatgaggttatgtgggatgctatcgtgttcggggtgtttaatgaagacttccccttgtacataaagcatgaagatctgtctgaaatagaacacggtggtcaatgtctcagcatctctgttatatataggcatttgaatgagacaagtatgcgagtggggaatttcgatgtgtatggattcctcgagccacagtccatccagagatttgggcaatcgcaatttgaatcagaaagttacatgaagaattggatgcaaaattcaaaacgggatgtctacctaggagcctacctgaatagtgcacactggcaaatggtcatcattttgcctaaggaaaatcttgttgtctggttttgttccttgcataataggccagacaactacctgaaaggaataattaacagtgctttgaaaggacttgacaatactccacaacgtaaatccaaggctggtgctagaaggaggaataaggttggtaggagatatgggtttgtgaggtatatgaaactgagcaacccaacagaggtggaaagacaactggactcactctatatcagcaatgaaaaactttttgtgaacctcccaagatttcacaaggaggccgcaaaagttactccggggaaggaaccaacaaaaaaaaaagattggagaagatgggggaaggagaaaataaggggggaaaatgtgtcaaaaggatggatagagggggaggaacctaatagtggatgttggggacattggatagttagagaagagctatgttggtacatgggggatgaaaaagttttgctaactcagattgaagaaggtaaaagtttaggggagcttgttgctgagaagacagaatggattctttgcactggacttcccctgcaattctggaaagctgaatcggatgaggagtccactatctatgaaaaagtatatggagacgaaaactcaaggttttcagagtgttacctgggtgacaataacttattggttgatggtgattgcctagggaggttggatgactctggtgagattgctctagaatcaacaacgacaatgggtagccatgaaaagttgagtgtggatacatttttaagcaccactgacaaggagacacaggcattaaatgctaatagaagagagaacaaaattttgggaggaagtaaccaatcacaagaaaggggggaattcttcaaggagaacatgccaaaagaaaatcaaccatcacagtctgagaatcaacatgtggtgaccagtataccagatacatctttcctttctcaggataagaaagaagaagacgagggtcatatgggacaagataatggagaagatatttgtaagaaaggagcaactaagaagttggaagtcaacaaaaaggaacttgtgggcctacttactaagggcttggaggagactgcttttgagaaagaaaaagaagggcagatgggtgacacaaacttaggccttattgagaaggacatgatcaatatggttgcctatggggaagttgacacggagaggaaggacaatggcaaagcaaagctaatagaaaaggagtacaacaaccaagggatgatcaagaaggatgtggatgaggcaaaaatggataaaactgaaggaggaagtgaaaagaagtttatcaaggagggaaagaagtatggatccctaacaacaaatgcagctggtggcctcttatgcatatggaaggatgatgagactttttttggtctaggttacttaggaatcaaagctttgaggctgcttcacttagggttggcttggagcgtggttggtgacttcaatgcaatgaggtctcatgaagaaaaaaggaattctaggaatgaaaaagtaggagaaagagatatgcttgaatttgatgcattcattcataacatggagcttgtggacatttcgttggttggtaaagataaggtggtgaggaagataagtgagtttgatttaaaggatgatcttgaagatattagtgaggagcacattgattgcaaccctatcttctttcatgccatggtgaaaggggaaaggaatgcaaatgggttgaaagggatacttgactatggctgggaagaagatccgagtcaagttgaaaagaaaatatactctttctttaaagagcggtttgaagagcaaagtgggaggagacctaaatttgatggcaacccatttagtcatataacggtggaggacaatgtcaagttgtgtattccatttgaggagttggagattaaagaggctatttag

SEQ ID NO: 65091 - DNA, 665 bp, Glycine max
  Peptide Sequence Number=SeqID_156776
atgagcacatctcccatggaggcactcagaagactgggaataattcttgcgggtgtgaaacttgaagttgagaaaaaacatgacccaaaacttggtttgccaagtcaaggagtttcactcacggcctgtaaatacgtgtatgtggtttggggagagggagaaggagacttgaagaaggatgaggatatgtttgatccaccaaacctgtctcagaaaaacgacgatctcggactcgttcaccgttggatcgtcgtgaaatttgagtaccatgttcgcaagaaaaatttggcttattccacaatgtctcaattgggttatatgatggagaaaaaggaatctcatgaagacagtacaagtggaggcttcaatctcttctccgtctctctgacatttgggaattctattggaacagtcggaggaataactgaaggaatctcagggaaccgctatagatgttactatcgctggctgaagacacgtgagtccgctcagagggagaaaaaggaatctcatgaagacagtacaagtggaggcttcaatctcttctccgtctctctgacatttgggaattctattggaacagtcggaggaataactgaaggaatctcagggaaccgctatagatgttactatcgctggctgaagacacgtgagtccgctcagag

SEQ ID NO: 65092 - DNA, 153 bp, Glycine max
  Peptide Sequence Number=SeqID_156777
atgggggagggatgttgtacgcagccttacccttgcatattcaaagaggctgtttccggattcgaacccatgaccaacaagtcaccaagagaggtgacagcatggtggatcagcaatgctgtgcctcttcaagtcaatgcaatcttgtcataa

SEQ ID NO: 65093 - DNA, 1063 bp, Glycine max
  Peptide Sequence Number=SeqID_156778
atggcctctaggaagagaaaagccacaacatctcggccccaagagccctatgacaccaccaggttcacatctgagggcgcttgggatcgatattcacagaacattcactcctgaaacatcctttcgaagaggaatgcggaactggcacaaggccttgacccagcatatggacggacacattgatgtggccctggtcaaggagttctacccgaaactgtatgatccagaagataaatctccaaaacagccaggggagcacctcacagcttattctagattttgccgaacgcgcactgatcctcaggagcttgcctccaagctttgtattccagggcgtggagtgtgctttcatactccaacctcgccccccacctctcacacgtttgaccttactatggacagggcgaggctcgactttccaaccctcattactgcactctgcgtggctcgaggagtagtttcagattctctgacttttgagtccctcagccctgccattaatttgacttacataaagaagaactgctggaacctggacgatcccacgatcgtatttccagggacccgcaaggctagggctaggggaccatcagaggcatccacaacatccccctcttctgctcctgcttctacatcagcttcccttacttctcttccaccatcatcagttccagcacctgccgacacctccgctctgagctttgatgtcacagtgccgatgttgcagagcctccaccatggcttatgcctggtggcctggccaggagtccagccttctcctttggggggaggtgaggcttccgcagcccaggagcctcaatcggaggtcgcacacgaggccacgccagagacgactccacaggtttcacctgctatttcacctgttgtggaggtctttgaggatgaagaaggcgcagaggacacaaactatgcagcagatttacaggcgacacagagtacttgggatccctggcctacagctgcacaggagacacctcagccagcccaggatactccttcttcacctcatggcgagcagacatcaccacaggaggagctttga

SEQ ID NO: 65094 - DNA, 366 bp, Glycine max
  Peptide Sequence Number=SeqID_156779
atgatagatgcagagtgccaagataatctggttttcgaggaaccaatgccttcagagaaaagaaaagagaagagaaggaaagaatttgtccttttgtgctatagaatattagaattagttattcttgtctcctcattcctcaacatcaaatcccacaacatcattccttcaagatcaggattcctcaaacgtaatctagcaggccttgcaatcttcctcttaattatgcttgctatatgcacctctgtttctgcttattttgcatctgctagttgcacccctgtgtctgttgtgctatcatcagtatcaactgtatcattctctggcccatcaaaaacaccttatcctcaaggtgttgggctttaa

SEQ ID NO: 65095 - DNA, 498 bp, Glycine max
  Peptide Sequence Number=SeqID_156780
atgactagaggcaatccatctgacctacaaccctttgatcctgagatagataggacatttcatagattatttaggcatcattatgtaccttttgagcatcctgagcattctgttattggtgagactgagcattttgtggttgataattttgaacatcctgactttgagcattatagttttgaacattctgattttgaacgttctaagaacatggcacaacctccaccccatgagaggactctaagggaaatggctgcacctgatttcacctacgaaagcttgtgcatccaataccctgatgaggatgtcccatatgttcttaaaactggactgatccattggcttccaaagtttcatggccttgcaggtgaagacccgcacaaacatctgaaagaattccatattgtctgctccaccatgaaacccccagatgtccaggaggatcatatatttccgaaggcctttccttattctttagagggagtggcaaaggactga

SEQ ID NO: 65096 - DNA, 849 bp, Glycine max
  Peptide Sequence Number=SeqID_156781
atgattaatcaagcatcaattgttgcattgaaccaaaggtggtcagttgttttccaaggaagaaacatgcatggaagtgacaaaaatcaagattcaactcttgatattcctgagactcatattctcttaacacaaacacctaatttgattcaatttgatgaagtttatggtgtctatgccactcgagatgataatgatgaagagatgtgggagaacattcatgctgacaagagaaaagaaaaaaaagagcaaaaggttcaggcacataatctctaccttcacacattgtctcgtgggggctatgataggcttcgactgaagataatgcaagataagatgaaagtatgggcattaggaaatactttggactacctacccgtcatggctttacctcaacaactatcaccgatagtaaatcgtgtgagcacaagatggagttttgttgatgttgatccattaggagaagacaattatattaatatacataacttgtgtgagctatacattgatgttgatcctctcattttagtaccaattggaaatgtgtacaatttgggattaaccatacaacacaagaaaataaaggatgatagtgtgagtattgtgatggaagaggttaaagattcaaatgctcaagttcctttccctaccgatgaggtgcaaacaatggggcatgcccctaatcatttcattcagtggccaagaaaacttgtcaagtctatttcgactaagattatggagcaatgttgcaaagatattcaacacaaaaagttggaacctaaacttgattcacttgaacatttattgatggtagcaagccaaaataaggatcctatacaactacattag

SEQ ID NO: 65097 - DNA, 1005 bp, Glycine max
  Peptide Sequence Number=SeqID_156782
atggtggaggataaggagagggcgacattaaggctccccttaaaatcaaagttgaggactcccttggaatcctgcgttgggattgaagagatcgtggttgtggtcatggtcggcgtagtcaacgacattgtccttggcgaggaagtcctcgagagtcatcatcttgttgtcaccatcatctatgtcgttgacctcgtcgccaccattctctgggagcaagaaggagtccaacaaagggtcgtcgatatatggttgaaaagaggagttagggttgaagaaggggaaaagatgaattggagaagggagcgagaaaatctctctcacctttcccatgttatgctcccatctctgacaaacaaaaaacctaagggaaccaccatcacactggccaaggccaagaaggctgaggcccaggccgtggcggtcgagccccaaagttttcccaacctcaaggaggctttgaactccaagcccaagaagaagaagggaaccaccatcacgctttccgagttcaatcatggtggtttcagccagggccttatgtgtgacgagatgctcgcccttcccaccggtcccaaggagcattccaccgaagaaatgcagttcaaccccttggcggtggtttctcctcctatgaccgctctggtggtcgctcacgcgactgcagcaataacgaaggttcgtgggggcaaaggaggcagaagatcgtacggaggattcaacgaggagcgcaagggtccgaatcctagagtttcggtcctggtttttgcaatttcggagtggagcctgatcgatggacgagaggcggtccaccgcggatggtattccttggacactgttattgcagctgaatctttggctctgatcctacaagcatttggcgatacaaaagattcaaaagagcttcttgaaagatgtcttaatgtccggaaggacttacttcctgatgaccatattcagagtaggtgcaaacttacttcatctagcaagagtggcaatgcttga

SEQ ID NO: 65098 - DNA, 783 bp, Glycine max
  Peptide Sequence Number=SeqID_156783
atggaagacataggtggtggccgtagaccacctaatcgtggtggcgagggtcgtggtgttggtggaagcgctccaaccagctttgaatctttcacttattccattcatatcttgacatcagagacaacagattacttacacctgagttatccacctactttaatgcttgaacatccaaatgatcagaggtcatggcttcatgcagaaaagagaaaagtcatctcaaatatcatcaagcgaaaatttgatgaaccgagtccgacttggaagaaagttgatgtagcctcatgtagagcttgtaggccttggatcttcttcatcaatggagacctttgcttcttgaagatcaatgacagtggaatgaagaaggaggaaagtctcctagtcatgactctagtgatgggtcccttccttggaaggatttcatcaaaagtaccacttgagaaagagtataggtgggatccacagcaagagcaagtaatcaagtctatttttgggacaaagttatgcaagtttcaagaacaagagctccattgccaaggcaaatcgactgttgatagtggagcctcaacatactgcgatggctccatatcgactgcaacttactatgagaaattgactgatgagtatcaacgggcactgactacttgggaggtagtgaagagaacgaagaagttgaaaactgaagcatgggccaatgacaagactaaagatctttttatttcaaaaatgtcaagaagagttgcgacaatgagctacgacagaaggcacacctacacatga

SEQ ID NO: 65099 - DNA, 140 bp, Glycine max
  Peptide Sequence Number=SeqID_156784
cgtgatgtcgtgacatccggtacgacatctgtcatcggtatcagaatttcactttgtaaaacttcttttacagagtctgaaccacacaggaataactcttcccttgtgttcaggaatccttacaacttaagagaccgaag

SEQ ID NO: 65100 - DNA, 1335 bp, Glycine max
  Peptide Sequence Number=SeqID_156785
tggcgtctccaatcatctttcttccttctccattctgcttccattgatattaaagaagcaaaagactccattgatgaagaagatccaaggcctacaagctccacatggagctacatcaagagctcccttgaattttgtcttcaagccaacattactttggccaaaggaaattcaaacttgaaggagcatgttttggttcttgaggtcgagatgaaggccttggagacacgtgttcttgatgttgaggcttcgattaagaccaataaggaggaagtggatagtggggagccgactaccccttttggcgaaacccaaatgaccaacctcagaaaggaggatggagacaaggatgatgaggaggacataaagagattccttatggatttccattgcaatgggatttttccaaaggggtgtaatgcctcttttatgtcacttattccaaaggtggaggatccacaaggacttggtgattaccggcctatatctcttcttggatttgggggtaaattgattggttggattaggcaatgccttgtttctacacatatctcggtgcttgtatgggggttctatgaaggaatttttccacaaagaggtctaagacaaggtgatcctttggtgccttttcttgtcacaattatagtgaaaggattgagtggtatgatgagagagataatctttaaagacatgtttgagggatttcttgtggggaactcctttggtggtattggagtaggaaaagaacaacttgagaaatttgtggatatactgaattgtagattgatgccacttccttttacctacttggattttcctattggtaccaatcttaggaagagagatatgtgggagcctattgtgttgaatgagggtgggctttgtttaatgatcatgattcctcatggaaggaaatccttgcatcaaagtatgatgggtggatggggcttgatggagaggtggataagtttgcttcattacggtggagagacgagagataagtgtgtggtgaggagtgcgtggataggtggttctaaagattggggatgtcgattgttggaccaacctatggataagttacaatcttgtaatttcgtacaaggtgagcgtgatttttggttgtggccctatgataattcttgcttattctcggtaacgtcggcatctgcaacactccatgatcttaggatggggtctgaagtggatgagattctgagaagggtttgggacttggaaattccactaaagacacaattcatgatgttgaggcttcttcttgatcggctccctacaaaggaggtgggagatgtagaagcaaggcttcatggtgaatga

SEQ ID NO: 65101 - DNA, 366 bp, Glycine max
  Peptide Sequence Number=SeqID_156786
atgcaggctatattatccatttttcaaaatgtcagtgcatcaactgagtcatctgattttgagtctatgggaatacttgcgaagagcgggagccatcttattggtgagagtgtagacaacgatcagactgacgaagcggtcaagatcgtagtgggtgatgccggtgtgcatcatttcaacggcacaagatgggaggctgaaggtcatgggccaaataaagtcgcaacgagcccaattcatcagaccgtcaaccttcaacatcacgaactttgccagcttcgacacgttggtaggaaaggaagcacaacaagatggaaagggaaatgtgagaggagagagctgcgcagagagagtgagaaagcatga

SEQ ID NO: 65102 - DNA, 411 bp, Glycine max
  Peptide Sequence Number=SeqID_156787
atggatgatgcccttttctttgtagagaaatctattcaaaacatcatgtgtttgaaggctatgctgagatgttttgagcttgctttaggattgtgggtaaagaggatatcggggtatgacttagcatggtggaaagaccctgttgttgtttgtggggttgggagggactcatggtttgacaaaaatgttgcttggaagggtacacatgaattcggagaaaaagagatgtgggtaggggaaatggggtcatgggataatggggtttggtctaaggagctagtatggaagaggccttggtttacatgggaactccctatggtggaatctttcatggctgatcttcataggatctctagggaccatcaagagatggattgtttggtgtggaaaactgcatcaataggtccttga

SEQ ID NO: 65103 - DNA, 270 bp, Glycine max
  Peptide Sequence Number=SeqID_156788
atgacgaatatggtggctcaaaggtggatatggcaattccaaatatttccaccctttggtgaatatgaggaggctgaggagtggggtaaaaggggtgatggtggatggacaatgggtggaggactcggggatagtgaaaatttattgaccgaggaggggaatagtgctctttgtgcgagatttagtaaagagaaggtgtgggattgtggtggtgataaaagtccggaccaggcaatttcaacttcaattttatcaagaaacattgggtaa

SEQ ID NO: 65104 - DNA, 453 bp, Glycine max
  Peptide Sequence Number=SeqID_156789
atgtctaaatatgaccctgaagcaaatgcctggcctattgaggaaggtgttatcgataagcactccaaagtgcggggccaatggattccttatgacatagatgccatcaaccaatttttagggaatccattgatcttagaggaggggcaacaatgtgaatacacggcaagaagaggtcagactacaggttttgatgaagaagctatagatgttatccatcagtttattggtactgaacctcctaggcacccagtggacccaaaaaagtccaacaaggcattgcaatttcctgcctcagttatagtcactgttgcatggcctaaagacatgcctatttttcaaaaggaggtaggacctgcagatgctcaaggagctgcccaaggagatggaggaagagctgaggaagatgaagacatggcagatttggttgattatttcattggaggagactga

SEQ ID NO: 65105 - DNA, 1499 bp, Glycine max
  Peptide Sequence Number=SeqID_156790
atggggttgtgggatgatgagagagtgcttttctttcaaaagatgaaaatgtttatagagttttcggtcgaagccttggaagtggatttcgaaatttcgggaatgattataaggttttggtgtctcctggatctcgtagtttttctgtggcttggatcgtaccaagagaccatagttgaagaagcaacattgggagttggtgataatggctttcccagatgtaactgtgatgatgagtccagcttgtggactattgagaccattttggagtgccagagaattggtgattttctgattgctgtggcctacttctccatccccattgagctactttactttgttagttgctcaaacttccctttcaaatgggtcctctttcagttcattgctttcattgtactttgtggaatgacacatttgttgaatgggtggacttatggtccccacacttttcaactcatggtggcactcactgtcttcaaaatcctcactgccttggtgtcatgtgcaactaccattaccctcctcaccttgatccctatgctgttgaaagtgaaggttagagaattgatgctaaagaaaaagacttgggatcttgggagggaggttggaatcataatgaaacagaaggaggctgcaatgcatgtgaggatgctcactcaggagattcgcaagtcgttggataggcataagattctctacaccaccttggttgagctgtctaagacacttggtttgcagaattgtgcagtgtggatgccaaatgttgagaaaaccgagatgaaccttacgcatgaattgaatgggaggaatgttaactgttctatacccattactaatccggatgttgtgagaattaagggaagtgacgaagtgaacataattgattctgattcaatacttgccactgctagcagtggagtttatggtggggcaggaccagttgctgccatccgcatgccgatgcttcaggtttgcaatttcaaagggggaacgccagagctaaggcagacgtgttatgccatattggttttgactcttcctagtgcggagcctagatcatggggcgctcaagagctggagatcattaaggtggttgctgatcaggtggctgtggctctgtctcatgcctcgattctcgaagagtctcagctcatgagggaaaagttggaggagcaaaatcgagctttgcaaatggaaaagatgaatacaatgatggcgagccaggcgagagcttcgtttcagaaggtcacgagtaatggaatgagaaggccaatgcactcaattttggggttgctttcgatgatgcaagatgataatttgaagagtgaacagaaacttattgtgaattcaatgctaaggaccagcactgtcttgtcaaacttgataaatgatgccatggactactcaactagggatgatggaagattccctttggagatgaaaccttttggattgcatgctatggtgaaagaggcagcttgtcttgccaagtgcat

SEQ ID NO: 65106 - DNA, 537 bp, Glycine max
  Peptide Sequence Number=SeqID_156791
atgcaatcacagggactcgcactgcctcctgagtctaaagttggtctttcagctgctcgtgtcagcataaaggagagttatgttaatcctttagggaatgacccagacacgagtgactcagagaaatccaggttgtatgtcgaagaaaattctcccttcctagttgccctaggaagactttatgaggggtcaacaaccgttcacaacatccctttatgcaatgatcaagtcaagggagttgtgggaccggcgaaacctgtagataggtcggatcatgatgtcaatgatcctctatatttgatgacattgaccatcccacaactttttctaaattcattgcaggttatgtgggatgctaccgtgtttggggtgtttggtcaatgtctcagcatctttgttatacaattgtggattctgcatatgattgagacaagtatgcgagcagggaatgccggtgtgtatggattcctcgagccactgtccatacagagatctgggcaattacaatttgaatcagaaagttacattaagaactag

SEQ ID NO: 65107 - DNA, 555 bp, Glycine max
  Peptide Sequence Number=SeqID_156792
atgaggatccctaagtatttggacttggaatggttctctcaacaaggaggaatgcttcttgacccagctaggaacttgaggaatcgcttaggagttggtggactgactgtagaagacaaaatgttggtttacctcattacctacattcttactccaaggtcaagcaatcatgctcaggtaacaaatgatgatctacaaattgtttatggtttgaaatcaagtatcaacatgaattgggtactcctaattgaagacattatgctaaagagtcgtcgcctggtggattacgaatatccttatgttgtgcttgcctcaagattaattgactacttcaatgatgatgtctctaatgagattgtggattttaccaaagtggctagtgagattatcaaaaggcatctcaagaagcttggaatgaggtttgttgatcatgaatggataatggctggagagccgacaattggaaactttgaccaaatggaagaagatgataaagctgaagctccacaagagcttgcacatcaatggagtccttttaagtcacttatgatttag

SEQ ID NO: 65108 - DNA, 153 bp, Glycine max
  Peptide Sequence Number=SeqID_156793
atggaggttggggaatctttgataggcttacgactaccattacattatcgagcagatacgggacaggtggattttgtggccaatttaatggtggtctttgtggatgattgggcgttcttggttggtagggtggtgagtaatgggaaggactga

SEQ ID NO: 65109 - DNA, 483 bp, Glycine max
  Peptide Sequence Number=SeqID_156794
atggaggccatgaaggaacagatgacaacgatgatggaagcaatgatgagcatgaggaagatgatggatgataacactgctacagttgttgctacgagtactgctactaagatagacctgattcacctgaccggtttcaatatagtgaatcttccagtctcagatgtagttggtcaaggaggcgaggcagcgaaaaatgcatgtgggcctcatcatgttcaggttcaaagcaagcattccttcccaccatatgggttgcctcctagttatacaccgcccactattgtatacacttctggtgagaatatcagcaattctgcacccgtactcattgagaatcagcaaccccaatttgatcatgcacatgtctctcaacccatggggaaacacatgaagttccccaagaccatactctggctgggtttggggtttatccaagatataccactgaagggcaggcattttctagcatcgttgtgctga

SEQ ID NO: 65110 - DNA, 183 bp, Glycine max
  Peptide Sequence Number=SeqID_156795
atggggaatctttacagagacggaggggtgcagagcaagagcgtggcaatgattggccctgaccccaaagctgcagcgagtagttgtcgcaacctacccttcggcgggagggcgacgcgtgactcgcgggatgcgtgttccacgaaaggaatacgcgcggagtcgccaccaacgtttatttga

SEQ ID NO: 65111 - DNA, 273 bp, Glycine max
  Peptide Sequence Number=SeqID_156796
atgttccagagatggcctccaggaagaggaaagtcacaacatcccagccataggagccctatgataccactagattcaactctgagggggtctgggaacctgatcaagcggaactggcacaaggccttgacccaattcatggacgggcacattgatgtggccctggtcaaggagttttactcgaacctgttgtgcacggatccttatgagcttgcctccaagctttgtattccaagctacagatttgttcttagtgctgaaggagctccttga

SEQ ID NO: 65112 - DNA, 159 bp, Glycine max
  Peptide Sequence Number=SeqID_156797
atgtgggaagagaaagagatattggaaacaagtgacagagaagttgaagaggggtcttgttgtgacagtaaggataatgatagtttgaagaagtcttctggatcacgagaccaaaagaatgatgatgaggttctattctctgatatgcgcattgcataa

SEQ ID NO: 65113 - DNA, 342 bp, Glycine max
  Peptide Sequence Number=SeqID_156798
atgaagactatgtatagggcatttgatgagttagtagggattaaagtggcttggaatcaagttaagcttggtgatgtctttcactcaccagagcaactccagcgcctttattcaaaggttcatctccttaagcacctcaaccatgactctatgatgatcttctatggttctttgatcgatgtcaacaacataacctttaacttcgtcactgaattgttcacctccgacacccttagagagtgtaggcagaagtacaagagagttgatatcagaccagttaagaattggactcgccagattctaagtggtttagagtatttacatagccatatcctcccttga

SEQ ID NO: 65114 - DNA, 435 bp, Glycine max
  Peptide Sequence Number=SeqID_156799
atggcttgtcttgtcaagctgtctctatccctttttgatcttcaagttggtatcagagccagttctccggccaccatcgtcgccgctgctgtccgccgccgtccgtcgccgccgccgccttccgtcgccgccgccgccatccgtcgctgtcgccgtcaaattcgccgacgagttcagggttttgtgcgtctcgaggagcgcgacacaaccccgcaaaccgcgtggcgagattcgccgccacgcgccgctctacaacagcgcctcttcccggcgcgtgaagcccacgcgtcgacctccggccaccggaatcgcaccggacttgtctcaaaaggagcgccgtcttcccttgtcttcgttccagcctcgggtgcagtgtttacgtgttattttgtgcttcctcctctctactccgttaggttttttgtttttccttga

SEQ ID NO: 65115 - DNA, 225 bp, Glycine max
  Peptide Sequence Number=SeqID_156800
atgaatgagtatgaaaagagtacgaaggaacctgatacttataatgtagaacctcagcagcaggcatacacagccacaactcctactccaacagacattgaggctgcaatggacaccctcaatattacttctccggatccgaattggtatatggacaccggtgccacctctcatatgatgtccacctcaggattttcagacagggatgcctctaatgaggtgtga

SEQ ID NO: 65116 - DNA, 228 bp, Glycine max
  Peptide Sequence Number=SeqID_156801
atggacacccgtctccatgtgattggtgatcccatgaatggaattcaacggatacctcttaatgaatccgatgacaattattgtaggggtgggggtcacaacccactctttgaggattcacctagtgagtgtggtggtggggccgccactatgagatatgggctaatctctaagggacactcacgaaacaagatacaagcgcaaggccgtgtaacgcactatcactga

SEQ ID NO: 65117 - DNA, 423 bp, Glycine max
  Peptide Sequence Number=SeqID_156802
atggttgtggcgcttgaatccaagaacaaagaccattttctttttggcacacttccttgtcctccaccaacagatccaatgcatgaagcttggcggcgttgcaattgcatgctttttaaatctggaaagatctcaaagatcgattttcacattctgataagtttcgcattgatgatcttcaagatcaaatccaaaattgttcctagtaattctggtaaaggacctaaaggcaataagctttgtactcattgtggaaaaaccaaccatactattgaaacatgctttttcaagcatggatttcttgttggatataggaatcatggtaaaggaggctcttcaaatttcaagtcttctgctagcatggctgaagtagattttgatataacttcacaaattgttgctttggaggatagttcaacctaa

SEQ ID NO: 65118 - DNA, 1101 bp, Glycine max
  Peptide Sequence Number=SeqID_156803
atggatagcatagcaagaaaatggagagatcttagtggccaaagtaactggcaaggtctgctagattctctagacatagaccttcgccgttacatactacactatggacaacttgctcaggcaacatacgatgccttcaactcggagaatgggaattgtcgatatcctatgagtgatttcttttccaaagttggtttggaaaatgggaatcctttcaagtatgttgtgaccaagttcctatatgcaacttcccaaaccagtgcccctagagcgtgtatcttgaacttgttttcgaagaaagaatggaacacgcgaacaaattggatagggtatgttgctgttgccactgatgaagggaaagaagcattggggaggagggacatagtggttacttggagaggaacaattcaggcctctgaatgggttgataatttaaatttcgatttggatcctgcgccagaaatgtttgctgttgattctcctttccaagtacacgatggcttttactccatgtacacctcaaataacccggaggatgtacaattcggtcttaccagtgttagaaaccaggtacaagaagaggttaaaagacttgtggaggaatataagaacgaagaaataagcataactgtgactgggcacagcttaggtgctgcactagcaactttaagtgcactggacatagttgcccaaaagtggaacatatcaaaagaccaacaaccttcgaaagcgtgtccagtgacagcatttttattcgctagtcctcgtgttggaaactctcactttgggaagatcttcaacgaatacaaagataagaacttgcgagcattgcgtattcgtaataaaaaagataatgtcccaaaagttccgtttagactctttccttggggcttcacgcatgtgggggaagagttagtgatcgacactagaaaatcagagttcttgaagagtgatgctagttcgcatagtttggaggtgtacctgcacggaattgctggaacaaaagagaaaaaatcagatggtacttggccaattatggatcaaattcatgatgatgttcaggccatacatgttgaaacaggtctagctcaggcggcctga

SEQ ID NO: 65119 - DNA, 879 bp, Glycine max
  Peptide Sequence Number=SeqID_156804
atgaaagtgatgaagaaggggaaaagaccctcacatagtggggaaaagaagaagaataagaggaacagggaacaaaaccctgatgttgagataattgttgccacgcagaacggtaacgtggatagtgccaatggaatgcatgttagagaggcaaaaaaggagaaaacttccatcaacaaaaagagaaagagcaaggacaagaatctagttaggaaacgaaaaccgaaaggccaagaggttgatttggatgagcaaagtgatggagtagtggacaatcctcattctaaagctgaggagatccaagggttagatgggcacatagattctgattctggagcagctatcaaaccatgtaggtcaaagaaagacaagaagaaaagaaaggaggttcaagattcaccggaaaaggagggagaagggtgcaatcaggaggaagtttatattatttcctctgttgatgatgactgctcaaaaggaatgaaaaaatggattatggaataccatcaaagcagaccaggattggatgtattgcaaaatcaaatcgatgactttataactgctcaagaggtgaaactggaagaggaaagaaaagaaaaagaagcccttgctgcagaaggggggtggacagttgttgtgcaccataagggtagaaagaaaactactgattctgagagtggaattgcagtgggctctgttgctcaagctgctgtagagaataaaatgaccaaaaagaaacataaagaagttggtcaagatttctatcgctttcaaagaagagaagcacagagaaatgaaatcatgacactgcagagcaaatttgaggaggataaaaaacgtctgcagcagatgagagctgccaggaaatttagaccttattag

SEQ ID NO: 65120 - DNA, 2487 bp, Glycine max
  Peptide Sequence Number=SeqID_156805
atggcagaacagaacaaggaatcctcagcttcagatccaaaggagaaaaaatcatcgctagatgatgaaattggaaatgaatttcttggctcctggaaatccatgtcaatggcagatgatgatgcaatggactttagctttgacactgtttctaaaggcaagaagaagacatttgactttgaaaaactggacatgaattttaatctggatggtgaattcgacaagatatcatcatttaagttggacatgtcagatcttgattttacatgcccacctaagaagaattcccagtctaaggataagaaaggcgaagtatctggtgcaaaagctgggaagcaagatgggtttaatttcagctttgattttaatgagttggatagcttcaatcttcattcaagcttcatgaaagaagatactacctccaacagtagcccaaaaaaaaagggagtaactactgaaggaagtgataaaggtggtaaaatgcctaaaaccaatgatgatgaaggtgctcatgcatctaatgatagcacggctgtgaaatcccatgcatcagagaggctggaaactttgaaggttgagactatggttggtatcccagggaatctagtttccaaacaggatggttctgtttccaaaatttcatcctctgggaatcttgacatgccaatggagaatcaaactttagatacaaataaacataaaagtacagaagaaattgatcaagaaagagacttaccagagaagacaaagttaacagaatcaaaatctgagcaggttatcaatatggcatgttctcagtcagtaggtcagagtgattcagaccagcacactatctcagaccagcatacaaatgttttttcatctggaacaagagtcagtaatgtttcaggagataaacaagaggttaacgataagacaacatatcagtgtaaaaaaatgttttcttctggaacaagagaaattaatgtttcgggtgacatacaagaggttaatgataaggcaacaaacatgaaatctgatagtgtagacttacaattagtgcattcctccccacatcacatcactaagtcagatagcagtgttggagaaccaattactctaggtagcagtacccaagaagttactaatgacccacagccagaaaagaggaatacaagttgtgaaaatattaataaaactgatgccttgaagaagatttcatgtgacaatggcaacagagaaaacaaaaatacaacttcagtgtgtcatttggctcccgcaaacagtaaacctgtagttgaaaaaatgatgctgatgaaagataaaaaactccaagatatgcagtcaaatatgttcagcacgccagagggcaaaaggtctttaaaacaaccttcatcaacagttgggacaaagggttgctcccttggcaacaaaaaaaatgctgaaatgctcctcggacccatcactcaagcacgggagaacttcaggtcaaatgatacaagacttggaagcaaattggtaggtgattccctcacatattccagcaaattaacgagggatgcagcagctttgcttggtagtaaagataatcttataagtagtagaaataccagggagggcaatgtttctgatgctacaacatgttcaggaaaattggctggaaataagaaatcattttctgatgaagtaaataaaggcaagaccacgtttctagaaatcggcatgtcaactaaagatgttagtatgtcaagttctcaagttaatccttcctgcttaacagagaagactgctagaattactacccaggtatctgcaaattctcaacctgaagcttcaggcaaggagtcctatcagaaatcaaagattgcttccatagaaggaaataaactttcttcttttaaaaattgcaagatcactcctgctctttcaagcttaaaaacttccaggaactttggagctaacagggttctaacaactttaaaccaaaaagaaacaaactccttagtaagctctggccaaagcatggacatacagggtattacagcatcaaagaatgaccatcctattgacagtggtgacaatcagaagccttcaaccccattcttgaagaggaaaactactgaggcttctgaagctgattttcaatcgttgaggcccctaaagcgcatctcccagtctcctatttcttatattggtacttctggacaagtaacaattcttaactgcagaaattctaaagaatcttcagaagaatttgttggagaggtagagagtatgcccaacaatttactctacaatcattcaacctctggacttacaagtccaccagcaattaaagtgacggaagtggaaatacctgattctatactcatggaagataacagcaatgttgaaaaggctgaagcgtatatgaaagaacttgaagatcactgtataagatattttgaagtaagtgtatcacatgagagatgggagtatgagagcaacaaatctcaactgtataattaa

SEQ ID NO: 65121 - DNA, 243 bp, Glycine max
  Peptide Sequence Number=SeqID_156806
atgaagacaaaatttatctctacgcacgattcaagaatcgcttgtttcactctcacacttaatgcgcaattactcgccaccgccagcaccaagggtactctgattcatattttcaagacaaatcatggctcctttcttcgggaactgagaagggatgcgaaattgcgaatgctattgacagtgctgagatctatagttggcaagtactacaagcgatctagtgtggatgatgcacgttattag

SEQ ID NO: 65122 - DNA, 129 bp, Glycine max
  Peptide Sequence Number=SeqID_156807
atggacgaagatcaattgacatattacagtgtgatgtccaaagaagttgatatggattttcaagatgaacaagattgtggtgtgaatgaaggacatgttgattgttcagatgtttttaatacttctcag

SEQ ID NO: 65123 - DNA, 1992 bp, Glycine max
  Peptide Sequence Number=SeqID_156808
atgtctgatcctgccgaagaggctgctttcatcgagaagctctacgaatacggcgagcaactcaacaatgccaaggacaagtcgcagaatgtgcaggattaccagggaatcatagatgcggcgaagacgagtgtgaaggcgaagcagctcgctgcacagctgattcccaggttctacaagttctttcctgacctttctagccctgctctcgatgcacatcttgatttggttgaggctgaagaactcgggccttgtggttcagggttgtgttggttcgtcaggctaaaagctaaattaataagggaagttgaactgaagagagttagtgagggatacacaggaaggaaaatagtgccatttgttgagattaaacgagacattgggaactgggaagttcgagtgcaagcaattagaggtctgcctcttttttgtaaggatacacctgagaatattgggaagatggttgatattcttgtgcaaattcttgggtctgaggaatttgtggagcgtgatgcagtacataaggctcttatgtctttgctgaggcaggatgtcaaagatattgttggggttaagggtgtgtttggaaatctctttggagccttgtcactggaagttaccactttccaaagccccaaaccttctttgacggctttgtttaagcacattggcagtgttgaagagccaagcacggatgatgttattcgtgagaaagttataaactttgttcgagataaggttttccctatcaaagctgaattgttgaaaccacaggaggaaatggaaagacacataactgatctcattaaaaagagtttagaagatgttactggcatagaatttcgaatgtttatggattttctgaagagtttgagcctatttggagaaaaggctccggctgagcggatgaaagagcttattggaatcattgaagggcaagctgatttagatgcacagttcaatgtatcagatgcagatcatattgaccggttgatatcttgccttcacatggcacttccatttgttgtgcttcctggagaacggaaggtagatttactcagaagccttgcagaattttcaccttatacaacaccacaagactcacgccaaatgcttccttctattgttcagttgctgaagaaatacatgacttggaagaagactggagaagagatgaattttacctatgttgagtgcttgttgtacacatttcatcacttagctcataaggttcctaatgcgacaaatagtttatgtggatataaaattgttactggccagccatctgataggcttggagaggacttttcagagcattataatgattttactgagagcgagaatgagaagacggcgaacgccagacgacggcgccgcgagagaagctgccagaggaaggaacctagaagctgcgagcctgtgacgaagcaagaactagatgacgacggatcagggcatgcccaatcgagcaacggactcgaccttgtccagccaccggggtgtggttggtccaggtttccaaactatggtttgagattgaataatgttgaggagttcacccgggctacaatcaagaaattaactcaaggaatggatgaaaacaacaaatctatggcaggtgctaaaactgatgaagaaaaggaaaaaattaaaactaaaaagcagaatgctacaactgggttgcggacttgcaataacattttgacaatgacaaagccattgcacgccaaagtgccttcttttattggagataagagaatcaatctctcttggaaagaagcaacaaaagcagcatctactgcaccagctgctggagcaaaacggcctgctaatgctgccaatgggtccaacaatattgcatcaaagaaaggtcgaggtgctggtggtttgcaaaatcaactagtcaatagagcgctggaaggattatctggtggtgggagaggagaggaagaggaggagggtatcggtaactttgttgcagatgtgatgtag

SEQ ID NO: 65124 - DNA, 264 bp, Glycine max
  Peptide Sequence Number=SeqID_156809
atggacccaaaactattacatgcactaagaatatattgtccaaactttgatggagactctgacattgttgccccttttgatgccactacccaattcctatttgaccatgcctattatggtaacttgctaaagaagttgggcatgttggcctctgaccaggctttggctttggaaccgcgaaccaagtccattgttcaggatcttgcaaaggacaagcagaagtttattcaggcttttgtgggggctatggacaaattgagctag

SEQ ID NO: 65125 - DNA, 594 bp, Glycine max
  Peptide Sequence Number=SeqID_156810
atgattacttatatatatgctataataagagcattatcaaatccaaccaagctcacacgaagctataggaatataaaccttgaacaagctggtataactccttttgaacttattgaatatcaagccactgattgtttcgacttcgacatacaacaacactttttagacttatttctcgaaaaagttgggtcactcgctattgttggtgtcccactagtggtggacatgaacactactgcgattgatggagaaggtggtagcgcaagggaagacgagaaacaagggtatttaaggaaaggaattaagagaagctttgaagaaagaactacgtcagcattgtcaactgattttgaatttaaattgggagtttcagcgctgcgagaggttgtagtgccggtggtgagggagtttcagagctgcaagaggttgcaaataagagtgagaaagcgttcaagcgagagcaagagtcagaaaggtttcaaaatcgtggttggtcaacgaacgaccaagaggggactaaaaggggaacgcgatcacccaacattgagtgcatatgcacgaggaggcttagggtcattcttagtcgatgaatga

SEQ ID NO: 65126 - DNA, 648 bp, Glycine max
  Peptide Sequence Number=SeqID_156811
atggagattcgtgaggttgggaagaacatgttcactttctgttttttggagagacgagataaagaccagatcctcagaggttaccagtggagctttgagtggaaactgattgtgctcaacgagttggaaaaggaagtcaatccgaaagaggggatgatgatgatgatgacattgagtggctacaatatggagcatggctggggcatccccaatcaatccaaatactattgcggacagaaaacaagaagtggcttatgggagggcacgacaaaaacttgtgcaagagaatgcgcaagagagtccatcaatagtgcaaaatcaagaaaagatcaagctgtcaaaaacaggagagggaggaatagaaggaacatcattagattcggtcttggatgtggttcaattctcggaaggatgcaatatggacagaagtgtacatcgcaaggggaaaggaacactccaactgatagcacggaaattaaccccctgaagaacctgaaaaacacaagtgaacaatcagaagtacagaacctagcatcacaaaagcaaaaagttgatgagtgccctacagagcagataatcagcaccccaaccaaggagttttggcaacctgatcatccaaacagcccagaaaatagcagaatgggatga

SEQ ID NO: 65127 - DNA, 303 bp, Glycine max
  Peptide Sequence Number=SeqID_156812
atgaagaagggaggagaagaaaatgaacaacaacaacatattcaacatcaacaacttgaacgtgctgccagatgccgctacggaggcatcagtgttggtggaggcaatgcctttagacgtggcacatttgagagggagaggaaagggacaaatcgtgtccttgtgtgggttttagtggaaggggaattaggggtggagggaggaaaggatgggggtgggggacgcgatagagagcaaagaaagaggggagggaggagaggcataagggaaggacgagttggcaaagaaaaaagagagaaatag

SEQ ID NO: 65128 - DNA, 1494 bp, Glycine max
  Peptide Sequence Number=SeqID_156813
atggctggtccaataaccagaccggcccggttatgccaccggatcccgattcgagattccattcgggctttattcccagacagggaatgcttcactcttgtgcgacctttgaacaacgaaaatgatctacagcgactggaccagatatcaatggataaattaagaactggatttcgagagggccttgatgctttgacaaagtttgttttcgagagaactaggccaaaacaagttggtgcaactatgatgactggacctgtattggttggtataactgaatcttatctgaaagcgctcaacgaaggtgccgtgcctacaatttcttcctcctggcagagtgttgaagaagctgagtgtcatcgggcatatgattctgctactgatgtttatatgtcttcttttgaccgctcatcgccacctgaggaagttgctttgagggaagcacatgaacaagcaaaacaaaaatcaatggctgcttttaatgctattgccataggagttggttcagccaggaagacatatgaggccctccttcttaaattcttcaaaaaggcatttgaggattataggaaagatgctttcatggaagcagatctgcagtgctctaatgctatacagtctatggaaaagaggctgagggcagcttgtaatgcttctgacgcaaagattgataatgtcgctaaggttcttgatgcccttttatctgaatatgaaaaaactattcaaggtccagggaagtggcaaaaacttgctgtcttcttacaacaaagttttgaaggccctgtgcttgaccttgtcaagaggctaatagcaaccgtcgaatcagagaagaggtctcatgctttacaatgccggtccattgaagaaaaggtggaccttctgacaaaacggctggaagccactgaaggtgaaaaatcgaactacattaagcgatacgaggatgccatcaatgataagaagaaactcatggatgaatataagaattgcataactgacctgcaagctaatcgtcgctcactggacgagaggtactctagtttattgaaaacacttgactctaccaagcaggaatccatggattggaaaagaaaatatgagcaagtcttatcgaggcagaaagctgaagaagatcaagctagttctgaaatagcagccctcaagtcccggagtggtgctgctgaagcaaggttggcagcagcaaaggaacaagctcagtctgctcaagaggaggcagaggagtggaagcggaagtatgatatcgcccggagagaagcacaatctgctttgcagaaagcagctaatgtgcaggagcgcacaaacaagcagacacaattgagggaagatgctttaagagaagaattttctggaactttggctgaaaaagaagatgaaataaaagagaaaactgcaaaaattgagcatgctgagaagtgtttaacaaccctgaatttagagttgaagtggtgccggccatgcacttggatggaggcctga

SEQ ID NO: 65129 - DNA, 987 bp, Glycine max
  Peptide Sequence Number=SeqID_156814
aaagagatgacatggtgcaatgactcagatgaggagaggggaattgatcaactggttgcaccaacaattactcctacttcaactaataacactactgttcttactgatcatcgcacaaaagcaagcgaaattcgcaccttaacttgcccctcatgtggccaaaacattgaattccaagaccagactggaatcaatgacttgccggggttaccagctggggtgaagtttgatccgaatgaccaagagatattagagcatttggaagcaaaggtactgtctgacgtgccaaagcttcatccacttattgatgagttcataccaacgcttgaaggagagaatgggatctgttatacgcatccagaaaagcttccaggtgtaagaaaagatggacaaatccgccacttctttcacaggccatctaaagcatacacaacaggaacaaggaaaagaagaaaggttcacaccgacgaagaaggaagcgagacaaggtggcacaaaacaggaaaaactagacccgtttttgttggtggtgctgtgaaggggttcaagaaaatcctagtcctctacaccaactatggaaggcaaaagaagcctgagaagaccaattgggtgatgcatcaataccaccttggcactagcgaagaagagaaagatggagaattggtggtttcaaaggttttctaccaaacacaacctcgacaatgtggtaattccattataaagcaggatctttatgatgaagaaagattgatgactaaccaaagtgtccataatgatgatgacaacaatataatacctagaaataataatgcaagtgctcttatggactactacaatccttctttcataaattatgaccaattgggtggtcgtagtaatagggaaaattcacctcaacttattccaaatttggtcatgcaaggtgatagctcttctttcattcgattagcaatggatgcaaccaaagccaagatggacagaaaatag

SEQ ID NO: 65130 - DNA, 264 bp, Glycine max
  Peptide Sequence Number=SeqID_156815
atggccactcctatgagcactgcttgctatatggataaagataaaaccggtcagtcaatagacataaagaaatatagagtctgttgcctacgtccagtccccaagaaactcacttgggagttccactatctcgcaaatcctttacactttctgaaacacacaaggacagccattcctttgtgttcagatgctttacgacaagagactctcagtctcttagcccttttattagaaagagaagaaggagaagatgacctctcttga

SEQ ID NO: 65131 - DNA, 99 bp, Glycine max
  Peptide Sequence Number=SeqID_156816
atggcgcagaaccgtagcgcggtcgcagatgcgttgaacctcttcgagacgatggctgatataaagcacggaacggccttcggccggggatcctctaga

SEQ ID NO: 65132 - DNA, 462 bp, Glycine max
  Peptide Sequence Number=SeqID_156817
atggggctaaaggcagaaatcaatcaaggtaaaacaataacacggccacagtttgccgtgcaatattgtttcctactttcagtaaatattggatgcttaatctaccctgagggagttcgagttagctcgcctgggcgatcaacccctgcacgagatgggttaaaagagggggaggggaacgttttcttcacccaaaactcccccccccccccgccccactttcaaaaaacgcaaagccacgagacttgctgtttttgcgcccccaagccacctttggtttcattttgcttccatttttgcacttttgctcactctctacaagggatggctgtaggcctattctatattctgaaatgcatgggcatgttgcattgcccccgtgcctcattttttcatgtccaaccatgcgcccaccaagtgttcggtgaaatgcctcaatggcatttgcgcatgattttgtga

SEQ ID NO: 65133 - DNA, 833 bp, Glycine max
  Peptide Sequence Number=SeqID_156818
atggcgctttgcatttcgactgattgcaaatacatggacgccaaatgcggcgattcatacactccgcctgcgcgtcatcccgcgcccgcttgcgcggcccggcaaacgcgccgcgcggcggcgggatgccgcgttgtgcgagcctgccgccgcgctgtcgatccgacgttgccggtacgcccgctttacctcatcttgaaaagcgtggcgcagcatgttcgattggtttcgacgcaagtggttcgggtggtccgcggagcagacgcgcgtgtgccgagctttccgcgggatacgggagcgccggaccggcgtggcggtgccgccaccggcgtggtggtcgcgttcttcacgcgcgacagcatctacgagacggaaaagaaccgtctgctgcgatcggcgcaaagattgggactggccgtcgacgccgagccgatcgaatccaccgggtcctgggtgcgcaatgcgtccatgaagccgtcggtgctggttgccatgcgccgcaagcacgcgggccccatgttgtacgtcgacgtggacgcggtatttcatcgcgacccgtggccggcgctggccgcgatggactgcgatatcgccgcctactacgagccgcaggggcatctgctgagcggcacgctgttcatcaaccatacgccggccgccaccgcgttgttgcaagcctgggcgcaggcttgcgcggagaatccggatgaatgggatcaattggtgctcgagcggctgcttgacagcgacgccgcccgcgccgaaccgcgctatcggctggcgcggttgcccgttgcctattgctggatcttcgacaagaccgacaatgcgcc

SEQ ID NO: 65134 - DNA, 588 bp, Glycine max
  misc_feature (575)..(575): n is a, c, g, or t
  Peptide Sequence Number=SeqID_156819
atgactaagaaaaaagcccacaaacctggatcagccaccattgcgctgaataaacgcgcccgtcacgaatactttatcgaagatgaatacgaggcaggcctcgcgctgcagggttgggaagtgaaatctctgcgagccggcaaagccaacatcggcgatagctatgtcattctgaaagatggcgaagcctatctcttcggcgccaactttacgccaatggcggtcgcctccacgcattacgtttgcgatccgacccgtacccgcaagctgctgctcaatcagcgcgagctcgatgcgctatacggccgcatcaaccgcgaaggttataccgtcgtcgccctgtcgttgtactggaagaacgcctggtgcaaagtgaaaatcggcgtggcgaaaggtaagaaacagcacgataagcgcaccgacgtaaaagatcgtgaatgggcggtcgataaggcgcgcatcatgaaaacgccgggcggtaatcccccctctctgcgggccagctcccctggccccacgctatattgctgttgtcgctgctttttcactcgatatgccgccagaatcctcgcttncaggggctggtaa

SEQ ID NO: 65135 - DNA, 240 bp, Glycine max
  Peptide Sequence Number=SeqID_156820
atgtctcctccacctctaggaatctcacaatcactcaaaaactcacaaatgcttaaaaaagggcttcctgtctgcaaaggcgcggttagcaccattctcgcgctaagctcgaaagggacaactgtctcgcttagcgagctgcatacgcactgggcgcctgctggcgtggaagaactctcttcaggcttatcctcagtcgctaagccacagttgtctcacttagcggtttggtctcgctaa

SEQ ID NO: 65136 - DNA, 300 bp, Glycine max
  Peptide Sequence Number=SeqID_156821
atggtggaagaatttgaagagatcctaggatgtcctttagggggaaggggaccatacctcttctcagggttctatccctcattagctagaacttctaagatagtccaaatctcggcgcaggaattagaccacagaaagcaagttgaaaatggggtggttggattaccgagaaaatatttggaggcaaaagcaagaatcttggcagcgatcgacgcttttctcgcctatcataaccacaaggaaagcccgattatcgctatgctagccgacatatatggcaccttcgaccgaagatgttaa

SEQ ID NO: 65137 - DNA, 90 bp, Glycine max
  Peptide Sequence Number=SeqID_156822
atggcattaaccgcccccctccatgattggcaagcgggttgcactagggttataccattttgggaacacagattggaagatctttcctaa

SEQ ID NO: 65138 - DNA, 543 bp, Glycine max
  Peptide Sequence Number=SeqID_156823
atgtcatttcctgctttcagtgtccttgcccattccgtacaaaaactctccacgaagaggtctagaagagacgccacaggagaaaggtccagtgtcgccccagagtttgatagtcatcatttccgaagtgccgagcaccagcagcgcttcgaggccatcaggggatggtcattccacagggaaagacgtgtccagctcagggaggaagagtatacggactttcaggaggagataactcgcagatgttggacaccgctggtgactcccatggccaagtttgaccctgagatagtcctagagttctatgctaatgcttggcccacgaaggagggagttcgagacatgcgttcatggatgccctcagccaattcctgggtgaccccctggttttggaggaaggctagcagtgtgagtttagccataggaggaacagggccgacgggttcaataaggaagccattgcccagctgttgtgcacaccgagacaggatttcacccagactgctgcagggaggagggtgcggatcatgcgcaccagcatga

SEQ ID NO: 65139 - DNA, 327 bp, Glycine max
  Peptide Sequence Number=SeqID_156824
atgagaggtgccgattccgtggcaccaattcgactcactgctacttcattacaacctgtggagtggatactacctacacctactccatatcgactagttgagtcagttcaagtgatagaggtgtcattctctgaagaggatcttgaagaggacccagaggagttacctcctgaacctgctatggatgcccttcacttacctgaggatgatgaagacccactccctgatgttgattctccagaggataatatgtcagcatctgaggcaggctttacagaggagagtggccctggagggacaacgattagtgatgactcttcatcgtag

SEQ ID NO: 65140 - DNA, 258 bp, Glycine max
  Peptide Sequence Number=SeqID_156825
atgctagttacccacgtctgggctatccgacaagctagtgccaaagaccctggaaggtcagtgaacagtgacccccacgatcatacacaatatccaacatatgaacatggccaaaagctagtgccaaagaccttggaaggtcagtgcaaagtgccccccacgaacatacacaacatgcacatgccaatgcatttccaacatcaatcaacattcaatttccatgtcattctcaacataaatatcatctcgtctcaatga

SEQ ID NO: 65141 - DNA, 1518 bp, Glycine max
  Peptide Sequence Number=SeqID_156826
acgcgggagccgcgatgcggcaggaattgtggaacgcgcggatttgcccgtcgcggccacgaacgatgacaaccgaataggcgccgatctgcacggtgaaatagctgccggacttctgtacctcacaatcatggccgacaaacagccagtcgcgataccagatggtttccatatccagcttgaagtaatccgggtccgtgtagaagggctgttccaggctaaaaccttcgcggcggtttttcagctggcgcaatacggtatcacgcaattccatggccaaatcctcgatcaaaccgccctgcccgacaccaattgcgggggctgcggaagcatgtcctcatctaatcatcggcggtcatttgcggcagcacagacagcgacatcggcttccgcattggcgacaaattgcgacatccactgcccacccatcaaaaaacaggggctgcagcgcaacggagtattaacgcaccctaaattatcttaccggatcgacagcaacgagggtgttcccggtggagaaggcgacacgcatacgctatttcgatgcgagcaggcattcgggcgcatcagccgttacgaagagcggtggctgccgaaagaacgcgtctactacagccatgacgaagtggctgcgctgaccgggcgaaagctggaagctgccgccgatgccacccacagccgcctgaacggctttcaccagtccatccgttttccgaaaatggtttttcaccatctgctgaatgaccggccgcatctgggttattgccacgtcacggcggcgacgaccagcttcgatgcagagcgtcatgtgctatggtccttctatttcgcgaatttcttcgcggaactgagcggggccgaaaacttcttcgaaaatatcgatgcgcgttattcgcggatgtatttcgctgtcgccatcaacgcccttcccgatcaggaaatcgccgtcgatacatccgatcatcaaggcgatatagcagcgacaaagcccccagggacttcatctttctttcttaggcatgtcgttgtcccgaaaccgacgaccagtttcggacaatgtgcattagcgctttccattctgcccggaaatacgctattgaccgccctgaaaggcagcatcatggcgcgtcatatccatattgaaaacgagcgggaaaccgcccttcaagcagccgtcacggagcttgccgccggccagccgatcgccctgccgacggaaaccgtttacggccttgccgccgatgccaccaaccctgcagccattgcccgtatctacgagaccaaaggccggccgcaattcaacccgttgatctgccacatggcagatatcgccatggcggaacgttacgccattttcgatcccatgtcgcttgatcttgcacaggccttctggcccggcccgctgacactggtgctgccgctgaagccggcaagcgatattcatgcgctggcgacggccgggctcgatacggtcggcattcgcgtaccgcaaggttttgccggcgatcttatccgccg

SEQ ID NO: 65142 - DNA, 798 bp, Glycine max
  Peptide Sequence Number=SeqID_156827
atggaagatggttcaaaagcattgtatttcgattggattgatcttgcttacttcgatatacacctgttacaacgtgaaggcgccatcaatgactattcggacccgatcttaaaagcggttgataaaaaaaagaaaagcataacagcggaagagcgtaaagtattgtctgaaaatattttaatgggaataccaggagaaaagaacattactctggaaagcctcagaaagagtatagacgtctataaaaatatcggaactgaaggattgcgggccaatttaaaacatttcttagaatctatcgcttctgtttgccggaaagagaaaataaaaatgaccattcatcctgatgatcctccttatcctattctgggattgccaagaattttaagtcataaagaagactttgagtatctgttaaacaccataaatgatgagttcaatggtgtttgtttctgtaccgggtctttaggagccggtatccataataatattcctgagatctttgatttggtaaaagaccgggtaaactttatccatctccgcaatgtcaaaaaggataaaatcggaaatttttacgaagcagatcatctgaatggtgatgtagatatgtatcatattatgaaagcgattactactgaaaatcaaaaaagaagcattccaattccattcaggccggatcacggccatcaaatgatggatgatatgaataagataaccaatccgggctattctgcgatcggcagattgcggggactggcagaactaaggggactcgaaatgggaattttaggacaataa

SEQ ID NO: 65143 - DNA, 456 bp, Glycine max
  Peptide Sequence Number=SeqID_156828
atgaccatccagaatatgcaatttcagcaagagacaagagcctccattcagagtctgacaaatcagatggggcagatggctactcagttgaaccaagctcagtcccaaaattctgacaaattactttcacaaactgtgcaaaatccgaaaaatgtgagtgccatcaccttgaggtctggcaagcaaattgaagtgccttcaccagttgcagcacctgcacctgaacctgtcaagcttcattctacagctgacaaagaggatgagctagctgcacaaaagagaaagcttcctgatcataagggagctaacaaaaattttcatgcaagtggaccttcttctagtagttctaacttgcagcagcctcctatccctcttccatttccacctagagcaattccaaacataaagatggaagaagtggataaggagatcttagagacctttaggaaagtagag

SEQ ID NO: 65144 - DNA, 282 bp, Glycine max
  Peptide Sequence Number=SeqID_156829
atgacacatcggagagctaaatcctctgttggttcttccttatctcccacaggcaatttagttcctctggacttggagatactcaggggttttcaccccctttttaaccacattgcccctaatgggcttctaaactacctaagagtatggagaagcaagggatgcaaaggggctgataagcacatagcagaaatagaaatatgcttagagatgagagagtgtagaggtttgggtgccaagttagcaacccaagtgcctttgcctctacgttttaaaaactaa

SEQ ID NO: 65145 - DNA, 123 bp, Glycine max
  Peptide Sequence Number=SeqID_156830
atgcaagaacaaatagaggaaggaaaagaacatcacgtagatgaagatgctctgataccacataatgtggctgcatgtagagcttgtaggccttggatcttcttcattaatggagtcctttaa

SEQ ID NO: 65146 - DNA, 289 bp, Glycine max
  Peptide Sequence Number=SeqID_156831
atgtatcactatccattcgaagctcatcaaagtgatacttctgcaagcaaacattcattaggtggtgttgcggagacacatgcgaatttttcatggcctactatgaccccttcacagcaacatgatgttccaattgaaacacctaatgccccattagatggttccagccaatccatctcattccttatccttgttgattttggccgccctttcgcacgaattgtacttggatcagggataagtgcccatggctcattagaaggaggaataaccgcttcattcctaagag

SEQ ID NO: 65147 - DNA, 317 bp, Glycine max
  Peptide Sequence Number=SeqID_156832
ggggagatcggagttgtggtggtgtgcatgatccatactcgtctccttgcagcggttgggtgaaatcttgccccggtatgcatagtagttgcgcgatagcctccctttcaggttatgctcgcactgttggtcaccctctaatatcagggggtggcccaggaactgataaaagcaaactactagcccctcacccgggagcatcttgccccgatatgcaaagtagctgcgcgatagcctccctctctggttgtgctcgcacagttgctcgccttccaatatcagggggtggcccaagaactaataaagcaaactactag

SEQ ID NO: 65148 - DNA, 432 bp, Glycine max
  Peptide Sequence Number=SeqID_156833
atacatagatgcaaaagtaagtggcaaaagacaaatgaaagctcagagaaccaatggttttggtccttaacagatttttattttatcatcccaaacaagtcaaaccaaatccttcagagcaacacattcttgccaaaagatgcttccacagctattaactcagagggctttgttctccttgatattaggccaacttgggagagagagaaggcacgtgtggcagggtctttgcatgtgccaatgtttgtggaggacactgataacagtccaataactctgcttaagaagtgggtgcattttgggtacattgggttgtggactggccagtacctcactactttgaattctgagttccttattcaagtggaaaattccattcctacaggtaaggagaccaagcttcttgtggcatgtggaggaggattaaggtga

SEQ ID NO: 65149 - DNA, 441 bp, Glycine max
  Peptide Sequence Number=SeqID_156834
atgcgtctaccagggaaggagagtctgctgatgaaatcatccatagccataaatgagattttggatgttagcatttcgtttctaaatgaccatttagaggaaacactgggttcgacaaaaatagaagaaatccactcaaagtgtatcaatctcgcacagtgcggggcgaaaaagtcgctagcgcacgggattttggttgataatcaaagggagaagaccattttaggtcgtggtttccttttcttcttttgttcatttggtgacaattctgtattgttcagatatcatctggtccaaggacctctcggcacatttcttctgggtaaggattatggtgagtcaggattttggctcaagacttgtagaatggctaggcatgatacatgtcagggtttggtttggttcaaggataaaaagggatgccccacattatttccatga

SEQ ID NO: 65150 - DNA, 384 bp, Glycine max
  Peptide Sequence Number=SeqID_156835
atgtcttcatgggttttactgcttggatttgcgctagtagccggtaggataagtaaagaggggcaactgtcataccctaatttcgtccggggaccattgtttatcggcatgcaatcttcgtttgaccacctcaaaatgtttaacacccatcgtggtggaatccgtaaagttccgagatgtttcggggaggaaccggacaaaaacacaaaagcgggggtgaacttatcaaacatggggggtgcactcaggaaacttcatccagaacattctagaaggtggggtgaacttatcaattacggggtgcattcaggaatcttccacaagaagcctctgggcggcaaccacctccattttgttaaaaaatggcatccggggcttccgtaa

SEQ ID NO: 65151 - DNA, 1067 bp, Glycine max
  Peptide Sequence Number=SeqID_156836
cgcctgagatagaaggcatgattgcagccaccggatcgagtccactgatcaggtgctctgtaatcaccactgatcctggacttatatccgctttcgtcgagaggtggcatagggagaccagcaccttccacctgctagtaggagagttgacggtcactctagatgacgtttcgtcactcctacaccttcccatcactagcgcgctgcatgccttcgagccgctagttacttctgacgcggtggggcttttgacggagctgcttgaggtcacccctgaggaagctacagctgagacccgtcaggctacggctgcattggtccacttgtacgagcatctgaatgaggcatcgcagacccctacacggcagatggccggttacattacactacttcagtgctggatatacgagcactttctgacggtgcaacagtgtgtcgttgatgatgcttatgttgaggcaagcccacgtgcctccaggtggcttacgggtaaggctcatatgacggggatcaagggagccccataccgggcacgtatggaagccctgattgtgactgacgtgtgttggatgccctatgctgagcaccggggacttagaggctttgacttgatcttgtcatacacgggccagctcaattgggctcagattgtcatctataccgtccctccgccgttggttcatgattcgttgatgaatgctgatatagacgaccgatggctgcacttttcagacaatctaatgcctgcgagggagatctgtgtagttcttggccaggtggcgccagactacatggattggtttttttggatttcgcacccgttcgtcacgtcgaccgaggatagtgctgagttgagacatccgcctaccccacatgatgaggagctcatcgagccacctatcctggaggtttcagttgcgtccgatctctttacacattcagtggatttgggagcgatcgctgaggatttggagcgggtcatcaacctcgggatggtcactaaaggcactgacttatatgacatcatgactcgttgcctgaggagagctagaggtgacgccgcatag

SEQ ID NO: 65152 - DNA, 186 bp, Glycine max
  Peptide Sequence Number=SeqID_156837
atgaagggaagaaggcataaatatgggtttaacaacaacaaacgtgagaaggcaaagaagaaaagggtggtggatgatgaaactggcgacaaacatcagctggatgaagtcctaaggatgccatgtggcaccttggttgtcttgtatcttatctcctcagtacctctgaaaaaaacttatgactga

SEQ ID NO: 65153 - DNA, 144 bp, Glycine max
  Peptide Sequence Number=SeqID_156838
tctgccctcttcaagtccaagcccaattctggattcaagcctaagctgatgcaatcctaccccgcaagggcattggatagaaaactccaagtagattgggccagagatgcaagagaaggccctagggttcttatgagctttagg

SEQ ID NO: 65154 - DNA, 624 bp, Glycine max
  Peptide Sequence Number=SeqID_156839
aagaaagaaaaaacctccaagaggaagcaaggtgaatgctcacaagttgctctcaaccatttggacacatggttcacagatgaaagcaagaagaatgactacaagatgatatatgtttccaaaaatatgaaaggaactttttatcttgagctagtcaaggttttctacacctttgcacatgctaaccttgaagataacctcttctctactgtaaatagagtagatatggtcattaatgctactgtgtggaaggaagtagttaatctggacatgggtggagtccgcaagttcgatgaaacacctgatggaatgattgcagaagatagaatgttagtttacctcattacctacattctcactctaaggtcaagcaatcatgcttatagtcgtcgccttgtggattataaatttccttatattgtacttgcctcaagattcattgactacttcaatgtcgatgtctctaatgagattgtagactttacgaaagcgtctagtgagattaccgaaaggcatctcaagaagcttggaatgaggtttgttgatcacgaatggataatggttggagagctgacagttggaaactttgaccagatggaagatgctgaagttgaagctctacaa

SEQ ID NO: 65155 - DNA, 799 bp, Glycine max
  Peptide Sequence Number=SeqID_156840
atggcgcccccgatcgcggcgtgctggccctgcagctcaacgtggccaacgacctgcgcctgcaggcccgcctgccgccaaagcccggctcaggcagcgaattccggcacggtgcgcggcgaatggacgttcacctcactcaactggatccctgccctgttcgtccgcaagccgtggctgcaactggacggcggcggcacactgaaggccgacctgcggctgcgcaacggcgagctgagcgaaggcagcacggtggacattccctctgccgaagcagttgccgaggtcgccggcgtccggcttgccggtgccgccagcgcgcacggggaactgaagtcaggcgctccaaatctggccctgcttgccgtccgcctgccccgcttcaccgcgcgtcccaccgatgccaaggacgttcggctgttcgatggtcgtgatctggcgctggatctgaccggcgacggtcgcctgcaggagctgcgcaagggcgtgcgcgcgcacctgagcttcagcgaagccaccattccagatctgtcggtctacaaccgttatctcggttcaaaacaggtgcgcctgctgcgcggcaccggctcactcagcggtgatgccaccctcgataccgatggccgcgttggccatggcacggcccggctgttggggcgcaacgccagtgccaaggtggcggggctggacatgggcggcgacgtcgacgtgaacgcaacgctgcgccgtggcgacttcaaccagcgccactttgatctgtccggcaccacggtcgagctacgcaacgtgcaggtggcgg

SEQ ID NO: 65156 - DNA, 201 bp, Glycine max
  Peptide Sequence Number=SeqID_156841
atgttgcaggccagggaccatcagcttggaatccgaaaccggcccaagggccggtcaagtcaatacggtggtgcgggtcgaactcaatcatgccgcgatctcatccttggccggggtcccagggcgcaggcaagagccgagccagaggcccagccattgccaagcggaagaggcgaaggctcggattcggctgatccatga

SEQ ID NO: 65157 - DNA, 291 bp, Glycine max
  Peptide Sequence Number=SeqID_156842
gtcgactctagaggatccccggttcgccagcaggcagccaaccactgggcacatgtacagacccatgattgtctttaccagttgagcctcagcctgcagagccagggttttacttcttttccgtgcactaatccggatcagtttagggcagaggtcgcttggcccggggattggcctgaggcccgggcaggagaggcaccatcagaggctcccgacgaggcagatgaggcccgcgaggacgaggagatgaccgatttacttgatttcttaggagggagcggagccacatga

SEQ ID NO: 65158 - DNA, 387 bp, Glycine max
  Peptide Sequence Number=SeqID_156843
atgtccgtgtggcaaagagaacgatcaacctgtactaaggtgattgattcactgcttaattggtatgacgttcatcagctactttttcttatactggtatctacattggcaaagttaattggtcaatcaacggacgaagtcaagaggctcaaaatagaagatgacgatgttgatttaaatgcctctcctcaagcactagataggctattgggttgtttccttgcattcaaagtgaaggtgcaaccaaggttcaggaattctgttcttaaatatttagatgaatcagacttgatcaatgttgtgttggatatgcttcccgatagtgagccatgttgcaagatcgagaattcaatacttgagtcgaccgatcctacagagcttgaatct

SEQ ID NO: 65159 - DNA, 927 bp, Glycine max
  Peptide Sequence Number=SeqID_156844
gcacgcctacacgctggaattcgcgcgcgccctggccgacgccgacctgctggtcgaaaaccgcgccgacatcaccctggccgacggccagcgcctggccatgtccggcttcaaggtgatcgacgaagccaggttcaacaagctgccggaagcggaattcctgcgctggcgcgccaatggctggctgccgctggtctattgccacctgctgtcgatcaacacctggcccagcctgatcgatcaggtgcagccggtggtcgcggccgaggaagccgccgaggcgtgatcttccggaacgcccgcgggccggcgcacgcgccaacccgcgcccccacggccccgccggcctcgccggtcggggccgaattccagcaccgcgcgataggacccctcgttgccggccgcgttggccggcggcgtaccgcccgcgtccagcaacaggcccgacatggcgtgcggcttgctgatcagcgtggccggcaggcacggatagtgcacgtgatgccccgcccccttgcacacataatgcgacgtgggcagcccgtgcgcctcgcgctggcgcatgacgatctcggaatatgcggtgctgggccagaagccgtcatccgacgcgctcaccagcaggaccgggcccggatagcgttcaaccggaatgcgggcgcgctcgaacgccgcggcatcgcggctggcgctcagaaacgcatgggtctgccggtacggcgggtccgaggcgtaggccgcttcccaatcggcgctggcgttgtcctgccacaggtgcggcaagggctcgccgcccttgcgccagacctgcgcattgcgtccggtgcccggctcgcccgcgctgaccacgccgtgcgtcacgggcgacggcacgtaggccaccaacgcgctcaccaggtcgggatagtgcgacgccaccagcaatga

SEQ ID NO: 65160 - DNA, 621 bp, Glycine max
  Peptide Sequence Number=SeqID_156845
atggacatgaatgtgagagccttcatctctggacagatcactcttatggttcagtccaactcctcgaggctcgaatttccagccctcatcactgccttatgcatggcccgaggagtcaccttagattccttgacttttgagtccctcatcccaaccattaacttggcttacataaagaagaattgttggaacttagacgaccccacggtcagctttccagggacccgcaaggccagggctagagaatctgaaggtccatcttctgctgctccccagacatctactacaccagctcctactccttcagcactagtggcttggccaggagtccaaccttcttctcatggaggaggtgaggcctccacagctcaagagcctcagccagatccggagactagacctgttgctcagaaggatgatttagaggccactcccctagagtcatttgtaccagaaactgatccagaggcagatccaatgattgcggaggccagcccacaggcatcaccaatatctaaaccagtgctggagctgagcaccccgcatggatcaccagtaggcacgcctgtgctgcatttgacagatgatgaggccatggatcaagacacaccgcaagactag

SEQ ID NO: 65161 - DNA, 864 bp, Glycine max
  Peptide Sequence Number=SeqID_156846
atgaaaggtggtccttcgattgaagtactccttgatcttgctttaggaaatgatatttctatcgcaaaagaagcagcaaacgttcttaaaacacaggttttcctatatgacgcagataccaaccgtctgaaagaagcattcaataatggtaatgaaatcgcacaggaaattgttgaaagctatgcaaaagctgagtttttcacaaaattaccagagattgctgacgaaatcaagattgttacttatattgccggtgaaggtgacatctcaacagacttactttctccgggtaaccaggctcactccagatctgaccgtgagcttcatggtaagtgtatgatcacgcctcaggcacaggaagaaatcaaagctctgcaggcacagcatcctgacaaaagcgtaatgcttattgcagaaaaaggtactatgggtgtaggttcttcaagaatgtccggagtaaataatgtggctttatggacaggtaagcaggcaagtccatatgtaccgtttgtaaatattgccccgatcgttggaggtacaaatggtatttctcccatattccttacaaccgtagatgttacaggaggtataggtatcgaccttaaaaactgggtgaaaaaactggatgaaaatggcaatcctcttcgtaatgaaaatggtgagccaatccttgaggaagcctattctgtagctacaggaactgtacttacaatcaacattaaagagaaaaaattatataaaggtgatcaggagcttattgatatttcgaaggctctcacacctcagaaaatggagtttattaaagccggaggctcatatgccattgtttttggtaaaaaacttcaaacattggggatcctctag

SEQ ID NO: 65162 - DNA, 1584 bp, Glycine max
  Peptide Sequence Number=SeqID_156847
atggatcttgataatgacatcaaaaccaattttgcagaaaaaatagaaaaagggcttaagaacagaagaaaaggaaaaccgacaagattcgttttcgataaagatatggataaagctttactggaattattaatccgtaagctcaatctcactaaaaaagacagcattattcccggtggaaaaattcataactttaagcatttcatggattttccggatgtttttgaagcttatgccagacctgtggaaagaacttcttttagccatcaggcttttgaacatggcgaaagggtaactgatgtgatcatgaaaaatgatgtgttgctcacgtttccataccataaatataatccggttattgatcttcttcgtgaggcggcaatggatcctgatgtaaaatcaatacagattacagcttacagactggcaagcagttcgaaaattatcaatgcattgatctatgctgcacgaaatggaaaagaggttacggtgatgctcgaacttcaggcccggttcgatgaggaatccaatcttgaatggaaagaaatgctggagccggaaggtattaccgttttagttggaattccggataaaaaagttcatgctaagctttgtgttatcaagaaaagagcccacaacaaaaccattcagtacggatttatcagtacaggaaatttcaatgaaaaaacggccagaatttatggagatcatttattaatgactgcagacagaggaattatggcagatatcaataaagttttcaacgtccttaaaaaacctaaggaagattaccttgctgttctgaaaacctgtaaaagtttaatggtctgcccacaattcatgcgtgaaaagatcgtccatcatatcgataaagagatcgaagaagcaaaagcagggagaagagcagaaattattgttaaagctaattcggtaagtgaccgtgctttaattacaaaactatatgatgcggctttagcaggagtggttataaaaacaattgtgagaggaatttattgcgctgtcaatcaaaaagaatttaaagaaaaaataaaaggtataagtattgttgatgaatatctggaacatgccagggtcatgtatttttacaacaaaggagctgaagacatgtatatttcatcagcagactggatgaccagaaaccttgattacagaattgaagcggcagtaaaaataacagataaagaactgaaaaaagagctgaaggacatcctcgatatacaattgagagataatgtaaaggccaggattctggataaaaaactgagtaacgaatacatcgcagcaatagatataggaagtaatgcagcaagacttttaatcaatgaagtaaaagataacggcaaacacccggaatttataaagcttaatcttttgcggattcctctaagactgggtatggatgtctttacccgtggagaaataggacctgaaagggaaaaaatggtgatcgattcaatgaaaattttcagtgacctgatgaaaatttataaagtggaacactacagggcatgtgcgacaagtgccatgcgcgatgctgtaaatggaaaagatatcattgaacag

SEQ ID NO: 65163 - DNA, 555 bp, Glycine max
  Peptide Sequence Number=SeqID_156848
atggaattcacgaatcactatttgttagacgattgttctttcgacaaccagtatcaaggggttctttgtctcatctgccatggtggacaccatgtggaaaccggagtaggaccaatacagtattgcggcaaagttgaaaacatcgtcgatgccataagggataaacaacgtcaagttggaggcttttccatggacgaagctgatgacgaaagttttgcggatgccgctgacggcaatgtcgttggcgatgaggagaacggcaacaacgaaaggatcaagcatgtcaaagcccaatttgatggaggggatgtggatcctaaagaattcggaatcgaatttgaccaggagcggccgaggccggtggcgaccaaggcaaggaagtgggtaaggaggtccacgacggcgcatgatccttcaccagagaagagaaagaggattgtgccaccgccatcaccaggaactgagctcctcgagaggggttttgacgaaaatgcagttgaggtttcagcttcaggggagaagctctgtaacgaagggaaaacaagggagggttaa

SEQ ID NO: 65164 - DNA, 96 bp, Glycine max
  Peptide Sequence Number=SeqID_156849
atggctgttttgacgttgcaattgagagctacaagtacaagccctttacttacaatgagttcagagcacaagtgcaacaagatatcaaggccctag

SEQ ID NO: 65165 - DNA, 252 bp, Glycine max
  Peptide Sequence Number=SeqID_156850
atggatattgaagaggattatgatattcctcttattcttggacgctcattcatgtctactgcaagctacatggtagacatgggaaagaaaatgctgcaaatgggcatagaagatcagaaaatcagctttgatttattccatgaggataaagatccgcttgaccaaaatgtctgtttgaaggtgcatgtgatggatgaaaggagacctgaaaagaaggttctggaagtgggaaccttattggaaccaggataa

SEQ ID NO: 65166 - DNA, 987 bp, Glycine max
  Peptide Sequence Number=SeqID_156851
atgatcattgaggagggggagacattatcagcttactctagattttcactcttgaggcatgatcctcaagagttggttgctaagctctgcatcccagggaggggatttgagctgaatgctgatggtcaacctttgaagattttaaggaagaacatgaccacactcgctcatatttggagtgttctttcttactccaacttggtccctacctcccacacttttggcatcacactggatcgggccaagttgatttatggcattatcatgaagatgaacatgaatctaggctacctcatctcccaccagatttctatcattgcccagcatgactcctctaggcttggatttccagccttaatcacaactttgtgtaaagctagaggagtcacatcagattccagatctttggagagtcttagccctgccattaacttggcatatataaagaagaactgttggaatctagatgatccaatagtgacattcagagggccaaggaaggccagggatccttcagcaccatccacttcgactccatatcttccacagtttctagttcaactcccagcttcttctgctcctgcatcagatttcttgtttacactagagatgctacatgccataatgcagagcttacacagagggcaggtggcttggccaggagtccagccttctccttctggaaggggtgggacctctgcagcccaagagcctgagtgcacagaggatcagacaccagcagtggaggatgagctcactcctcctgagcccttttcatttgtctctaattcagtggtggctcaggaggaagtacattcatcagagcttattctagagccatcccctgcacctatctctgaggatactctaccatctgcaccaatattggagcaagagcagcctagttcacaggatctaccagctgctctagtgttggatctgaatgagcatgcagaagatcagcaacaagatgatcaggagttttaa

SEQ ID NO: 65167 - DNA, 612 bp, Glycine max
  Peptide Sequence Number=SeqID_156852
atgtgtagggccactgacccagatgccaaaaccatgggtgattgtgtgtcattgttgcaatcttgggcatggtatcgcatgtccttcattgtagtaagagttaatcgaacaccatcatatccgttggttatgagatggagtggcggtggattaagctttattggtacaccacatggagatgtcatcgattatagaatgagattagaccacatgacaactgaacactcgatagcttttgtagagtcctttatatggacaacctacacccctctaatttgtttcttgatagtagaatggcaccaagaggatagagttaaacttcaattccgcctccgacaagacataccagatcccccaagaaacatggacaaacttcacaaaattgacatgcgaggtctaactgacacaaattgggatgaaaaaacatgcaaaatggataagggacaaccgattataaggcatgcaaagcatcctcaagaatacatggcatgccaagatgttgaagagaataatccatcactgcatgatatagcagatcaacgcccacatcaaaatccaggacgtaataggagacgccctccatgtggaacagaacaccattatgggaattaa

SEQ ID NO: 65168 - DNA, 567 bp, Glycine max
  Peptide Sequence Number=SeqID_156853
atgtgtagtcctctaaaggcgagggcgtgcagccctctaaaggtgaggacgtgtagtcctctgaaggtgagggcgtgcagccctctaatggcgaggacgtgtagccctgttcaggtgaggacgtgtaatcctctaaaggcaacgatgtctagtcctctaaaggcgagggaatttagccctctgaaggcgaggatgtgtagtcctctgaaggcgaggacgtgtagccctctgaaggtgagggtgtgtagccctctgaaggtgagggcgtggagccctctgaaggtgaaggcgtgcagccctctaaaggtgaggacgtgtagccctctgaaggcgagggcgtgcagccctctgaaggcgaggacgtgtagtcctctgaaggtgaggacgtgtagtcctcttaaggcaaggacgtgtagtcctcttaaggcgagggcgtgtagccctctgaaggtgaggattgactgtccttttgaaagaggtgataattcatgcaaccttatcctatcttttgcaaatctctccgggaactccctcagagtgtatgatcagtttgatttaaacacttga

SEQ ID NO: 65169 - DNA, 558 bp, Glycine max
  Peptide Sequence Number=SeqID_156854
atgtcgtccaatgtcatcgttggatacaacaataccgatcttgtgttgtcattggtgaaaattgtgtttccagataaattgcggttagagaaactagacctgcataatgctggctaccttgcacagaaacgccttgcgtgtggtttaaggctcaattatgttgaaactgtggcacagaaactagacctttttattttaaggcataaatattatgcatgcttatggacatttcagattgggacaatgtttggatgtgacaagtacaacattaagccagaccttgtatccctggctaaggcactatcttctgcatatttgccaattggagctgtccttgttttagtcatgacccctcaaattcttttgaacattttaaggcatagcataataaaaatggaagcaatcaatctcttgattctggatgagtgcctccatgccatgaagaaacacccatattcactggtgatgtccgagttctaccatacaacacccaaagagaacaagccatctgtatttggaatgactgcttctcctgttaacttgaagggtagttattaa

SEQ ID NO: 65170 - DNA, 240 bp, Glycine max
  Peptide Sequence Number=SeqID_156855
atgggtggaaataagcgaaatagaaggcgagaaaaatggattaagggtttggcacatgaaagaaggttgagtgacaaagtaggaagtcactgtccatggacaatcatggattcaaagctagaagtctggaatatgtctgtcctaaattgttcattgcttttccgagggtgtaactggtggcaagttaagtggtttgggaattgtggagcattgaatgctacgtctaaagattggacgtga

SEQ ID NO: 65171 - DNA, 288 bp, Glycine max
  Peptide Sequence Number=SeqID_156856
atgctgagccagggtgttgtgatctatggaggtgcaggagcaggagctggtgctgaagtagaagctggagcagaggtggaggcgtcagaaggtccccgagccctagtcttgcaggtccctagaaaggtgatcgtgggatcatttgggttccagcagttcttccgaatatatgccaaattaatggcagggctcaaagactcaaaggtgagagaattagggaccgctcctctggctatgtataatgctgtgatcaaagcagggaatccgagccgagaggagttggactag

SEQ ID NO: 65172 - DNA, 150 bp, Glycine max
  Peptide Sequence Number=SeqID_156857
atggctggtacattcttccttttgaaacagcaaaatagtttagagattatgagcgaaataggaataaaccaacacatgttatggcaccacttggtaggtgctaccaaaattgtgtatgggaagacttggtgcctcgccaagcctctgtaa

SEQ ID NO: 65173 - DNA, 396 bp, Glycine max
  Peptide Sequence Number=SeqID_156858
atggttctttatcaggttctctctgttgttgggcttcttcaagatgaagttgatccattaatggtctctgttatgaaggttgaaaaggcacctttggaatcatatgttgatattggtggtttagatgctcagatactggaaattaaggaagcagtcgaacttcccctgactaagaggactatgatggagttgctgaaccagttagatggtttcgattcaagaggtgatgttaaagtgattcttgcaaccaacagaattgaaagccttgatccaaccctgttgcgacctggtcgaattgacaggaagattgaattggttttacttggacgggcaactgaaagtgttcctgtggacattgacttgggcaaaggagggcatggcaatgcaatatcttga

SEQ ID NO: 65174 - DNA, 204 bp, Glycine max
  Peptide Sequence Number=SeqID_156859
atgaggctattcctcctcgacattttcttcctcctccgtgctccacaactactgcttcaagaggactattctcgtcgaaaagaagggcagatcaaatacacccatgcccacgtggaagctcgagatctctgctctgggaattgcccctcgccccccttaaatacctgttttcatataccagtaacaagccccgccaagctctag

SEQ ID NO: 65175 - DNA, 2634 bp, Glycine max
  Peptide Sequence Number=SeqID_156860
atgggggtgtacgccaaaaccgctctcaggagcttcgttgaagttgtgaagaagaacggtaaaggtggagtcttgccttgtgagcttaacggtttgagcgtggtttcggtggaaaaagagattggggagtttctgagggaaggtgggaggggtgagatgatttttgagcatgtgggtcatttggtggagcatggtggtggtggggttgtggtgtgttacggggagattgaggtttttgttggggggtataaggaagaaggtagtgttgggtttgtggtttcgcagttgacgaggttgttgggggttcatggaggagggaaggtgtggttgttgggggtggcgggaacctctgaggactattctaagttcctgaggttgtttcctactgtggacaaggattgggatctgcatcttctgaccatgacctctgccaccccttccattgaaaaactctaccctaagtccagcttgatggggtcctttgtgccatttggtgggttcttttctacaccttctgagttcaaaaatcccgtaagctgtacgaatgcatcatcatcatctttactaactcgatgtgacacatgcaatgaaagttgtgagcaagaagttgctgatattttgaaggtaggccctgctgctacttcaacttctgtttactcctccacgagcttgcctaggttacaaaaggttaatgtggactcagatagaggattggatgtggcaaagaatgaacttcatcatccagtgcagactaatgaagaaaatacaagtttgaatataaagatcttcggattgcaaaggaaatggagtgatatttgtcaacgtcttcatcaaaaccgatcattacctgaatttgatatcaccaaaacaaggttccaagctccttcccatgaggggtttcaatttggtccaggaagtagcagcagaggtccactccatagtgaaatccaatattctgatcatatttcctacatgtctaaagagtcacaaagtgcatttccatttaaacagatattaccagtttcggtaccttttgacactgttagtatcactgatgaagcagaccaaataccaaaagtttcaaagactgatatgcatggtacttgggtttctccttcccctaaggccaatataagccttcttgatcccacaacattttcatctgtgactcctgtgaccacagatttgggattgggaacaatttacacatcagctgctcatgagccagacacaccaaaactaagtgatcataagaagcctctccatcacttgtcagattccctttcaaccgattttgatgctatgaatgagaatacttcacaccaaattgcaagatcttcttcctgctctggtccaaatctagaagggagatttgaaactgtagatttcaagtcactttaccatcttctcactgaaaaggttggctggcaggatgaggccatatacgctatcaatcgaaccgtgtctcgttgtagatccggtgctggaaagcttagtagtggttcacatgttagagcagacatatggcttgcttttcttggaccagataggcttggaaaaagaaaaattgcatcagcacttgctgagattttatttggaaacaaacaaagcctaatcactgtggatttgagctcccaagaccggtgttacccatcatactctatttttgaattccaaaattcatattgtcatgatgtgcttatgaggaagacagtgttggactatattgctggggagttgagtaaaaagccgcactcggtcgtctttcttgaaaatgtggatcaagctgatttcctggtgcagaatagtttgttccatgcaataaaaacaggtaaattcccatactcacacggaagggaaatcagcatcaacaatgcaatgtttattgtaacctctagtgtgtttaaaagtagtggctcttttaacttggaggaggatcctaaaatgtttccagaggaaagaatcctagaagctaaaagatgtcaaatgcaattatcacttggacatgcttctgagggtgccaaaaggagtggttgcacaaatgtgaaggttgcagagagaaaagggaaatccaaaacaacatttctgagtaaaagaaagctaatagaaagtggtgatttaaaagataaagcaccatgcaagacactgaaaccagtcagggaggcatcgaggtcctatctcgatcttaatatgcctcttgaggaggttgaagagggcaacaattacaatgatgatgaaagtgaatcaatagttgaaaactctggagcctggttaaatgatttgtgtgatcaagttgatgaaaaagttgtttttaagcctttcaactttgattctattgctgagcaagtaattaaaagcattgacacacaatttcaaaagatgttaggatcagagtttatacttgaaattgagtatgaggtcatgacacagatacttgcagctgcttggttatcagacaagaaaaaatctttggaagattgggttgaacatgttcttggaagaagctttggtgaagctcatcaaaagtaccactttgcacctgaatttgtgatgaaactggttaattgtgaaagattttttttggaagaacaatctcctggagtatgccttccagctagaattaacttgaactga

SEQ ID NO: 65176 - DNA, 135 bp, Glycine max
  Peptide Sequence Number=SeqID_156861
atgaagaaaaagtttcaggccaaagaagagaaggttcaagtagctgatgacttgctcagcgaggcagatccgctcatcgagtgtcatccgcttagcgaggcatacaactcgtttagtggattgggaaacccttga

SEQ ID NO: 65177 - DNA, 273 bp, Glycine max
  Peptide Sequence Number=SeqID_156862
atggacgaacctttcattatggcaaaacaagccagacaggtgttttacgtccaagatccatatgattcaagattttcagtggttctacaaggaagacctactggtatcaatcatgtagttgatgattcaacacttgacatttgtgaggcaccagctttttccaatagaatgccttctctaaatgagtcacacaatgttgatgatgtcatgggaacaccaccaaggtcccctttgaggctatgcctaggaaaagtagacaatccacctggctaa

SEQ ID NO: 65178 - DNA, 660 bp, Glycine max
  Peptide Sequence Number=SeqID_156863
atgctacaactgggagaggatcgggcccccaaaaagagaagttccatagctatctgggggatcgtagttagagaaaagattccaattgtacatagcaattggaaagatgtattggaatctctaaaggacctagtattggatgacattttggtaaaatttgatatcccaaaagcatcaaatgccaagaaaaagatccacaaacttgggaggaatttgatgcaacccgcaaaacccctaattggcagggaatcaggaaaaagacataggaaactaaaaaatacaatgactgccccccccccccatttcctgtgtcgtgggggatatgatttgcgtgaaaagaagctattagacgagaaaatcaagaaaagacaacagaaggtaatcatgactgagaatacaccagagattcatgacccccatctcccattgaaagacatatcatggaggtcatgttcatgcagcgaggtgtggtgtgagacaataaatcaatactatggaaaggcatcacatggctctagtagctcatccacatccatcacccaacaacagttggctgagataattggaagccttaaggaagagtggaggaatgagattaaggaagaaatcagaaatgagattggagaagaaaacaaatggaatctagagaaattgaaatag

SEQ ID NO: 65179 - DNA, 1098 bp, Glycine max
  Peptide Sequence Number=SeqID_156864
atggaattttgcagtttgattatccgttgtacaaaggttgttgaactgtggttattcaacaagctaacatcaattggaagcttctacaagtgtcagattaacaacctcaccctgctttcattgttttgtaggttgaaatccatagctgaaatagatgaccaaaaggaaacttgcaagattattgttcgagtgataaacatgtggactataccaagatcgcctaaatctattgttgagctaattttagttgacaagaagggtgataaaattctagcacaaatgaggaatgttgatgttcaactcgacaatgtaatttttgatgttggtcatacttatgttattaagaactttgaagtagaaaagaatagtggtcattataaagcaacacgtcatggctttaaaataaattttgtaaagacaactaaagtcacacctcacaaaatactagaaatacctaaaacaatgtacaacttcacaatgtttgatgacatttcactggctctggagtttaaggattgttttgatagacatgtttctggtcctgtgatgttgttgctcaatctggctaaaatcaaagaagcaagaggttgttgtttcattgagtgtatgtgcgtcactgtggctactttaagcaagttgttggtagccaatgggtggatctatgatgggtgccccaaatgtaacaaaaaagatgatggagaaggttcgtcgcttttttgtgttgaatgtggtaataagagtgcaagtacagttgcaaagttttgcgtggatgtcagagttggtcaacctaatgagtatgcaatttttacactatgggatcgagaatgttatgctctgataaaggagactgcagatgagattaagcagaaaatgattaatgaggatgaagcttcgccttgtgtatcgatgatgcacgatattaatgatgttggtgataccactactgagtctgatccaacactgctggaatccatcacaccggctaagcgcattttgccactgcttcaaagtcaactagatggaataccattcgaagatttatcatccatacaattatcctcagctaggctagacaaaaagcatatcaagactgaatga

SEQ ID NO: 65180 - DNA, 147 bp, Glycine max
  Peptide Sequence Number=SeqID_156865
atggctgaacaaaaatatagaaatagttatgactcaagctacaaggctccaaatgaggtgattccaaaacgaggaacaaggttgaagatgaaatggtggaagaaaagaatcactctttccagtgagggcaacacacaaaggatgtga

SEQ ID NO: 65181 - DNA, 483 bp, Glycine max
  Peptide Sequence Number=SeqID_156866
atggcattcttaggagagacttcgtcccagacgatcgtgaactcgaggttggcattcatttttccaaatggaaccgtcattcacaacgagtgtggggtttattttcaaagttctagtccagtgcccatgcgagtaccaaacctatgcgatttttcaactctcaaaagcagaatacacattagccttctgctaaacaacaatcaagttgtggatgaatttcattaccggcgaccagtggaagatacagcagatgcaattttaaacttacttgaacgccccaacatccctacacatgatgtggttctgtattacaatggaaggtggaacatgccacgccaaaacaactttgtgggttacgcgttcaccggaacaaatcccaaaaaatttgatattccaaaaggatgtagcatagatcaactgaaggatctgcctctacctgtgcctaccgcacgacgtagacctcgtgttctaaccatgatctga

SEQ ID NO: 65182 - DNA, 1000 bp, Glycine max
  Peptide Sequence Number=SeqID_156867
atgaatgtcaacattcctaagttcgaaaggccacaagtagcttttagcaaagatgaaggagggacatcgtatagagctaaggagcgtgaaccaactactctgtatgaaatggaaggcgatactgggaaagccaaccatgaacataaagagagacaattgataacacaatcatttgttgaggttatgaagggtcagattaacactaagatgaagacatggaaaccgaggtgtggcaagcaagctcttgaggaggaaaagaagtggtgggaaatggagttgaatattcaaaggaatgtatatgtcaatgaaaacgctggaaagataaagtttaactatttgggggatgacatggtgttgatctcagggtgcacgaaagagtggtttagtgaaaacaccaagcaggaaggccttctttccatttttcattctatccaaaaatgggaagctagcatcacctttggaaacagactcacatgggttaggtgtactggtgtaccattggacgtgtggggtgaggaatgcttcgcagcgattgcaggacagtttggaacattggtaaagttagaccctttaaccatggatatggtaaatctgagctatgcaaagatgttagcgaagttgtcttcaccactacatgtaacgttcagtgaaaatattaagataaatgggacggcacatcttgttagagttgtggaagaagtgcttagtcttgcgactacgtgcaagaacataatatcctcagattctgaaagcgagactgaaagcattggtggtgtctcagacgaagccaatgaggagatgtatggtgaccatgggaccagaggagtgagtcatcgaggtggacgaagagaagatcggtcaacaatgatgtcgaaaaattcaaaatgtcctgaaggtgttgcgacccatgggataaatgtcttacacactagtaccttcaaagacgatatgttgtacaaagaagttgaatgtcacgaaggcatgtctaacatgcttgcat

SEQ ID NO: 65183 - DNA, 717 bp, Glycine max
  Peptide Sequence Number=SeqID_156868
atggttggacctaacttcatggatgagatagactgtggcagcttctttgaccacatcgacgaccttctcgattttcccgtcaaggacgtcgacggcggcgccgccaccttgccttccgtcgccgctaatattgtcaaggagctctcagatttcatccttaaacgcctcgaccataaaagtcccatcgtcaaacacaagactttacgattgatcaaatatgcggttggaaagtgtggtgtggagtttagaagggaaatgcagagacattcggtggcaattcgtcagttgttacactacaagggtcaatcggatcctgtcaaaggcgatgcattcaacaaggctatgagagacactgctcaagaggccatctctgccattttttctgcagatgataccaataagcaacctcttccggctcctgctgctgctgctggtctcaatagacggatagaagggtttgggaacacgaatttccaagcgccttctcaggataataagaaatcgtttctcggtgaggtggttgatattggaaatgcaaccactaagcaaggactcagtgccttcacacaaggccattcttctctcatcaagaatgaggctgggactggaacctacaagggccccaacaatcttcctgcctcatttatgacagcaacagaaagtggagacagagattaccgaagtgaaactttggagaacagaataaaaaatacttaa

SEQ ID NO: 65184 - DNA, 1254 bp, Glycine max
  Peptide Sequence Number=SeqID_156869
atgaagaaccccaggaagaagaagagaccgaagccgcagaagaagcttgagaagaacaaaggcgttgttgctgctgctgctgttgttgccgagaacgaaaacgaaaacgaagaagaaaagagaaaacgcagcattttggaggcactggttgaggccttctccttgtcttcagtcagggaagcttccatggcctataacattgccggcggtgatcccgacagggcttcggagatcctaaggaagggtttttcggacagatccgaggattcgttctcgtgtttttcttacggctcttcttcttcttcttcctcttcgtcggggttggaattgggttcgaaaggtggttggaggcagcagcagcagcagaagaagatggttgcttcaaccggcactgtttcaacggttttggggaaggaatatgtgaggaggaacaataataatataaggaacaaagggttaagttctaatggagtttttgaaatggaggaggcagagcagttcctctgctctatgcttggcgatgattctgatattaacttggctgttgtcagtgtggaaatgatattgaaagggtatgatgacaatctgagattgtacttcagttatctaagtatgattttccaggcctcagatatattgcttgatttagctgcttccacaaatgagaaaccgaatactgctagacatcctaactacggagtggacaacatagatgatgagaggttctttgctgaccccaatgacagtattttcgaggtatttttaacttcatcatctgtgtccatactgtacagtactaattgccaaattttgtcacagttgatagacaggagattagagtgcacatctctttcatgggaaggttatctttctaataatccatggtctgttggatcttttggaaggaaatatgcggaggttctcaataattctaaagctaattctgctgttagcccaggatgtacaaagtctgagattcctcagaaggtgttggaatctttgtttaacattcccaaaagcactgaacatgacaaaaataccatgaattggagaaatgtagtaaagaaaattcagtctttgggacctgggttctatgtttctccgcatgttgcagaatctcagcaacgtacttgtggtggcttggggcttgccaccctaggcaacctgagtcagagcgaagaggattcatcatgcatttttggcaagattacctctgctatattggtagagtttactagaaagggttggatctga

SEQ ID NO: 65185 - DNA, 660 bp, Glycine max
  Peptide Sequence Number=SeqID_156870
atggatgatatggttctatccaataatgagttcatgaaaagcattgttgacaatgtcaaaagggatgtatgtcactcaacaaagacaacatccaagcatgtggttaccaactcaacaaagacaacatccaaccatttggtgaaaaacttaaaggccacaccatcaccgttggaacaggatttcagtcaacaaaattctgaaggcatcgagaccatattcatttactctgaaaatgaagataacacttcaaagagagtgttaggtttaaaaggcaagtatgtccacctaaagacttgcacaaatgttggtggcagtagcagtaaaagaaaaaaagtggttgaagatgtagtacaaactgtggatgtgaaactaatagctgaagaggcacaagcttgcgcctaccttctcaatgatagcttggatctgagagacaatgagatagctgatgccattgaagggtttccagttcacgatatatgtttgcattacgacaaagactatctcaattcgtttgacaacctcaaccttatttgcataccaattcttgaaaacaaagagcactggtatttaatgttcataactactgaggagcggaaagtctatcatttggactcttatttgacaaacaatgtaaacgaggaaagggaaaggctaatctag

SEQ ID NO: 65186 - DNA, 507 bp, Glycine max
  Peptide Sequence Number=SeqID_156871
atggcagaaaaattagccccggaaaagcgtcacagcttcgtccacaacggtcaaaaggtgttcgagtgggatcaaacccttgacgaggtcaatatttacatagctcttcctcctaacgttcattccaagcaattctactgtaagattcagtccaagcacctcgaacttggcatcaaaggcaaccctccgtatctcaaccatgatcttactagcccggtgaagacagattcttctttttggaccttagaggatgacataatgcacataacactgcagaaaagagataaaggtcagacatgggcttctcccatatcaggtcagggtcagttggacccttatgctactgatcttgagcagaagcgactcatgcttcagagatttcaagaggaggtgagttttgctttcatcagaatccttttccggctgttgggatttggaatgcatttgcaaccccatgatatgtctaacatgtgcttatcagcgtccttggtcgttatgttctattaa

SEQ ID NO: 65187 - DNA, 273 bp, Glycine max
  Peptide Sequence Number=SeqID_156872
atggccatcacggggtttagttttgacatggcgtcggaaagagagttgtttgcaagggcttccaatgccgaatgggtggaacaagatgaagaagagcttcaaatggttgcattgctgaggttgtcgatgcagaagcatgtcaacacgacgttgattgatgtgaggaagctaaatcgcttccaccgtgaacgggtcgtcaaggacgccttggctaccaatgaacaagacaattacaagctcctctctgccatcaaggaacacttcgacaagtaa

SEQ ID NO: 65188 - DNA, 1164 bp, Glycine max
  Peptide Sequence Number=SeqID_156873
atgtcattagagaatgattctgagatcacccatctcaagaaaaatcttaaagtccaaatggaaagaaatgtgtcactagagaaagaaaacaaggatctcagacaagaagtagcacgtttgaagtcacagataatgtcactcaaagcacataacatagagaggaaatccatgctgtggaagaagatacagaaatccatggatggtaataattcagatacccttcagcataaagcagcagttaaggtaataatgcttgaaaagagtccaccaaatgagagagtgcatacaaattcagatttgcaagaaacacctatagttaaggacagatcagtaaaagtaccaccacctgcaccctcttccaaccctcttcttccttcacaaaaaactgagaaaggaatgaaagtgcagccattggcattgccaagaacagcaccaccacctcctccaacaccaccaaaatcactagttggattgaaatcagtgcgtcgtgtgccagaagtaatagaactgtatcgttctctcacaagaaaggatgccaacaatgataacaaaataagtaccaatggaactcctgcagctgcattcaccagaaacatgattgaggaaattgaaaatcgatcaacttttctgtcagctgtagagtcagccgcatatgcagacatttcagaagtagaggcatttgtgaaatggctagatggggagctatcatcacttgtggatgaacgttcagtgctaaagcattttccacattggccagagcaaaaaacagatgcactcagagaagcttcttgcaactaccgaaatctgaagagccttgaatcagaagtctcatcatttgagaacaatccaaaggagccattggctcaggctttgaaaaagatgcaagcactccaggacaggcgagcatgtgcaaaactagaatgttcaagaagtgtgaacagtgcagagaagacaagggagagtgcaagtaaaagatataggagttttcatatcccttgggagtggatgctggacacaggcctcattggtcagatgaagctgagttcattgaagttagcaagggaattcatgaaaagggtaaccaaagagttggaatctaatgaagtctcaaaagaagataacctcttggtacaaggagttaggttcgcattcagagtacaccag

SEQ ID NO: 65189 - DNA, 1338 bp, Glycine max
  Peptide Sequence Number=SeqID_156874
atggttgaaaaaaataggcattggcacaaaatagcaagtaagcagtctgctgacttctttcgagctgacaatcctgaaggcgtggaggcacgcaatgagtttaattgtgagtctgtgacaattgaccgagtaaaatctatagcttgcacgctaggccataaggtagcagcactggcatttgaagatatgatctcttggatgcaagaaggtggccaggttgggatatttgatgccacaaacagtagcaaagaacgaagaaacatgctgatgaaattggctgaaggaagatgcaagataatcttcctggaaacaatatgcaatgatagaaatataattgaaaggaatattcgccttaaaattcagcaaagtcctgattatgcagaagagccagattttgagactggattgcaagactttaaaaatcgtctagaaaattatgagaaggcaagtctacaacgtgtttatgagacagttaatgaaggatcttacataaaaatgattgatatggtcagtgggcatggtggacaaatacaagtgaacaatatcagtggctaccttcctggacgaattgtctttttcttgcctctttgcatatgcaagggtaaggctgcgtacaacatccctcccccataccttcgcatagcgaagagcctctgggcaatggggtacgaagtttttttttttaatagggtggggttaggatttcttgaccagattaaggtaaatacacatcttacaccacgcccaattttacttacccgacatggggaaagtcaggataatgttagaggcagaagaattggaggggatactgcaataagtattatggcacaattggtttctgagggaagacaaagtgaggctggagaactttattcaaagaagcttgccaagtttgttggaaagcgtatcaaatcagaacgggctgcttctatatggactagtacactgcaacgaacaattctgacagccactccaattgttggatttcccaagttgaatgcaactaatatggcagataaaaagaagcacaatgtgaaacttcttttggttttgggatcgtgcaagaaggacaagcttaggtatcgttatcctcgtggtgagtcatacttggatgtcattcaaagattagaacctgtaattatagagcttaagcgccaacgagcacctgttgttgtgatatctcaccaggttgcagttttgagggcactatatgcttattttgctgacagacctttgaacgaaattccgcatatagcggttcctcttcatacgattattgagatacagatgggagtcacgggtgtccaagagaaaagatataaactaatggactga

SEQ ID NO: 65190 - DNA, 636 bp, Glycine max
  Peptide Sequence Number=SeqID_156875
atgggggcaaacacgatggtagagaagagtgtcatcgtcgccaaccatgacctgaaagggcttaatggctgtggtgggaaaagtgggaaatgcgtaacccaagcctgggagtcaacgaccaaaggttccggcaagttgatcgaggagtctgttgctgagggagacaatgatagctctgacttgtcatatgcgataaacaagtctaggcatttgaccgaaaacttgggaaatgctggtaatggtggggaactcgttgtagttaacaacgccaggggagcagatggtgaaggaatcgaaaaccgattggtcgtgaagcttgtcttcctcgatgtcactatcaagcgttctttgtctagcacaccttgggagtcaaagaattgcgtaattttaaaaatccaccctagtggatccttaccatcaaatcgcggaacgcccaatttcataagtggacgagggggtagagaaggggttagtaatggtggtgaggaacatttaagggtaggtggagtaatgggagtgttgtccctgggtaagtcaaaggataacttcctcaaggtgttttgtggatgcttgccgggtgttgtgcttaggcataccgacaacgttgaggtgcttgtcggcaaggtgaaatcctag

SEQ ID NO: 65191 - DNA, 280 bp, Glycine max
  Peptide Sequence Number=SeqID_156876
atggctactcagatgaacccagctcagtcccaaaattctgacaaattgccttcacaagctgtgcagaatccgaaaaatgtgagtgccatcaccttgaggtctggcaaccaaattcaagtgcctccaccagtagcagcacctgcacctgaacctgtcaagcttcattctacacatgaaaaagagcctcctatccctcttccattcccacctaaagcaattcctaacagaaaaaatggaagaagcagaaaaggagatcttggagactttcaggaaagtagag

SEQ ID NO: 65192 - DNA, 534 bp, Glycine max
  Peptide Sequence Number=SeqID_156877
atgggtgaaatagaggagttgcaagagcggataaaggccgacatggaggccatgaaagagcaaatggccacaatgatggaggccatgatgagcatgaagaagataatggaggtcaatgcggctgcagttgtcgctactagcaccgttgctaaggtggacctggttcccccatctcgcctcaaccaaataaatcatccaacctcgaatatgaacaagcatgccttcttgccatatggcttgcctcccaagtatacaccacccaatgttgcgcacactcctgatgaaaatgtcaataactccactcctatactcattgagagccaacaacctcaatctgatcatgcatatgaagtaccccaccacaatctagccgacttcgagccttacctcgaatatgccactgaagggcaagtagttggtggtgtacccctgccaaacactttgaagggccctttaatttcccccacaaccataacccttgcattttgcagtggggagagtccctcttgctatggtggaaaagggaaaatttga

SEQ ID NO: 65193 - DNA, 343 bp, Glycine max
  Peptide Sequence Number=SeqID_156878
atgacaggacgctccaggtctacgctagtgtattcaaatccttcctcaggagcttccagaacctggtatatgcagtatactgctcccctggctccagaactggtggtttgcataaaattccttgaaccaggccacatttatgtgcccatccatctacctggtcaaggatttatgccaattctgcctctcaagttccttgcgaaactcatcgtactccgtgatgtaaaaaataacattcctctctggaagaatgttccgggagtgaatgttctgatcatatctctcctaggcgcccacagatatgaatctggtagtgtcatagggctccctgggtctggaggcg

SEQ ID NO: 65194 - DNA, 216 bp, Glycine max
  Peptide Sequence Number=SeqID_156879
atgatacctctagagaacagccgtgggcaaagagaaaacacgctcctgtaccatcctcctgagcctgctgtggatgcccttgactttctagagggtgatgaggatccacttcttgaggtggattctcccgaggaagtcatgtcggcatctgaggcagactctacggaggatggtggtccgggggagatggcgatcagcggaggctcttcatcctag

SEQ ID NO: 65195 - DNA, 305 bp, Glycine max
  Peptide Sequence Number=SeqID_156880
cggatgccgggagcagacaagcccgtcagggcgcgtcagcgggtgttgccgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttctgttgggctaagctcagtagttgggccaagcgcataatcaccactaagcgcagcttcaacgcgcttagcgcaaaggagaatctg

SEQ ID NO: 65196 - DNA, 228 bp, Glycine max
  Peptide Sequence Number=SeqID_156881
atgtcagtgaaaaacctcgtcgggcgcctaggagtacatgacaagacaaaccactcactagcaagtcaagtcactctcgataatatcatagggagaccagttagggtcacaatgttttgcgagaatcctccaaccatatgggatcaacatagacctaaaggagcactcaaatcgggtgacccccatggcctacactccgaagagtccgtcggggcctctccctcttga

SEQ ID NO: 65197 - DNA, 186 bp, Glycine max
  Peptide Sequence Number=SeqID_156882
atggactcgggaaggttccaagttagtgtaccaggtgacagctacccaagtaagactttcttggaagaaatatggttcttggggcaagtagtccccttgtacttgtcaaagtccggcaccttgaacttgggaggggtgacgatattgggtactaggaacaactcttctaggttagcaaaggcataa

SEQ ID NO: 65198 - DNA, 560 bp, Glycine max
  Peptide Sequence Number=SeqID_156883
atggcttctcataagagaaaagccatagcttcaatgtctcaggctagttatgatagatcaagatttatatcacagaagacttgggaccattactcagataatgtgcttgccaggaacattctgctagaaagaaatggaagcattgatgtggccattgagaaggaattctatgcaaatctatatatgcctgaggacaagtctcctaagcaagttagggttcaagggcacctgataaaatttgatgttgattccctcaacacctttttggagagtccagtggttgtggagcaagggggatttgttcttaatgccgagggtctgccgtggaagctcttgtggaaagatcttaccactctggcccaaacctggagtgttctatcttattctaacttggccccgacatcccatacttctgatcttaatcttgatagggccaagttagtctacgagcttgtaatgaagatgaacatgaacttaggatcacttatttctggtcagatttcactcattgctcagtccaactcctcgttgcttggatttccagctctgattactgcctt

SEQ ID NO: 65199 - DNA, 549 bp, Glycine max
  Peptide Sequence Number=SeqID_156884
atggccccgaggaagcttgcctcaaagaggtccaggaaggacaaggcggccgaaggaactagttccgccccggagtacgacagtcaccgctttaggagcgttgtacacccagcagcgcttcgaagccatcaagggatggaggaaatagggcgccggcggtgggcaccactggttactcctatggccaagtttgatccagaaatagtccttgaattttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgcttatgtataccggggcaggattttgcccggaccgctgcagggaggcgagtgcgaatcatgcgcaccaatatgaccaccctgacccagatatggatgacgttgctcctcagcaacatcctgcccaccgatcataa

SEQ ID NO: 65200 - DNA, 115 bp, Glycine max
  Peptide Sequence Number=SeqID_156885
caatcttcctcaagaagtgatgcaatcctaccccgcaagggcattggttagaagactccaagtagattgggctagagatccaaggaaaggccctagggttctcatgagccttagg

SEQ ID NO: 65201 - DNA, 423 bp, Glycine max
  Peptide Sequence Number=SeqID_156886
atgttggaagatgaacaggcaaaggtgtcggccttgcgggttgaaagggaggcgagagaaggagtaatagagttattgcataaagaagccatgaaatggatggaaagatttgctctcactctgaatgagagtcaagagcttccaaggttgttagctagagccaaggcagtggctgacactcatcgtcgtcgtcaaaacgtaatcatagtaataaaaaagaaagaatgcgctttacgacacccttaccgaacacgttccaaggctagaatcatgagtgagatggaggaagttcaagaacagatgaaggccgacatggaggccatgaaagaccaaatgaccaccatgatggaggccatgatgagtatgagaaaaatgataaaagtcaaaatggatgcaattgttgccacaagtaccgccacttag

SEQ ID NO: 65202 - DNA, 86 bp, Glycine max
  Peptide Sequence Number=SeqID_156887
atggctggacggaatgatcatgcgatagcggatgcccttcaagccttagctcatgctatagggaatccgaatagaggagaagctgg

SEQ ID NO: 65203 - DNA, 458 bp, Glycine max
  Peptide Sequence Number=SeqID_156888
ctttcattgatcccactacattacaacctaccccatactctactggttcagtcagaacctcaaacgcctgggttaatctgaattctaagaatcctggtccaaatcatagtcaacccggtgtcatgctgactaattcaacctctcagggaatgggcaagctgactaataagatccttctgaaaggagttgttggtgttgatgaaatttactcctttcataatctcaagcttcaaaagagtcattcactgctgatgtctactgtttcaagtgttgcttctcctaattcaactctcactattaatagtaatagttctactgtaatgtctgattctgtttcttcttctctcagtattgctaatctttggcatgctaggtatacttggatatatcctataaagtccaaagctgaaaccatgcttgtttttcaaactttcgagtccatggttgactacaactaa

SEQ ID NO: 65204 - DNA, 690 bp, Glycine max
  Peptide Sequence Number=SeqID_156889
atgcccactgatattagagagattgaggctgctttgtgtatactcggccgaaggtttgttttaaatgctgaaggccatcctgggaagatcctcaagaaagatctgacaactcatgctcaggtttggagtgttctctcatactctaacctagctcttacttcccatacctcggatttgactttagatagagctaggttaatttttggcctagtctctcagctggacatgaatgaaggagctctcatctctggccagatcacatctatggcccagtctaactcctctagacttaggttccttgctcttatcacagctctatgtaggtccagaggggttgcttctgacagcctagtcttggaacacttgagcacggtcattaacttggcctatatcaggaagaactgttggaaccctgctgatctgaaaactttcaacatcttgaagccatgcttcaaagcatacatcagagcctggcccgggactcagcctccccttcacaaggaggatgaaggtctcaccgctcaggtaccacagcagagggagaatgagtcatccgagacttccactccagagcccctaatcagaagaaaaagggtagttgaaacacaagaagttgcagccattttggagaaatctcttgaggccacttctgagccttcagaaccagtggcagatacagcttcattttag

SEQ ID NO: 65205 - DNA, 915 bp, Glycine max
  Peptide Sequence Number=SeqID_156890
atggataaattttctgcggcaaaattagtgattctgacgacacgttatatttatgaaacagctgtaaatccggattcaattaacctggtagggctgaagactgaaaggactttcctcgatatcaaaggcagtcaatcgttattcataagtgaacataaattagtaagggactctcttgtgtcaaactttaaacgggatgaaaggataaataataaaaaagagggtaaagatttttcaaaattaggaataggaaaatcgggggaacagtctttttttgattattatattcttaaagatattccggatcaaaaagtatattattatgacagagtaggagggaagcagatttattatcaggaggacagacctatacaatggcatgtaacaaatgatgtcgaaaaacagaatggctattcgtcacaaaaggcaactgccagctttgctggaagaacctggacagcttggtttacgaaagacatcaatgtttctgatgggccttacaaattttcggggttaccaggattgattgtaaagcttgaagatgataaaggagattataaatttgatctcataaaaaaagttgttgtaaagaactcttttgaagagcctatggatgctgatgcgagaaaaagttcaagggtcaatttccatggagataaagcggcgttggaattggagcttagtaaaaacaaaagaagtataaacggaggaaataacggtggtatgcaaggttttgaggcaggcagacatcagggaggaatgaatggtggtggaagagacggaatgagaggaggaggaatgcgtcgtggaggaacgggaatgaatggggggaacagtgaccttcctgcgcaaagtttcggctctggaaatacatcctttaatacaggaagccaaaatccgatcgaattacaataa

SEQ ID NO: 65206 - DNA, 233 bp, Glycine max
  Peptide Sequence Number=SeqID_156891
atgcctcacctcttggcgaaaaaggtgcgaaaccaaccatacatgggtaccgagctcgaattcgtaatcatggtcatagctgtttccttcgggaaacctgtcgtgccagctgcattaatgaatcggccaacgcgcggggagaggcgctcactcaaaggcggtaatacggttatccacagaatcagggatacgcagaaagaacatgtgagcaaaaggccagcaaaggccagacc

SEQ ID NO: 65207 - DNA, 231 bp, Glycine max
  Peptide Sequence Number=SeqID_156892
ttgagccgggttcaagtgatagaggtttcatcctctgaagagtatcttgaggaggacccagaggagttacctcctgaacctgctatggacacccttgacttacctgaggatgatgaagacccactccctgatgttgattctccagaggatattgtgtcagcatttgaggcagactctacagaggagagtggccttggagggacaacgaatagtgacgactcttcatcatag

SEQ ID NO: 65208 - DNA, 285 bp, Glycine max
  Peptide Sequence Number=SeqID_156893
atgggcttaggtcagaacagtgatggcgtggccagcttggtggaattcaaggagaaccgcagaaggttcaggctaggatatagacccatgcacaccgatgtgagaagaagcaccctagaaaggaagggcaggagcgtgggccaacggcaagggctgcaagtgaaagagactcctccgtgtcacatcagtgaaagctttgtaagcgcgggctggaggtgtgaagggcgagtgatcgaggtcgtacccgaatcaaataaacatgaaaatgcagtaactaggaagtaa

SEQ ID NO: 65209 - DNA, 1649 bp, Glycine max
  Peptide Sequence Number=SeqID_156894
cgctccttaccgcactctcattaagcggctgcgataacagcggtgaaccacaggccgtatcggcggccgataaaggcgccgccgatagcgcgaaaaagccggatagcgcgcagttggcgacgttaaaagaaaaaagccagggcaaggcgctgacgttgctcgacgcttctgaagtgcagctagatggcgcggcgacgctggtgctgaccttctccattccgctcaaaccggatcaagatttctcccacagcgtccatctggtcgataagaaaagcggcaaggttgacggcgcatgggagctggcgccgaatctcaaagagctgcgtctgcgccacctcgagccaaagcgtgaattgatcgtcaccgttgacccaacgctcattgccctcaatgacgccactctcggcagctcttttgaaaaaaccatcgctactcgcgatatcgcgccgagccggtttcgcccggttcgctggatctggccggggaaagtggtcgccgggctgccaccggtgaaagctgaagtggtgcagccgaatggtgaagtggcacaaaccttcgtctggcagccagagaacggcgtttatcaacaacgttttgccttaccggcctcggcgatgaccggtaaatggacgctacgtattaacagcggcgacaaccagccgcgcagctggccgttcaatgtagaagatttcctgcccgaacggatggcgctgtcgcttaaaagcaacgctcagcccctgtcgccagatgccaacgtcacctttgatgttgaaggtcgttatttgtatggcgcgccagcggcaggcaacgaactacagggccagctgttcctgcgtccggcgcgtgaagcggtcgctgcgttgccaggttatcagtttggcgacatcactgaggaactgaaacgtagccttgatgatgtggatgaaaagctggacgacagcggcaggctgcagctcagggtcgaaagcagctgggcggagagccactctccgctcaacctgattttgcaggccagcctgctggagaccggcggtcgtccggtaacgcgccgcgccacgcaagcgatctggcctgcggccgcgctgccgggcatacgtccgttgtttaacagcgaatcggtgtacgactatcgcaccgatcgttataacgacgagccaaccgtgccggaaaacagcctcgccgaatttgacgtggtgtacgccaatgcgcagggcgaaaagctggcggcgcaggaccttgatgtgcgtttgatccacgaacgtcgcgactacttctggagcttctctgacagcgaaggctggcagtcacgttacgatgaaaaagatttgcaggaagagcagcagcgcatcagcattgcggcgggcggcagccagaaagtcagcttcccggtggagtggggcacctatcgtcttgaagtgcatgctggtgacaacatcgtcagcagcgtgcgtttccaggcaggttactggtggcaggacaacaccaacggcaccggcgcgctgcgtccggatcaggtcaaactgaagatcgacaaagccgcctatcaacccggcgacaccgcacgtgtcacggtggaatccccggcggccggcaaaggctatctgctggtggagtcgagcagcggcaccttgtggtggcaaccgctggat

SEQ ID NO: 65210 - DNA, 351 bp, Glycine max
  Peptide Sequence Number=SeqID_156895
atgaagaacataaccaatacagggaacaagggaataccggaccatatctgcttttgcgctatgacaatctcactcgaattacagggacctacacatatgagtacagtataccggggtccccggccagaaccacacgtgcaagtttccctgcatgtggctcgcaacctgccttttattcagatgttggggcaaggcaagtcccaggaaagtataggttggcttccagctccatctcggccggcatcctgctctcgagggggtggagtcctggggcgaactactcattgccctccttcgtcccctctcctttcagtcgagctctactctgtcccctctacttctagaggataa

SEQ ID NO: 65211 - DNA, 702 bp, Glycine max
  Peptide Sequence Number=SeqID_156896
atgagacaacttggctaccctatgagaggggcaccactagaggaaagcctcacacctattattgcacgaggtttcaatagcaccaacgcgggggtttttcagaaggtccgcaaggcatgggagatggtgcaaaagaaggacaaggaacttaaaggcagtagcaacgggcccatcggcggctaccataggtggttgaaagcctacgcacaaggtcttgattggctcccgaatttgagaaccactaagagggtggaggttgaaactctggaagaagacgaagagatacaagtcctcaagacagaacttgagaaagcccaaacagtcaaagaaaagttcaagtcagcagctgttaggatccgaaaggagaacgccgaactgagagacatcaatatagccaccgccaaggccttagaacaagagaccaagagggcccatagggaagaacatggtcggaacaaattccgaggggctttgtggggcagtaacagcgagcttaagctccgaagaaaggaaaaggaccaatcgcgagtagatagtttgatcttgaaggatgaattcagggtttgcctaaggtccaagaggagcttgtctcaacggttatgcgagaccgaaaccaacatgttagccatcatcagcaagtaccaagaagagttaaatctagccatggcccacgagcacaatgtagcagacgaatatgcctga

SEQ ID NO: 65212 - DNA, 906 bp, Glycine max
  Peptide Sequence Number=SeqID_156897
atggctccgaagaaactcttcacgaagaggtctagaagggacaccactggagaaggctcccgtgctacctcagagtttgatagtcaccgtttccggagtgccgagcaccagcagcacttcgaggccatcagggggtggtccttccatagggagaggcatgtccaactcagagaagatgagtactcagacttccaagaggagatagctcacagacattggacacctctagtgactcccatggccaagttcgaccctgagatatggattcccttcgacgcaaatgccctcagccagttcctgggcgacccgctgattttggaggaaggccagcggtgtgagttcagccaaaggaggagccaggccgacgatttcaatgaggaagccatcgcccaactattgtgcataccggggcaggatttcacccggaccgctgcagggaggcgggtgtggatcatgcgcaccggcatgactactttgacccagatatggatgacactactgctcagcaatgtcttgcctagtgatcacaactccgacctccctttgcctaagttccagttggtgtatgtcatcctgacacggatgagcgtccatgtggcccaggtgattgctgatgccatttatttgtttgcaggtatggtgcctactaggcaccctctggacccagagaagtccaatagggccttggggttttcggctctgatcacaggcctatgtcagtcctacggagttcctgacatccccagcaaggccgctggcacaccgccaccacctcggcaggtcgactcggctgggccactgggcgtggagcgttatctacagcatttggttcaccagcagcctcagtcagcaggggcagagttccaccccttttgtatgccctaccccagagcagtttgggctgag

SEQ ID NO: 65213 - DNA, 207 bp, Glycine max
  Peptide Sequence Number=SeqID_156898
atggattttatgggggagacctttgtggttgagtgggcattctctgttggatgggcgtcagactgggaggagaacactagtaatgtgtccactatcattgttatcatctccctctccatcattggaggtgctacttgggctgccaaatccctccacctctatgcgtactccttgaaaggctcatgctccttcttgcacatgttttga

SEQ ID NO: 65214 - DNA, 489 bp, Glycine max
  Peptide Sequence Number=SeqID_156899
atggtgcacgtgcccagtgagaatgccaaccactccattcttattctccttgaaagccagcaaccgcagttggggcatgcaccctttgctcaacctatggcagaagcccgtaaagagccccgggatcacactctaggcgacttcgaaacttaccctacatatgtcaccgagggacctacactacctctggccatggaagaaagggagaaatttaatctcatagaggaaaggctgagggccattgagaggatcaatgattatccatttgccgacatggtggagctatgcttagtacccaatgtcatcatccctcccaaattcaaggtgtcggacttcgacaatttggctggggcgacaatcacttggtatactaacttggaagctttctggaaggacatgatggctgctttcatcaggcagtatcaatacaacaccgacatggctcccgatagaacgcaattgcaaaacatgagcaagaaggagcattaa

SEQ ID NO: 65215 - DNA, 191 bp, Glycine max
  Peptide Sequence Number=SeqID_156900
agtttgtaaaaagcattttacaagatagtggaaatctcaagcgggttgcttggggactgggtgtaggcacaggggttgggctaagcgcatatccatcactaagcgtagcttcagcgctaagcacagcaggtgccttcagccaggctaagctcgagactggcgctaagcccgaatccacttacccacgctaa

SEQ ID NO: 65216 - DNA, 476 bp, Glycine max
  Peptide Sequence Number=SeqID_156901
gactttgccagtcgttcggcgtccctgtcacacctagcaaggtgattcggccgcccatcacccgagcttttattgagaagtactgcacgcagagacaggtccagggtaatgcaccacaggccgtggacgcgccgccacctcatcaggctggtccagccggattgtttgatacagagcagtatttgcggcatttggttcgccagcaggcggccaaccatcgggcacatgtacagactcatgattgtctgtatcagatgagtctcagcctgcagagtcagagctttacttcttttccgtgccctactccggaccagttcagggcagaggtcgcgtggcctggggattggcctgaggcccaggcaggagaggcaccagcaggggcaccagcagaggctcccgatgaggcagaagaggcccgcgaggatgaagagatgaccgatttacttgatttcttaggagggagcggagccgcatga

SEQ ID NO: 65217 - DNA, 993 bp, Glycine max
  Peptide Sequence Number=SeqID_156902
atgaccaaaacaaaattagcaaaggcagaaagacctaagtacctcttccttcgtggtgcgacttactactatgtaaggaacatcccgccacgtcacagacataagtttcctgagataaaagggacgcagatttggcgttcgctggaaaccagaaactattcggatgcagtgtctcggctggaaatggtgtcacgcaatgatgacgccgttatgagcggcagagaagcagcaccaaataagcacacttttgaagacttattggaacatgctgaaacgcatcgtttcagctacaagcgatccgacgaaattcgcctccaagagatagctgatagcgttcgggatatggcgttacgtctggcgtccacacaattcttgagccaccctaccatgctggaagtggcagcactggctggagcagaagaattcccagaagtgacgattgacgaggcggtcaatcgttacttggatatcacgccagagtacacgcatgatctaagcgactttgacgccgatcagaaaaaaaagcggcttcgaagatcaataaatgatttcataaagcgttgcgggaacatcaatattctctcaatcgatgatcgggtggtttccgactatcatctgtcaatcaaagctgatgtggtaaaaaaggtcttcggttctgaacacggcattcacatgattgctgacgtaagaaaggtactaaagtcagtcctgaaaacggactaccaacggtctttttcggcaatggatggtcttaaaatcaagatcaaggattctggtaagcggtctgccttcctcgaagttgaagtacggaaaatcctcgaagagcttccatccttccggatgaacgacgaggctaaggcgattattcaactggctttgatcactggatgcggtccgaaagaattatgctggttgacggctgaagacatccacccctttgctaatactccttacattaaaatcggaccgaattctttgcgagctttcgtcaag

SEQ ID NO: 65218 - DNA, 1356 bp, Glycine max
  Peptide Sequence Number=SeqID_156903
atgccacacgataacaacgtagaaatccgagggtttatcgatgaccagccattttctcgctaccagtggttgatactggttttgtgtttcttggcggtagcgctggacggcttcgataccgccattatcggtttcattgccacgtcgctggtgcaggagtggggaatagaaaaaacctctctggggccggtgatgagcgctgctttggtcggcctcgcggtgggcgcgttggccgccgggccgttggcggatcgtatcgggcgcaagaaagtgctggtgatctcgctgctgctgttcggcggcttcagtttgctgaccgccttcgccggctcgctgtcaacgctgacgctgttgcgtttcctgacggggctgggattgggggcggccatgcccaatgccgccacgctgatgtcggaatatgcgcctcagcgctgccgggctctgatggtgaatctgatgttttgcggttttcctctcggctcatcgctgggcggcttttcttccgcctggctgatcccgcatttcggatggcagagcgtgatggtgctgggtggcgtcatgccgctgctgctggcgctggtcttgatcgccgccttgcctgaatccgcgcgctttatggttgcgcgcggctatgccgcagaacgcatcgccaaagtgttgaagcgcattgcgccactgccaaagacgccgcatttcatgttgcaggaagaggggcagataaaggcggcctcgccgctggggatgattttttcccgtcgctatctgctgggcaccttgatgctgtgcctgacttactttatggggttgatgattttctatctgctgaccagttggctgcccctgttgatccgtgaaaccggcgcttccgtcacgcaggcgtcgctgatcaccgcgctgtttccgctcggcggggggctcggcgtattgattatcggttggttgatggatcgcatgaacccgcacaaggtggtggccgtcggctatttgctcaccggcctgttcgtcggcatcatcggctttgtctatagctacccgccgctgatggcgatcacggtattcatcgccggcacctgcatgaacggcgcgcagtcatccatgccggccctggcggccggattttatcccacccagagccgggcgaccggcgtggcatggatgctcggtctcgggcgttttggcggcattctgggggcgatgagcggtggtgcgctgatgcagatgcagctgtcgttcagcaccatattcacactgctggccatcccggcgctgatcgcggcgctggcgttgatcgccaagcacctttccggctacccggcgctgccggcgccgctcaataaaaatgctgtgagggaataa

SEQ ID NO: 65219 - DNA, 346 bp, Glycine max
  Peptide Sequence Number=SeqID_156904
caaggtaattcgaccgccgatcacccgagctttcatcgagaagtacttcacgcctaggcaggcgcaaagtgatgaacatcaggccgcgggtgcacagccaccacctcgacaggccggttcggctggaccactgagcatggacctcagccagcatgggcagggtttcgccccttttgtatgccctaccccggagcagtttggggctgaggtcgcatggcctggagactggcccgatgcccagacaggggaggagcctgcagaatcccccgatgagacggatgaaccccatatggacaaggatatgactgacctactcggtttcttgggagggagcggagccacatga

SEQ ID NO: 65220 - DNA, 4818 bp, Glycine max
  Peptide Sequence Number=SeqID_156905
atgggtaaagaatttccttcaagtgatgggtcaaagttgcgcgttgcttataagggccttccaggagcatatactgaggatgcagctttgaaagcatatccaaaatgtgagacagtgccatgtgaggactttgagacttcattcaaggctgttgaatcgtggttagtggataaagctgttctacccatcgaaagttctgttggtgggagcatccaccctaattatgatttacttcttggacacaagctacacattgttggggaggtgcagttgctaattaaccactgcctcttaggattacctggtgtgagaaaagaggatctcagagctgtaatgagccaccctcagtctgccgtcgacgtatcggtgttctgttctgttcatggcccgattgaaatcgctggagatgttgctggttgctccaagagattcaggacagtggtgaaatcagagcagatggtggagtattctcttgtcgaaagaaacttaattgtgctaatcatatctgtatcgagacttgtgggaaaactagattggaggagaaacgccacatttcccagaagtgtcgatgtggctctacttcccgcactgtggagtgttgcaagacaaaaatggaaaatcagaaatttactttctaatccaaataatattcttaatgcggattgggatccacacttgtgtcaattaccatgtgaatccctgtgccacagtggtcattgtccaccttgtcttcaaactatatttactgatttgacatgctcttgtggcacaccgcctccctcatgtcagcttccatgttcagttcctcagccttgttcgcatccggcctctcacagctgcctttttcgagattgccctccttgttcagtgcctgtagcaaaagaatgtattggtgggcatgtagttcttaggaacataccttgtggttcgaaggatattagatgcaataaactctgtgtgaagaccagacagtgcggtttacatgcatgtggcagaacatgtcacctcccaccttgtgataatctatctgttgtgacatgtggtgctcctaggagagactgccggcatacatgtatagctccttgtcacccttcaactccaagtccagatacaagatgcgaattccccgtcacaattacttgttcttgtggccgaataacagaaaatgttccttgtgatgctggtgctaattataatgctgatgtggtacatgaagcttccattattcaaaagttgcctgtgcttcttcaacctgtggctgcaaatggcaaaaaagctccccttagacaaagaaaactgatgtgtaatgatgactgtgctaagttagagcgtaaaagggttcttgcagatgcttatgagattaccgctccaaatctggattctctccattttggtgagaattcgattgcttctgaattgcttgctgacatgttgagaagtgattctaaatgggttttatctgttgaggagagatgcaagtttttagtacttggcaagagcagaggaaatgatgcacatggtccaaaagtccaagttttctgtcctatgttaaaggacaaaggagatgcagtaagggtgattgctgagagatggaagcttgtagtgaatgcagctggtcgggagccaaagcatttcatagttgttcatgttaccccaaaatcaagagctcctgctcgtgtgctaggggttaagggtactaccactgtaaatgtgccccttcctcttgcatttgatcctttggttgatatggatcctcgagttgttgtctcttttctagacttaccaagggatgcagatattagtgcattggtgttgagatttggtggtaagtgtgaacttgtttggttaaatgacaaaaatgcgttggccgtttttaatgaccctgcccgtgctgcaactgcaatgaggaggtttgatcacggcactgtttataagggagctgtgatggtggttgttccaccaaatggaaatccatggaaaaaagatgttattcaagagctgggttggagagaagatgcttggggtgatgaggagtgggctactggctctgctaatgttcaattgcctattaagaagaaagaagccctaatatctgcttcagcaaatccttggagtgtcttaaatcaagaatcctcttcaagttcatctgttgcagccattaaaattgatggttctaggaaacactatgaaagtagtgttgtcacaaagttggagcctcgtgatggtggatcaaatctaggagggcagcctgcaggaaactttgatgctttagaaggtgctgatgtagtagatgattgggagaaggcttgcagtggaaaaaatggaatgatggtgtatggggtgattgaaggaaagatcaacttggctttgatacatgtcgtgtccttcaagcatcatataacccacccccgtgctggagcttgccccgtcaactataccgaggcatataggaataatgatgcagatgatttatgtgctgatgcctctgctgacttgccaaatgatgcgtgggcgggtgtgttaagagtccttaatcagacagcagcctatgaagcaacggaagtgttgggaagcagtgtcaggcaaggaggtgagactgtagaagattcggagatgacatggaaagctggtagagtccacagcacaaacggggaagggagtgagggggcgatccaaaatggggaaagaatgcatgcatcatgccgcaagtttgtgattcatcctcataaccggtggtacctggcgtggaagcacttcattcttatatgggcagtgtactcatccttcttgactcccatggagtttgggttcttccgaggcttgccccagaagattttcctgctggacatggcggggcaattgtttttcctccttgacatcctcctccggttcttggttggctatcacgaggtccagtccaactccctctccttggtcctggacccccacaagatcgcccttagatacctcaagtcttgcttcctccccgattttctctcctgtctcccctgggactacttttacaaactctcctccaacaacgagctcgtccgctatcttctcttgataaggctctgccgtgctttcagagtcacccaattcttcgacaccctcgagaagaacacccgtgtcagttacttgttctcccgtatcctcaaactctttgtcgttgaactttattgcacccacactgccgcttgcttattttactatctggcaactaccgtgcccccttcccaacactcttatacctggatcggtagcttgaagatgggtgactatacttattctgacttcactcatattgatctttggaagcgttacgtcacctccctctacttcgctattgttaccatggctactcttggctacggagacatccatgccgtcaatgtcagggaaatgatatttgtcatgatttatgtctcctttgacatgattctcggcgcttaccttctcggcaacatcactgccttgattgtcaagggatctaagaccgagagattcagagatcaaatgtctcatattgttaactacatcaataagaacaatttggacaagcagatatgtcaccacattaaagatcatttgcgcttaaagtatcatccaagttacaccggatcttctgttctccaggacataccaaccactatccgcacaaaggaagagtttttcctcccaggagaattggttatggagcaaggagatgttgtagatcaactctattttgtatatcacggtgagctgcctcaaacttccatggttgaagctcatgaattttgcaaggttttacgacttgataagaaatcctttactgaaatactgaagatatactttttagatggtcgtattgtcttgaacaatctccttgaggtaaaagacttgagtctacaacgtaagcttttggagtcagatttcaacctgactattggtaacatggaaacagagctggcaataaggatgaattttgctgcccatgatggtcatcttgatcttgtgaaacgtttgattggatttggggcagatcccaataagactgattacgatggcagaacacccttgcatatctcagcatcaaaaggatatgtagatatttcttcctatcttgttgagcaaggtgtaaatatcaactgtgcagataaatttggcaccactcccttgcttgaagccatcaagaatggacacgaagaagtagcatctatacttgttaacgcaggagctatctttaccattgatgatgttggcaattttctctgcatgactgttgccaagaaggagttggaccttttaaaaagggttctgggttgtggagttaatccaaatgccaaaaattatgatcaacgtacacctcttcacatagctgcctctgaaggtttgtttacaatggcggaagtacttctagaagcaggagcgagtgttttatctaaggacagatggggaaatacacctcttcatgaagctcataccggtggggatagaaatatgatcaaaatgcttgaagtggcaaaagcttctcagttggttgagttgtccaataatattcatgaaactcaagcaacaccaacagatgaaattccgaaaaagagatgtatagtatttcctttccacccatgggatgatcagaaagcggatagaaaagagggagtggtcctaacggttccacaaagcattgaagagcttataaaggaggcgacaaaacatttggaaattccaaacgcttcctgtattttgtcagaacaatgtggcaaaattgtttatgtaggcacgattaacaatgatgagaagctatttctagtgagtgaagcacagaatgaatga

SEQ ID NO: 65221 - DNA, 587 bp, Glycine max
  Peptide Sequence Number=SeqID_156906
taagcagtatacactccgctagcgcccaatacgcaaaccgcctctcccgcgcgttggccgattcattaaatgcagctggcacgacaggtttcccgactggaaagcgggcatgggatgttctttccaacggtaatgccgttcaagaggttgccaacatagcaaatggtttgcaccctggtaactgtatatcagttcttcgagctttcaacaacagtcagaacatgttaatactacaagaaagctgcatagattcctatggttcacttgtggtttattgcccagttgatctgccatccatcaacacagcagtaagtggtgaagacccttcatacattcccctactaccaaatggatttaccattttgcctgatggtcagcctgaccaggaaggagatggagcatcaactagctcaaacacaaacaggaatatagcaaggtctggtggttcactagttacaattgcattccaaattctagtgagcagcttgccatctgctaaggtcaatatggagtcggtgacaactgttaacaatcttattggctccactgtccagcaaataaagtcttccctaagttgtcctacctag

SEQ ID NO: 65222 - DNA, 225 bp, Glycine max
  Peptide Sequence Number=SeqID_156907
atggcttgtctcctcatgttacctaaaaggggtgcagttttcctagttataaattctaaggatgaatacagtctcattgctgttattcaggttatgagtgggatattggacattttcgtggggctcagcgacctagtgtggactgctttaggaacacttcatttggtctgtctcgggaagaggttgggtcattatctgatgtgtcagggacctaatgtgaactga

SEQ ID NO: 65223 - DNA, 675 bp, Glycine max
  Peptide Sequence Number=SeqID_156908
atgagaattgtgagagaggaagtggtggaagaagtgaagaggctatggttagcagtgcctctcttctcagttggaattttgctacacattcttcaagccatctctattatgtttgttggccatcttggtaccctccctctttccggtgcttccatggcctcttccttcgcatcagttaccggcttcaacttattacctttttatttatttgcatcaagcaaactagttattggggttagctactgcactggacacattttgtggtcaatcaaatggagcaggacagtaccatatgcttggcatacacatgcagagatccatgcttgttgctttaatgacatgatcccaagtttatttgcttacggtattcttcggtgcattctcaagttcttgcaaacgcaaaagattgtgttcccaatggtgctaacttcaggaattgcagctgtgcttcatgtccttttctgttggcttttggtttttaagtcggggcttgcaaacagaggagcagccttggccaattccatatcttattgggtaaatgcaatcttgatttctctgtatgtcaggttctcttctgcatgcaaacactcttggacaggtttttccaagatggccctgcacaaccttcttgatttccttaaactcggtgctccttcagctgctatgcactggtaa

SEQ ID NO: 65224 - DNA, 765 bp, Glycine max
  Peptide Sequence Number=SeqID_156909
atggagagctttgagaaggggataatggacatcgaaaaaaggttttccctattagagatgcttaggcgaatatcttcgatagagagctttgagactccaccgcgtatcttctgggctcagcgaggtgtgaaagtgtgcactaagcctggcctgtgcgctaagcgagggtgtgcggaaagtggagatgtggtcgatagggaggaccagaagaaatttctagatagtgttgattttctctctcagcatggtatgcctgccttgatttctgatatggaagcagcaacaaaagaagttctcaaaggaaagcagttgagtactttcttcaacagcacaacgcttcatgaaactatcatgcagatactcaacaccttcatgagcatggggactccaaattcctggataaagtatatgatacctgaagatgttagaccgtattccacaacctctggcagtgatgacccggtaccatttgacgtgactgaatttgaacaacttatgattgaagcacgggcagtattatcaagtgctgaatttggaagcattgtagagatatctctgaaagcagtggtggatacactggtggagcttatgaggactaaatttagtggaggaagtgtagctgagggcatgccgctggccagagtgttgcctcaagttgcacagatattgcctttcaaatgttctaacagtgctagtgtttgctcttgtagattctacatcatgatgagatatgcaagagttgttcaatggtgtccaatattttga

SEQ ID NO: 65225 - DNA, 675 bp, Glycine max
  Peptide Sequence Number=SeqID_156910
atggtggcgtctctggtgctctctagagctcctcctctgattgctctgttagggttcttttctccctcaggaactggtcttggaaatcctgtcatggcttctgatgcgactcggtgcaccttggaagatcttccagaaacacctccgtcctctacacaacgtttactgaacgacccatcatccatagttgattatggtggtggctccccaaccaatcacaattatgaggtcattgaagtctgcaatggagacctatatctcatcaacagagagactgtgtcctattttggaaccccgctactaggagacacctacaaagtggttgaggattgcaactcactggaaacggaagtgagaattcaccgtctgggtcacaattgttggaggatcgttgtaagatggagtggttttcctaaattaaggaatgttcatggggctgtttatgcctctgtgtcaccacggaaatcattatttctctgtttggcaaatgaaggagtcttggactacattgctgaataccgtgatattctgttgctgtcaagcaatgaagtttttgaagttattacgtataaccggagagataacagactagagtatactgacattagctccaacaaagtttggttgcactccagtgattatgttgaaagcttggttttgccttattgtaactga

SEQ ID NO: 65226 - DNA, 4242 bp, Glycine max
  Peptide Sequence Number=SeqID_156911
atggctgaccttcttgtcaaagacgagacctttcacgagctcggtgtcgtcgacggtgccgccgagcttcttcacgatcttcacatcgcggaggtcgaccatgtcgggcttggcggcatcgacgacggaaagaacggcgtcgacggcgaggggagccaggagcgtggagtactggctgacgaccttgctgttgagggatgtgctagcggacttcacgagggagtcgcggtcagagagctcgacggggacggccatggcggtgagaacgtcgacggccttcacggcagccttgtggagggcgtcggagacgacggtggggtggatgccgtgggagaggaggaggaggcactgctcgaggagggcgccagcaatgacgacgacggtagtggtgccgtcgccggcggcggagtcctgggacttggagagctcgacgagcatcttggcggcgggctggaggacctgcatcttgttgaggatggtggcgccgtcattggtgatgatgacctcgtcggaggaggtggagatcatcttgtccatgcccttggggcccagactggtgcgaaccgcgttggcgacggagcgtgcggccacgatgttggcgtggcggatgtcatccttgcgcttgttgtcaacgtaggactccgtcttcgaggatcggtgctggggagctgctcagcagtcatcagcatgcctatgacctattccggcatatttcagggcttcatcagattcaaagccacgtcgcggcttcgttccgctcctctcagacattctcttccctccatttcatccgctccttttcaccgcaccgccattcgcctccgccaccactcctgctccgccgcgcttcaagtcgtcaagaacacgcgccagaggaccttcaagtttccgttttggcaccaacgcagctccacctatggtcgtttcgcctaccaggacgtctccagtgacgaatccgatgtcgaattcgcgtcttctccctctcacaaccaacaactgggtgattcaactcacgagaacattgacgattggagatggaagctcaccatgcttatgcgcaacaaagacgaacaagaagcggtgtccagggagaagaaggaccgtcgcgatttcgagcaactttccactttagctaccaggatgggtttgtatagccggcagtatgcaagagttgttgtgtttagcaaggcgcctttgccaaactaccgccctgatttggatgataagcgtccacaaagagaggtagtcttaccacttggtgttcataaagaagtagacgctcatctccttgcccatctttcacaaaaggctagaaacaagtgggattttatggaagattccttgcataactcaagtgattctagaagcattccagccaatgaaagaatgtatgaacagccagagcccgtgacccataatagtgttgtcaaggagaaaatccttcaacgaaaaagtttgcaactgcatcatcagcaacaggattggcaggagtctcctgaagggcaaaagatgcttgaatttcgtagaagtcttcctgctttcaaagagaaggatgcatttctgagagttatttcacagagtcagggtgagcctttgtgcaacgataaggttgctatcttttgtaacttggaggtcacaagttcaaatcttggaagcagtccctgtgaaactggttgtggtaagaccacacaacttcctcaatacatattagaatctgagattgaagctgcacgtggagctgtatgtaacataatctgtactcagcctagaagaatatctgctatgtctgtttctgaaagagttgcagcagagcgtggggagaaattgggagaatctgttggatacaaagttcgcctggagggtatgaaagggagagatactcgtcttcttttttgcaccacaggtgtattattgcggagattgcttgtggataggaatttaaaaggtgtaactcatgttattgttgatgaaattcatgaacgtggaatgaatgaagattttcttctcattgtcttgaaggaacttctccatcatcgtcctgatttgaggttgattttgatgagtgcaaccttaaatgctgagctattttcttcatactttaatggtgctccaactatgcatattcctgacattctggaaaggactggatatcgattgacaccgtataatcaaattgatgactatggtcaagaaaaaacatggaaaatgcagaagcaagctcaagctttcagaaaaagaaagagccacattgcttctgctgttgaggatgctttagaagttgcagaatttaaggggtatagcctacgcactcaagattcattgtcctgctggtaccctgactcaattggttttaaccttattgaacatgtgctttgccatattgttaagaatgaaaggtcaggtgctgttttggtttttatgactggttgggatgatataacctctttgaaggatcaacttcaagctcatcctttgttgggtgatcagagccgagtattgcttcttgcatgccacggctccatggccagctctgagcagaggttgatatttgaaaatcctgaaggaggggtgaggaaaattgttcttgcaactaacatggctgagactagtattaccatcaatgatgttgtctttgtggttgacattggaaaagcaaaagaaacatcatatgatgcattaaataacactccttgtttgcttccatcttggatatcaaaagctgctgctcggcagagaagaggaagggctggtcgtgttcaacctggtgaatgctaccatctttatcccagatgtgtttatgatgcttttgctgattatcaattgccagagcttttgagaacacctttgcagtccttatgtctgcaaatcaaaactctacaacttggaagcatctctgagtttttatctagagctctacagccaccagagcctctatcggttcaaaatgctattgaatatttgaagattattggggccttagatgagaatgaaaatttaacagttttagggcacaaattggcaatgcttcctgtggagcccaaacttggcaagatgctcattttgggagctatcttcaagtgtttggatcccataatgactattgttgctggtcttagtgtaagagatccatttgtaatgccgtctgacaagaaggatcttgcagagtctgccaaagcccaatttgctgctcgtgactatagtgatcatcttgcactcatccgggcttatgatggttggagagatgctgaagcgcagcaagctggttacgagtactgttggcgaaattttctttcttctcaaacacttagggccattgactctcttcgaaagcaattcttttatttgctcaaagatatttgtctggttaataacaattctgaaacctacaatacatggagtcatgaagagcatctactccgagcagtcatctgtgcgggtttgtttcccggaatatcctctgttgtgaacaaagataagtcaatagcactgaaaacaatggaggatggtcagagctctgtaaatggttgtgtaccccgaattccattcccatggttagtgtttaatgaaaaggtgaaagtgaattcagtattccttagggattcaactggtatatctgattcagtgcttctcttatttggtgggaatgtatccagaggtggactagatggtcacctgaaaatgttgggagggtatttggagtttttcatgaaaccagaattagccaagacttacttgagcttaaagatgggactggaagaactgatacagaaaaaacttttggatcccatgttggaaacacaatcgcatagtgaacttctttcagctgttagattgttggtatcagaggaccattgtgatgggagatttgtctttggtcgccaggtcctaccacaatcaaagaaggaaacaaactccaaaactggtggtgtagctgaggagaaaaattataaaaatcaccttcaagcattccttaacagggctggacatgattcaccaacttacaaaacaaaggagctgaaaaacaaccaatttcgttctactgtcatattcaatgggttgaattttgttggtcagccatgcagcagcaaaaagttagcagaaaaatctgctgctgctgaggctcttctatggttaaaaggggatagccattcgtctgatgatattgaccatgcatcagtgcttttgaaaaagagcaacaagaaaagtaggaaaaattcgtttagcagtgctaaatggagttga

SEQ ID NO: 65227 - DNA, 459 bp, Glycine max
  Peptide Sequence Number=SeqID_156912
atgtgttttaatgagttgatatttgcaggttcacagatctgtgagtatgagaaagctgcttctatctcgagtagtcatgatcctcctattgttttggctaaagtagatgccaatgaggagaagaacaggagcagtgagatggataaaactccaaaagagaaggagtcaaagacaccgccaccaccacctacgtcacaggagcagtcttcgaccaccagcagtggaacaattaatcctgagtggcctggctttcaggcatattctcctatagctccacatggtttcttggcatcaagtccccaggctcacccttatatgtggggtgtccagaagctcttagattttgctgaactcaaggacaactctatatctttctttgacattgagaaacatgaaactgccattttccgttggtctagagctacaaccagagctgccaaggaattgaatagagcttaa

SEQ ID NO: 65228 - DNA, 1371 bp, Glycine max
  Peptide Sequence Number=SeqID_156913
atgagtagtagaaagagaacggggatgcgggaaggttacgagtttatgccaatacgagatgttggtagatctgttggccagaaagccaagttgattggggttattcttgacttcggctttccaaagaaatccaagggcactgatttttgttgttgcctaagaataattgatgaaacacatcaccaaatctccatggctattaacatgtttgaggaaaatgtagaaagacttccccgtcttgctgctgtcggggatgtagttgtgctttgttgtgttgaggtaaaatcatttaaaggggaagtaaatgttactttcaacaagagattttcctcttttggtttatataaaggcaaagatggtgatgatttggatccttatcacgtttcttcttattttcaccacgtacgtgaagacgagagcttaatagttaagcttagaaaatggctgatgaattttcagcctcacgaagattcgagtaatttccccatgttaagagaaatcaaggaagaaacttctgttaatttggcatgcaagatccttcatttttgcgagactgctaaagatgagtggattatattttcttgggatggtactaacactccttcaaatgtcatatgttcaaagcttgaagaggaaattaactgtccacttcctttacaactagaacccttgcctttgtcaagagaggttctatgtactttgcctgttgctggatccatcttgaggataatgtttgataaagtcgttgtgaaaaatcatctgcaccttttaaatgttgataaatgggtcaaatttatgaatattcatcttaaggtggttgatggactatggcttggtgttttttcccctcaatcaagacttcgatatacaccaaatgaggacagtctgattgtagaacgtcaaaggttgtctgatgagcagttatttcctaagcctttatttattacagaagaagttaatcaagatcatgcgactcctgttactttaatgactgtcctcactcattcaaaggtggtgaccgctaaattcaagtgtgttgttcgagtggtagcagcaatgccatacctagctaaaaatctgttgtctagtattgggaaatatagaatgcagctaacattagaggattcaacggctagagttcatgcttttgttactggcaaggatggggagaccctttttgatggttacccaagcattgatgagttgacaaggaagctaaatagattacttggagtaactgggataaaggatgctccaagagatccaccatgggttagtgtttgtctcaagtcatattatgtctccaaaactgatgtatggggcagtagaaacttcaaaatatttggcatcaaaatagtaggcgatacgtga

SEQ ID NO: 65229 - DNA, 2004 bp, Glycine max
  Peptide Sequence Number=SeqID_156914
atggctggccccaagcccaagttgttgttcctgattgtcatcctcagtctctctgcctccgtcggcgcccgccccttcgtccttatcctctcccaggaagactacaaggacgacccccccgccgatcccgactcgcccgccgagtgggatgagttcgcccacggagacgcccacaaatccgaggaggacctcgaccccggctcatggcgccccatcttcgagcctcccgccggagatccccaacccctccccgaatccgacgccgcctactactccgccgtccacaagctcatgtccggcgagcccgccctgatccaggacgccggcgaggagatcgccggcctggccgtgagcgggcaccctgcggcgcaatcggtgctagggtttttgtgggaaatggggctttttagagagcggagcaaggggaaggcctttctgtaccaccacttcgccgcggagggaggcaacatgcaatcgaagatggcattggcctacagctacacgaggcaggacatgttggagaaaggtgtaaagctgtatggggagttagctgaagtggctgtgaacagctttctgatatcgaaagagtcccctgtgattgaggcggttaggcttcacaacggggccgaagagaacaaggaggctcttgggaaatcgaagggggaagaggatgaggactttcagatactcgagtatcaggcccagaaagggaatgctgctgccatgtacaaagttggactcttttactactttggcctcaggggactgaggcgcgaccactccaaggccctctggtggtttctcaaggccgttgagaagggtgagccgcgatccatggagctccttggagagatctatgccagaggagcaggtgttgagagaaactacaccaaggcattggagtggctgacccttgcttccaggcaccacctctattctgcttacaatgggatgggctatttgtatgtcaaaggctatggagttgaccaaaagaactacaccaaggccaaagagtattttgagaaggctgcagataatgacgaggttggcggccactacaacctcggcgtcatgtatctcaagggcattggagtcaagagggatgttaagctcgcctgtaagttctttgtcctcgctgctaaccatggtcaaccaaaggccttctaccagctcgctaagattttccatactggtcttggcttcaagaagaatattcccttggcaactgcactgtacaaactagttgcagagcggggtccatggagttctttgtctagatgggctctagagtcatacttaaaaggtgatattggcaaggcatttatgttgtattcaagaatggctgagatgggctatgaggtcgcacaaagtaatgctgcttggattcttgacaaatatggggaacgtagcatgtgcatgggtgaatctggattttgcactgatgcagaaaggcatcagcgggcacattctctgtggtggcaagcttctgagcagggtaatgaacatgctgctttactcattggagatgcgtattactatggtcggggtactgccagggattatgagcgagctgctgaggcttatatgcatgctaaatcacaatcgaatgcacaagccatgttcaatcttggatacatgcatgagcatggccaaggacttccatttgaccttcatctagccaagcgttactatgatgaagctctagaccatgatcctgcagcaaagttgccggtcacactggctctttcaagcttgtgggttcgtaagaactatgctgacagtttcgtggtgattgattcattgccagagctgtatcctaaattagaagcttgggtggagaatgtgcttttggaggaggggaatgctacaattctgaccctctttgtatgcctcctaactgtgctgtatctccgtgagaggcaacgaaggcaagctgctgttgcagctggagaggggaacaacacttgtatagcggtggaaataagtgcatttgtagataggtag

SEQ ID NO: 65230 - DNA, 477 bp, Glycine max
  Peptide Sequence Number=SeqID_156915
atggcatccaggaagagaaagagcatggcttctagacccatagctcagtatgataccaagcgtttccaatctctgggatcttggaacagatatacggacaacattctcagccggaacatcattctgaagagaaatgttaaaatttatcatactgagttcgacgagtttaaagtggatttggagaggcgtaatttccacaaacacctcaccaacctccaagctggaagcatagacgtggttgtggtgaaggaattttatgctaatctatacaacccaaaggaaccagcccctaaacaagctagagtaagaggacatctgattaagatcgatgcagacagcctgaatgaatttcttcatacttcaatggtgttagaggaaggggaatctttacccacctactctaggtttgttatgaatgctgagggccaaccatggaaacttctcagaaaagatctgacgacactggcccagacatag

SEQ ID NO: 65231 - DNA, 309 bp, Glycine max
  Peptide Sequence Number=SeqID_156916
atgactagtttggcttcattgtcatccaagaatacatacttcaagtgtgcagggaaagtaatatgtttaactctgactaaaacatcttctatcactccatacggcctgatggtggagcgatcaactaactacaaagtcattctggttggcattatctccagctatcccatcctccaacacatagagagcgacatcaaatttatgttggctcctaaatcaataagagccttaccaactgagactgcaccgatcgagcaaggtatagtgacactgcctagatctttgtgcttgggtggaaggatgcgttga

SEQ ID NO: 65232 - DNA, 453 bp, Glycine max
  Peptide Sequence Number=SeqID_156917
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggacaagttttggtgactgcgctcctccaagccagttacctcggttcaaagagttggtagctcagagaaccttcgaaaaccgccctgcaagcggtttttcgtttcagagcagagattacgcgcagaccaaacgatctcagaagatcatctatatcagataa

SEQ ID NO: 65233 - DNA, 342 bp, Glycine max
  Peptide Sequence Number=SeqID_156918
atggatatgaacctgggctatattatttcgactcaaatttctctgaccgcccagcatgactcttctaggcttgagtttccagccttaatcactgctctgtgcaaggccaggggagtcatttctaattcattgacattggagagccttggtccaactattaatgtggcttatatgcttcatttcatgctccagagcctacacagggggcagtccatcatcatgcagagcctgcagggcttgggcttgccatccattatgagcatggatgagtttgatgcacaggtggcctggccaggagcccaaccttctccttctagagggggtggggcctccgtagcctag

SEQ ID NO: 65234 - DNA, 402 bp, Glycine max
  Peptide Sequence Number=SeqID_156919
atgttttattgtcctaatcatagtacgagatttgtcgaaactggaaatgcaaggttcattgaaaatggtgaaataagtgggagtgcagttcgacgagaagtggaaattaaagatgttaaagtttgttgttacaaaattaatgaagaggagcaacacaataatgaacccatgatgcttaatgaacctattatggaagaattgcaagaagtagcattaaggaggtctcaaagagaaaggagaccagctatttcgaatgattatatggtatacctacatgaaacagaaacaaacttaagcattaatgataatgatccaattttgttttcacaagctgtaagttgtgataattctaaagaagtggttaaatgccatgaaagaagagataaattccatggaacataa

SEQ ID NO: 65235 - DNA, 1149 bp, Glycine max
  Peptide Sequence Number=SeqID_156920
attgatgctgatagtctcaacgcattcctagagacacctgtgatattagctgaggcagaaactttacccgtatactccagatactgtaggttgcctacagactttagagagatagaggctgccttatgcatacctggtcgagggttcatcttgaactttaagggccatcctggaaatattctcaggaaggatttgactacactggctccggtgtggagtgtcctctcatactccaacttggcccccacatcacatacctctgatctgacagtggatagagctaggctaatctttggcttagtctctcacttggataagaacataggagtgctgatttctgtccaaatgacttctatagcccaatataacacctctagactttggttccctgctttaatcaccgtattatgcagagtcagaggggttgtatctgacagccttaccttcaagcgcctgagtccggtcattaacttggcctacatcaggaagaactgttggaaccccgagcatctaacagtctctaaccgaggggccaggagggcgagggcaaggccagtcgagcttccttctacttctgcagctcctattccagcatccacttcagcagccccctctattctagctcaaacaaattctcatcgttttgaagccatgctccaaagcattcatcaaggacagataattttactacagagttttcatatgatagcacctccagactctattccttctgttcaacagtttaatgagatggtagcatggcccgggacccaaccttctcttcaaaaggaagacaaaggtcccacagcccaggtacctcagcatatggaggacgagtcatctgaggccaccatcccagagccatttgatataggagaagaggcagaggagacacagctgagacaggtagctgctaccactcctgagcaatcccttgaggctacttcagagccttctgcaccagtggtaaacccaccctcacctcagccagcatcacacccctccactcctcttctacagattctagagtatccaactacaccagtcctagctgtggacacttctcctcctactactccagttcttcagttgacagatgaggaggatggtcaaacacagaagacacaggaccaatcacaggaattttaa

SEQ ID NO: 65236 - DNA, 1193 bp, Glycine max
  Peptide Sequence Number=SeqID_156921
cagaattgcaactgtggtcaaggattcagcaagaggtttggaccgcataaaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcggatctattggacacatttgaccgaagattgggaccagctcttggccggataggaggtagaacaatcagttggttcccccgatggaaggaaggaaaagaaggagtccttttctcatgtggaggatacccaaacattccgctggtaggaacgaggggttgtattaactacaatcccgcgctcgctataagacaactagggtaccccatgaggggagcaccgacggaagaaagcatgtctcctttccttcttaggggcattcgtaatggcatcattggtgggtaccacgaatggctgaaagttcatatacgaggtttagattggctcgccaagttaaaagtcgtcagcgaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatgaccggaacaaatttgcggagctctatggggtagcaatagtgaactcaagttgcgaagggaagaaagggaccagtcgcgagctacatagcatgaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctatt

SEQ ID NO: 65237 - DNA, 449 bp, Glycine max
  Peptide Sequence Number=SeqID_156922
gagcacctaggaaggccagagggaagagatctgaggccccttccacttcaacatcagaggaagcaacaccttcttcttctacacttcctccctcttccaccacagagctcccagtgattcctcctgcacccacacagataccactaccagctcctctctctgtaggacaaacagaatttatttttactcctcagatgcttcactccatgctccagagcatccataaagggcagtccatcatcatgcaaagccttcagggcttgggttttccctccattatgagcatggaggagtttgatacacatatggtctggccaggagaccaaccttcttcctctggagggggtggggcctctacagctcaggagactgtgagtgaggagccactagcaccagcaccatcgccagcagcaacagaggaagagaccactccagctcagaccccatag

SEQ ID NO: 65238 - DNA, 1131 bp, Glycine max
  Peptide Sequence Number=SeqID_156923
ggtgaacccttgggtactagtacctattgccttcagagggctacacgccctcacctacaaaggactacacgtcctcaccttcagagggctgcatgtcctcgccttcaaaggactacacaccctcgcctttagaggacatcacgtcctcaccttcagagggctacacgccctcgccttcgtggggctacacgtcctcaccttcagagggctaaacgccttcgcctttgtaggacttcacgtcctcaccttcagagggctacacgccttcgccttcgtaggactacacgtcctcaccgtcagaggactacacgtcctcgccttcagagagctacatgtcctcaccgtcagaggactacacgtcctcaccttcagaggactacacgtcctcaccttcagagggctgcacgccctcacctttagaggggctaccaacctcaccttcaaaggtctgcacgccctcgcctttagaggactgcacatccttgcatttagaggactacacgtcctcaccttcagaggattgcacgtcctcaccatcagaggactacacgtcctcctcttcagagggctacacgtcctcgccttggtaaggctgggcatcctccacttcagagagttgcacgccttcgcctttagaaggctacgcgtcctcactttcagtgggctccgtatccacaccttaagagaatttaagcgaccacaataccgatctccccctacggaagtatcaattggtctatgtcatcccgacatagagaaacccaacaaggccctagggtttccagctcaggttacgggcctctgtcagtcctacagggtgcccgtgcccccagcaaggtcatgccatcgtgacatagggatcgcacccataagacacccagtggactcgaagaagtccaatagggtcctggcgtttccagctctgattatgggcctctgtcagttctacggagtgcccgtcgctgtcaacaaggcgcagggcgagacaccacagcagcctggggatagccggcagcgggcaataaacgcaccgccgccacctctagagttcacctcagctcatctacaaaaggttagagcgttgcctacgacacgtggcggaccaataggcgaccaagtccaaagccaaag

SEQ ID NO: 65239 - DNA, 340 bp, Glycine max
  Peptide Sequence Number=SeqID_156924
ggatcgcgcccacaagacacccaatggacccggagaagtccaacaggtcatagggtttccagctctgattacgggcctctgtcagtcctacagggtgcccgtcccccctacaaggtcatgccgccatgacatagggatcgcacccgcaagacaaatagtggacccggagaagtccaacagggtcttaaggtttccagctctaattacgagcctctgtcagttctacaaagtgctcgtcgcccccaacaaggtcatcaagcccctattaacagggctttcatcgagaagtactgcgcccccaggtaggcgcagggcaaggcatcacggcagtgggcaatag

SEQ ID NO: 65240 - DNA, 264 bp, Glycine max
  Peptide Sequence Number=SeqID_156925
atggtcattctgcgccttttgtcatccagaggcggcgagcccaatgacatgcggagaaaccatatggtcccgcacctttttcactgtccagagacaatcaagcccgactgcacacggagacaaattatgatcatccgcacgcttttgctatctgggcagcaagtcgagtggtgggcggagataccttatggtcatccgtgcctttcgtcaaccgagaggaacgagttcagcagtatcaggatgatgttggtcattcggtgctga

SEQ ID NO: 65241 - DNA, 324 bp, Glycine max
  Peptide Sequence Number=SeqID_156926
atggaaagaaacaaaaaaagaatcagcaaaaaagggggcaaaggggtgtatttagtaaataggggtgtgcaaatagcaatcaggcccacttgggccttccaagatgttccaataggtgccttctggtggaagcaacccagctcgcctgggcgagctgagctcgcttgggcgagctgggcgacaaccacctccctcttttcccctataaataggggaaggagggcagagcaaattcgttcaaccctcctggaatatgagattcacttaaaattagtgataaaaattgattctgtgaagaaaatccaagccgaggcacttccgtaa

SEQ ID NO: 65242 - DNA, 243 bp, Glycine max
  Peptide Sequence Number=SeqID_156927
atggcagaatcgtcaaagcaacaaaagggatcatcctccaccaccgctgctgctggccatcgttgccatggaccttatcatctccataatcatcaactctattttcttcagatgatcaacgtctacgtgtttcaaaactctggattggttgaatttatgtccttaaaattgccttactatcctgaacttgttaaagtcttctatagcaatttaaaaattgaggatggtattatttcttctgag

SEQ ID NO: 65243 - DNA, 315 bp, Glycine max
  Peptide Sequence Number=SeqID_156928
atgataacaaaagatgatgacaaaggtgatgacaaaaagctcaaaggtcaatcaaagaataattcaagagttcaagatagaatcaagaagaattcaagactcaagaagaaagttaagagtcaagaatcaagattcaaggttcaagatctcaagaatcaagatcaagattcaagactcaagattcaagaatcaagaaaaggcttaatcaaaataacacatgatttttctcaaaacatgtttaccaaggagtttttactctctggtaatcgattaccagattgctgtaatcgattaccagtaggaaaattgttttga

SEQ ID NO: 65244 - DNA, 1552 bp, Glycine max
  Peptide Sequence Number=SeqID_156929
atgcatcgcgtcggcaaagtggttccgccgaagcgtcacattctgaagaatatctcccttagctttttccctggcgccaaaattggcgtactcggcctgaacggcgcgggtaaatcgaccctgctgcgcatcatggccggcattgataaagatatcgaaggggaagctcgcccgcagccgggcatcaaagtcggctatctgccgcaggaacctcagctgaacccggaacacaccgtgcgtgagtcggtggaagaagccgtcgcggaagtggttggcgcgctgaagcgtctcgacgaagtgtacgcgctgtacgccgatccggatgccgacttcgacaagctggccgctgagcagggccgtctggaagaagtgatccaggcacacgacgggcacaacctggaaacccagctgaaccgcgccgccgatgccatgcgtctgccggagtgggatgccaaaatcgcgaacctgtccggtggtgaacgccgccgcgtcgcgctgtgccgtctgctgctggaaaagccagacatgctgctgctcgacgaaccgaccaaccacctggatgctgaatccgtcgcgtggctggagcgtttcctgcacgacttcgaaggcaccgtggtagccatcacccacgaccgttacttcctcgataacgttgccggctggattctggagctggaccgtggtgaaggcattccctgggaaggcaactactcctcatggctggagcagaaagatcagcgtctggcgcaggaggcttctcaggaagcggcgcgtcgcaaatcgatcgagaaagagctggagtgggtgcgtcagggcgcgaaaggccgtcagtctaagggcaaagcccgtctggcgcgctttgaagagctcaacaacaccgattatcagaaacgtaacgagaccaacgaactgttcattccacctggtgcgcgcctcggcgacaaagtgctggaagtgaagaacctgagcaaagcgtatggcgatcgcgtgctgattgacgatctgtcgttctcgctgccgaaaggcgccatcgtcggcatcatcggtcctaacggcgccggtaaatcgacgctgttccgcatgatgtcaggccaggagcagccggattccggcagcatcgagctgggcgaaaccgtgaagctggcgtcggtcgatcagttccgcgatgcgatggataattccaaaaccgtgtgggaagaagtttctggcggtcaggacatcatgcgcatcggcaataccgagatgccaagccgcgcttatgtcggtcgctttaacttcaagggtaccgatcagggcaaacgcgtcggcgaactgtccggcggtgagcgtggtcgtctgcacctggcgaaactgctgcaggtgggcggcaacctgctgctgctcgacgaaccaaccaacgacctggatatcgaaaccctgcgcgcactggaaaacgccctgctggagttcccgggctgcgcgatggtgatctcgcacgaccgctggttcctcgaccgtatcgccacccacatcatcgactatcaggatgaaggtaaggtggagttcttcgaag

SEQ ID NO: 65245 - DNA, 1995 bp, Glycine max
  Peptide Sequence Number=SeqID_156930
atgctgtcggaaaccagcattgagcagatctgcctgatcgccgagcaggagcagccgaagctgatggtgatcgactcgatccaggtgatgcacatggcggagatccagtcatcgccgggcagcgtggcgcaggtgcgggaaaccgccgcttacctgacgcgcttcgccaagacgcgcggcgtggcgatcatcatggtcggtcacgtcaccaaagatggctcgctggccgggccaaaggtgctggagcactgcattgactgttcggtgctgctggacggcgatgccgattcgcgcttccgcacgctgcgcagccacaaaaaccgctttggtgcggtgaatgagctgggcgtctttgccatgaccgagcagggcatgcgcgaagtcagtaacccgtctgctatctttttgtcacgcggcgatgagatcacctccggcagcgctggtggaccattcgatgatgggcaatccgcgccgtgtggcggttgggctggagcagaaccgtctggcgattctgctggcggtgctgcaccgccacggcggcctgcagatggccgatcaggacgtgtttgtgaacgtggtcggcggcgtcaaagtcaccgagaccagtgcagacctggcgctgctgctggcgatgtcgggctggccggggagattcgtccggtgccgagcggccaggagcgcatttccgaagcggccaagcacggctttaagcgcgccattgtgccggcaggaaatgcgccgaagaaggcgattgacggtatgaagggggtttggcttgtgctccaccttttccctcaccctaaccctctcccgcttgcgggagaggggaccgttcgcaggggcgggaaggacggtaccgatctgttgttaaccgctctgttcaggattttccccctctcccgcgggcgggagagggccgggggacacacattacagcaggtggctgatgccagcgggatgaccaaaggctatctgagccagttgctgaatgccaaaatcaaaagcccgagcgcgcagaagctggaagcgctgcaccgttttctcgggctggaattcccgcgtcgcgacaaaaccgtgggcgtggtgttcggtaagttctatccgctgcacactggccacatctacctgatccagcgcgcctgtagccaggtcgatgagctgcacatcatcatgggccatgacgatccgcgcgatcgccagctgtttgagaacagcgccatgtcgcagcagcccaccatcagcgatcgtctgcgctggctgctgcagaccttcaagtaccagaaaaacatccgcatccattcgttcaacgaagagggcatcgagccctatccgcacggctgggatgtgtggagcgctggcgtgaaaaccttcctggcggagcagggcattgatcccgactgcgtctataccagcgaagaaccggatgcgccgatgtatcagcagcatctgggcattccggcggtggtgatcgatccgcatcgatcatttatgaacatcagcggcagccagattcgtcaggatccgttccgctactgggaatacatcccgactgaagtgaagccgttcttcgtgcgcaccgtggcggtactcggcggtgaatcgagcggtaaatcgacgctggtcaataagctggccaacatcttcaacaccaccagtgcgtgggagtatggccgcgattatgtcttctcgcacctcggcggtgatgagatggcgctgcaatactccgactacgacaaaatcgcgctcggccaggcgcagtacatcgatttcgccgtcaaatacgccaacaaggtggcgtttatcgacactgactttatcactacccaggcgttctgccttaagtatgaagggcgcgagcacccgttcgtgcaggcgctgatcgatgagtaccgctttgacctggtgattctgctggaaaataatgtgccgtgggtggccgacggcctgcgcagcctcggcagttcgatggatcgccgcgagttccagtcgatgctg

SEQ ID NO: 65246 - DNA, 213 bp, Glycine max
  Peptide Sequence Number=SeqID_156931
atgaattcattgcctagcgctgtttatgtgtcctccaccaacgagtctggagccccgcgaattgattgcctagcgctgttcgccaattctccattctccaatcttattcggagacccatgaattcattgcctagcgctgttcatgtgtcctccgttatcaagcgcagagcctccgagaaagaagaaggagagatgagagtcgttatagactaa

SEQ ID NO: 65247 - DNA, 345 bp, Glycine max
  Peptide Sequence Number=SeqID_156932
atggagggggttgttgagttttttggagagttttggttgtggagagattggagagaaccaagcttgaagaggaagctatcttgcaaagcattagacgagattttgagtgattgtgaggtttctagaggtggaggagacatccccgctacctcctccctgctatggagagctaaatcctcaattggttcttcctatggggtacttgattacttcatttcagtatgcttttgccttgatcacgtagatgtatgcttggttagggttattcaacattgggaaatgttttggtcaagtttagtccaacaagagggatctgaggatgacgcttggctaggattaggctaa

SEQ ID NO: 65248 - DNA, 327 bp, Glycine max
  Peptide Sequence Number=SeqID_156933
atggggatcatgaagcatgtgccatatacccttagacttgtcgagtctattgcgcaagtctctgaggatgactttgttggttgtctttgcctgaccattggtctaatgatgtccgacaaagattacaagtatgttcattcctcacatggcgaagggccaaggggagctcaagctatgaagattgtcaggaagagtgcgtggaacatctgcaaattcttggcatcgtcagcacctcttggtgaagtcaagggtgtctgccctgagcgttggctaatagtagctggcacgcaccattttggtcgcaaaggagtgtcccccagcatgaag

SEQ ID NO: 65249 - DNA, 192 bp, Glycine max
  Peptide Sequence Number=SeqID_156934
atggcggtggtgggaacaacaggtagctacggtgggcacgacggagaattttcgaagacaggagatgaagtgttgaatcaatatggaaacacgagtatatatagtacgaaatttacgacggtgtataagcaacaccgtctttgtatacttttatttctacgacggtgtcttcaaaagcaccgtcttcgataa

SEQ ID NO: 65250 - DNA, 288 bp, Glycine max
  Peptide Sequence Number=SeqID_156935
atggtggaaaatcaccatgtaaaggacctcattgaagctcaaagatccagcctccatagaagctccacaagcaagcttccatcactctccctctccctccactcatcttctcctaccttcaagctcttatctatggcttcctatggcgaagcaaaggactccattgatgaagaagatgcatggcctggaagcttcacatggagctacgtcatgtggtatcaagagcatcttcgtctaggtgatgttcttttgcttcctctatctttttgttcggtcaattcactttaa

SEQ ID NO: 65251 - DNA, 438 bp, Glycine max
  Peptide Sequence Number=SeqID_156936
atgagcaccacattttcaaccgcatcaactgagatgaaaaatggcatcatgcgacgaccactgatcatgcaatttatcgctgccttcaacaatgacaagaacgccatacaacttccagccttctatcatactcaatgggcaccaaactatcctgagtttgttcatctcagatacaatggagccatttatgaaatacgagtcagacaacgcagagagaaagtgtatttagcatatggactgcaaaacttccggaaagatttgaaaatctatgagtcaaccagcatcaacttttttgcatgtggccatcactctgtttttgacatacatttcacaccaccactggagcggcaaacttgtggcaggcagaggcattcatccaggaagcacatatggactcttcaacttactcaggaaatgctggatcatcctgaacccctg

SEQ ID NO: 65252 - DNA, 435 bp, Glycine max
  Peptide Sequence Number=SeqID_156937
atggatccagactatgatgaaatgtcaccatgtgcatgctggtggatttctacgaaggcttcttcgaagtcattgctagcatcgacgttccggaaatgtctacatggactgacaattgttgatgtttactggatgccttatgccagcggtccggccaaacatccacctgtgacacaagatgacacatatgtggagccatatatccctgaggtcccagtggcagcagcaacacctacacatgcaccttctgatgcggagcagcctagacatgcagtggcaaattatgtggcttgccaagcaatcgcagaaaggttggagcgtttgctcaacctaaggatagtcactgaaggcacagaagtacacgatatcatggaagactgcttaaggatcgctaggggtgtcactgaagagggcaatgtttatgttaggtcgtga

SEQ ID NO: 65253 - DNA, 222 bp, Glycine max
  Peptide Sequence Number=SeqID_156938
atgatgacaaaggtgatgaacaaaaagctcaaaagatcaaagaacaactcaagtgaatcaagaacaagtcaagagttcaagaatcaagaagaattcaagactcaagaagaaagtctacaatcaagaatcaagattcaagatacaagatctcaagaatcaagatcaagattcaagactcaagattcaagaatgaagaaaagactcaatcaagataagtattaa

SEQ ID NO: 65254 - DNA, 90 bp, Glycine max
  Peptide Sequence Number=SeqID_156939
atggactcacaacataatgatgacaaaggtgataagggtgatgattgggatggtgaatttagaatgaaaatgaagaaaaaacagggtaag

SEQ ID NO: 65255 - DNA, 690 bp, Glycine max
  Peptide Sequence Number=SeqID_156940
atggagagaagtatgatagatgctgttagtggtggagcccttggagacatgacccctgctgaagccagaaatttaattgagaagatggcttccaactcccagcaatttagtgccagaagtgatgttattgtcattagaggagtgcatgaagtagctacaaattcatcctcatcaggagagactaagaagcttgaaggtaaactagatgccttggttaacctggtaacccaattggccatgaatcaaaaatctgcatctgtcgccagactctgtggtttatgctcctctgccgaccaccacacagacctttgcccttctatgcaacaatctgaagcaattgaacaacctgaagcttatgttgcaaacatctacaacatacctcctcaacctcagcagcaaaatcagccacaacagaacaactatgacctctccaacaatagaccatacgttcctccaccaatccaacagcaacagccccagaaacaacaaacagttaaggctcctctgcaaccttcccttgaagaacttgtgagacaaatgactatgcaaaacatgcagtttcaacaagagaccaaagcctccattcaaagcttaactaatcagatgggacagttggctacacagttaaatcaacaacagtcccagaattctgatagattaccttctcaatctgtccagaatcccaaaaat

SEQ ID NO: 65256 - DNA, 889 bp, Glycine max
  Peptide Sequence Number=SeqID_156941
gtcgactctagaggatcccccacgtgctcgccttgagaggactacacgtcctcaccatcagagggctgcacgcccttacctccagaggactacatgtcctcgccttgagagggctacacgtcctcaccttggagggctacacgccctcaccttgagaggactacacgtcctcaccatcagagggctgcacgccctcacctctagaggactacatgtcctcgccttgagagggctacacgccctcaccttgggtactagttaccctcaccgtcagaggactacacgtcctcgccttgagaggactacacgtcctcaccatcagagggctgcacgcccttacctccagaggactacatgtcctcgccttgagagggctacacgtcttcaccttggagggctacacgccctcaccttgagaggactacacgtcctcaccatcagagggctgcacgccctcacctctagaggactaagtcctcgccttgagagggctacacgccctcaccttggaggactacacgtcctcgccttcaaagggtcatgtaccttcaacttcagaggactacacgtcctcgccgtcaaagggtcatgtgccttcacctttgggcacgtcctcaccttcagaggactgcacgtcctcgctttcagaaggctacacgccctcgcctttagagggctacgcgtcctcactttcggggccagtagtttccttttaacggttcctgggccaccccctgatattggaggagggccaactgtgcgagcacaaccagagagggaggctattacacagctactatgcataccggggcaagatttcattcgtgccgctgtaaagagacgagtgcggatcatgcgcaccaacatgaccactcttacacagatatag

SEQ ID NO: 65257 - DNA, 1104 bp, Glycine max
  Peptide Sequence Number=SeqID_156942
atgacgatgctttccaagatatcatcatcactgttactatcactatcctccaaacccaaacccaaacccatttgcaacccctttctgctttctcgttcagccgccacaaaacatcagaagaataaaaaggagaacgcaaaagcagcgttggcgaaggagaagcgcagaacccgttccgataagcagttcaacagagacgcaataatcgagcgttgcagaataaacgacattgacaccgacaccaagttctctcacgttcccgttatgctgggcgaggtcttggacgtcttttccaactccacactaacctccttcgtcgattgcactctgggcgccgcgggtcactccaccgccgttattaggggccatccagagttgaagtatttggtggggatggacgtggactctctagcacacgacatcgcccagcctcgtcttgatgccgttttgaacgctggtgtcaaagcgattaccgttttgaggaattttagagacgtcaagtctgtgcttagagaaatcgctgagctacacttgttgggggttgacgccatcttaatggacttgggaatgtcatctatgcaggtggacgatcctgcgagaggattcagtgtgcttggtgatggaccccttgatatgcggatggatcctcagaatgagatcaatagatatggtgccaaggcaactgttgatggtggaaggcaaggttggataaagacggcaacccgggtgtttcaagctctgagaatcgctgttaatgatgaattgaagacacttgaggattctctctattcttgttttgattgccttgcacctgggggtaggcttgctgtcatatcttttcatagtctagaggacagaattgtgaaacagacatttcttaacataatcaaagggagggaagatgtggaagaaagggagagcctcaacagtgttttgaggaacactagtgatgaaatcaaagaaaaagaagcatggataaagcaagtgatatatggatcaaatggaacaattctcacaaaaagaccaatcacgccatcaggagaagaagaaaaattgaaccgccgaagtagaagtgcaaagctcagggttattcagaagcactga

SEQ ID NO: 65258 - DNA, 381 bp, Glycine max
  Peptide Sequence Number=SeqID_156943
atgggtaatttttccaattttagtttagcagtcgtgatggttggggttccagagaaggagaaaacaggtccaaaggaagccatttcagctcaggggctgacgacaaagttgtcgggaccagacaggtcagcttttgacgacgaggtgacggcgcgtgggatccattgggagcgtgactaccaggggtgggtcgcacttttcgaggcgaacctaaccctggtctcgccaaaaaaaatggtcggagatgatgacggttggcgtgcaatggcgaatgccgatgacaagtgcgaagatgacaagctttgtgcgacagccgacgacgagcgtgaatatgaagagaagggaagagcatggtggcctgtggccatgaagataagctga

SEQ ID NO: 65259 - DNA, 183 bp, Glycine max
  Peptide Sequence Number=SeqID_156944
atggatgcacagtttgcaggaatggatacacacatcaccaagcttgaggaggatggggagattgtggaagcaatgtctttcaagattattttgatggtgccaaagaatcaagagtcaagcaagttccatagaatcaagatcaagattcaagttttaagaatcaagatcaagattcaagaataa

SEQ ID NO: 65260 - DNA, 81 bp, Glycine max
  Peptide Sequence Number=SeqID_156945
atggctaaagtagacttaagcaaaaatggtaaaaattatgtttgcgaaaacaggcactttaatttgtcaccaactaattaa

SEQ ID NO: 65261 - DNA, 411 bp, Glycine max
  Peptide Sequence Number=SeqID_156946
atggaatttcagtttcttcccagattctaccttcttgtttccttatccattctgttccttgcaccctttcacgctcaagctaaaattaaagtgacttactgcgataagaaggcagactatgctgtgaaggtgtctggagttgaaatatcaccaaaccctgtggtgagtggccaggcggctacctttaagatctcagcaacttctggtaaagctatttatggtggagaggtggtaattggagtttcatacgttggggtgccagtccatactgaaagaattgatctttgtgaagaagtaacctgtcctgttgctaatggcaattttctgatttctcacacccaaacattgcctgcaattactccaccgcttcctttgacatcttttaagggtcccttgagccttgacacttaa

SEQ ID NO: 65262 - DNA, 270 bp, Glycine max
  Peptide Sequence Number=SeqID_156947
atgtggcatgtgaacaagcacaatggtagactagccattaacatggtgttgatggaccatacggaggttaacagatctgagattcctgataacatccatgtcataaatgaatttgctaatattatttccagcattgcgtcgcgtgatacgttagttgatgttgtcaatgttgttgctgaagttattgaacgtaagacagttaatcctgtgtacaaagttactgtgaagttgagagataacaatgatgctgagatcatcatgactgtgtag

SEQ ID NO: 65263 - DNA, 858 bp, Glycine max
  Peptide Sequence Number=SeqID_156948
atggttcttcctcacttcaaacattctagattcaaagatgaccaacattgcagtcaccgtatagctgaagtgctagatctagatggtaaaatttcaccagctcaaatttccaatatgttaaaaaggttaggactagtagttgcacctaggagaaagatgtgtgatgctgatgctaaaggacctttgtctactagccctaatctgttagacggtgacaaaataacaggagctaccaatcataaatccgtgaatttggagggaagcctgttggttcagcacctattcaaggactacagaagatgtagttacatgatagccaatgcactggataaggatggtaaattcactactgcccaagtctctcgaaaacttaagcagcttggtttgtctcttcctctgaagagttctggaggaaaaatgcacccaaagggtgcagatctcatggatcgttcaaatgaaaggatggatgaatctgatgatgagacattggtatcactggggtgcttctccttaactaacacaacaatcggcattgatgtccctgcaaggactatgcagactcggagggaatgccattacgtcaatgctgaatatttgttgagcgagcttgaagaaattggttcatccccagaaaatttgaagaaagaaagtgccaattggaataaaactcagggagatgaagaaattggttcatccccagcaaaggtgtggacacaggatatcaaaaacaagcttgatgatgttattaaaggcattgcacctacctctggcagtaacagtgacaaagatgatcataagaagaaacttgttcttgatggtgatttggaaagacaaatcaaagatctccatgagaagtag

SEQ ID NO: 65264 - DNA, 144 bp, Glycine max
  Peptide Sequence Number=SeqID_156949
atggaggcgcgtgggcttcacgcgccgaagaacgcgcgtgttgagggaagaagcccagagtttcaagagcctttggatttgagatcaaatctttttcaagggggagggaatgatgcaatcctaccttccaaggacattggatag

SEQ ID NO: 65265 - DNA, 372 bp, Glycine max
  Peptide Sequence Number=SeqID_156950
atgtcgggaaactttacggattacgtaatcatcccttctttggctttcgagatgttttggaacttcacggattgtgcaacaatgcttccttttgactttcgacatgtcacgaaacttcacagattgcctaacgatgggtgccaagtacctcgaagtggtcaaacgagggtcgcatcccaacaaacggatggtccccggatgaaattagggtatgacaggtggcataaagttcaactagctatctgctggagatcaaggcagcggtttggagttgtgatggtgataaaagtcttggccctgatgggttcaattttcaattctcaaggcgtgttgggaatttttaaggccaaagatttgttgtatggtgcatga

SEQ ID NO: 65266 - DNA, 645 bp, Glycine max
  Peptide Sequence Number=SeqID_156951
atgtgtcctcgctggaaatggcgccgcaaaagcttccagccaggaggtccagcaaagacaccgctggagagggttctggtgcagccccataggcagatgtggactttgatagacacattaaaggctgaagaaggagttagagacaagcgctcctgggtgaggggccagtggattcccttcgatgaggatgccatcaatcaatttctggggcatccaccgatcttgaaagaaggccagcattgcgagttcagccagaggaggagtcaggcctccagctttgatgaggatgttgtcagccatttgatgtgcgttccggggcaggacttttcctggagcatagcagggagacaagtgcggatcatgcacaccaatgtagggtcaggcaccccaacagccaaaggaggaccagcaacagctgactgcagatgcgcgactgccgcctctagaggaggtaccatctctgagcaaagtcaggaccccggtcctttcccttggcctacccccgagcatttcggggccatattggcttggcctagagacaagactgattttgagacgcgggcaggacccgcaggggcccttggggatggcggaggagctaaggaggatgacgacatggctgacgtgttggatttcttcacctga

SEQ ID NO: 65267 - DNA, 1431 bp, Glycine max
  Peptide Sequence Number=SeqID_156952
atggcaagaatggcaaaagtggtcaagatctcagaacatgagctagacaggttgaagcaaaatagaaatgaggtagttgggataccgaggaagcgcttggaggagaaagcaaaagctttggcaaatcaaagggagtggacctcgttcattgacatattagcgttgttggtgtttgggactatactatttccaaatgtagatgatctagtggacctagcagcgatcaatgcctatcttgcttatcaccatagcaaggaaagcccggtcatcgtcgttttggaagatacatatgatacactcgacttgaggtctgtctatcctctacaaggtcatcgcatgtgccccaaaaatagaaaagcaaattgggaagaactcttagcaggattcccaaaaattcccttaatggggacgaggggttgtattaattataatcccatgctggccataagacaactaggctaccctatgagaggtgcgctgtcggaggagatcatcgcgcctttcgtcgcccaggcatggaatatagtggaaaggaaagataaggagctcaggggaagtagcaatggtgccatcaacagctatcataagtggttgaagtctaggacgcaagagataaattggctcccaaagctaaaaggcctaagtgggaaagaagctgaagtccctgaggaaagcaaagaagtgcaagctttgaaggtagagctcgaaaaaacaagagtggtcaaggagaagctaaagacggaagtcactagggtcaagaaagagtgtgatgtgctgagagatgtcaacatgactacagtcaaagcattagacaacgagctcaagcttagaaaggctgaaagggacaagtcaagggaggaaagcatggtgttagaggataagttgaaggcttatcaaaggttgaagagaagtttgacgaaacagctaagaagaacgaaagagaatatgttgacaattattgatcaatataaggaaaaggtgaaccagctgctagtcataggcaaaagttggaggaagaacatgcgaaggtatcggctctgcaaatggaaaagggaagcaagagaaagggtgatagaatcattgcacggggaagccatgagatggatggataagtttgctcttactctgaataagagtgaagagcttccaaggttgttagccaaagcaaaggcaatggccaacacgtactcggctcccgatgaagttcatggtcttttcgattactgccaacacatggaagttccggaacagatgaatgccgacatggaggccatgaaggaccaaatggccaccatgatggaggccatgttgaccatgaagaaaataatggagagcaatgcggctgcagttgccactaccaacgccgcagctaaggtggatctgacccacccatttggcataaatcaaatgagtcatccagtcccggatgtg

SEQ ID NO: 65268 - DNA, 774 bp, Glycine max
  Peptide Sequence Number=SeqID_156953
atgggtgaaatagaggaggtgcaagagtggatgaaggccgacatggaggccatgaaagaaaaaatggccacaatgatggaggccatgatgtgcatgaagaagataatagaggtcaatacggctgcagttgccgctaccagcatcattgctgaggtggacccgactcccccatctggcctcaaccaaataaatcatccaacctcggatatggtaggtcagggaggcaaagagttgggaagtacgggcggcccccattttgtgcaagttcaaaacaagcatgtcttcctgccatatgacttgcctcccaactatacaccacccaatgtggcgcacactcccaatgagaatgtcaataactccactcccatactcattgagagccaacgacctcaatttgatcatgcacatatccctcaacccatgggggagacacataaaataccccaccataatctagtcgacttcgagcctcacctcggatacgccactgaggggcaagtagttggtggtgtacccctgccaaacactttggagggccctcagtttcgcccacaaccacaacccttgcattttgcggtgggaagaatccctcctgctatggtagaaaaagggaaaattggaggaggcagagatcatgcttttgctaacatggcagagttatacctagtgcctgacgtcgtcatcccttcaaagttgaaggtgttggatttcgataagtacaaggggactacttgccgcaagaatcaccttaaactgtacaatcggaagatgggg

SEQ ID NO: 65269 - DNA, 255 bp, Glycine max
  Peptide Sequence Number=SeqID_156954
atgggaaagggaagaatcaaaagaattctcagactgtgttttattgaattctttgagaagggagaagggagacacaaaagaattcaggcagttagtcctttgttcttttggaaaagggagaagagagacacaaaaagaattcaagcgaaaactttgaaaggcttttggcaaagaaagaagaagaagaagttcaaagagattcagaaatcaattagaaaagttattgaaaagcaagtcaagctcttgcatttatag

SEQ ID NO: 65270 - DNA, 867 bp, Glycine max
  Peptide Sequence Number=SeqID_156955
atggctagaaagaagcttcgccatacatacataaacaaccccctaaagaggaaaacaacgttcaagaaaagaaaaaatggttttctcaagaaggttgatgaaatcactaccctttctgacattcgagcatgtgctatcatttatactctggatgaacctgagcctaaggtttggccatctaaccagggactagaaagtgtgatttccaggtttaggggagtttctgaattggcacaaagcaagagaatgttgtgtcaggagaaccttttgaaaagaaacataatgaaagctcagggaaaattgatgaatgaaatcaagaagaaggagattggccttttcatgtgtcaatactttgctagttggaacaaccttgacaatgcaaacattattgatcagaatgatatcacattgttggctaataaaaaattggagattacaaagaaaaatgaaattctccaagtccaagaggtgacaccagctattgaaaatggaggagaaaccatgactgaaggagagcaaacacttgtggccaatgtggatgccatgccaaatctgaattggtctaatgacaacatcgatgatggtgatggggatgggattgatgtgaagattggaagatgtttgctcaaaaaggttggtgaaatcactactctttgtgacattcaagcgtgtgctatcatttatactccagatgaacctaaggctgaggtgacaccagctattgaaaatggaggagaaaccatgactgaaagagagcaagcactcgtggacaatatggatgtgatgccaaatttgaattggtctaatgacaacatcaatgttgttggtgagtattgggtttatttgaacattggaagatgttattga

SEQ ID NO: 65271 - DNA, 387 bp, Glycine max
  Peptide Sequence Number=SeqID_156956
atgaggtcctttaattgtgattttccaccatggagatgcagcggaagacaaaggagaagaggtgagaggaggcgccatccactagggaataagccatggaagaaggagcttcaccaccaagatgagccttggataagaagctcggaaggatgcttcaatggaggaaaagaaagagggagagaaagagagaggggggagcacgaaattgaaggaatgaaagagggagagaagtggaactttgaaatagggtgcatctcttgtggatcagttcaagtaaagggtacatccacttggttgttcaaagagaacaagggagggtacatcccttgtggatctttggcttgtaaaggtttctacaagattgaaagaaatctcaagaaccgttga

SEQ ID NO: 65272 - DNA, 336 bp, Glycine max
  Peptide Sequence Number=SeqID_156957
tattggcctcaataccaagatgctcggaatgaggaagatctatgtgctcagtttgagaatgggcttcggttggagatccaacaggcggttagctacatgcagatcacagattttaaccagctggtgacaaagtgcaggatttttgaagataagatgaaggagaggcaagctagaggcgttggaggacctcagagaaaccatccttttagaggaaatagtaacaaaaggatgaagccgtatgctagcaacaaggggaagcaacctatggctacctccaacatgagcaagtcaacactgtggacacctttgctctggatgacactatgtattttgtaa

SEQ ID NO: 65273 - DNA, 2346 bp, Glycine max
  Peptide Sequence Number=SeqID_156958
atggacgttgattcctcgatggtgccggagcccgatcacgatccgccggtgcagaaccatgccgagagagaccagctaggagactcaccgtcgccgtcgttgtcggaggggggcggatctctggctcagtcgccgcctcaacaacagcagcagcagcagcaacagccgccgccggccacggcggctcaggtgcaccagcccaattctctggttggtccgaggctcgcgccgacatactcagtggtaaatgcgattttggagaagaaggaggacgggcccgggccgcggtgcggccacacgttgacggcggtggcggcggtcggagaggaggggacgtcggggtacattggtccgaggctgattttgttcggcggtgccactgcccttgaagggaattccgcggcctcagggactccttcatccgccggaaatgctggcatacaattctatttccattatcacctatgcctcacccataggctgggttgggccaatgaaccccattcctttgctttggattatggaatattgtgtttgtctgaagctttgaagctcagatacttcaaaaagggtttagctggtgccactgctgatgtccactgttatgatgtcataagtaataaatggtctaggataactcccattggcgagcctccaaccccaagggctgcacatgtggcaactgctgtgggtaccatggtagttattcagggtggcattggccctgctggtttgtctgcagaggaccttcatgttcttgatctcacacagcaacggccacgatggcatagagttggtgttcctggccctggaccgggaccacgctatggacatgttatggctttggtggggcagaggtatctcatggcaatcggaggcaatgatggaaagagacctttggctgatgtatgggccttggacacagccgccaagccttatgaatggcgcaagttggagccagaaggagagggtccacctccatgcatgtatgcaactgccagtgcacgctctgatgggcttcttctgctttgtggagggagggatgccaatagtgttccattgtcaagtgcatatggacttgctaagcatagagatggtcgttgggaatgggccattgcccctggtgtctcgccatctccaagatatcagcatgcagcggtatttgttaatgcaaggctccatgtgtctggtggggcccttggaggaggacggatggttgaagattcatcgagtgttgcagtgttggacactgctgctggtgtttggtgtgataccaaatctgttgttaccagtccaagaacgggtagatacagcgctgatgcagcaggtggagatgctgcagttgagttgacacggcgttgtaggcatgcggctgctgctattggcgacttaatttttatttatggtggtttacgtggcggtgtcttgctggatgacctacttgttgctgaagatcttgctgctgctgaaacaacaactgctgcttcacatgctgcagcagcagcagctgcgtctaatgtacaagctggacggctacctggacggtatggatttattgatgataggacaaggcaaaccatgcccgaagcagcttctgatggttcagtagttttgggaaatccagttgccccccctgtaaatggcgatatgtatactgatatcagcactgaaaatgccttgctcccgggaactaggcgaacgagcaaaggagttgagtatctagttgaagcatcagctgcggaagctgaagctatcagtgccacactggctgctgctaaggcacggcaagtgaacggcgaagtggaattgcctgaccgagaccgtggggctgaggcaacacctagcgggaaacagatatcttccttgattaagcctgattctgctgggtcaaatagcattcctcctggtggagtgaggctgcatcacagagctgtggttgttgctgcagagactggtggagcattaggtggcatggttagacagctttcaattgatcagtttgagaatgaaggcaggcgggtcagttatgggactcctgaaagtgcaacagctgctagaaaattattagaccggcagatgtctatcaatagtgtcccaaagaaggttgtagctcaccttttaaagcctcgtggctggaaaccgcccgttcgccgacagtttttcttagactgcaatgaaattgcagatctttgtgatagtgcagaacgcatattttcaagtgaaccgagtgtcttacagcttagggctccaattaaaatatttggtgatttgcatgggcaatttggagatctcatgcgcctctttgaagagtatggtgcaccatcaactgctggtgacatagcgtaa

SEQ ID NO: 65274 - DNA, 363 bp, Glycine max
  Peptide Sequence Number=SeqID_156959
atgttggggaagcttgggaggattgatggggacctggtgttgagagaaacgaggatatgggctacatgggagtacgtgagctcagttggaggtgggcaacaggggatggtggagtggtacctggagatatgttgcgagggtcaggagaccttgggaacgtcaggtggggtgctattgcccaaaaccaagcttgaccaatcccgacccaacccgagcatagtcagtcatcaacagataaaaggaacaaagaccacaaagcaaggaggcttgtggtggctggccagctgtgaatcttgtgtgatatatgggttatggcctctgctaatcgattaccaagggtgggtaatcgattacaaggcttaa

SEQ ID NO: 65275 - DNA, 673 bp, Glycine max
  Peptide Sequence Number=SeqID_156960
atgcatgaacatcctctgattcttctagtgaagaagaacttgcaggatgactctttaatcattgaagaaactgaggtaaattctaaatttgaaaaagttttggaagcctttaatgaaatgcatgaggaaacacaaaggcttgctatttcgaactataagctaagaagcgatctaaaatggcatatcactaaattggcttcaacacaaagtgagcttgttaaattgaagcatgaaagtgaaaaacttgtttcaagttataaagccattggttgtgtttgtgtttctaattctcttaatatggatgattacaaatctttgccaaatgagtttgaaaagtttaaaaaggattactatgaagaacttataaagttacaaactgagttttcctatcttaaatatcttttcaggaaaatgaacaaagaaaagaatgatcttagtcactttctcagtgtgcaaaagcatactaccagtaagactggtttggggtataacaagcaaactaaattttttaagaaaactaagtttgcatcctccaaaaaggtgaacccaaacagagtatccaaaaagaaaaacataatgtatcctaagcttgatgcaaagacttatcattgttgcatgaaaagagggcacacatcctgcaaatgttatgttaggagatttgatgttctgagag

SEQ ID NO: 65276 - DNA, 156 bp, Glycine max
  Peptide Sequence Number=SeqID_156961
atgccaccatctgatgttgcgttgtcaccattggccactgataatgcaaatgacgggaagaagaacagtcaagaacactggggttttaggctcttctctcttagtgtggttatgcgcatgctattcactttcgcacctgtggatgtgccacattga

SEQ ID NO: 65277 - DNA, 363 bp, Glycine max
  Peptide Sequence Number=SeqID_156962
atggcactcaaaagggcactgtggttgatgctgctgctgttatctgtagctgcagctgctaccaacaccaacaatgtgtaccagccttgtgctgatgccaggattcagagatccgatggcttcacttttggcattgccttcagttccagagactctttcttctacaaccagaaccagtcccttcagctctctccctgtgaccgacgcctctctctctctttctccaactcacagcttgctctcttccgtccccgggttgatgagatctctctcctcaccatcaacacctctagtttcttccctaatatggggataatgggattgtggtttctgttcattggttgtactatttgtgctggataa

SEQ ID NO: 65278 - DNA, 345 bp, Glycine max
  Peptide Sequence Number=SeqID_156963
atgaaggcagcaatgaaggttgcgatgagtaatgatggtagcaatgaaggctgcgataggtcaccaaacttgtctcataaaaatgacgatctcggactcattcaccgttggattgtcgtgaaatttaaacagcatgtttgcaacccatttccgagcattctaaccgttgggaatttcgatatcatgtctgatctaagagaaatacctctcatggagaaacaggaatcgcataaagatagtccaaatggaggctttaatcatttctccgttcctctgacgtttgggaactctatcggagcattcggaggaaaaactagaggaatcttagggaaccattggagatga

SEQ ID NO: 65279 - DNA, 348 bp, Glycine max
  Peptide Sequence Number=SeqID_156964
atgatctctcacccagtgaatgaaacattaagaatcgacggtagagatatcaatagtggttgtagtgaaaatagaggtggcaacgatggtgtcaatgacaatggtggtgcgatggtagtagtagtgacaatgacaacgacgatgttggtggcattggtggtggtggtggtgggtggtgatggtggtgacagaggtagtggtggttgtgacagcaacgttggtgatggtgatgaagtgacaggtagtattggcggtggtggtagcagtggtggcaatgacgatagtagtgttagtggtggtagtaatgttagtggcgacgacaattgtggtatcgatggtggtaactag

SEQ ID NO: 65280 - DNA, 550 bp, Glycine max
  Peptide Sequence Number=SeqID_156965
cgcccaatacgcaaaccgcctctccccgcgcgttggccgattcattaatgcagctggcacgacaggtttcccgactggaaagcgggcagtgagcgcaacgcaattaatgaatctaacggaagataaggtcacgcgtatcttggctcctcatgctgccaatactgggcttatgaatctggacctatctaattacaccaatgcagtatctcaacaacccaaagtaaccttagagacttcccccgtgtctacctcagaccatcttcaggaagcagaacaccattggagcatggtaaagaaattggggatgacctgcgacatgaatcatgacagcatcattgaaagtttccgggccttggagaacagagatagaaaagaggcagagaatctgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 65281 - DNA, 582 bp, Glycine max
  Peptide Sequence Number=SeqID_156966
atggaaaaacctaaagcagagattttgacaacttgtgcaaagatttttgctaagccctgccgtcaaaaatccttgtacaagttggccgattttttccgctatctcctgacgggcgagcttcgtatcgtgctctcatcgcacactgacaggaacagcctgatgaaccagccaaatccacaaacagcgcgcagcggcgcgttttccccttttgcctacgggcttttcgccgtgatctggaccgcttcggtgctcggcaataccggtagctttatccgtgacgtcgccagcgcctggctgattaccggactgtcggataacccaaccgccgtcgcgctgatgcaaaccgccgccacgctgccggtatttctgctggcgctgccggccggcgtgctgtcagatattgttgaccgccgccgcctgctgattgtggtgcagctgctgatggccagcgtcagcggcacgctactgctgctgtcgcacaaccactggctcaccgttgaatggctgatcggcctgacctttgtcggcggcgtcggcgcggcgctgttcggtccggcatggcaggccatcgtgccggagctg

SEQ ID NO: 65282 - DNA, 1401 bp, Glycine max
  Peptide Sequence Number=SeqID_156967
atgccacgcgccagacgcgccaacaaagaaggcactggcgaggaaggccgccaccgacatatggaacaggcggtacgggaacgacgggttgaagacaatcttaaaccagtcctgcggcaccacgatgccattctcaatgatgtagccctgcggggtatgcatccagctgttggacgcgaggatccagaaggtcgagatgatggtaccgagcgcaaccatgcaggtggcaaagaagtgcaggcccggcccaacgcggttccagccaaacagcatcacgccgaggaagcccgcttcaaggaagaaggcggtgagcacttcatacgtcagcagcggaccggtaatactgccggcaaactgcgagaagccgctccagttggtaccaaactggtacgccatcaccagtccggacaccacgcccatgccgaagttaacggcaaagactttggaccagaaatggtagagatcgcgataggtctcgttacgggttttcagccacatgccttcgagcaccgccaggaaactggcgagaccgatgtccggttaatcagcgaaggagaggttatgacccgtcttaccgcccaggattttccccaggaactgcttgagctttatgactactatgcacacggtcgcatcagcaagcgcgagtttctctcgctggccgcgaagttcaccatcgccggcatgaccggagccaccctgctcagcgccatgagccccaattatgcgctggcagagcaggtgtcgtttaccgaccctgatatcaacgccgaatacattcactacccgtcgccccagggacatggcgaggtacgcgcttatcgggtgcgcccgactcacgccagcggcaagctgggtgccgtggtggtggtacacgagaatcgcggcctgaatccttacattgaagacgtggcgagacgggtcgccaaagcgggctatgtcgcgctggcgccggatggcttaagccaaagtcgacccggccaaactgatgaacgatttcttcgcggcggtcgatttcctgatgcagcatcccgaggggaacggcaagtcggcatcactggcttctgttatggcggcggcgtggcaaatgcggcggcagtggcgtttcctgagctggcctgcgccgtgccgttctacggccgccagccaaaagcggaagatgtggcgcgcattcaggcgccgctgctgctgcactatgccgcgctggataaaggcatcaacgaaggctggccggcctatgaagccgccctgcaagccagccacaaaacctatgaagcgtatatttatcccggcgtgaatcacggctttcacaacgactcaacgccacgctatgacaaagctgccgccgacctggcatggggtcgcacactcggctggtttgagaaatatttgcacgcctga

SEQ ID NO: 65283 - DNA, 1842 bp, Glycine max
  Peptide Sequence Number=SeqID_156968
atggtgctggccaataatgccgccaccgcgcagggctatcaaaacctgctggcggagccggtacagattcgcttcggcgcgctggatatcagcaaaaacctgctgctgtggattaacgatgcgctgatggcgctgttctttctgctgattggcctcgaagtgaagcgcgaactgatcagcggcgagctggccagccgcgatcgtgcgatcttcccggtgattgctgcgctgggcggcatgattgcgccggcgctcattttcctgctgttcaatcatgataacgaggttgcccgcaacggctgggcaattcccacggccaccgatatcgcctttgcgctcggcgtgctggcgctgctcggcagtcgcgtaccggcggcgctgaaagtgttcctgatggcgctggccatcattgacgatctcggtgccatcgtgattattgcgctgttctacaccagcgatctgtcagtgctgtcgctgagcgtggcagccggtgccatcgtgctgctggcgatcctcaatcgctgcggcgtacgcaacatcgcggtgtatatgctggtgggcgtggtgctgtggaccgcggtgctgaagtccggcgtgcatgccacgctggcgggcgtggtggtgggcttctttgtgccgctggaggagaaagagggacactcaccggctgagcacctggcgcatggcctgatgccgtgggtgaactggctgatcctgccgctgttcgcgttcgccaatgccggtatttcactcagcggcatcacctttggcgatgtgctgtcgccggagccgctcggcattatcctcggtctgctgattggtaaaccgttagggatcacgctgttctgctggctggcggtgaagctgcggctggcggcgctgccaggcagtaccaccattcgcgacattatggcaatcggcgtgctgtgcggtatcggctttaccatgtcgatcttcatcagctcgctggcgtttgacgccgcgcatgaacagctggtgacgttctcgaaactgggcattcttagcggttcgctgctgtcggcgctcaattttaatcatctctactacttctggcaggtgtgcaaaaccggttcggtggtgcgcgccgctgaagtgctgtgcctgacgccgcaaaccgtgactggccagatcaaggcgctggaagagcagctgaatggcgtgctgtttcgccgtcaggggcgcggtctggtacctaccgagctgggccagctggtgttccgctatgccgatcgcatgtttatgctcagccaggaaatgctcgatatcgttaactaccgcaaggagtcgcatctgctgtttgatgttggcgtagcggatgcgctgtcaaaacagctggtgagcaaggtgctggaaacggtggtgatggccggcgagaaaattcagctgcgctgctttgaatcaacgcatgaaatgctgctggagcagctcagccagcacaagctggatatgatcctctccgactgcccgattgattcaacccagcaggccgggctgttttcggtcaagctcggcgaatgtccggttagcttctggtgtaatgcgccaagacctgagctgccgtttccggcctgtctggagcagcggcgcctgctgttgcccggccggcattcgatgctggggcgcaagctgctgaactggatccacacccagggattacaggttgagattctcggtgaatttgatgatgcggcgctgatgaaggcgtttggcgcgcagaataatgcgatctttgtcgcaccgacgctgtacggggatgatgtctatcgtgacgatagcgtgcgcgagatcggcaggctggagacggtgatggaggagtatcac

SEQ ID NO: 65284 - DNA, 273 bp, Glycine max
  Peptide Sequence Number=SeqID_156969
atgtatgctgttattcaagaaaaagaaaagctaagtgcggaaaggcaacctagcctcattacaagcctagtaaaagtccttcggattcaagtttgtgtgttcttgactgtatgtgaccgtgaggctttggttgatgatccttccttgatatctgtcattcctactaacttatctcagttgtgtttcttaataatcatgttcatgtcttcgaaaaactgcatgtcttgtgagaagttgttgatggaagcattgattgccattcatgtcatgtga

SEQ ID NO: 65285 - DNA, 471 bp, Glycine max
  misc_feature (11)..(11): n is a, c, g, or t
  Peptide Sequence Number=SeqID_156970
atgttggtganctgcccctcctccgcgccatatgtagaagtagaggaggaatcattggaaacaactttccaatccttcgaggtggtgagttgtgcctctgtggaaacgagtttgttgctaccttgtctctctaatgcggccctaatggtggcacgggtaaggctcaggcacggtaatgagccaggaatgggtctgggcaaggacagccacgggaatgccgatgtggtcgacattaggggaaacccgtacaaatatgggttggggtatgaacccgggaaaccgggaagaaggaatgcgccgtcaagactccaggcagatagggcatggcccggccttgttagccagtgtttcacaagtgccaggataatgttcgaggtaaaggtggcggtgataggagaggaactccacaagatccgccaagtttcgtgggaccgtgccatcccaattcccaagtggggaactggcgcgtga

SEQ ID NO: 65286 - DNA, 468 bp, Glycine max
  Peptide Sequence Number=SeqID_156971
atggaaaggagtatgattaatgctaccagtggtggagctcttggtgatatgacccctgctgaggctaggaatttgattgagaagatggcttctaactcccaacaattcagtgcaagaaattatgttattgtccttagaggagtccatgagcaatctggagtcaatgagcaacctaaagcttatgatgcaaacatttataatagaccccctcagcagcaaaaccaacaacagcagaataattatgatatttcaagcaacagatacaatccaggttggagaaatcatccaaatctgagatgggcaagtcctccacaacaacatcagtctgtccctcctttccagaatgttgttggtccaagcaagccatatgttcctcctccaatgcaacagcagcagcagcagtcacaacaaagacaacaagcaactgaggctcctcctcaaccttccttagaagagttagtgaggtaa

SEQ ID NO: 65287 - DNA, 722 bp, Glycine max
  Peptide Sequence Number=SeqID_156972
atggagaatggagaattggcaaacaccgttaggcaatcaattgacggggctccagactcgatggcaatcaattcgcgtggctccatactcgatggtggaggatgcatgaatagcgctaggcaatcaattcatgggtctccgaataagattgagaatggagaattggcgaacggcgctaggaaatcaattcgtgacgctcgagacacgatggcaatcaactcgtggggctccagactcgatggtggaggacacatgaacagcgcaaggcaatcaattcatggatctccgaataagattgagaatggagaattggggaaccgcgctaggcaatcaattcgtggggctccagactcgatgcgctacgcaatcaattcgcggggctcaagactggatggtggaggacacatcaacagcgctagacaatcaattcataggtctctgcataagattgagaatggagaattggcgaacagcgcaaagcaactcgatggtggaggacgcatgaatagcgctaggcaatcaattcatgggtctctgaataagattgagaatggagaattggggaaccgcgctaggcaatcaattcgcggggctccagactcgatcgtggaggacgcatcaacagcgccaggcaatcaatgcatgggtctccgaataagattggagattggagacttggcgaacagcgctaggcaatcaattcgcgggtctccagactcgat

SEQ ID NO: 65288 - DNA, 195 bp, Glycine max
  Peptide Sequence Number=SeqID_156973
tacgatctcaaagccaaaaatatcatcacttcagccctagggatagatgagtactttagagtgtcaagttgtactaatgccaaggatatgtgggatactcttcagttaacccatgaaggaaccacagatgcaaaaaggtctagaataaatactcttacccatgaatatgaatccccctacgatgaacccaaatga

SEQ ID NO: 65289 - DNA, 459 bp, Glycine max
  Peptide Sequence Number=SeqID_156974
atgtccaaatcttgtggatttgggatgaccggccctctcgatgagtcgatctcttgctttctcataagggtggacccttgggtacttgtacctatcaccttgagaggactacatgtcctcgccatcagagggctgcacgccctcacctccagaggactacctgtcctcgccttgagaggactacacgtcctcaccatcagagggctgcacgccctcacctccagaggactacatgtcctcgccttgagagggttgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgccttga

SEQ ID NO: 65290 - DNA, 270 bp, Glycine max
  Peptide Sequence Number=SeqID_156975
atgggctcgggaaggttccaagttagtataccaggtggcagctgccccagtaagactttcttagaagaaattttgaggttgttggctttcaatgagtatgggaggagagttattgacatcctcactggaagtgtatgccacattgggtggtgtatagttgagaggcaagtcatatggtgggaaggcatgcttgtttttgcactaaaaggggccccccctgtacttcccaactctttgccttccagacctaccatatctgaggttggatga

SEQ ID NO: 65291 - DNA, 267 bp, Glycine max
  Peptide Sequence Number=SeqID_156976
atgtccccagtggagtcgccaactgtcgcaacgtgcccttttgcgggcgagcgaacgcgaggctcacgggtgtgctttccaaaggaggaaagatgcacggagtcgccaccaacgtttatttgtggaaaacgtcggaaaaatcgaaggaaaccggtcgaaatggaaattctaagttcgggagttgtatttatgtttgaggaaggtcgacaaaagcggggctcttgctcctacgtacccttcatcgaagaggaaatcagacctacgtag

SEQ ID NO: 65292 - DNA, 258 bp, Glycine max
  Peptide Sequence Number=SeqID_156977
cgcgaaggagaatttggcagagcatcagcatcaaggccacgcgctaagcacgagatcaatgtgctaagtgtgggaggtgtctttagccaggctcagcatgtgtgcacactattccagagtgcctatttcgggaaaagagccctagaagcagaaagaggagcaacttgtgcattgaagtctgggttttgtaatttgatagagattagttcgttggagagtgagtgtgagatgctgagaagaggaggaggaatccttctt

SEQ ID NO: 65293 - DNA, 132 bp, Glycine max
  Peptide Sequence Number=SeqID_156978
atgggggatcgacacaggcttaaaggagcactcaaaccagtgattgaattcgtcaggttcccacagtggatcccatcacaatgctcgtcgctcattaactcgttgccactaaagggtcttacagtcgtctga

SEQ ID NO: 65294 - DNA, 875 bp, Glycine max
  Peptide Sequence Number=SeqID_156979
atgcggtcatgggtaaggggccagtggatttcttttaatccagatgcccttagccagttcctgggtgatccgctagtgttagaggagggccaggagtgcgagtttagtcagagaaggaaccgggccgatgaatttgacgaggaggcctttgcccagctgttatgcatatcgggtcaggatttttcccggaccgctgccgggaggtgggtgcggatcatgtgcaccagtacgaccacctcgacccagatgtggatgacgttgctgctcagcaatgtcctgcctagcgatcataactccgacctccctctgccgaagtgtcagctggtgtatgccatcctgacacggatgagcgtccatgtggctcagttgattgctgacgccatttatttatttgcaggtatgccacctaccaggcaccctctagacccagatatgtctaacagggccctggggtttccagcattgatcacgagtctctgccagtcattcggggttcccgtcacacctagtaaggtgattcgaccgccgatcaccctggccttcattgagaagtattgcacgcctagacaggcgcagggtgatgctccacaagccacagacgcaccgccaccacctcatcaggctgatccagctgggtcatttggcatggagcgggggcaggtgcagatagatgagtgtctctaccagctcagcctcagtcagcaaagccatggtttcgctccttttgcgttccctactccagatcagttcagggctgaggttgcatggctcggagattggcctgaggcccaggcaggggaggcgcccgcagaggctcccagtgatgcagaggaggcccgcatggatgaggagatgacagatttactcggtttctt

SEQ ID NO: 65295 - DNA, 159 bp, Glycine max
  Peptide Sequence Number=SeqID_156980
atgaaggttttccgtcgttcttcaccgttcttcatccattcttcattcgttcttcgttcttcaacggttctcgaagaactacgtaggtctgatttccttaccacaattgaggaatacgtaggagcaagggaaacacccttgtcgaccacaaaaagataa

SEQ ID NO: 65296 - DNA, 180 bp, Glycine max
  Peptide Sequence Number=SeqID_156981
acttatcaaggtaattcttgtggcgtctatcctgacttatcttccttcaccggaagtggcgtctaccctgacttatcttccctctttggaagtggcatcatccaaatctccgtagcctgtatcaagcgatccgctcctagtcaggttcacatcatctggtatcagagcttcggctcttga

SEQ ID NO: 65297 - DNA, 696 bp, Glycine max
  Peptide Sequence Number=SeqID_156982
ctgtactcgccacttcgaccagctgttgacgtagcagaagtatttctttggatgatggcagttcttaccatattgtgtgcatcatattggtcagcttggacgacccgagaagcagctattgaacatgataagttgctaaaggatgcttcagatgaactcccaaacactaaatatgctagtgttagtggagttgtaaatatgaatgtgaaagctacagtcctttttgttgtatttgcttcgtgtttcctgtttatgctttacaaactgatgtcgtcgtggttcattgatgttttggttgttctcttctgtattggtggtattgagggcttgcaaacatgcttggttgctcttttgtccagggcgagccctggtgcagcggtaaagttgtgtcttggtgacttgttggtcatgggttcgaatccggaaacagcctctttgcatatgcaaggggcgagccctggtgcagcggtaaagttgtgccttagtgacttgttggtcatgggttcgaatccggaaacagcctctttgcatatgcaagggtggttcaagcatgctggagagtcatacatcaaagtacctttcttaggagctatctcatacctgactttggctgtttctccattctgtataacattttccattctctgggcagtttatcgcaacgaatcctttgcctggattggtcaagatatactt

SEQ ID NO: 65298 - DNA, 241 bp, Glycine max
  Peptide Sequence Number=SeqID_156983
gtaaaagatgttaattcatacttgtcgcaacgtgcccttcgcgggcgagcgagggcgaggctcacgggtgcgctttccaaaggaggaaagatgcgcggagtcgccaccaacgaaggtattagcacctcttacgtcgacaaaagcggggcttttgctcctacgtaccctcctttggagaggaaatcagacctacgtagttcttccttatacgtgaatcaagtgattcctttttacttgaagg

SEQ ID NO: 65299 - DNA, 857 bp, Glycine max
  Peptide Sequence Number=SeqID_156984
atggctcgcaccaagaaaactgggcagatgacgtctgaggcagcaaaggaaatcgctgagaagatcctaagtcattttcaattaagaattctgactatgtttgattctttggaggagcaggcgtcacagggatcattcatccctcacggacgtcaggatgtcctgattgccgccattgtgcgaccagaccaccctggccatgttcatgctgttggagctgtcaccatcaagcaatatttcggattggctccacgaatatcccgtagctcttccttccttcttcctgaagacctacagcagctgacccaacaaatcaaggaccagctagaggagtcgatcacagaaaaagtgactcagcagctgatggcatctttcagccagatcacaaaggagagttatgttgatccctcagggaacgatcctgagacgggtgactcagacaagtgcaggttatacatcgaagcaaatcctccccgcccagttgccctgggaagagtttatgagggatcaacagttcacaacattcctttgttgtctagccaagtgaaggttggtgttgaggaggttagagatgcacaggctctcgttcctgtatccactgatgaggttaccttagtggggcaggcacttaacaccttccttgcttggctgacacatctcgtgaagcctttatcagaacaggcagcagtttctctagcaaaacctccacaaaggctggatcctgaggttaactgggatgctaccgtgttcggggtgtttaatccagacttcccgctgtacataaagcacgaagatctctctgaaatcacacacggtggtcaatgtctcagcatatctgtcttacagttgtggattct

SEQ ID NO: 65300 - DNA, 174 bp, Glycine max
  Peptide Sequence Number=SeqID_156985
atgggggtacaaatagcaattaggcccacttgggccttccagggtcttccaacagaaaggcggtgccttctggtggaagcaacccagctcgcctgggcgagctgggcggcaaccaccaccctcttttcccctataataggggaggagggcaaaacaaaaagttcaaccctcctg

SEQ ID NO: 65301 - DNA, 322 bp, Glycine max
  Peptide Sequence Number=SeqID_156986
atgtttcatctttcataccctaattttgtttggggactatcattcgttgatcttttgatccttgctagtcgacttacagtgttgaacgccagttacagtacaaagcaaggaaccatttggtgtttcgctcaagaatacaaaagataccaagaaaggagggcaaaagggtcttttccttgtttttttctaggccccagcttgcccaggccagcatttggctcgtctgggccaccaaataacttcaacgctaagggactagctcacctgggcaagctgcaactgcctcaaggtggccttttgcctaaaaataggcatcctaagg

SEQ ID NO: 65302 - DNA, 348 bp, Glycine max
  Peptide Sequence Number=SeqID_156987
atgtcgatattggccaggaaagatgaccgatccttgaggtctaaagaagaagcttcgccggatgatgccgatcgaacatttcccaatcgacatcatcaaattgttattcagggattgaatagaataaacaatggccggtgtcagtcgctatatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 65303 - DNA, 591 bp, Glycine max
  Peptide Sequence Number=SeqID_156988
atggcagatcaaggagaatgggcctcattcattgatgttttagcgttattggtgtttggagtcgtcctctttccaaatgtggatgggctagtagatctagtagcgatcgatgcttttcttgcttatcaccacaataaggaaagtctgattgttgttgtgttggtcgatgcttatgacacatttggccggagatgcgagaagagcggagcaaggattgtctattgcacacccgctctttatttatggttggtttctcacattttccaccatgaaagtagacccacctgtttcctacaaggtcaccgcatgtgtgccgagaaagggaaagcaaattgggagcaactcttggctggtatggtaggggcatccattaattggttcctgtcgcaacgtgcccttcgtgggcgagcgagggcgaggctcacgggtgcgctttccaaaggaggaaagatgcgcggagtcgccacaaaggtcgacaaaagcggggcttttgctcctacgtaccctccatcgaagaggaaatcagacctacgtagttctttcttatgcgtgaatcaagtgattcttttacttgaagggcgatcattttaa

SEQ ID NO: 65304 - DNA, 341 bp, Glycine max
  Peptide Sequence Number=SeqID_156989
atggaagccatcacaaacggcatgatgaacctgaatcgccagcggcatcagcaccttgtcgccttgcgtataatattttgcccatgggtgaaaacgggggcgaagaagttgtccatattggccacgtttaaatcaaaacctgaaactgccggaaatcgtcgtggtattcactccagagcgatgaaaacgtttcagtttgctcatggaaaacggtgtaacaaggttggaacctcttacgtgccgatcaacgtctcattttcgccaaaagttggcccagggcttcccggtatcaacagggacaccaggatttatttattctgcgaagtgatcttccgtcacag

SEQ ID NO: 65305 - DNA, 240 bp, Glycine max
  Peptide Sequence Number=SeqID_156990
atgtacattgttggtttgtttgctcaagtgaactatgctcctgatttgatctccaaggtcatgataaaaaagacaacaatagataccatagagccctataccggggcaattagaggcaccatgcatgagcctcaagcggacctaggggcagatcaaaagttctcacccggtaggttgaaaactcggaagggcggcctaggaaaaatcagggtaatgaaaaataaaaagaagaaagaataa

SEQ ID NO: 65306 - DNA, 285 bp, Glycine max
  Peptide Sequence Number=SeqID_156991
atggccttctacaggaagcttttgcttactcgaacccactcagggaagatatccaatatttactttaaagacacaacacgctttggggcatcccgtggactgagcgaaaaggctcaggcgaggctcacgggtgtgctttccaaaggaggaaagatgcgcggagtcgccaccaacgaaggtattagcacctctcacgtcgacaaaagcggggcttttgctcctacgtaccctcctttggagaggaaatcagacctacgtagttctttcttaagagtgaatcaagtg

SEQ ID NO: 65307 - DNA, 174 bp, Glycine max
  Peptide Sequence Number=SeqID_156992
atgatgttttacttatccacttggcggacaaaaattagtttctcccttgacttggttccagttcaggcatcctgcaaggtccattttccactctctgattccaatgatcctccctactacgagcctgttcataattgtgggcactatcgcatgttcaagctgcaccaatgctaa

SEQ ID NO: 65308 - DNA, 1668 bp, Glycine max
  Peptide Sequence Number=SeqID_156993
atgagtgatataaggaagtggttcatgaaaacacatgacaagggcaacaatgccgcttcttccaagccttcttccgataaaccccagtccgagaaaacggtggctggaggtcaggaaagttcagggaggaggataactagcaaatattttaattcgaacaagcaaaaggggaaagatgagaaagaaaagcaggagctccctgctaaaagaaagaatgcgaaggacagtgaggaaattcatgaagacgatggagatgactctgtcttgcccactaataaaaagaagttagctgacaccactccaacaaaaaaattgaagagtggatcaggtagggggattccaaagaaatctgcagttttggaagaaagtgatgaagatgatgacaaagatgctgtgtctgctgctaaatctgctggaaggggtggtggtggtggtggaagaggagcaccggggcgatcaactggtgggagaggtagagggggtggtaggggtggattcatgaattttggagaaagaaaagatcctccacacaaaggagaaaaggaagtccctgaaggtgctcctgactgtttagctggcttgacttttgtgatcagtggaacactggacagtttggaacgagaagaagcagaagatttgattaaacgccatggtggccgtgtcactggatcagtcagcaagaaaacgaattatctgttatgtgacgaagatattgggggacggaagtctgaaaaagccaaagagctaggaacttccttcctcacagaggatggattgtttgatatgattcgtgcctcaaaacctgcaaaagcttcttcacaagaagacaagaaacttgtgaacaaggctgttgcagtagcatcccagtcaaaagtttctccgaaatcacaagttaaggtccctctgtcttcacgctcaccttctaaacaagccaagccgaaaactgctactactgttcagtcttcttcgatgtggacagaaaaatatcgacctaaagatccaaaggatatcatagggaatcagtcacttgttttacagcttcgtaattggttgaaagcttggaatgagcattttttggacactggtaacaaaaagcagggaaaaaagcaaaatgactctggtttgaaaaaagctgtcttgttaagtggaactcctggtataggaaaaacaacttcagcaaagttggtctgccaggagcttggtttccaagccatagaggtggaaatatttcttgttaaatttatatgtttggaaaaggtaaatgctagtgacagccgtggaaaagctgatagcaaaattgaaaaaggaattagtggaagcaaaacaaattccgttaaggaacttgtaaccaacgaggccattggtgttaatatggaacggtcaaagcattacaaatctgtgcttattatggatgaggttgatgggatgtcagctggtgacaggggtggtgttgctgatcttattgctagcatcaagatatcaaaaattcctattatctgcatttgcaatgaccgttacagccagaaactgaaaagccttgtgaactactgtttgcttctaagttttcggaagcctacaaagcaacaggttatcccattttattccccttcccctctgacagatggggtgtataatctgaataacaaattctttagatcccgaaagtga

SEQ ID NO: 65309 - DNA, 1431 bp, Glycine max
  Peptide Sequence Number=SeqID_156994
gctaaggaaaacattaaagaggtaccatctttccaaagtagaaagcttcttttggcatgctctctgaacttgatgtcctgttacttgaagacaaggcagtataatgaatgtgtaaaagaaggttctgaggttttggcatatgatgcaaagaatcttaaggctctttatcgaagaggtcaagcatataaggaactaggtcttctaaaagatgccgtttctgatctgagcatggcacttgaagtgtcccctgatgatgatacaattgcagagcttttacgggatgccaaggaaaaattggcaatggatggtggtgagcatgcacctggaagactagtaattgaagaaataactgaagatgtgccttctggaagctcttctttggaacaaacagtggttcaaccaaaaaaatctggtgactcctctaagagttacagtacagctaacaatggaaatccaaaaacaaatgcagacagtttagatgcattgaaaaaagatcctgaagctgtcagatcattccaaaactttatttcaaataccgatcctgacatgctggcttctttgaatgctggacaattcaaagacgtgtctccagatatgattaaaactacctctgatatggttagtaaaatgtcacctgaggaacttcaaagaatgcttgacatggcttcttcatttcaaggggacaacccattttttagaggaggttcccctgattcttctttcaaccctggatcaatgcctccaaacgtgacacctgatatgtttaaagcagcaagtgatatgataagtaaaatgccagcagacgaacttaagaggatgtttgaaatggcatcctcactgaaagggaaagaatctactccattagcagcagcagtagatgagaatgaaagaaatgtttcgcggtcaaacttaccatcatcaagtactaatggaactactgcttttggagaatcaagttctcataacgtgttttcaaatatgagaaatgcttctcagtcaaacttcccttcctcgagtaccgatctacaagaacagatgagaaaccagatgaaagatccagccatgcggaagatgtcacttccgttgtctaagattgacttttcatattctcattgtattttcttttggcaagtagtacagatgttctcatccatggttaaaaatatgagcccggaaatgatggctaacatgggtgaacaatttggtgttaagctttcaccaggagaagctgcaaaagctcatcaagccatgtcatccttatcaccggagagcttggataaaatgatgctttgggcggacaggattcaaagaggagttgaatccgcgagaaagacgaagaactggctgctagggaaacctggcatgatctttgcaatattcatgctcattttggctgtcattcttcaccggttaggcttcattggtggctag

SEQ ID NO: 65310 - DNA, 1497 bp, Glycine max
  Peptide Sequence Number=SeqID_156995
atgatgccagacactaccctggatggtgttaatattgaaagtagacaagaagaaagcaggaaagaaacgagcaaaaagttgtcacctttgtcaacattggaatcatcttttgaggcacttaatgtaaagaagtttgatggtgatctcaaatcctattctgtttctgttacttgtttgatgaggcgtggtgttgaggttgtgctaaaaatagctgcatttgtcgtggatcctctctatcgccaaacaacagcaaaattcgatgaaggtggagccaagggtcttttaatgaataatcttggtgtatatggtggctgtagggtgctctttgattcacaagaagtgcctgctaagtgtatggcaagccaaaatcaatctgatatttcagatactattgatctttcttttctcaaagattgtattgatcagatggtgttggacatgcgtgtaaaggatgaaatttctccaagtctcaggactatagtaaaccaatttgatgaaagtaacagaaggcccactgatattcaacttcaaggcccgagttcagctgaagatcttgacaatgctgataataatgaaaatggttttgatagagaagaatacgagaactgcacggcctggagtgatgatcatgatgaccaaacagttgttgccgatcttgactataatgatgcagatccaagtttttccagttaccctcaggacaatgctgagcaatttccttccccagaaactgatatggatgacagatttgaaaatgttgaggggtatttatttttgagtctgggttttagttcaaaacaaaacgcatgggcagggcctgatcattggaagtatcgaaaatccaaaggtggggtttggatgccagataaagattttaatacttatatattttttagcattcagtatgaggttcatcctacttctgaagatgggtcgaccctaaaaagtaggcagccaaagagtaagagacaaacagaagttgatttaaatttcacagattctcttgagaaaaaagtgctagatacgttttctcctcccaagaatcccaaattgttactgcttcccgaaagcagattgccttgcaatacaaagcttcctgaggactgccactatcagccagaggatcttgtcaagttatttcttctgtctaatgtgaagtgtctcgggaggaaggcaaacaggttctcagatggatctagagaacaatccaacgaatatgaatcattcccttcgtgggataatggaagtgtttgtggggatgacgctggtgactacggaggtgatcttcatagtgacatggaggactccaacactctaattactcagcctcgtcaggtcaataaaattgaagtccagtatgacaagacttccaaacaagttgatgttcatgcactgaaaattactctttgggaccatgttcaagaatctgttaaacttcctttagagatggggactgtttcactgttgagtaacaagtccaagaaagcattgaagtga

SEQ ID NO: 65311 - DNA, 372 bp, Glycine max
  Peptide Sequence Number=SeqID_156996
atgtcaagaataacacctatgaatgctggtttttgtgcatttcttagtgtcctacttaagctgtttagaatatctgaaactgtgtttgacataacaaagaaagatttgccctcagctaaggatgttggagatgataaggatgctggaaggtacaccttcgatgagtccgtagttttcttaccaggaactaccattttgttggtgcaattgacagcaatggttatcaagttattagggttccaaccaccagtggcaactcagagtgggaaacatgggtgtggactaggatataaccacattgccattctcagaagaaaacaagctagcctccttcaagcacttgaagaacttctgtgtttctcattttgctga

SEQ ID NO: 65312 - DNA, 171 bp, Glycine max
  Peptide Sequence Number=SeqID_156997
atggcgctggctagtgccctgtattcagcttctgatgagcttctagatacagtggcttgtctcttggatttccatgaactcaatgagtcaccaatcagaaaggaaaatccctgctcctggggatcccttgatatacctaagaattcgaacagcaacttgttgatgagctga

SEQ ID NO: 65313 - DNA, 876 bp, Glycine max
  Peptide Sequence Number=SeqID_156998
atgggtgacaatgagaaacaacatctacaaccccatgtagagttgccaatagatgtttcagtcagcaaaactcaatcaaattgcaagcctcaaatccaaatccagtctttgtcctctatcctgacacaattccatgcagggtacttcaggattagtttgtccctcgcaagccaagccgttctattgaagatcctcattgaaccaatccaagatgcacatgctcttagacgtttgttttcatccataccctcttctgtccacaccctcctatggttcctagccttgttcacagtagccacactctcttttctttacattctaaaatgtctcttacactttgacatgattaaggatgagttcttaagccatgttggagtaaactacctttttatcccctggatctcttggctccttttgctagaatcatcaccattcctctccccaacaaaactttattacaaagtactttggtgggtgtttgtttctcctttggtgatgctggatgtgaagatttatggccagtggtttacaaaagggaagaggtttttgtcaattggagcaaatccaacaagtcaattgtctgtgattgggaacttggtgggtgcacaagctgctgcacaaatgggttggaaagagagtgcactttgcatgttttctttgggtattacacattatttggtgcttttcgtgacactctatcagagattggcagggaacaatagtgtcccttcaatgctgcgtccagtgttcttcttgttctttgcagcacatagtatggcaagcttggcttggaactccatttgtggcaagtttgacaccacatgcaagatgctgttcttcctctctttcttccttttcatgtccctggtaatttga

SEQ ID NO: 65314 - DNA, 216 bp, Glycine max
  Peptide Sequence Number=SeqID_156999
atggtagagtctgcgttgactcgtgctagcttttgcactgtcactgctgatcagtgggaaaagctagctagattgcattcacagcagctccagttgttactacatgtgagcaataaaaagaacaaaacaaaaacaagctacactcttaaggaagagatctcaagagcatcagacatctacaaaggacgtaacgaaactggacaaagttatgtttag

SEQ ID NO: 65315 - DNA, 1152 bp, Glycine max
  Peptide Sequence Number=SeqID_157000
atggagcttatactattccttttggctgatacttctggatatgggaggagagactatttagataatgacttgagggataaacttgacagaaggcatgtatctcctcgaagagagagatatgcacatgctgctttacctaatgattttgcacctgctgttttcctaatgttccatgaattaaaaattgcagaatacagtcctacaagatctttggagaaaaaaagtgacaggagatataggagaaaacaggatattactggccaaagtgatgtttctggaaatttgaaagtctcagatagagttcaagatcgagttaaagaaggaaaattgctttcctctggttctaggaataatcttgaggagaagctgaagaaagtagattcagatatcagcactcttcagaaccgaaaattccagctagagaaatgcatatttttgaaggtcttccttgatgagaatgttcaagaagtggatagtcttaattctagaattcgggaacttgaaggtcaattatccaaagaggatgaggagtgcaaaagatcacaagtccgacttcaaaggtttggagatcagcttttctcagacatttctagaattggtgccaatgaagaagatttaagcattgatattttaagcaatggtgaaaatactggtcttcatccaatcgctaaacataatgtggagcagaatgatgcatctttccacagaagaaggctgcatattgaatgtgatgctttggaagagttgaaacaagatagatcaaaagatgggcatttggttgagacagctagaactaggaagcgttctcgctggaatttatctgatcaattgaatgaggactctcttggtactccagacaatggaactgaagttactagatctctagatcttgaaggcaagcacaagaaaggattgaagcaacccaggattgaagcgccatcaaccagcatggcagctcatgtggttgatgaggacgttgatattgaacgttatgatggaaatgatatctatgaaactgcaaatacggaaaattataatggagcggcatataaggtgaagggtgcgccacttatgcttcccccagctttgatacctcgtagcaattattcgcagtatgagggtaacgacgagaatgttgatgtggatggttga

SEQ ID NO: 65316 - DNA, 387 bp, Glycine max
  Peptide Sequence Number=SeqID_157001
atgattgaaagttttcaacaacaacaacaaatgtcaattctagaattgtacgcagaaaaggatgttgctggtggttctatgtttcatgctgcaaattctgttacgtcatgtggacgtaatgtatctcatcatgagtcagaactgccaagaaatatatgcaatttacatgacgatgaagatgatgatgatgattatcttgcgtctaacccaaacattgaagagtctttcgatgaagatgatagtgttgatggaatatctgatacaaacgatgaagtcaccaacatcgttgaaccagtttcaattgttcacccaactgaagcacgcttcttgccattgacaatgacgacaccctccatgtcaccaaccttctcgccattgacaatggcg

SEQ ID NO: 65317 - DNA, 699 bp, Glycine max
  Peptide Sequence Number=SeqID_157002
atgtcgtggctcctccgatccaccaagtctaagttcctctcttcctcttcctcttcttctctttctagaaccttcccctctctccctcgccctcagattggagccatctctcccctccccgatctcttccaccgcaacaccgccaccatgcctttcgcgaaggaaaacgcttccggtggaaacttgaccggtcttcccaaagttcccgcgaataagcttggcagtgattctgatgcgaccaattcttcgaggtacaaagcttctggactgaacaccaatgtgctggctggagctagatatgtctctagagtttgggctgcacagggtcaaatgccattgggagtcaatactgtgatggctagaagttttgagagaagtatggaagctggcacattgggaatgattggtcataaacgttttatgagtgacatcccaagtaaaaccagtgagacaaacccatctggttttcgtccgttatctcctcatcttcctctttatcagccccaactttcttcgaccctctcaattttcaatagaattgctggagctttcctagctgctgttccggaattcctgttctggaatgggtattccagaatagccattctgaaacacctgtttgggaatgactattccaaaatagaacccttgtgtatgacagagatggagaggaagctcttggagtttcaaggaggatga

SEQ ID NO: 65318 - DNA, 609 bp, Glycine max
  Peptide Sequence Number=SeqID_157003
atgtggtttatgtatccttatgtgtcacactcaaattactgtagtaccacattttctggatgggttttcatgatctcagttggatttaacgcagctgcaagtgtgagagtgagcaatgaactaggggcaagaaatccaaaatcagcatcattttcggtgatggtggtgacattgatttctttcataatatcggtgattgtagcacttgtggtgctggcaatacgagatatcattagctatgctttcacagacggtgaagaggtggctgctgctgtctcagatctttgtcctctccttgctctttctattgttctcaatggcattcagcctgtcttatctggggtggctgttggatgtggatggcaaacttttgttgcatatgtcaacgttggttgttattatggaattggcataccattgggttcggttctcggtttctatttcaaactcagtgctaagggaatatggttgggaatgctaggtggcacggttttgcaaacaattattttagtgtgggtcacatttcgaacggattggaataatgaggttgaagaagcagcaaagaggttgaacaagtgggagaacaaaacagagccacttgtgaactga

SEQ ID NO: 65319 - DNA, 1185 bp, Glycine max
  Peptide Sequence Number=SeqID_157004
atggcatacaagggtgatgttgttaggatcaatattgaggagatgctggagggggcaaaggcacccgtaactactgagtgttgcatttacaaagtgccgttaagtatccgaagacacaacgaagaagcctacaccccagaggttgtttctattggcccttttcaccacggccatcctcacctccaagacatggagaaacacaaactcttttactccaaggcatttctcaaacgaactcaaacaactttgtacagttttatcggacagattgaagagatggagcccgagtttcgtcgctgttattcacacactcttgagttcagcaaggagcaactggtcaaaataatctttgtggattgtgctttcatacttgagctcttttacagattcgatagtggagaacggaaagaggacataataaggcacttcactgatctgataagaacttttcacttgcaagatcctctgccgtctaggattgatggtaaaataataaaacatcttcctagtgccactgagttatcagaagcaggattgaggtttaaggttcttgaaagtgagtcttgtttactaaagttagacttttcgggacgggttcttgaaattccgcagttggtagtggaagatccgactgaaactttgtttcgcaatatggtggcattggagcagtgtcactatcctttccaatcttacattacggactacgtttgttttttagacttccttgtcaacaccaacagagatgtggatatactagttcaagagagagtctttattaattggctaggggacactgattcagtggctaccatgattaatggccttatgaaagatattgcgacatcaaatgataccagttctcaataccttgatgtctgtgaaaagttgaatgcttttcataaaaatccttggcgtaagttgaagtcgactctgaggcgagattattgtagaggtccttggcaaactgctgcttccactgctgcgattattcttctcattctctcttttgttcaaacagttttatctatcttgcaagtgttgaaacagattaatttattagtccctcccaaaattactatagctatttcagggagggaggaacaaaagttccaacacaaccgtatacctatttacagtttgatcaaaagagaggtgaaattgggaaagttgtatcactttctataa

SEQ ID NO: 65320 - DNA, 249 bp, Glycine max
  Peptide Sequence Number=SeqID_157005
atgtttgatctaacaagtcgacgcacattaaacagtgtcgtgggatggtacaaagaagccaggaaatggaatcagacggcaattccagtgttgattggaaccaagtttgatgatttcattcagctccctattgatttgcaatggaccatagccaatgagaatctgcaaaagagcttaagtatgaaagcacaatccacgaagattattttgaccagttgctccttgctgaactcaagaatgtgtgaataa

SEQ ID NO: 65321 - DNA, 1443 bp, Glycine max
  Peptide Sequence Number=SeqID_157006
atggcatacagcggtgatgttgttaggatcaatgttgcggagatgctggagggggcaagggaacccgtaaccactgagtgttgcatctacaaagtgccgtttagtatccgaagacacaacgaagaagcctacaccccaaaggttgtttctattggcccttttcaccaccgccatcctcgcctccaagacatgcagaaacacaaactcttttactccatggcttttctccaacgaactcaaacaacttcggacagttttatcggcaagattgaagagatggagcccgagtttcgtcgctgttattcacacactcttgagttcagcaaggagcaactggtcaaaataatctttgtggattgtgctttcatacttgagctcttttacagattcggtagtggagaatggaaagaggacatgtatctttcaaaacctttgacgaggaggagcatgagatatgatttgttgttacttgagaaccaggttcctttttttgttcttgagagactctttaatctgtccttctcttcacagggcgatgacttcccttcatttcttgagtttacgtttcacttttttggatggttcaatagatcaagcttaaactttaacaatattaacagaataaggcacttcactgatctgataagaacttttctcttgcaagatcctctgccgtctaggattgatggtaaaatgataaaacatcttcctagtgtcaccgagttatcagaagcaggattgaggtttaaggttcttgaaagtgagtcatgtttactaaagtttgacttttcgggacgggttcttgaaatcccgcagttggtagtggaagatgggactgaaactttgtttcgcaatatggtggcattggagcagtgccactgtcctgaagaatcttacattacggactacgttggttttttagacttccttgtaaacaccaacagagatgtggatatactggttcaagagagagtctttcttaattggctaggggacactgattctgtggctaccatgattaatggccttatgaaagatattgcgacaccaaataataccagttctcaatactttgatgtcagtgaaaagttgaatgcttttcataaaaatccttggcgtaagttgaagtcgactctgaggcgagattattgtagaggtccttggcaaactgctgcttccagtgctgcgattattcttctcgttctctcttttgttcaaacagtttgttccatcttgcaacatgctgtgcgtggcattggtggccttgcttccggagaagaggaggatacggtggaggacgcggaggaggcaccgctggagcagggaaacgcggtggtggaaccgtcgccggagggtggaggaacggctgagtttccgatcaaatctttcaacgacttttgtgccaatcagcaacactactttaacgccacggttgaccgttaa

SEQ ID NO: 65322 - DNA, 627 bp, Glycine max
  Peptide Sequence Number=SeqID_157007
atggcatacgacggtgatgttgttgagatcaatattgaggagatgctgaagggggcatgggcacccgtaattactgagtgttgcatctacaaagtgccgtttagtatccgaagacacaacgaagaagcctacaccccaaaggttatttctattggcccttttcaccacggccatcctcgcctccgagacatggaggaacacaaaatctattactccaaggcttttctcgaacgatctcaaacaactttggacagttttatcggatggattgatgagatggagcccaagtttcgtcgctgttattcacacactcttgagttcagcaaggagcaactcgtcaaaataatctttgtggattgtgcttttatacttgagctcttctgcagagaccatgatcaaggattgaaccaggacgtgatgtgtctttctatccctcctttgagggatagtatacagtatgatttgttgttacttgagaaccagcatgctgtacgtggcattggtgggcttgcttccggagcagaggaggatacggtggaggacgcggaggaggaaccgccggagcagggaaacgcggtggtggaaccgtcgccggagggtggaggaacggctgagtttcggatcaaa

SEQ ID NO: 65323 - DNA, 549 bp, Glycine max
  Peptide Sequence Number=SeqID_157008
atgaagaatttctcaaattggatactgagtgttggagatggaagtattggggaaagaaatgatgaaggagggcacaggggagttccggcagaggggacacgtggcactcatcttgagccactcatcgatgcactcagcgtggaagcagtggcggcactccggaacgcaccgtatggtctccttgggaagatactcgctcaggcaaatcgcgcacgggccctggtcgctgggcctggacaggcgtttgctctctccgatcacgatcttgggcccgtagcaggtctcgatggcgggcttctccatgcccaggaccacaacgccaggcccatccgaggcgtcacgaaaactactattgttattattattattattgttgttgatgctgtggttgtgacggtggcgagtgatgatgatgacgttggctttgattcggacgcaggcgtaggaggcgagcatgatggtggagatgaggaccaggatgctcacggcgatggcaatgccgtagccgagtccctcggtggcggtgacggcggaggttggattgcgtga

SEQ ID NO: 65324 - DNA, 475 bp, Glycine max
  Peptide Sequence Number=SeqID_157009
atgtctgtgtctgcaaataacctgatcaaccgcaacatcgagcgcgtcagcgccctgtccgtcagccaggccgccgcatttcaggcggcgattctggccgatgtcgccggtcgtcgcggcaccctgcatggccgcgttaagccgctgtcgccgcagatgaaagtcgccgggccggccatcacggtggaagtgcgtccgggcgataacctggcgattcacgcggcgctggcgattgcccagccgggtgatgtgctggtagtagacggcaaaggcgacatcagttgcgcgctgctgggtgaaatcatggcaacccaggccgaagcgtccggcatcgccggcatcatcattgatggtgcggtgcgtgatgctgacgccctcgcgcagggcagctatccggtgtttgctgccggcctcaacccaagcggccccaccaaaagtattcccggacgcgtgaaccatccggtgtcggtggccg

SEQ ID NO: 65325 - DNA, 246 bp, Glycine max
  Peptide Sequence Number=SeqID_157010
atggataatgaagagggagtgcaagaacagatgaaggccgacctatcgaccttaaaagatcatatggcttctatcacggaggccatgctaaagcttcagaaaactatagaagataatgcaacggcgaccgcttccaatacagctagggaagcggaatcgatgctacagcccgcaataaacttgggccgagacagaaacacaacagtgttcggtcggagacttcactcctcgtaccgctccagatga

SEQ ID NO: 65326 - DNA, 468 bp, Glycine max
  Peptide Sequence Number=SeqID_157011
atgggtggtggtgcatggccgttcttagttggtggagcgatttgtctggttagttggaccttgggttgggtcgatcggtccgcctccggtgtgcaccggtcggctcgtcccttctgccggcgatgcgctcctgtccttaactggccgggtcgtgcctccggtgctgttactttgaagaaattagagtgctcaaagcaagcctacgctctacgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 65327 - DNA, 258 bp, Glycine max
  Peptide Sequence Number=SeqID_157012
atgcagggttactttatggttactcgcacctttcatcaaccagggtcaaacgagcccgttgacacaaggagactaacatcgtcttatgcaccttttgtcgtcctgacccgtgaagtcagggcaaacgagcccgttgacgcgcggagactaacatcgtcttctgcaccttttgtcgtcctgacccgtgaagtcaagactgggggatcctcaaggtcgacctgcagccattcgtcaaccaggggcaaacgagaccattga

SEQ ID NO: 65328 - DNA, 236 bp, Glycine max
  Peptide Sequence Number=SeqID_157013
acagcaaaaagaatgtttatacggataaccactcgggtatttccgcccgtcagcgtgactcaaatgtcagtatgacagatcttgtgagcgcagaagatgacgtaaatctccgcgtgtcaacgggcttgttggccgcgattgacgaagggcgcatggtatcaggcttttcgtcttacagacagcaaaaagttttgaaagtgcggacaaccacttgggtatctccgcatgtcatgtga

SEQ ID NO: 65329 - DNA, 213 bp, Glycine max
  Peptide Sequence Number=SeqID_157014
atggtcagatggagaacatacaacttcaaggtagatggagaacaaagagagcaagaaagcttagatggagaagaagacagagagaaggacaagacaacgcgaaggagacgaaacatacctaggtatggtggcgaaggagaagaaacgatgctcgagtgcgacgaacacgatgctcagatgcagacagggacgatttcgctagacggagattag

SEQ ID NO: 65330 - DNA, 672 bp, Glycine max
  Peptide Sequence Number=SeqID_157015
atgcaaagtgctgcgcgggaaggtggacatggcgaccaactacagcctggagccggacgagctggccgccggctgacgctgaaccgtccggcggcgcgcaacgccctcaacaatgcgctgctaacgcagctggcggagcagcttgagaccgccgcagcggataccggagtcgctgtctgcgtgatttacggcaacgaacgctgctttgccgccggggcggatctcagtgaaatggcggagaaagacctgcctgccaccctgaacgatattcgcccgcagctgtgggcacgtatcaacgcttttcctaaaccgctgatcgccgccgtgaacggcttcgcgctgggagcgggctgcgagctggcgctgctgtgcgacgtggtgattgccggtgacaacgcccgttttggcctgccggaaatcacgctcggcattatgcccggcgcgggcggtacccagcgtcttatccgctgcgtcggtaaatcgctggccagcaaaatggtgctgaccggcgagagcatttccgcagagcaggcgctaagcgccgggctggtcagcgacgttttcccggccgcgctgacgctggagtatgccctgaagcaggcgagcctgatggcgcgccactcgccgctggcactgcaggcggcgaaacaggcgctacgccagtctcaggag

SEQ ID NO: 65331 - DNA, 171 bp, Glycine max
  Peptide Sequence Number=SeqID_157016
atgtgcgggcttgctgcgacattagaactcgatgtatggctagtccccatgtgggtggaaggatatgtcatcaaagaactctgtgagcttcttgatgtaggcctggtaaggtatcagcttatgatccctagtctcccattcgcctctcagctggtgatttaccaaggctga

SEQ ID NO: 65332 - DNA, 354 bp, Glycine max
  Peptide Sequence Number=SeqID_157017
atgaggatattgatatgcggtaaaggaaagttatcctttggactggctcgggacatctcgggcttcatcctcctcagcttttgctttatcggggacactcgggatttagagctgctcaaaatcaacatccgagtcctcggtatcactactttcacaggactcattgtcgcaacctacccttcggcggaagggcgacgcgtgactcgcgggatgcgtgttccacgaaaggaatacgcgcggagtcgccaccaacgtttatttgaggaaaacgtcggaaaaaccggaaaagacacgatctacgaacttttaagtgaaaggttcgggagttgtatttacgcacggggaaggtattag

SEQ ID NO: 65333 - DNA, 252 bp, Glycine max
  Peptide Sequence Number=SeqID_157018
atggtttctagaggtatcatccccttcgaagaacatacagcagcagtagggactactagcaacatggagtcgccaactgtcgcaacgtgcccttttgcgggcgggcgacgcgtgactcgcgggatgcgtgttccacgaaaggaatacgcgcggagtcgccaccaacgtttatttgaggaaaacgtcggaaaaaccgaaggaaagccggtccaaaaagaaaattctaagttcgggagttgtatttacacttga

SEQ ID NO: 65334 - DNA, 207 bp, Glycine max
  Peptide Sequence Number=SeqID_157019
atgggtgaatcagatcagactatttcaaccagggttaatcatcccaacactttaactgtgctacagtctcctcgtccagctgccccaacaccctctgctactaggcatggcaattctccccgcaattcggggatccccgcggggactgccccattcggggccctgcggtcgtggaaaaattcctcgcggggacgagaatggggatga

SEQ ID NO: 65335 - DNA, 366 bp, Glycine max
  Peptide Sequence Number=SeqID_157020
atggaagcggcattgttgtgcatcgtgatgttatttaggtattacgacctcttaggaagtatcactttgatgatgcttgcgtctactttaccaaagatgttgatagttactccccatataatgtcttctcaagcctccaaccattcaatacgagagcacctacaattaggaaaatatgttagaagaatagatgtttttgcctccatccaagttaaatcatttgctgaagttgttgacgacaccattgtgtgtagggttatcattgatcttacaaacattagtatcatggacaaaactggtgatacatcaaatgtagttgtggttgatgaagttgaaccacatattctagaccctgcgtccaagtag

SEQ ID NO: 65336 - DNA, 239 bp, Glycine max
  Peptide Sequence Number=SeqID_157021
atagcaaatgagactttttcgcagtcccggccgaaagacgctgacatctccgagaatggtgcagggcatctccgcgtgccaaaggactcacaggtcacgatagcaaaaggtggggcgatcgagaaaagcgaggcttttgctcctacatatcctcaatttgtgatgaggaactcagacctacgagaccccattgttccttcttccgaggacaaggatggaaattctcatcctgggtcaag

SEQ ID NO: 65337 - DNA, 573 bp, Glycine max
  Peptide Sequence Number=SeqID_157022
gactcaggcctgatttccctaggaagactttatgagggatccacaacggttcacaacatccctttgtttcatggccaagtgaaggttggtgttaaggaggttaaagatgcagaggctcccattcctgtacccattgatgagacaattgtgtctccagcaaaacctccagaaagcctggatcatgaggtcgatgatcccctgtatttgatgacattgaccatcccacaattgtttttgaagcctttccaggttatgtgggatgctatcgtgtttggggtgtttaatcaaaacttcctgttgtacataaagcacgaagatctctctgaaattgcacacggtggtcaatgtttcagcatatttgttatacagttgtggattctcggacactggcaaatggtcgtcattttgcctaaggaaaacctagttgtctggttttgttctttacataacaggccagacaactaccttaagggaataattaacagtgctttgaaaggacttgatgatactccacaacctaaatccaaggctgctgctaggtggattgttgttaaggcaaaaaggaagcattga

SEQ ID NO: 65338 - DNA, 183 bp, Glycine max
  Peptide Sequence Number=SeqID_157023
atgaagaccaacaagaagtgtgtctgccttattctcaaagacagggatgatcctgatcttggcttgaagattaacatgacaattgctgttggtctcccttctctttgcaaaactcctgataatctctcacagtgctcggatagcctctgctatcagttcttcagactgtttggcggagaatga

SEQ ID NO: 65339 - DNA, 165 bp, Glycine max
  Peptide Sequence Number=SeqID_157024
atggtgtattctaagagaaatgtgtgcctaaacgcaagggattcattatggtacttggatagtggcgactctaggcacatgacaactgacaagtccaaactctctgactttgtgtcaaaagatggaggatacgtcacgtttggagacaataacaaaggaaaataa

SEQ ID NO: 65340 - DNA, 175 bp, Glycine max
  Peptide Sequence Number=SeqID_157025
atgactacaccacccaggtctccccctcctcctccttctactgatgcagcatcacattcccctcctaccttgaagtggacaagaaaagccacacgcctgagatcattggatactagaccagttggagcagagagacccctggtctatgtggatcctgtgactgggaaagccgacg

SEQ ID NO: 65341 - DNA, 1923 bp, Glycine max
  Peptide Sequence Number=SeqID_157026
gtcgactctagaggatcccccgatcttgcgcgctacttcaacaccagcgtctccgatgtttctattgccattatgctgacgctggccgtacgaccggtaggcgcattgatctttggccggctggcggaaaaatatggccgccggccgatcctgatgctcaacatcgtgctgttttcgctgtttgaattgctgtcggcatggtcacccaactttgctgccttcctgaccttccgcgtgatttacggcgtggcgatgggtggcatctggggcgtggcctcttcgctggcgatggaaaccattcccgaccgttcgcgtggcctgatgtccggcatcttccaggccggttatccgtgcggctatctgctggcgtcgatagtgtttggcctgttcttcgaacaggtgggctggcgtggcatgttcctgattggcgcgttgccgattctgctgctgccgtttatctattttaaagtgccggaatcgccggtatggctggcggcgcgcgagcgtaaagagaatcacgcgctgctgcccatcatccgccagcactggaaaatctgtatttacatggtgctgctgatggcctgttttaacttcttcagccatggcacgcaggatctctacccgacgttcctgaaagtgcagcaccagtttgacgcccacacggtgagcattatcgccatcggttataacatcgcggcgatgctcggcggcattacgttcggctcgctgtccgagcgtatcgggcgtaaaaaagccatcatgctggcgtcgtttctggcgctgccggtgctgccgctgtgggcgttctccagcggttcctgggcgattggtatcggcgcgttcctgatgcagtttatggtgcagggcgcatggggcgtggtgccgacctacctgaccgagctggtgccggccaatgcgcgtgcggtactgccgggcttcgtttaccagctggggaatttaattgcttcggtcaacgccacgctgcagtcccgcatcgccgaagcccacggcggtaactacgggctgggcatggcgattgtcgccggcacggtggcggtgctgatttgcgtgttcgtggcgtttggccgcgagacgcgcggcatcgaaatatccggggcgcccgaacgggcacacgccgccgaccggatggccggtccagttcaccacttcatccacgctcagcatgcgcgcttttgccccgagcgctgccttcagcttgcggttatccagccgggcgtcgccgcggttttggcgatttgccccggcgccacgccatgtacgcgtgcggccagttctacggtggcagtgctttccggcatctcgatgatgtcgatatccggtgcgtgttcggcaaagaagtgccgtaccgactccaggctcatttttttctccgttaccgcagcgttcgacgtccggaatgcgatagcgctggcagcagctgcggcgctccatcgcgccgttacgcgggatcatggtgcgatacagcggattatcactgccgtcggacagggatttgctgaaaaacagcgcctgttccagttgatgccgggtggccgcaggcagctgctgctgcagttcgccaaggaaccagccgtgctgaatcaggcgttcgatacgctgctgcggattgagatagcgcgcatcctcatcctcctgcacatcaatccagaaggcgcacggatggccgttttcgtggaactcaacgtggatacgctgcggcgagcacggtttggcttcctgcggaacatcgggatggtggcgatagagatagtcgctgtaacgctgcgtcaggcggcgatagtgaaacggcgtggaccattcggccagcgtcagcgtgcctgcgggggccggctggcccagcttcacgttttcccgcatgtagctgcgctggtcgcacatcagatcttccagcgcgctggctaa

SEQ ID NO: 65342 - DNA, 675 bp, Glycine max
  Peptide Sequence Number=SeqID_157027
atgacgatgaatattgacgcgctgctggcgccggtcagcagtgataacccctgcggcgacaacctggagtatcacgcggattaccaggcgatggagcaggccagtaccggtaaagccgaacagcaatttggcgagaccattatcccggctgaatcagcggactggaataaagtcgaaaagctggcgattgacttgctcagccgcagcaaagacctgcgagtgatgttagcgcttactcacgcctggaccgagttgaaagggctaccgggctatgcgcaggggctgaagctgattgagcaggcgctgctgctgtactgggagccgctgtggccgcgactggaagagtacggcgaacaggatccgttttaccgcatcaacgcggtggcgctgctgggcgataaatcagcgctgagcagcgcggtacgccagagctggctgttgcgctacgcctcggatggcatcacgctgcgcgatgccgcagcgctgtgcgacggcagcaagaccgaagttgcggactatcctggcggtctgccgcgcctgaccgatgagctggcgcgcggcgagcagcccggtattgaagcggtgctacagataactgggggaagcggcggtgccggagctgtcgcagctgcgcaggcagatcgccatgatcgccgaacgctgtcaggccactga

SEQ ID NO: 65343 - DNA, 75 bp, Glycine max
  Peptide Sequence Number=SeqID_157028
atggataagagcttgaaggtacgagaaaatgagtggaagggagaaggacagaaggagcacaaggcctcaaataag

SEQ ID NO: 65344 - DNA, 369 bp, Glycine max
  Peptide Sequence Number=SeqID_157029
ctgtcccctcctgttcagctactgacggggtggtgcgtaacggcaaaaagcacccgccggacatcagcgctggcaagtgtagcggtcccgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgtcctctgaaggggagggcgtgtagccctctgaaggcgaggatgtgcagtcctctgaaggcggggacgtgtagtcctctgatggcgagggtgagggcatgcagccctctgatggtgaggacgggtagtcctctcaaggcgaggacgt

SEQ ID NO: 65345 - DNA, 710 bp, Glycine max
  Peptide Sequence Number=SeqID_157030
tggccaaagtgctcattgataatggctcttccctcagtgtcatgcccaaggctactttggacaagatgccttttaatgcgtcacacccaaggccgagctccatggtagtgcgagctttcgatgatagctgccgagatgtcgaccttggattcattcagttgggacattctcgtaagttgcccttcttctacgccctatgtggaagccacggaggagtccttggaaacgtcctttcaggcataggaagtggtaagaaatgctcacgtggagtctccactagtacaaccatgctcatctggggccacattgatggtagctcggagttcacggggaaccacaggaggtttggactaggatatgagcctacgcgcaccgacatgaggaggatttccctagaaaggaggggaagaagcatgggccagacgcaagggctgcaagtgaaagaggttcccttgtatcacattgataagagctttgttaagtttgaattggggaactggcgaatcgtcaaacaacccgtagtttccgaggactcagacgttgattttgagcaactggtaagtcaagctgaggaaggggaagatgaggattgggggcttcccctagagctaaaaagaatggtcgaacaagaagacagggaagtaaagccacaccaagaagaaacaaagatcataaacttaggtgttggcgaagaaagaaaagaggtcaag

SEQ ID NO: 65346 - DNA, 105 bp, Glycine max
  Peptide Sequence Number=SeqID_157031
atgacttctggcttagcgccaggcatgctcgctcagcctggaggttcaagtggatcttctacgcgcttagccatatgttggatcaagtggcctcggaataattaa

SEQ ID NO: 65347 - DNA, 228 bp, Glycine max
  Peptide Sequence Number=SeqID_157032
atggtgaggcgtactcatgggttattttgtcatgcgtggcagtgtgcggttgggttttggcgtagtgggtggcggcggcgtcgggattgggtgcaagcaatgcacgataatgttggtaaggattgtgttggtgtttctaaaggcagtgcacatgtcagaggatggtggcgggttagtgtgcgacgcctagatgtcacatggtaccccatattcattccctctaaataa

SEQ ID NO: 65348 - DNA, 357 bp, Glycine max
  Peptide Sequence Number=SeqID_157033
atgtatttttcgaaattagtcactggtaatcgattaccattaaggtgtaatcgattacacatcaacagatggtgtgtcatctgtggtggagctcatgattctggatgttgtctccccaatgaagaaccaacagctcatgaagtcaattacatggggaaccaacccataaataattttaatgcaggtggatttcctggattccagcatggacaacaatacaaccaacaacagggacattggaggaaccaccctgggaatcaattcaatagagaccagggtggaccgtccacaaggccgcaacaacaaaggcctagtctctacgagtgtacaacgaagctagaagagactctagcttag

SEQ ID NO: 65349 - DNA, 96 bp, Glycine max
  Peptide Sequence Number=SeqID_157034
tattttaacgatgttagaccattggaagcagagagattgaaggcgcttcgcatacagtgggcacaattttatctcaaagttacaaatcaaagttag

SEQ ID NO: 65350 - DNA, 342 bp, Glycine max
  Peptide Sequence Number=SeqID_157035
atgaagcttgcttttcataatttaacttttatgttgtgttattcaactcaagaacgacctgagttgaagctggtctcccacggtaggaaagttgataaatttgggagtccagtgcctgggattgaaggccttgttgccggcatcggattaagtccattgattggggagactagcaccttccaccttctagtgggggagttgatgatcacactggacgatgtggcatgtctcatccatcttcctatcacaggggcattacacaggtttgaaactctgggcgtggatgaggcggtcttgttgttgacggagcttttagaggtatccggcgaggaggctcgataa

SEQ ID NO: 65351 - DNA, 446 bp, Glycine max
  Peptide Sequence Number=SeqID_157036
ggtacatcctttgtggtaaaagtagagggtacatctacttgggtttgactgagaacaagagagggtacatctcttgtggatcagttctagtggagggtacatccactaggttcaaagagaacaagggagggtacccatacgtgactggatcctctgtagtcgctatcaaatacaaagatgggattctaatggcctctaacatgggagtcgctatcaaatacaaagatgggattctaatggccgttgacatgagagacatgggagggtgttgcagttgtcatgtttcatttgtagggaaggtgcatgatgtggaatctgaatgtaaccataataatgacgatggtgcatgtgaacatggtagggccagggtcatgttaaaagggtcctctacgtttgtgtcaatgtacaaccaaaaggttcaaaaggagctaatcaaaatgcattaa

SEQ ID NO: 65352 - DNA, 228 bp, Glycine max
  Peptide Sequence Number=SeqID_157037
atgttggaagttggaagtggaagttactggaagttggaagttggaaatgaaagttattggaagttgaaagttaaaaatggagattggaagttggaagttggaagggggaagttactaaaggtggttgtcatcatcaaaaagggggagaatgtaaatcatgcaggttttgatgatataaaaaagaatttgcttgacaaagggggagaatgtgaatcatgcaagctttga

SEQ ID NO: 65353 - DNA, 321 bp, Glycine max
  Peptide Sequence Number=SeqID_157038
gatgtcctggacattgtatccgacatcgtggatcctgcacaatctgttaaagatataacagatttatgtgtccagtattttcgggcaggatgtcctggacattgtatccgacatcgaggtttaaggagcacctacttgaagctcttgtactctgattaccacttgatgcaagctccattggagcttgtaggcctaggatcttcttcatcaatggattcctttgcttcttggaagatgaatggcagcggaatggagaaggaagagagagacgagacgccacttcaaggagaagatgagtctagaagaagctcaccaccatag

SEQ ID NO: 65354 - DNA, 300 bp, Glycine max
  Peptide Sequence Number=SeqID_157039
atgagagaggtcattgcaatgttaattgatgctagggaatatgtcagcaagtcaccaacctctcctacatcagaatctccattggatgaggatgatgacatttcttccaaagatgagtttgtgaatttaatcgattgttttgcagacgaggttatcattgaggcatgctttggtgtttgcattaattggggcgttgtggaacttgtagagggctgggggctaattctccctagcattacggcgacgaaggtgtcgaccttgtgccgctctatgattgaatattcttatagatttatatga

SEQ ID NO: 65355 - DNA, 72 bp, Glycine max
  Peptide Sequence Number=SeqID_157040
atgggtctcgagacaagatcgtctttgtatggtaatcaggtttggcttatagcaggtcacctaatagactaa

SEQ ID NO: 65356 - DNA, 690 bp, Glycine max
  Peptide Sequence Number=SeqID_157041
atggctcccaaagaacttgaacagttgactcaacaaatcagggaccagttagaggagtcgatcacaaaaaaaggacttgcaatgcctccagagcctgaggttggtccctcagctgctcgtgtcagcacaaaggggagttgtgttgatccctcagcaaccaatccagacacaagtgactcagacaaatgcgggttgtacattgaaaaaaatccttcccgcctggttgccctaggaagagtttatgagggatccacagtggttcacaacatccctttgttgcatggccaagtgaaggttggtgttaaggaggttaaagatgcagaagctcccgttcctgtacccactaacgaggttaatttagtggggcagacacttaacaccttccttgcttggccgacacatctcatgaagcgtttatcacaacaattaactatgttggataaacatgcagttgtgtctccagcaaaacctcaagataggtcagatcatgaggtcgatgatcccctatatttgatgacattgaccatcccacagctttttttgaagcctctccaggttatgtgggatgctaccgtgttcaaggtgtttaatgaacacttcccgttgtacataaagcacgaagatctctttgaaattgcacacggtggtcaatgtctcatcatatctgttatacagttgtggattctgtaa

SEQ ID NO: 65357 - DNA, 279 bp, Glycine max
  Peptide Sequence Number=SeqID_157042
atggaggagtttgatgcgcaggtggcctggccaggagcccggccttctcctttcggagggggtggggcctccgtagcccaagagtctgcttctaaggagccagcagcagaggaggaggatgagctcacccctcttgagcccttttatttcgacgcatatgcacacatggctcagaaggagggtacctccatagatcaaatacctgagccatcctctgcacctgctcctgaggagactcaaccatctacaccagtcacagagctagagcagcctatctag

SEQ ID NO: 65358 - DNA, 1068 bp, Glycine max
  Peptide Sequence Number=SeqID_157043
atgtccttacggatagtattcctacttccccatcaggctctgataccagagatcagcggaataagatcaaacggacagataggaagtaagaatgcaatatcaagggcacaccgaaacggcttacaaacccagatatattgcctatcttcgaaaacgggccctgacgggtgcagagaaatgcgaggaactggaaccagagaggcggcatgcaaactgaggcaggattttagcatccaaaaaggtccagtttttttttcttcttttatggctgagtatgtggtcaaatcaaaggaaaaggtgaaaaagtgtgagattttgagggttagaaagccaaatttggggaaaacttggtcagagcaaatgaggaaagtgagtgacaaatgtgaaagaaaagagccatttatagggacttgtaggatccaatttgagtggaattggatgtatgtgagcttgatttcaaaaatctgcaaaattatgcagcaaagctgtcaaattgtgcagcaaattctgccaattatgcagaaaaaaaatggttgtgcagtgctagtttctgctgtcacgggaaaggttccaatgtgcaaaggctatggtaattcgtttttgggcactggtaatcgattacttactttgatcgcaatggcagcgcagttgatccatgatcgcgttgtgatggagtgcctagagggtgtttgggagacccttgaaggcaatgagaggtgtcgattccgtggcacaattcgactcactgctacttcactagtacatccggagcaacccgaacctacacttcagcagcctatggagtggatactacctacacctactccatatcgactaattgagctggttcaagtgatagaggtgtcatcctttgaagaggatcttgaaaaggacccagaggagttacctcctgaacctgctttggattcccctgactttccacaggatgatgaggatccactccctgatgttgattctccagaggatattctgtcagcatctaaggcagactctacagaggagagtggccttggagggacaacaaatagtgacgactcttcatcatag

SEQ ID NO: 65359 - DNA, 1176 bp, Glycine max
  Peptide Sequence Number=SeqID_157044
atgggctcgtcgggatatggtaggtatgcctcaggcttgtcaggatttggtgggtgcgcgatggaattgtcgaggtttggtgggtgcacgacggagttatccgaggtttggtgcatatgcgacgaagttgttgaggtcgctaacgatggtatgccaccttgcagatctatgttgaacctcattgtacgagacaaagaaaaggagagggaggttgtgtcgtttgatgattggggaggtggtagaggcaagttcgatgatggtattgccagtgtgtgcgacagaggagaggagttctttgtctctgaatcacgcaacaatgccactctcaatgcaatagaacgagctgcaaggtcaaacccagaaactgtgattgtgaacatgtttcatgatcgagcttataacagggcaaggtacgaccttgtgtcgtatgttttgcatgactgcacaggaaatcccatatacagccccttgcatcaaactgtcatagccatggctgaggctacattcaatgccgtcaaccttgaattccatgaaggtgctcaccctcgcttgggcgcagtggacgacattgttttccatccacttggtcatgcgtcgctcgacgaggcagcgtggctcgccaaagcagtggcagcagacattggcaaccgattcagtgtgccagtgtttctgtacgctgcagcccacccaacagggaaggaacttgacgccataaggcgagagcttggatattacaggccaaattctaggggcagccaatgggccgggtgggcaatgcccgaaacgcttcctctaagcccagatgaagggcctaacgtcgtttcaagagctaaaggcatcacaatgattggtgcacgcccttgggtcacactctacaacgttccaattttgtgcactgatgtgtcagtagcaagaaggattgcaaggaaggtgagtgctcgtggcggtggcctccccactatgcaaacgattgcgcttgtccatgaggactcaactgagatagcctgcatgcttttggactccaagcaggttggagcggatagggttcaaaatagggttgagatgctggccgcacaagagggactggacatagaacaaggttatttcactgacatttctccagaaatgatcgtagagaaatacatgaaattaatcaatagtgctaacaaatcgtga

SEQ ID NO: 65360 - DNA, 495 bp, Glycine max
  Peptide Sequence Number=SeqID_157045
atgatgaaggaaggcataggtcacatcttagacctcactcccataggagagaaaaggaaagaaagcctcaagaggctaacattaaacctcccatacttccatggaaaggaccataaagaccaaggtcaaggcatcttaggggtaacaccttctaagcccaaagatgataaggggaatacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggttactacttcaccttcttctagtgaaagtgaagaagcaaaaggggaagaatctagtgaagagatctacccccaagaagaaggacaacctttaatggttaaggatgagtgtaaggaggtaagtgtctcctccaagaggtttgctaagaaggaaagtgattga

SEQ ID NO: 65361 - DNA, 285 bp, Glycine max
  Peptide Sequence Number=SeqID_157046
atgaagaataaaaaggttgttgtggctggtgtcttgctaagcaaggcttgtgcgcttagcgagaatcatctgctaagcgaggcactcagcccgcttagcgagttgggagaatctggaggagaatctgtcaagcatcagcgcactcagcgcgtcatcagctcgctcagcgagtcgtttgtcttctctcgcactaagcgcgcccagctcgctctgtggaaatccactaactcgcgcttagcgcaaaaatggagctatgtgagccttcgaggacagaaagccctttaa

SEQ ID NO: 65362 - DNA, 219 bp, Glycine max
  Peptide Sequence Number=SeqID_157047
atgagggtaggaaaaactctgtggaatttgaatgaatcttgtgcaaagattctgcctccactctgtttttcattgtgtaagcttggaggggttgatggggacccggtgctgagaggaacgaggagaaggctacagtggtacctggagatatgtcgcgggggtcaggagaccttggggacgtcaggtggggtgctattgcccaaaaccaagcttggctaa

SEQ ID NO: 65363 - DNA, 495 bp, Glycine max
  Peptide Sequence Number=SeqID_157048
atggcaatgggatctttttcacaagcacgaggagccttgggcaaaattgctagattccaagtatggtggttggagggctttggaggagggctttgcaataagaaaagaaactggttggatagtggggggcggagacaagttcagattttgggaggactcgtggttagatactgccatgcctttaaggcagaaatacccaagctcagcagcaagttcagcctcatagggaagataaatggatatggaagcatgaccacagtggacattactcttcaaaaagcggccaaatcagctatctttgcttggagattgatcaaagacaggttaccaacaaaaatgaatcttataaggcgccaggtggtggtaaatgacaggttatgtccattctgtggacttaaagatgaggaggcagagcacttattttttaactgcacctataccttacccctgtggtgggagtctatatcttgggctaatttaacaactgccaattaa

SEQ ID NO: 65364 - DNA, 228 bp, Glycine max
  Peptide Sequence Number=SeqID_157049
atgaagatgctcttgataccacatgatgtaagctccattggagcttcggaatggagaaggaagagagagaggagacaccacttcaaggagaagatgagtctagaagaagctcaccaccataggaggccatggataagagcttggaggaagaaagagatgaatgaagggagagggagagaagagcacgaaattttgtgctctaagagagctctgaaatctgaagcttaa

SEQ ID NO: 65365 - DNA, 297 bp, Glycine max
  Peptide Sequence Number=SeqID_157050
atgcttccatttgatttccggtgtgtcacggaaacttacggattgtgcatcaatattttttggtttttcggcatgtcccggaatttcacaaattgcctaatgatggatgccaagcacctcacaaggaccaaagaaaggtcgcatgtcatcaagcaaaggtccccggacaaaattaggggttttggcgttggtaaatggttgtcccacgatagagttgatctcgatactcaaaggtttgagataagatcaccctttagctccctccttgttcaatgtggtagcgaagggcttgagtga

SEQ ID NO: 65366 - DNA, 375 bp, Glycine max
  Peptide Sequence Number=SeqID_157051
atgagcaatgacttccaagattattttgatgatgccaaagaatcaagagttaagcaagttccaaagaatcaggagtcaaaaagcttcaagaatcaagtttcaaagaatcaagattcaagaataatcaattttcaagaatcaagattcaagaataatcaagatgaagattcaagactcaagattcaagaatcaagagaagactcaatcaagataagtgtggaaacaatgccttcaaaggttattttgatgatgccaaagaattcaagaatcaagagaaagattcaagagaagtttcaagtttcaagttttcaagaatcaagaatcaagaataatcaagaacaagattcaagactcaagattcaagaatcaagataa

SEQ ID NO: 65367 - DNA, 312 bp, Glycine max
  Peptide Sequence Number=SeqID_157052
atggatgaagtcctaaggatgccatgttctccacctgcctccactcctcctcctcctcctcctcctcccccttctcctcctcctcctcctcctactttggacgcatcgacttcgccgtctgccgtgaagtggacacgcaaagcctcacgtctacgatcgttgtccactagaccacctggtgctgagagaccagtggtgcatgttgatcctgctatcgggaaggccgacggtccccacaggaagaaattaagaacatatttggggattgtgacacgtgataaggtggacatcacctacgagaactggaaggag

SEQ ID NO: 65368 - DNA, 1113 bp, Glycine max
  Peptide Sequence Number=SeqID_157053
atgaatcaagatgagagggaacaaataagggaagaaaaaagaaggaaaatactaaaagagttaagaaaagaaaaacatgcctcctatagtagtcataactcttgcaagagcctaagtgaagaacttcgtgactattatgaaggaagatataggtcacaccttagacctcactcccataggagagaaaaggaaagaaagcctcaagaggctaacattaacctcccatacttccatgggaaggatgatgtagaggcttacttagatggggaaataattgtagagcaacaatttaaaaggaagtctacttcaaaatcttatggctctcactcttatccaaagaaagaccaaggtaaaggcatcttaggggtgacaccttctaaacccaaagatgataaggggaaaacaatagaaaagcaaccccttaaggctagtatgcaagagaagactagctctataatatgctttaaatgttttggaaaaggacacattacttctcaatgccccactaagaaaaccatgattatgaggggccaagacatttatattagccaagatgaggctactacttcaccttcctctaatgaaagtgaagaagcaaaggggggagaatctagtgaagaaatctatccccaagaagaaggacaatctttaatggttaaggaggagtgtaaggacgtaagtgtctcatccaagaggttagccaagaagaaaagtcattatgaaataaagacaaatattaaagaaacttctcctcttagacaacctctaaatcttctcctttgtaaaaagacacttgttaacactatcacacctctttggcttgatattattcctcaagtaaaggagtttttggatgagggtttggttcataagagcttaaatccttgtgctttgttggtgcccaaaataggtgttattaggcatcaaatccctaaaataagtgatatgatgaatgtgttgagtggtgcaaccctcttttgtaaaatcactcatgcgccaaacatcttcaagatttgtgtagatagggacttattaggtgttgagcaaagaaccccagagtttcaagaacctctagatttgaggtcaaatcctttttcaagggggagggaatga

SEQ ID NO: 65369 - DNA, 144 bp, Glycine max
  Peptide Sequence Number=SeqID_157054
atggtgaatgggaagttggtggtggcccgggggtggttttggggagttgatctggtgaacatatctgctaaatgggaggctggtggtggcacaatggtggttttggtgagtggatctaatgaagggagaagtgtgagagtgtaa

SEQ ID NO: 65370 - DNA, 342 bp, Glycine max
  Peptide Sequence Number=SeqID_157055
atgattggccctctcgatgagtcaatctcttgctttctcataagggtggacccttgggtacacgccctcgccttcaaaggacaacacgtcctcaccttcagaggactgcatgtcctcactttcagaggactacacgtcctcaccttcagaggactacatgtcctcaccttcagaggactacatgtcctcaccttcagtgggctgcacgccctcgccttcagaggactacacgtcctccactttagaggactacaagtcctcgccttcagagggctacgcgctctcgcctttagtgggctccacatccgcatcttaagagaatttaaggtcctctactcttaa

SEQ ID NO: 65371 - DNA, 273 bp, Glycine max
  Peptide Sequence Number=SeqID_157056
atggtggtgcgatggtggtttaggcaagtagatctagtgaaagggaggttggtggtgggaggtattggtgtttcagtggtggtttggacaaacaaatatggtgaatgggaagttggtggtggcccgggggtggttttggagagtcgatctggtgaagaggaggctagtggtgctgcggtggtggtgaacatatctgctaaatgggaggttggtggtggcacaatggtggttttggtgagtggatctaatgaaggtagaattgtgagagtgtaa

SEQ ID NO: 65372 - DNA, 831 bp, Glycine max
  Peptide Sequence Number=SeqID_157057
atgcttgcacccccacttacccaatcaccaccgtcaccattccaacactcaaactccatccttctcatctcccatcatcttaaccaaaagaaaattgaactctctcctctccattctctcaaactcgtgaacaacttaaaaggaagtctacttcaaaatcttatggctctcactcttttacaaagaaagaccaagggccaagacatttatagtagccaagatgatgctactacttcaccttcctctagtgaaagtgaagaagcgaaggggggagaatctagtgaagaaatctatccccaagaagaaggacaacctttaatggttaaggaggagtgtaaggacgtaagtgtctcctccaagaggttagctaagaaggaaagtcattatgaaataaagacaaatattaaagaaacttctcctcttagacaacctctaaatcttctcctttgtaaaaagacacttgttaacactaccacacctctttggcttgatattattcctcaagtaaaggagttggatgagggtttggttcacaagagcttaaacccttgtgctttgttggtgcccaaaataggtgttattaggcatcaaatccctaaaataagtgatatgatgaatgtgttgagtggtgcaaccctcttttgtaaaatcactcatgcgccaaacatcttcaagatttgtgtagatcgggacttattagcaccactcattgagttggtgaggaaccatgttccctcgagggaagatgcccaggaaatggattttcagaccttgccttactccaacgtgttgagcaaagaaccccagagtttcaagaacctctggatttga

SEQ ID NO: 65373 - DNA, 627 bp, Glycine max
  Peptide Sequence Number=SeqID_157058
atgattatgaggggccaagacatttatagtagccaagatgaggctactacttcaccttcctctagtgaaagtgaagaagcaaaggagggagaatctagtgaagaaatctatccccaagaagaaggacaacctttaatggttaaggaggagtgtaaggatgtaagtgtctcctccaagaggttagctaagaaggaaagtcattatgaaataaagacaaatattaaagaaacctctcctcttagaaaacatctaaatcttctcctttgtaaaaagacacttgttaacactgccacacctctttggcttgatattattcctcaagtaaaggagttgttggatgagggtttgtttcataagagcttaaatccttgtgctttgttggtgcccaaaataggtgttattaggcatcaaatccctaaaataagtgatatgatgaatgtgttgagtggtgcaaccctcttttgtaaaatcactcatgcgccaaacatcttcaagatttgtgtagatcgggacttattaggtgttgagcaaagaaccccagagtttcaagaacctctggatttgaggtcaaatccttttcaagggggagggaatgatggaatcctatcccccaagggcattcaatag

SEQ ID NO: 65374 - DNA, 210 bp, Glycine max
  Peptide Sequence Number=SeqID_157059
atgcgcggagtcgccaccaacgcttattcgaggaaaacgtccgaaaaaccgaaaagacgtggtctacgaactttaagtgtgaaagatttgggagttgtatttacgcaaggggaaggggaaggaggttgccgcccagctcgccctgggttgcttcatccagaagcaatccagcttcgaaaaacagtctggaaggcccaaataaaaatttaa

SEQ ID NO: 65375 - DNA, 276 bp, Glycine max
  Peptide Sequence Number=SeqID_157060
atgattatgaagggccaagacatttatagtagccaagatgaggctactacttcagcttcctctagggaaagtgaagaagcgaaggggggagaatctagtgaagaaatctatccccaagaagaaggaaaacctttaatggttaaggaggagtgtaaggacataagtgtctcctccaagaggttagctaagaaggaaagtcattatgaaataaagacaaatattaaagaaacttctcctcttagacaacctctaaatcttctcctttgtaaaaagtga

SEQ ID NO: 65376 - DNA, 186 bp, Glycine max
  Peptide Sequence Number=SeqID_157061
atggttgccaatcttggtcaaatggcaacacctgtgaagattatagagatctcattctccaagttcactagcctcatctttctcaccacccacgtcaaacacacctacagaggaccaccttttgccagggatggctctcctcagtacgtgccagggccaccttatgtcaggaatgactctccttag

SEQ ID NO: 65377 - DNA, 264 bp, Glycine max
  Peptide Sequence Number=SeqID_157062
atgtgctttgattttcttagaatccaatccttcacattagttttcaaatataattcaaaagtggtggtttggacaaaaaaatatggtgaatgggaagttggtggtggcctgggggtggttttggagagtcgatctggtgaagaagaggctagtggtgttgcggtggtggtttgggtgaacatatctgctaaatgggaggttggtggtggcacaatggtggttttggtgagtggatctaatgaagggagaagtgtgagagtgtaa

SEQ ID NO: 65378 - DNA, 333 bp, Glycine max
  Peptide Sequence Number=SeqID_157063
atggggatcaattacaatcgaatgcaacaaacaaaaatatgcagcgatggccaatgtattatcaaggtgaaaggatttggtgaaagggaggataatggtggtgcgatggtgggaggtattggtgtttcagtggtggtttggacaaacaaatatggtgaatgggaagttggtggtggcccgggggtggttttggagagtcgatttggtgaagaggaggctagtggtgctgcggtggtggtttgggtgaacatatctgctaaatgggaggttggtggtggcacaatggtggttttggtgagtggatctaatgaagggaaaagtgtgagagtgtaa

SEQ ID NO: 65379 - DNA, 1134 bp, Glycine max
  Peptide Sequence Number=SeqID_157064
atggaagaagatcacaagaagactctcaaattcttagatgttacaaatgcaatcaacttggcctacattgcatgggacaacaatgattcatccgatggttcagaaaaggagatcaatcttctaaccaaggattatgagagtgatgaaaacatttctcaagaagtcaacgacattctgagacataggaaatgccgattccctcctctattccctgtgcctcattattttcatccgaagaacagcaaatacgcatttgaaaactccaatcttattactttcatgtctttaaaattgcctgtttattctgatttagtcaaagccttctactcaaacctagaaatccaagaaggcactttaatctctgaagtttatgggattaaaatggtcattgaccaatccctattctatgagttaacccaattatctactgaaggtgtaccatttgaaggtacattggttgatgattggaaatatgaattttttgtgcatgatgcccgccggttggtttgcaccaaccaagcggatatgaccggaaggcttcttcccggttcattggattttgagagccgcatccttcattaccttattgttcgtatcttgcttccaagatcttcaaaatttgcacaggtttatgaagaagatcttattgttatgtgggcttttcataaaggccgacaaattgattgggcacacttagtacaatatcgcatgaataaggcattgcgattaaatgctccatttccatatccacacctagtcaccctcttccttcaacactttaacatccctcttgattctgaaccttatgtttcaatcaagagatcctttctaataggcgcttcagtcattgcatcctttggttatcaaaaagagcatgatggctcttgggtgaaaaagggtgctcaacatgttgatgaagaaggacatggtgaagaagattcatctcttcttcaaaagattttggataggttcgatggtcttcaaacctttgttggagaaaggtttgctactttggagttacaagtggacatgcgcttcaatgagatggagtcaagaattgccaaggtcgaagaagatgtttcttatattcgttcaagctttgatctaccaccaccgccgccaccatcatcttag

SEQ ID NO: 65380 - DNA, 891 bp, Glycine max
  Peptide Sequence Number=SeqID_157065
atgcctattaggcagatgaaggtagaagtggtgaacatttcaagaaactggagtttcctcttcaatggcaagaagttgatacaagatccaaatatgtttgatgcaaagaccttttggaatcagattgtgttgaatgacacgttaaaagcttcatttccagctatgatggaaagggataatgttgaacaccatgacttcgttcaagtgttgcgtcctgtcaagacataccactttgatgatgcttgtgtgtacttcacaaaggatacgaatacttatgccttcatcactaggttgaagaaccttcccatcatcttccatgaaactacttattatctaacaaagatagatgaaagggacttcagagatcatgctaaagttgctggcaaagctgtggatgagaacattgttaatgaggtcatcattgatctcactaacactggtgtcatggatgagaactcaaaagcgtccaaggaagctcaagctgatgaggttataagccgacaacaggaacctatgttcaagaagtcagaaacctcacatgaagttatgtccaaggaaaaagatgtgcctgaagtagtgattgtctattccgcaagctcaagtcctattcccatcaagtatgcacctccaaacgatgtgaccagagatcaagttcaagatatgattagtcaagccatggacacttttgctgagcgacaaagacaagagaattactgttgtggcacccctgttgttgcaaattttattacaacactagttgaacgtccaactccatccattcagcaaccacctgctcttgatcaaccaccaacaagtgttccatttgtcgctgctaaacatacactatcagcaccaaaacatccttttccatcaccacaagttcaacagtga

SEQ ID NO: 65381 - DNA, 954 bp, Glycine max
  Peptide Sequence Number=SeqID_157066
atggagattatctttatcactaagcacgccccgccgaagcaagcccttaatcaacgccaccacagacatatcaaaccgaggccacgagaagcacaagctcgccctaacgttcatcacctggcaccgcgcgaggatcgcggcacccagcccgtccacaacgctcccggaagggtagtaatccaattcttcccccaagagcttctcggaggaggtcatttttctctcggcggaggtctcgagcttgaacgccacggcctcgtcggaggagagcttgccgcggaagttggtggggtcgagggagtcgaggacgaggacggagtagggccggatcgagaggagggtgcgggcgacggcgtgggcgcggtggggagggacggggaatggcacgacggcgaggagggtgtcgggggagagggggaggatggaagcgttgtgagggcgagggaggagggggagagggcgatgatgagaagagagggtttgaggggtagtttgttgtgtgggaagatgaggaagggtgtggggagaggtggggatgggggtgtgaagatgtttaggtcttcttccaggaaccttgatgggggtgctgcttctgttatcacgtcttccatttcttttctcgaaggaaggaaggaagggtggtgctgttcctcagggaccgaactgtggtttccagatctaagaaagagaggaagattcgttgttgttgtcgtcgcctttgcgtggcttgtggtctttatcgttgtgctttggggtgggtttgtgatggtgtttggtgatgagtttcgtggtggttcgcggcggttcagggtaggggaacaaagatgtagtgtatttgaaagtggtggaggtttcgccgcccttgccggctttggtgtcactacggcgacaacgacggtgacaaaagtagcaagtgctcgggtaggttgcagcggagttgagactgagaactga

SEQ ID NO: 65382 - DNA, 792 bp, Glycine max
  Peptide Sequence Number=SeqID_157067
atgaacaagatgaggttgttgcaagagcacaatagaacttttatcagctggtttagagaaacaatcttggcagatgacagtgcttcaaagacattacgattgctagttcggtcagaacagtggggtcagtgtgatggtcattcagatcacttttgtagtgcttctgataacaatccaattcaagcgtccatgccttactatggagtcattgaagatattttggagcttaattattaccttgaaaaggttgcttacaacaatgatccattcatcatggcagcgcaagctagacaggtgttttatgtccaagatccatgcgactcaagatggtcagttgttcttcaagggagaacaacttgtatcggctacgtccaggaagaccagacaatcgacccagctgagaaggttgactatccaaggtttggatcagctgcgaccaatgcgcgtgaaaaaattcctattctccactccacttggaatgatgtaccaaaatctttaaagaaccttgtttcggatgacattttgggaaaatttgacattcccgaaggtgacaatgctaaaaagaaggtggtgtcaacggtcgctaccagacaaaatatgtttatgctgacaaagacagtcatcagaaagatgatccttctgttaagtatggtattgatgcagcaacatgggcagaatttgcaaaaagccactaaacccttaactggcagggaatacggaaaaaggctcaggaaattcaaaaatacaacggctgcccccatttattgtctcgtgggagttatgagctactag

SEQ ID NO: 65383 - DNA, 373 bp, Glycine max
  Peptide Sequence Number=SeqID_157068
atgggtcgagatgagcatgatgttgatgttccccggcatcgtaggccaaccgcttctgcccgtaggcaacaggaagttcctcaggtgactgaagatattcctgatgtgatagaggatgttcctcatgtggacgacgacattccgactgcagacgtagatgctgcggacgtagctgctgatggtgttgaggggtcacctgctaatcatggcgagggattccttggttggccatgtgacacatcgtcaacaacccaagtagatgtaccctctacttgtaccacaaaggatgtaccctccaatgcgttaagacaaagttctcaggcggttaaacctttgaaaccttgtgaatggggatacaaaagattctcaggcg

SEQ ID NO: 65384 - DNA, 201 bp, Glycine max
  Peptide Sequence Number=SeqID_157069
atgaagaaacaacagtggaagagaagatgcagcggaagacaaaggagaagaggagagaggaggcaccatccactagggaataagccttggaagaaggagcttcaccaccaagatgagccttggataagaagtttggagagggtgcttcaatggaggaaaagaaagagggagagaaagagagaggggcgagcacgaaattga

SEQ ID NO: 65385 - DNA, 375 bp, Glycine max
  Peptide Sequence Number=SeqID_157070
atgccgaccacaccaagctcccctttgcagtcagatggtaatacggaggcaccgcctaagaagacaagacaaaccacacgtcttaaaaggctgactttaagaactttagataagcatagaccaatggttactgtcgatcctgcaactggaagagcatcaggcccagaaaaacaaaagttccaccgctatttaggggtcgtagctcgagaaaagatcccgattgtccatagcaattggaaagatgtgctagaaactcttaaggacatagtatggggtgacatttttctaaatttgatatcccagaagcctcaaaggccaagaaaaaggtcatgtccacggtggccactagatggaggcaatttaagtcttcactaa

SEQ ID NO: 65386 - DNA, 255 bp, Glycine max
  Peptide Sequence Number=SeqID_157071
atgatagtaataatcagagatgtgatactagatgagtcaaagtggtggaattgggatgagggcaatcccaaagctactaaaagacctcaaagaaatcggcaacaacctcaaaggttgaatgattttaagatgcttcttgacatccttgtgacacaagaaggagatctagtccatctagccttgttcatcaaagcaaaacctatgatctttgaagaggcaattcaggatgagaagtggtcaaatgctatgaaataa

SEQ ID NO: 65387 - DNA, 198 bp, Glycine max
  Peptide Sequence Number=SeqID_157072
atgtcagtgaaaaacatcatcgagcgcctaggaggagatcagtcagggtcacagtgttttacgagaatgctccaaccatgtgggatcaccacaggcttaaaggagcactcaaaccaagtgacccccaaggcctacactctgaagagtccgtcagggcctctccctcttgattcaggtccaacccagaaaacattttag

SEQ ID NO: 65388 - DNA, 330 bp, Glycine max
  Peptide Sequence Number=SeqID_157073
atggatgggttgtccctgtgtggttcagaaatttctatcactcttaagttattgaagccgctggtccaacacaaggtcttttgttttgatgtaagctccattggagcttgtagacctaggatcttcttcatcaatggattcctttgcttcttggaagatcaatggcagcggaatggagaaaggaagagagagatgagacgccacttcaaggagaagatgagtctagaagaagctcaccaccataggaggccatggataagagcttggaggaagaaggagatgaataaagggagagggagagaagagcacgaaattttgtgctctaaatga

SEQ ID NO: 65389 - DNA, 87 bp, Glycine max
  Peptide Sequence Number=SeqID_157074
atggatggctcgaattctcacaaaggaattaatgaagcattgggcttgaatctagaattgggcttggacttgaagagggcagactaa

SEQ ID NO: 65390 - DNA, 564 bp, Glycine max
  Peptide Sequence Number=SeqID_157075
atgcactacttgattgtgcacatcctactccctagatcttccaaccttgcacaggtttctgaggaagatttgataattatgtgggttttcttaaccggtcgtcaaatcgattgggcccatcttgtgagatatcgcatgcataaggcattgcaatcaaatgctccactcccatatccccatctgattactttgtttctacaacattttaatgttcctcttgactctgagccctttgtcaaactcaagagatccttctctatcggtgcaaatatagtctcttcctttggttaccgcaaagagcgtgatggctcttgggtaaaaaagggtgctcaaccaaatgatgatgaaggacacttaccagttgaaggggactcttctctccttcagagttttttggacaggtttgatggacttcaaacctatgttggtgagaggtttgactccttggaacgtcaagtggatacacgattcaaggagataaactcaaggattgcaaaggttgaacaagatgtcaccatcattcgtgactgccttgatttacctccaccaccaccatcctcatag

SEQ ID NO: 65391 - DNA, 597 bp, Glycine max
  Peptide Sequence Number=SeqID_157076
atggcaagagctggtgacaatgggggtgtatatcatcaactggacgaatctcaacgcttatttctggacgcgtggactacacaaatgcaacgtttgttgaaccgtaacaaagaaaagccctacagacgaatagccaaatcttcctcatttactcttaaacctctatcccctagagaatgttcaaccattatttctcctagtgttcaaccattattgcaaccttcaagaggcatagaacatcaagttgatctcctccccggagcttcattgcctaacaggccaacttacaaaagcaatccccaagagactcaacgtaaggatgcacatgccaaagttgagtatgtgaaaagattgtatgaccaagtgaaggtgcaaattgcaaagaagaatgaaagctatgtcaagcaagcccacaagaaaaggaaggaagtggtacttgagcccggtgatgatcctgaacatttgaggacaaatgttttccaagaaggagggaatgatgagaatcatgaaactggccaaatacaggctaaaggcccaagtggagaaggacgaaggcccaagtggagaaggacaaagaccccgagtggagaaggatga

SEQ ID NO: 65392 - DNA, 292 bp, Glycine max
  Peptide Sequence Number=SeqID_157077
gtgccccacttcttccgctgcttcgtcttcttctcctctcacatctccttccgttccgccatttccttcctcgcgcaagcttcttcctgcattttggagctgcatttatgtggttgggcttgcgcaaacttcttccgtcgaggttctgaataggttcaacacatacggaagaacttctttcctatgtgttggtgagggcttagggggtagaggagtgtttatgttagggttagggttgagtgtagggcggttaggggtggcattagggtttggtgtggggcttagggtttaa

SEQ ID NO: 65393 - DNA, 153 bp, Glycine max
  Peptide Sequence Number=SeqID_157078
atgccaatctccccctgcagatggattgcgcccacaagacgcccagtggacccgaaagaagtccaacagggccctgaggtttccaactctggttacaggcctctgtcagtcctacaaggtgcccgtccccccacgaggtcatgcccctactaa

SEQ ID NO: 65394 - DNA, 416 bp, Glycine max
  Peptide Sequence Number=SeqID_157079
atgacgcaaaacaacaatagcctggtcacgcgcagtactgacccggagcaaattgatttacttgatttagtgctgcaactttggcgcggaaagtgggtaattggggcatttattgcggtttttatcgtattcgcgggcgtatacattacagtcgcgaaagagaaatggacctcctccgccattattgctcagccagatgcggctcagatcgccacttacgccaatgcactgaatatcctttacggtagcgctgcaccttcaatgctggatatccagaaccgtgctattaatcgtttcaattcctcgttttctgctttagctcaggctctcgaaaaccaggacattccagaaaagctgactatcgacaccaccgttaaggggcaaccgctgccgttaagcgtctcctatcaggggga

SEQ ID NO: 65395 - DNA, 920 bp, Glycine max
  Peptide Sequence Number=SeqID_157080
gacgtttggtagagaaaaaaggcgctcatgtactgcttgatgcattctcaaaaataaaagataaattccctgatcatatcattacatttattggtgatggaccattgaagcctcaactttatgaccaagcacatactttaggagtaaatgcgaaatttttaggtgcatgctcaaaagaaaaaattatagaggagttgcataatacagcagtattttgtttacctagtattcgcgcaaagaatggtgattccgaagggtttgggttggtaatccttgaggctgcagcatgtggtgtacctgttgtgacttctgcattgggtggggctactgagggtattgttcatggggaaacagaatttcatagaaaaaaaagtaatggtggagcatgccaatccaggaaccagggcgcaagccttagtgaagctgaatttattgcttttcttgatgatgatgatatgtgggagccagagcatatagaaaagcttataaactgctttaaagatgataaagttgcattagcctactctggaaaaaaaataacaaactttgccaaagatagcgtcagaaaaagcttaaatgttatccctaataaagaacaatataaagcgcttcttaaatgtaactatccaggttcaacttcttcaattcttgtaaggaaaaaatatttccttgaaacttcaggattcgatgaaaaactgcctgccattcaggactatgatttttatctaagattagtcaagaaagtgattgaaaaaagaaatcatattggtggaaatatatactgtaaggaaatcgagggtataaacgtccatgcttatggtgcgcatatttttcacacaaatgataaaaaaatttgggactacgttaacgctcttactgaatttaatcgattcacaaattccccggtagcatatcaaaag

SEQ ID NO: 65396 - DNA, 396 bp, Glycine max
  Peptide Sequence Number=SeqID_157081
atggtcgaatcattaaagaaacgaaagggatcttcctctaccaccgctgctgttggccatcgccatggaacctccggagacacaccagcaccaattcctccctctctttcatctccccaatcatccaccttattttcctccgatgatcaacgtcagaggtactactctcaattttgtaatagagttattcaagaccctaagtaccttgaccttgaattttttgatggagaaacatttgattgttaccaagtgcataacattcctattattgttgatcagtccttattttattcattgactaaactaccaagtcaaggtgttccttgcactcttgttgatgattggaaatttgattattcaagtcatgatgctcgtagaatggtctacaatgactag

SEQ ID NO: 65397 - DNA, 282 bp, Glycine max
  Peptide Sequence Number=SeqID_157082
atggtggggtacgcaccttcaagctttgcggatttggtcttcgctggggaaaggatcgaagcaggtttgaaaaaaggcaaatttaatcatcctgcttggacgaatgagaaaactggggcaaatgaagagggtgagaatgaaggagaaacccatgatgtgattgccgttcctacatggaaacttcctaccagccaaacaatgtcattactcagccaatatcagcccttctcattacccaccacccagtcatccacaaaggccatccctaaatcaaccacataa

SEQ ID NO: 65398 - DNA, 489 bp, Glycine max
  Peptide Sequence Number=SeqID_157083
atgttgctgccagagagaaatgtggtaatctaccacactgaatttgatgaattcaaggaagaattggacagaagaagatgggatgaagaattgaccagctttaaggaaggcaacattgatgttgccatagtaaaagaattctatgctaacctctatgatccagaggacaaatcaccaaagcaggtgagggtcagatgtcatttgataaaatttgatgaagaagccctcaacacattcctaaagacccctatgatcattaaggagggggagacattatcagcttattctaggtttgcactcttgaggcctgatcctcaagagttagctgctaagctctgcatcccagggaggggatttgagctgaatgctgatggtcagcctttgaatatattaaggaagaacatgactacacttgctcagacttggagtgttctttcatactccaacttggtccctaactcccacacttctgacatcacactagatcgg

SEQ ID NO: 65399 - DNA, 982 bp, Glycine max
  Peptide Sequence Number=SeqID_157084
gactacacgtcttcaccaacagagggctgcacaccctcaccttgagaggactacacgtcctccgcaacagacggctgcacgccctcatcttggagagggctacacgtcctcgtcaatagaggactacacagggctacgcgccctcaccttcgtagggctaaacgccctcaccatccgaggactacatgtcctcaccttcagagggctacgcgccctcgccttcgtagggctacacgccctcaccatcagaggactgcatctcctcaccttcagagggctacacgccctcgccatcagaggaccacacgtccacaccttcggctacacgccctcacctttagaggactacacgtcctcgccaacagagggctgcacgccctcacctttagaggactacacgtcctcgccaacagagggctgcacgccctcaccttggagagggctacaggtcctcgccaatagaggactgcaaatcctcaccttgagaggactacacgtcctcgccttgagaggactacacgtcctcaccatcagagggctgcatgccctcacctcatcttcagaggactacatagagctacgcgccctcgccttcttagggctacacgccctcaccatcagaggactgcatgtcctcaccttcagagggctacatgccctcgccatcagaggaccacacgtcctcaccttcgtaaggctacacgccctcacctttagaggaccacacgtcctcaccttcagagggctacacgccctcgccatcagaggactgcatgtcctcacctccgtagggctacacgcccttacctttagaggactacacgtcctcgccaatagagggctgcacgccctcaccttgagaggactacacgtcctcaccaacagagggctgcacaccctcaccttgagaggactacacgtcctcggcaacagacggctgcacgccctcaccttggaaagggatacacgtcctcgtcaatag

SEQ ID NO: 65400 - DNA, 438 bp, Glycine max
  Peptide Sequence Number=SeqID_157085
atggcaaaagaattcagccgcggccaacgcgtggcgcaagagatgcagaaagagattgcgatcattctgcagcgtgaagtgaaagatccgcgcgtcggcatggcgaccgtttccggcgtagaagtgtcccgcgacctggcgtatgccaaggtttacgtcacctttctgaacgtactgaccgagaaccacgatccggatctggtcaccaacggcattaaagcgttgcaggacgcttccggttacatccgcaccctgctgggcaaagcgatgcgcctgcgcgtggtgccggagctgaccttcgcttacgacaactccctggtggaaggcatgcgcatgtccaacctggtgaccaacgtggtgaagaacgacgccgagcgccgttccgcctcagtgatgacaaggaggattaatgagtcgccctcgtcgccgcggccgtga

SEQ ID NO: 65401 - DNA, 291 bp, Glycine max
  Peptide Sequence Number=SeqID_157086
atggttaatatgcttagtagtgcctctgcttctaggccttcatctttctccacttgggacttgttaaaatgtttggagaaccaactgaatcagaatactggaagaccttatggtggtaacagagtgggcaatgttggacccaggcaacacagaatggaggggcagaatagaattgagggagtaaaactcaatgtacctcctttcaagggtaagagtgatctagaggcctaccttgattgggagatggaaattgagcatgtattctcctgtaatgattatactaaagagtag

SEQ ID NO: 65402 - DNA, 499 bp, Glycine max
  Peptide Sequence Number=SeqID_157087
atgggtgaagtagaggaggtgcaaaagcagatgaaggccgacatggaggccatgaaagagcaaatggccacaatgatggaggccatgatgagcatgaagaagataatgaaagccaatgcagttgcagttgccacttccagcgctgttgctaaggtgaacccgatgcccccatctggcctcaaccaaatgaatcatccaacctcagctatggtaggcaaagatttgggaagtacgagaagcccctattatgtgcaaattcaaaacaagcacgccttcctaccatatggcttgcctcccaactatacaccacccaatgtggcatacactcccagtgaggatgtcaataactttgctcccatacttattgaaagccgacaacctcaaactgatcatgcacatgtctctcaaccaatgggggagacacatgaaatgccccaccacaatctagccgacttcgagccttgccttggatatgccactgaagggcaagtagttggtg

SEQ ID NO: 65403 - DNA, 1146 bp, Glycine max
  Peptide Sequence Number=SeqID_157088
atgagttcagccaaacccgaacgtgaatatttcctcgactcgattcgagcgtatttaatgctgctgggcgtgccttttcacgtctcactgatttactcgacccaacgctggtcggttaacagccaggacgcctcactgtggctgacggtgctgaatgattttattcacgccttccgcatgcaggtgttctttgttatttcaggttatttctcgtatatgctctatctgcgctatcagcccaaccgctggctgaaggtgcggctggagcgcgtcggcattccgctgttaaccgcagtgccgctcattaccctgccgcagttttttatgctgaaaaatctcaccagcaaagtcggcgactgggcaaacttctcgctgtatgacaagtacaacgcgctgatgtgggatctgatttcgcacctgtggtttttactggtactggtgattctcaccgcgtttggcatgctgagcttccgctggctgcgcgatcagcagcgccgcatcgattatcagcaggttggctggggcaagctgacgctggccctgctggcctatgcgctggtgtggtgcgccttccgccggctgattttccactttgctcccgcgctgttaatggatggcctgttcagcattgcggtaatgcagtcgctgttcttcctgccgttctttatgctgggtgcgctgagctggaaacatcaggcgctgaaagcgctgtttgtgcgttttaatccggtgatgtgctttggtgccattgcggtgtttatcgcgtacagcctgaatcagcgctacagcagcggtgaaggctggctgtacgagcttgatgccatcatttctacgctgatgggcttgtgtatgctgaacgtctgctttagcttcggccacaagctgctgaacagccactcgccgcgcatcatgtatctggtgaacgcgtcgctgtttatttatctggtgcaccatccgctgaccatcctgtacggcatctacgttacgccacacatcagcagtaatacgctgggcttctttgtcggcctgctgatggtgtttggcgttgcctttgccctgtacgagattcatctgcgtatcccgctgctgcgctttttgttctccggcaagccgcagcgcaaaccagagacctccgcgcagacgtaa

SEQ ID NO: 65404 - DNA, 2121 bp, Glycine max
  Peptide Sequence Number=SeqID_157089
atgcgcagaacgcctttcaatcccggaatgaaaccgacgctgctggccatgctggtcagcgccggttgtttgccagtgatggctgctaccactaacaccagtaatgctcctcagggcgctaacgaacagccgacgctgaccgtcaccgccacgccgcagagtgaattcaaacccggcggcaacgacttagtaccggcctttctcgacggccagattgcccacggcggtcgcctcggcatgctgggcgagcaaaacgccatggacgtgccgttcaacgtcatcggctatacggcaaaaatgattcaggaccagcaagcgcaaaccatcgccgatgtggtgcgcaacgatgcgggcgtgcagaacgtcaaaggttacggcaatttcgctgaaacttaccgcattcggggtttcactctcgacggcgatgatatgaccttcggcggtctgccgggcgtggtgccgcgccaggtgatggacgcttcgctgatcgatcgcgtggagatcttcaaaggcgccaacagtctggttaacggcgcagccagttccggcgtcggcggtggtggaacgctggacgtggggcgtcgctttggcgataacaatcagtttggcgtgcgggttaacgccgtgcatcgcgaaggtgaaaccggcgttgacggcgagaaaaaacgcaccacggcggcctcggtcggtcttgattatcgcggcgatcggctgcgcacctcgctggacgttggctatcagaagaaaaccttccatgacggcttacagggcgtgaaattcgccagcgccggcgtgattccgccggtgccgtcaaattcgcacaactacagccagaaatgggtgtacagcgatatggaatctgaattcggtatcgccaaagcagaatacgatattaccgacagctggacggcctatgccggcctcggcgcacagcacgctcatgaaaccggcaactacggcgcgccgaccattaccaacagcaacggtgacggcaccatcagcagcttctactccaaccgtattcaggacaacatgagcggcatggtggggctgcgcggtgagttccacaccggtttcgtcagtcataaagtcaacgtgggttactcggcgctgaccaccaatgcgaaaaatgcctacgacatgtcgctggtgggcacgccgtttaatatctaccacagcggtgacgtggcggaaccggcggccaccttcgccggcggcaagttctccgatccgcttaccacgtcacgcacccgcacccagggctatctgctgagcgatacgctcggattactggacgatacgctgctggtgaccgttggtgctcgccatcagaaagtggtggtgcgcagctataactacaacaccggcgcggaaagcgttgattcgcgcttcaccaacgaccgctggatgccaacgtacggcgtggtctacaagccgtggaaagaagtggcgctgtacgcgaaccatacggaagcgctgcagcctggtgaagtagcccctaaagacgccgtcaactatggcaccgtgactggcgtggcgcactcgaagcagaatgagatcggtgtgaaaacggatttcggccgcatcggcggctcgctggggctgttcgaaatccagaaaccgtccggtctgatcaacagtgacaatgtctacgtcatggatggcgagcagcgccatcgcggcgtggaagccaacgtgtttggtgagccggtgctgggcctgcgcctcaacgccagcgccacctggatcgatccggtgatgaagaaaaccgccggcggcacttacgatggcaaacaggcgatcggcgtgccgcgctacacctacgtgctgggcgcggagtatgacatcaagccggtggagggtctgacggccacggcgctgctcaaccacagcggtgctcagtacgccaactcggccaacaccctcaagctggacagctataccacgctggatcttggtatgcgttaccgcatgaaggtgaatcagaacgatctggtgtggcgcgtggcggtcgaaaacgtcaccaatgagaagtactggtcaaacgttgatgacaccggcacctatctcgcgcagggcgacccgcgcacgctgaaaatcagcatgagctacgatttctaa

SEQ ID NO: 65405 - DNA, 915 bp, Glycine max
  Peptide Sequence Number=SeqID_157090
tgtctccgcgggcggcgcgctgccgggcgcggatgcgcaacgcgcgcagcaacgctggactgcgcagtggatgaaatttatggcagtaccgaaaccggggtgatcgcgtggcgccgggccagcgatgacgctgcgctgtggcagtgtttcccccacgtttcgctgcgcgagatcgcgccgcagcgctggcaggtcttctccgatctgctggagagccgcgcgggctgtgcgctggacgatcgtatcgtgcagcagccgtcgggccagtttcagctggcagggcgccaggatcgggtggtgaaaattgaagacaagcgcgtgtcgctgagcgaagtagagcgtcgcctgctggcgctgcctggtgtggaagatgccgccgcgctggcgattcagcgtcacggccgccatgccatcgcggtggtgctggcgctgccgcaactgccggacgccgccacgctgcaccagcgtaaacaacaatggaaacgcgcgctgcaaccctggctggagccggtcgccatgccgcgctactggcgggtggtgacgacgattccggtcaccgcgcagagcaagcgcgcatggccgcagatagaggaattgtttgatgttaccgcagccggtgccgccggatgcgcagctggagctgcagttgcagtggctgccggaaaagtcgctgctaagttttcgctacgcgctgctgcgcgattcgcctgtgctgagtgcctcttttgcgccctgcgtgctgattccctgctacaaccacggtgccatgctggcgtcggtgctggcgcggctggccccgttcaacctgccggtgatcgtggtcgacgacggcagcgatgcccggacccaacagcatatcgctgcgctggatgcgccgcagctccgggtgctgacgctgccgcacaaccaaggtaa

SEQ ID NO: 65406 - DNA, 396 bp, Glycine max
  Peptide Sequence Number=SeqID_157091
atggcttccagaaagagaaagagtattggtacaagacccatagctcagtatgatagaaggaggttccactcctttgaggcctggacccgatacatagataatgttctaggaagacatatactgcatgagaggaaggtagaaatatacgatattgagctggacgagtttaaggatgaattggagaggcataacttccataaacagctcaccaatttagttgacaacaacatagatctagctttggtgaaggagttttatgccaacctttatagctccgaagggccttcaccaaagcaagttcctggtgctaaaaaggatgttttgtatttaacagtgctcatgcgttcctatgttgtctcctggactgctagaccccgattcctcatgatagcctag

SEQ ID NO: 65407 - DNA, 339 bp, Glycine max
  Peptide Sequence Number=SeqID_157092
atgggaggtactggagttgtagaagaagatggagctagagtctctggtgctgctgaagtagtggggacctctaatctcttacccttggccttccttggccctctaaatgtcacagttggatcatcaagattccaacaattcttcttaatatatgccaagttaatggcagggctcaagttctccagggatctagaatctgattggactcctctagccttgcatagagctgtgatcaaggcaaggaatccaagtctggatgtatcatgctatgcaataagagagatttggtggaagatgaagtaccccaagttcatatccatcttcataatgataccataa

SEQ ID NO: 65408 - DNA, 579 bp, Glycine max
  Peptide Sequence Number=SeqID_157093
atgaatggcggaacaccggggcatttggtcgaacaatgcatggccctcaagcacaaagtccagagcttgattgaggcgggatggttgacattccaagaagatgggccaaatatgaagacgaatccactcaccaatgacaggggatcgactgttaatgcaattgaggtgtgcagtttgcaaacgcctaagcatttaaaggacgtcacaacctctaggaggtttagttttgaagccctacaagaggcaggtgtggttcctctcagtgagcacaagggggatccttgcttgatgcatctgggtgcaccgcatgatatggaaacatgctcagcggtggaggagctacaaggaaagtcccaagaagcccaagcctttggtgatgcatttcaccagagatgcggctccccaaaatcactaaggcccttcgatgttgtccggaagtacgctcctcagaagccgaacgagaggaagaagaaggtcaccgacattgactcattttctaccaaagtgaccaatatcactgggttaagcggtatgacctgcaatggctacatctttgtagcgcctgacctcccaatatga

SEQ ID NO: 65409 - DNA, 567 bp, Glycine max
  Peptide Sequence Number=SeqID_157094
atggcagaaccatcgaagaagcgaaagggtgtttcaacttcatccgcagtcactggaactcgaagccacggagcatccaaagcacagacaactcgcattcctccctccatatcatctcctatgttgttttcctcagaagaaaaatgtatccggtacaattcctttttctcttctcattccattatcgaccctaagtttgtagacttaactttctttgatgatgaagtgtttgattgttttcaagcatttcaaaattctggattaatccaatttatttccattaaacttcctttttatcctgaattagttaaagccttttattctaacttagaaattcaagaagattccttgatttccgagatatccagtgatggtgtaccgtttaaaggtacacttgatgatgattggaagttcgacttttctgtttctgatgcccgccgattggtctgcaccaagcaagcggatatgaccggaaggcttcttgccggatcattggcattcgaatgccgcatcatgcactacttgattgtgcacatcctatttcctagatcatccaaccttgcacag

SEQ ID NO: 65410 - DNA, 207 bp, Glycine max
  Peptide Sequence Number=SeqID_157095
atggtgagtgcggaaggcggttttgctcgtatcggactctttcatcagatagagcaaaaccagactgcgcctccaagttcatccaatagctcgtccacagtaggggctgagttaaggacaaggttgatggtgtggtctgtgggtcaagatggaggtaaggtcatcaatggttggaatagggaggagtatttggcgaggagattctga

SEQ ID NO: 65411 - DNA, 78 bp, Glycine max
  Peptide Sequence Number=SeqID_157096
atggctggatggaatgatcgtgcgatggctgatgctctccaagccttagcccaggaattaatgaaacattgggcttaa

SEQ ID NO: 65412 - DNA, 1281 bp, Glycine max
  Peptide Sequence Number=SeqID_157097
atggcgcatctctacggagcgtatcgccatgcgcgagggaatgcagcgcgtgtggcgcgaccgccgtttccgcctgtgatgctgatgctgccggtcatggtcaatcaggtggcgggcgcaccggcggcggtgaagtggatgtacgcgattgaagcgctgctgtcgctcagcctgctctatccgctggcacgctggagtgaaaagcgcttccgcctggaaacacgcctgatggccggactgtttctgatgaccttcagcctgctgccggttggcatgaccgattcgctgccgtcgctgtttttgctgatcgccgtcttctatctcggatcgatcatcgctgaaccggcacgtgaaaccctgagtgcctccctggccagcgcccgggcacgcggcagctacatggggttcagccggctcggcctggcaattggcgggctgattggctactccggtggcggctggatgttcgatatgggccagcagctggccctgccggagctgccttccagccgcgccaggtggcaccggcgatcttcagcagctagtttgccggttcaggcgttctcttccatacttcccgcacgtccggaaaagggtgacctccgtcaccctgagaatcacaggagaaacgggatgaaactttacatctacgatcactgccctttctgcgtcaaagcacgcatgatatttggcctgaaaaacctgccggttgagctgattgtgatgctcaatgacgatgaagcaacgccgaaaaagctgattggccagaaaatggcgccgattctgcaaaaagccgatggcagtgcgatgccggagagcatggatatcgtgcgctttgtcgataatcaggatcgccagccgctgctgaccggcaagcaaaatcccgccatcgccgactggctgcgacgggtcaatggctacatcaacaagctgctgctgccgcgcatcgctgaggccgcgtttgctgaatttgccacccccgaagcacgtgattacttccgcgaaaagaaacaggccagcctcggtgactttgccgaactgcgtaagcatgccccgggtttcatcaaaaatatcagtgatgatctgcgccagctggataaattgatcgtcaaacccaatgcggtgaacggcgagttgtctgaggatgacattcatctgtttccgctgctgcgctcgctgacgctggtttccggtatcgaatggccgagccgcgtcgccgactatcgcgataatatggcgaaacagacgcaggtgaatctgctgtcgtcgattgcggcctga

SEQ ID NO: 65413 - DNA, 387 bp, Glycine max
  Peptide Sequence Number=SeqID_157098
atggcactctcccaaccaagggcgcccacacccccacaggggggagctctccggaccccaacttcgactcggcctcacccggccaacaatgcttactttggcgcaaacacgacaaggaacttttcgccaaggcagacacagatcttcgccctgatcccaatgacatatggagaacttttgccatctctcattgccaaccaattggccgtggtggtcccgggaaagttcttccagtctccgttcccaaagtggtataaccctagtgcgacctgcgcataccatgggggggaccctagggcactcgaccgaacaatgcttgaccatgaaaagcaaggtccaaagcttgatagaggccgggtggttgacttttcagaggacaggcccaac

SEQ ID NO: 65414 - DNA, 630 bp, Glycine max
  Peptide Sequence Number=SeqID_157099
atgcatccatatcgcaccagatcaaaatctaggatgatgggtgacctagacgaagtacaggaacagatgaaagccgacatgtcggctttgaaagaacaaatggattccatgatggatgccatgctgggaatgaaacaactaatggagagtaacgcggccaccaccaccgttgttagttcggctgccgaagcagacccgactctcccaactgtcgcgcaccaccctattccaaacatggtgggaggggagggaagcacaccggggcatatcaacaacccttatccgaggtaccaccgagccatacatgaagacatgggtcacgttcctcccctcatcctcaaaggggaacctcctctacatcctgacggggtccacgagaatcatagagagcatgctcagggagacgtcgactcctactccccgttacccgctgaggggccagcgcccaacgcactacctcaacccaaaatcacggaagagcctctaagccacccaacgcagccaatgtttttgtccgtgagaggaccacccccggcagcggaaggaaaggggaaactcgatctcatcgaagagagattgagggctattgaagggttcagtgattatccgtttgtagacatgactgactga

SEQ ID NO: 65415 - DNA, 216 bp, Glycine max
  Peptide Sequence Number=SeqID_157100
atggtctttgcttgtcaatctgacttggggtctccgaatgacatggtgcggataaccgtaagcaaagggtgtgtgcgggttaccatcgggtgtcatcgtatgccaccggagtcttgggtcacggtagcaaaaggtagggtggtcgacaaaagcagggcttttgctcatatgtatcctcaatttgtgatgaggaactcagacctacgtagttgttga

SEQ ID NO: 65416 - DNA, 438 bp, Glycine max
  Peptide Sequence Number=SeqID_157101
atgtccgatttaggcgcatcacatatagagacgctcgaaattgaacaacggaagctctcgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 65417 - DNA, 147 bp, Glycine max
  Peptide Sequence Number=SeqID_157102
atgactgcatttgccttctttcatacatggagagttgggttgtcaaattccgcatgggccatgtatcatatggttctccaccaatctgtagagttctgggtcatcttgatgggaagaacaaagaaaaatgtccaaatgaccaactaa

SEQ ID NO: 65418 - DNA, 1515 bp, Glycine max
  Peptide Sequence Number=SeqID_157103
atgaggcgagtgtggagattctcttccgacgcaacaaggcgagctcagttgttgttgctcttgcaatcccattatttccatggattctcaaaccccaaaaccactccctctttggccacggcgctatctcatcatcgcaatctcaattccgtgccaaacgcatgctctgacctcattcccttgttcactgccaagtcttgctcttcagccaaagaggatctcatcaacaaggcctccattctgaagaacgagctcatacgagaatccagcgactctgctagggttctgagcattttggacgataattccgacactttgattcagcgtcaccccgatggatctgtgttgctcaggcttatgaatcaattgaattcaaatccttcccttgccctccaggtgtttagttggagaagaaagagatcaaatgttgaaaaccctatggatgcgtatgagtactcaaagggtataaaagctgcaggtagatctgggaatgttgatttagctgttaagctctttaaggaggctgctgtcaaaggtatcaagacgaccagcacttacaatgcgcttatgggtgcttgtatgtccaatggtcttgctgataactgccagtccttgttttgtgatttgaagagggatccgacttgtgatccttctattgccacgtacaatattcttctatctgtttttggtcgcttgatgctggttgatcacatggaagcaacatttagggagatacaaaagttaaccttcaccatgaacatctgcacttacaatcacatgattgctggatatatcacggcttggatgtgggatgatatggaaaatgtgtttcaaatgttgaagaggagccccgttgagcctaacatgaaaacctacatgctaatgcttcgtgggtatgcaaattcaggtaatctggaaaagatggaagagatatattcctttataacggatcgtgttgatataaaggaaatttcattaatcagatgtatgatatgtgcctattctagaagttctgatgcagatagacttaagaagatagaattattgttgaagtttattccaggaaaagagtacaggccatggttaaatgttttattgattaaactctatgccaaggaagactggttagagaaaatggagaatgctataaatgaggcatttgagcatgggacttctataacaaccaagggtattttgagatgcatagttgcaacttattatcgatacaatgcagtagaaaagctagaaaattttgtgagacgtgctgaaatctctgggtggagtatctgccgatccgcatatcattgtaagctagtcatgtatgggtcacagctgcccttaatgcataatgtccttgaggagatggaaatggtcaaccttgaatgcacaaagaaaacattatggataatgtacaaagcttacatgagaaatggccagagttccatggttttaaaaacattgggacaaatgttcaagcatggttatgaagttcctttgagtgcatttccatcatga

SEQ ID NO: 65419 - DNA, 225 bp, Glycine max
  Peptide Sequence Number=SeqID_157104
atggagatgcccgtgtttcttagaaagatctccaattgcaagaatgtcaagcctataaccatagttaagtatttgttacaagatgatggtttgagcagtgtgaaacagaaccgcaatggccccaacttcttgggattggagtctctgtttttctctaacccgcatcatcttccggcttctttggtacgatctgcatgcatgaatgatggctcaaatgaggaatga

SEQ ID NO: 65420 - DNA, 840 bp, Glycine max
  Peptide Sequence Number=SeqID_157105
atggcgatcaaagaagatgtggaggaaggcatgcagaaaggagtcagagagccactggtggtccgtgcaagcaaagggcatccatggatggtttactttactacattcgttgcagtgtgtggttcttatgaatttggagcttgtgcgggatattcatctcccactcaagatgctatcaggaaggattttagtctgtctttggcagagtactccttgtttggatccatcttgacttttggtgcaatggttggcgcaataacaagtgggcctatagccgattttattggacggaaaggggcaatgagagtgtcaagtgctttctgtgtcgcagggtggctagttatttactttgctgagggcccagtgtatttggacattgggaggctatcaacaggatatggaatgggagttttttcatatgtggttcctgtctttgtagcagaaattgcaccaaaagaacttcgagggaccctgactaccttaaatcagttcatgatcacggctgcggtgtcagtgtcattcacaattggaaacgtgttttcatggagggttttagctataattggcctcattcccactgctgtattgcttttgggtctgtttttcattccggagtctcctagatggctggcaaagagaggacgtgaaaaagattttgtggcagcactgcaaatacttcgtggcaacgatgctgatatatctgaggaggcagaggaaattcagataatgccactaaaatatcaccgactttctttaagagcatctttagtgcaggatcttggagtgggttcttgccaagatccagtagtagagacagaccgtgccctaaagatgctctaa

SEQ ID NO: 65421 - DNA, 288 bp, Glycine max
  Peptide Sequence Number=SeqID_157106
atgtgtgagaagaaaatagaggaagtgagagatgaaagtattggtggtggtggtatcaatgacattattaatgatggggataaaggtgatattggtggtgacaataatagtcataatggtgtcaatgatgatgacaatgacaatggtgttggtggtaatagttgtggtgatggtaatggaggtgatattggtattagtggtggcgacaatgatggactagtggtggaggtaaaggtggtgacaagtacgatggtcaaatttaaaaaatatgtattttttaaaagctaa

SEQ ID NO: 65422 - DNA, 2832 bp, Glycine max
  Peptide Sequence Number=SeqID_157107
atggactgtggcagcgatggaggccttgggtttaagaaaaaggaaggacagttgcaccagagcttatgtaaaggctctgataagttgcacgataaagctttctgcaatcctgccgatgttgaagtatttactgaagagaagaaacaatctcttgccaaacgtccaggaagaggtggtgaatttgctcgtgcagtaaaggagattattgaatgttatgaaaaattgaggactgagaatcaggatggtgacacagggtcaaaggagcagatggatgagtcatattcacctgatccatctgccaacacaggggcaaaggagcagatggatgctcctttcacaattaattcacaaatgaaatcttcaaattgtgtgattgacagacctgaggatgctgttgcattgaaggatgaatcttataatatagaagcatcattggaggaagctactgataatgctattatgactgcaactgtaaaatcacttttttcaacaacccagagaaatgcaccagttcaaaggtctagaagcacattacaggtccaaaactttgttttaccttatagtgatggtggaaataatggcagcaatagtaatgacaacatatcagctgatgcaattgaggatacatctataagaaggagaaaacatatcaggaaatcacctgaccttttaggttgtgatgatactgattcacctgcatttgctccaaatgttagcatggaggacaatggttctgaaattattacaatcatttctgatgccttcactttaaatgagggaagtacgatagattctaatttaaaacttgaacagtctgagcctattgagtgccctgaaggtgaagatgatttgaacaaaggtcttgatctagaaataaaggctgtaatcaacaagaagaaaagaaaaccaaaccggaaaaaggaaactaatgattctggtgctcagaatgccagccaaagtttgcagaatatgggtggaaattctaaagaaagatgccctgatcaagatggagatgaacacttgcccctggtgaaacgagctagagttagaatgggtaaatcatccgcagaggcagaactcaatagcattgcacaagttcaggttaaatgtggcgaggaagatattactgactcaccacatcagataatcacatcctcaaattgtgaaaatggtagccttgctgaaggaggcacatcagtgttgaatagtgctttggttagtgtttctccttctaacttaatagctctgtgttctgaaaatgggtctcagatttgtaaaattaaaaaggaccaaatgtttggctgctctgtggatgatgaagctgctttacctccatctaaacgcatccatcgtgctttagaagcaatgtctgccaatgctgctgaagaaggtgaagcttgcatggaatcctcctctataatgacatcaagtggtagatgctgtatatctaccattaagagatgtccttgtatgaccgttaacaatcaaggaggtaatgatttagaactgcaaaggttggattcttgtggcattgattcatctcatgttagtatgtatagtttctcaactcgttcgaatacaattatttccacagagaatgagtcatctacagaagtggataagcatttggccaagttccaatgtgaaactgggaaggatgtcatcccaggtgatagacagcaaggtggtgaagatcttagtgattctgttgtctgtcatcctgccaaaatagattcacaaatacaatcacatggaaaaatttctcctgatcttgatgtaaaatgttgccaagttggaaacagtaaggattcaccatgtccatcattgttaccaaatggtgattacaatgtcagaccttcaaaccattcagatgcatctgatacattagagcatggtggaataagtcttgatcctgtggcaggtgacggtgaaagtgataaattggtacctcaaaatagtattaatgtgccacagaatgtggtggttgcttgtgaggatatggggaagcaagcagttggtggcagcagcaaaattaatgacacgcatgaggttgtcaaagaggtaaaatttaaaggacaagaggaggatatgaattctgtttcaatatcaaatgattattcaggtgaaaagggtaatttggtcattctgtcaagtccatccttgactgatgggagagttttccttccactaggttcacctccaaatacatcagtttgcaatatttctacatcagacagtagtaatatccttcaaaatggaagttgtagccctgatgtacaccagaagaacactttatctggtcctactgatggatggaaagatgggattgtggaaaatggacgatcaagatctgtgggcaagtcaactgaagcaggagatgctgcattgttgtactttgaagcaacgcttaggacattgaaaaggacaaaggaaagtattggtcgagcaacacgcatagctattgactgtgcaaagtttggcattgcaactaaggtaatgcgatggaaactgctccccttgaaaaaccagaccatttcaatgtatccaattctgaatatggctcaaagtcatttgatgggttggacttcggtgatcgatagcagagtgcttgctgtgcaggggtctttagggatcattgggatcagtggaagtctggcttgggatcttgaattcaggcacctcattgagtctgattctaagcgggctattgagtttagtgcaaatgactatcctataccgcacccacaatgttctctccttgtcttgaaggatgctatggggtctgctaccctgagatccattaggatcttgaagtttcttgtcgggctttag

SEQ ID NO: 65423 - DNA, 516 bp, Glycine max
  Peptide Sequence Number=SeqID_157108
atggaagtgaggccaaaggatggggataacatgccacaaaaaagtgttgagctaacactgatagaacttcatttagatgggcatttacaaggccaaatggcatcacgagaaaacgcgggagccatgcagctcgtcaatgaacttgttgatgtgacggatgatgtcctctgtgagaagctcctaaacttgttgctcaatctcgtccttgtgatggccttgtcacgtaaggaaggcaaactcaagcaagcccttggagcatgccttggtccgcaaaagtgcaaggatgatcatgaagatggtgcccctataaagttgcgggtacctgcccttgagttggattcgggtgacttggggctagatttggaccctttatccccaagcccaatagaagagccacaagaatgggtgggactcatagtcccaaagtcccagagtgttgtgaacgttggccacccaaaagggagttaccagagaagggagagtgaaggaggatgccaactgatggcaccacgctga

SEQ ID NO: 65424 - DNA, 1575 bp, Glycine max
  Peptide Sequence Number=SeqID_157109
atgttgctgtgtggggacattcttggcttcgaactattttgcaactccgtaccacgttctagttccttgaacagtaaccctcaccacacatgcatgattgtcactgcacagcatgaccacactgttcaaggaaccaccactcgtccttttcacggcttccctatttgttttgacgaaataccaaggttgcccggaacagcatatgccaggaggcagcatttatggctcagtggtgcaaacgaagtagacagcaaaactttttcaagagctattcttgccaagacagtggtgtgtattcctgtgttggagggcgtcgttgagttgggcacaaccgataagatcgaagaagacctaaatttcatccaacacataaagagcttcttcatagatcagcagcctcctcctcccacggcaaagcctgcactgtcagagcactccacctccaatctcacttcttcataccctcttgttattgttcctgtcactgctgccgccaccgccaataatgttctcatccaaaacgacatgaacattgttgataaaggagaagctattatattgaataataataataataataccgaagcagaattattagcagaccctaacagtaacagtttcataccgagcgagctaatggagctggaccaccagttggaggaattcggggtcggatcacctggagatggctccaatcacttggattccttccccaaagaggagtcaatggcactgtgtgctgcagggttggagctccttcaacttcaacgaccaccagctccagcacatcctcccacagaaaatctagcacaaggcgacacagacacccactactctcaaacagtgtccagcatccttaaaaagaactccagcaggtggtggccggattcaccctccgtcaaccaccccactgactccttccaatcagctttcaacaaatggaaatccgacactgacaaccaccaccactatttccacgagacggtggccgatggcacctcgcaggggctcctcaagtacattttgttcaacgtcccttacttgcacgccaaccggctcaagggcacgggagcttcgtcatacgagactaatcacgtgatggcggagcgccgcagaagggagaagttgaatgagaggtttctcattctacgttcgatggtacctttcatgatgaggatggacaaggagtccattctggaagataccatccactacatcaaacagttaagagagaagattgagagtctcgaagcgcgtgagcgcctccgggggaagaggagagtgagggaggtggaggtttcgatcatagagagcgaggcgctgttggaggtggagtgtgtgcatagggaaaggttgttgctggatgtgatgacaatgttgagggagttaggggtggaagtgatgatggtgcagtcttgggttaaggatgatggagtgtttgtggcggagatgagggccaaggtgaaggaaaatggtaacgggaaaaaggctagtgttgttgaagtgaaaaatgcccttaaccagattataccacatcatgagccatacacactttgttccaatgatcacttttaa

SEQ ID NO: 65425 - DNA, 375 bp, Glycine max
  Peptide Sequence Number=SeqID_157110
atggataaccgttctaaggagcagttatgtgcatgcaaggtggtgcatcgtgctcgtcagaagtcctacaaacatcgcctagtttgcatgggagttttgatatgtgataggctagtgatctcttgtttgctgaatatttgtagtatcgtattaatgaagatacacatcaaaatcaagatggttattgttgaagaagataaagtggttgcgacccttgacgtgaaaaatgctctagatagtaatgattttcaacctagcaatgatcaggctaattcggaatatcagtctgaccataatgtggaaaattatgagtcttggcctgtcaagtatctctccagttccaaagcaggagtacttcctacatctgaaacttaa

SEQ ID NO: 65426 - DNA, 942 bp, Glycine max
  Peptide Sequence Number=SeqID_157111
atggttgtgaattgcagtccatgggatgatgctctatataaggatgctgctgagagaactaacatgggttacatatctcttaatggattcctggcgcagtgggtccttatgacattacttgatccaccatgtagcctggctaatttgatttacattggatatagtggtaatccagctgctgctcttcgtgttacccgtagaagagcagtagatcgcaagaagcaagcaacagaaaagaatgtgttccaatgctatgtttttggttctaaaaatgctgggaagtctgctctgttggattcattattgggaaggcctttctcaaacaattatactccaacaactgttgagaggtttgcagcaaattccattgaattaatagggggaaccagaaaaactcttgtgttgcgggagataccagagagtgaagtatcgaatgttttgtcaaataagggttatttggcagcatgtgatgtagctgtttttgtctatgacagccattctgatgaatatgcttggagggaatcaagaagctcagatgaacattcatggaagaaatccagagatttgcttgagaaggttggtagacaaggagatctaactggttatagagttccttgtctccttattgccgcaaaggatgatttaactccatatccaagggcagtacaagattcagttaaggttactgaggaattgggaatagaggcacctattcatgtaagtatgaaattaggcgattcaagtaacgtgtaccataagattgtcaatgctgcagagcaccctcatttaagcattccagaaactgagattgggaggaaaagaaagcaataccatcggcttcttcagcactctcttgtttttgcctcagttgggactgctatggcatttgttggtttggcagcatgtcgtgcatatgcagttaaaaagaattcctctggttag

SEQ ID NO: 65427 - DNA, 309 bp, Glycine max
  Peptide Sequence Number=SeqID_157112
atggggttcttttggttttatttccggcatggggtagtttcgtacgtgaatagtgtgccatgcaggacccaaaccgccattgtcaatggcgagtttggtgtcactgagcaagttgcaaatggcagtggcgatacgtgcctaaaccgccattacaggtggcgatttgtacaatccatagggaaccgccagtcaaactggcgagttccattggttgcaggaggtgacgggagctttaaaggggagttgcaactgccattggctagttgcctggaagttgcaactcccattggcgatttagggcacaaatag

SEQ ID NO: 65428 - DNA, 774 bp, Glycine max
  Peptide Sequence Number=SeqID_157113
atggaattggaaaactttgaacgagttgcgattactgatgacgatgataatcttgtcatccttattgcgaaccaagcggatgatacccctgaccagagtctgtgcctcgtagggagattcctgactgatagaaccattcagattcttatcatgaggtgttccaagaagatccgcaaacctggaggagaagtgacagaagtcacatttaaatacgagaagctgagcaccttttgctacatatgtgtgctgctaggctataatgatgatcactgcgacaaaatttttgaaatggctgatgatggtggagttagactatggggtctagaaatcaaggttcaatcccgcacttacggtggcaacaatggaggttcgcggtggctgaaggaggagggtagccatggcagtaatgtatcaagaacagttggaggaaatcaggaagcaaatcccattaattgcggtgcaattattgccgaggataaaaaatgggatgaaatggtaattagagatgcaaacataaattttcttgcaactagaaccttggtacacacaggtgcattatccatagcagaagcggaggccctggctttgttagcagccatcaactggaccatggacaaaggatacaacaatattgtgtttgagactaactgtaaacatgtgcatgatctgatcctctcgacgaaacgcaacatttcagatttagggctcattttagctacttgtaaaaataagctaattaactcttctaaaccaagtcgttcacttccttgctag

SEQ ID NO: 65429 - DNA, 1137 bp, Glycine max
  Peptide Sequence Number=SeqID_157114
atgagtgttcagctatcaagcttatgggtccccaattctccaccaatacctcaacacttcgttcccaaccgtggcagattctccgcatcagctctctcatcccaatcccccactattcaggcaacccttttccccttttcactcaagttcttatctttttttcaatgcactctcacttcccgagattactgttctgggataattggcgtgggaggccccagttggagggaaaatggatatggaaaccccaacaacaacaacttgtttgatgggtgccaaggagagagtgatcattggagtgagcttgacactgatctttatcactggacaaaggcattgcgccctgtgcagtggtttcctggtcatatagcaaaagcagaaaaagaactgaaggagcagctcaagttgatggatgttgtgatagagatggatctatggcttggaaatagaaagagaattttagttttaaatagagaagacatgatatcaactgcagaccgcaatgcttgggcagattattttactaggaatggcacaaaggttgtcttctccaatgggcagcttggaatgggaacgatgaagcttggccggttagcaaaggaattagcagctgatgtaaatgttaagcgtagatccaaagggctacttcctcgtgcggttcgagctggaatagttggataccctaatgttggaaagtcatctttgatcaaccgtttgttaaagcgaagaatgtgcccagcagctcctaggccaggagtcacaagagaattgaggtgggttcgttttgggaaagatcttgaactgctggactctcctgggatactcccaatgcggatcagtgatcagtccgctgctataaaacttgccatatgtgatgacattggagagaggtcctacgatgtggccgatgttgctgcaattcttgtgcagatgctttcgaagcttcccacagtaggcagagatgctctttgtaaaagatacaagattgatgtagattgtcgagatggtagaatattcatagagaagcttgccgttcgagtatttaatggagatgttcatcaagcagcattccgcgtcctagcagattttagaaaaggtaagtttggttggactgcactggagaggcctcctaagtga

SEQ ID NO: 65430 - DNA, 177 bp, Glycine max
  Peptide Sequence Number=SeqID_157115
atggctcagggtttcattttatgtgcaggcagtatgagtggaacaagttctggtaatgaacctccaaatggcagtggcagtggcagtgttgagctgaaggttgttaaacttatgtgggatcaatcatttcactttcatctcaaaaatgacgaggaaggcaatgaaagagcacattaa

SEQ ID NO: 65431 - DNA, 369 bp, Glycine max
  Peptide Sequence Number=SeqID_157116
gtttacccgtgcatggatcctcagattcataggaggagttctatttgttgacaaaagcagcagtaaagtttccctaagcgccaccgattacaaaataaaatcaatcggaggtatgtgcatcctaatccaaatgtgggcatgggaacgctgcacgactttggctccaaagagaactcctcctataatggaaaacaaaccactcggacacaggtggctgcgacgtggaaaccaacatattggcaatgatgatctaatagttttccgtcgcaaattggatatcatgaaacgacatgagtttctgtgggagccttacacagcaactgttatgtcgatgttacctctcatttgtttggttggcagtatggcgtg

SEQ ID NO: 65432 - DNA, 264 bp, Glycine max
  Peptide Sequence Number=SeqID_157117
atggagaagatcaacaagctgcagcatcaatgccaagtacctcgagctgaagagaaatttgtattgcaatttatggattcgatggataactacctatccctctttgatgcagtgtcctccacacttcgacagatgaagaaaatgagctccgatctaggagcgtgggaacagttaatggtgatgaaggcgaacgcgagaatggagacatgcatggaagctatggagaaggcgatagaggagaatcgcgatgtgatggaggcgtga

SEQ ID NO: 65433 - DNA, 318 bp, Glycine max
  Peptide Sequence Number=SeqID_157118
atggtagcctggccagggacccaaccttctcttcacagggaagatgaaggtcccatagcccagcccttggtcagaaggaagaaggcagatcaaacacaagaagttgcagccacttctgagaaatctcttgaggccacttctgagccttcagaactagtggcagatacaacttcacttcagcaggtagcatacccttgcactcttgaggatcagactatgccagtcctgtctctgaacacttctcctacaactacccatgtgcttcacttaacagacgaggaggatgttcagacagaggatactcaggaccgatcatag

SEQ ID NO: 65434 - DNA, 348 bp, Glycine max
  Peptide Sequence Number=SeqID_157119
atgcaagaagaagaaaaagaagaagaatctgatgatgaagaggacttctcactctttgtgaagaagtttcataaattcgtcaaaaatagaagaatggagaaaagccataacttcaacaataggaagagatctcaagaattttccccaacacttaaatgctataaaagaatgagaagaaaagctataaagaaagaagatccaagaaggcgtatattgcttgggaccataatgactcattcgatggtttggagaaggagatcaaccttctatctaaggaatatgaaagtgatgagaacatctctcaagaagtttaagcaagaaaaccaaaagtctgacttccatctttga

SEQ ID NO: 65435 - DNA, 579 bp, Glycine max
  Peptide Sequence Number=SeqID_157120
ggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgacttggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 65436 - DNA, 307 bp, Glycine max
  Peptide Sequence Number=SeqID_157121
aagccgctccctcgacacccacattgtcgtcggtcaaactcacaaaaccccctacactgttggaaaacccacattgtcctcgctggaacccacagaaccccctacactgccagaaaacccatattgtcatcgctcgaaccccacagaacccacattgtcctggctcgaagaaaaccctacatacactgttgctactagggtgctgaaacactcgtcggtgctcaaaggtcaaagctttctccgcgaggctccgctcacgtgcgtgttgctgggttctcttgatcaagtaataagtaatggtgcatga

SEQ ID NO: 65437 - DNA, 577 bp, Glycine max
  Peptide Sequence Number=SeqID_157122
atgcacctctccctttaccctcaattggtcactctatttctccgtcattttcaaattccgcttgatgatgaaccatttgttcaagtcaagtgttcctttgctattggtgttggtgtagtgacttcttttggataccgtaaggatcggaatggtcaatggctgaagaaagatgcacttcctcctcaagttgagcgtactccttctcctcctcctcagcgagatgattcaaccctcatgactgaagttctttccgagttacggggtcttcgtacttatgttggcgaccgttttgattctctggataatcgctttgccggcatggatatccgtctcacacagcttgaagaagatgtgggttatattcgtcagagcttcgaccttccatgtcgcgctaagcacgagttgactgaatttggtgacggcaacattgatgttgccaatgtgaaggaattctatgccaacctctatggccctgaggataaatcacctaagcaggtgagggtaagaggtcatttgattaagtttgatgaagacatgcttaacatatttttgaagacccctgttgttgtggaagagg

SEQ ID NO: 65438 - DNA, 237 bp, Glycine max
  Peptide Sequence Number=SeqID_157123
gattgcatcaagttccatgacagcttgatagctaagaaggactttgtggttggacaaaaagttttattgtataactataagctcggactcatgagtgttgagatcaaaagtgagtccatagataagagcttcaaggtcaatggacaccggctgaaaccattcctcacaaatccctccttagtagatgtagtggtggaggagaccttcttacttcaccctacttctcttttgccatga

SEQ ID NO: 65439 - DNA, 291 bp, Glycine max
  Peptide Sequence Number=SeqID_157124
atgatgaaagactatgaaaacggagaagagcaaaagcgatacattgataacaatttctccaaacacatggcatacatcaaagtttattcaacaaacaaaggccacttgatcaatatgcccaacaactatgtagaaaaacctgaaaattatcctgtcataggaacaaaatgggtttttagaaataaattagatgaacatggcatagtaagaaacaaaatagtgttgctttatccactgctgaagcgtaatatatctctgccggcagttgttgtgcacagattttatggatga

SEQ ID NO: 65440 - DNA, 264 bp, Glycine max
  Peptide Sequence Number=SeqID_157125
atgaatcttgaagaacggtcgagaatcttcgccaaaataggggagaagcttgccgcccagctcgcccaggcaagctcagctcacccaggcgagcaaggttacttcctccagaagcaacagccttctggaggaatcttctggagggcccaagtgggcctgctttcgaagaagttacggaaactcacggattgcgcaaaaacacctcttttcgacttccgccacattacggaatttcacggatcacgcaagcctgcttccttttga

SEQ ID NO: 65441 - DNA, 801 bp, Glycine max
  Peptide Sequence Number=SeqID_157126
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggaaaatcaccattaaaggacctcattgaagctcaaagatccagcctccatagaaaccccacaagcaagcttccatcaggagtgaagtccagtaggagtgctgacaggctgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgttttcatag

SEQ ID NO: 65442 - DNA, 384 bp, Glycine max
  Peptide Sequence Number=SeqID_157127
atggtcctttttggtaacttggttcagcctcctatagtcgatgcaaactctaaaactgttctgcacccgagtaggaatcaactcctccttctcattttttatcacggtgaggccagttttcttcgggactacctagatgggactcaaccattggctgtcggagataagataaatgattccagcttgcaaaagcttggttacctccttcttcactacatcaagaatcaccaggttgagtcttctttggttcatcctatatcctttgatgcaatcctacccccaagggcattggatagaagactccaagaagattgggtcaaagatgcaagagaaggccctagggttctcatgagccttagggtagatttcgggcccatgggctaa

SEQ ID NO: 65443 - DNA, 642 bp, Glycine max
  Peptide Sequence Number=SeqID_157128
atggattcctttgaggagcaggcgacacagggatcctccgtcccccatggacgtcaggatgttctcaccgctgctattggacgtccagagcaccctggacgtgtccgtgctgctggagccggtgtcaccatcaagcaatactttggatcggctccacggacgtcccgtaactttccctccctgcctcctgaagaattgcagcagctgacccagcaaatcagggaccaactagaggagtcgatcacagaaaaagtgtctcgacagctcatggcatcattcggtcagatgcagacccagtttcaatcccagatgcaatctcagggacttgcactgcctttggagcctctggtgggtccctcaagtcctcgagtaagcataaaggggagttgtgttgatccctcaggaaatgatcttgagacaggtgacttagataggtgcggcttgtacatcaaagcaaatccttcccgcttggttgccctggggagagtttatgagggatccgctgttgttcataacactcatttgttgcctggccaagtaaagatgggtgtggaggaggttaaagatccagatgctccagttcctgtacccactgatgaggtttccttggtggggcaggcaattcacaccttccttgcttga

SEQ ID NO: 65444 - DNA, 252 bp, Glycine max
  Peptide Sequence Number=SeqID_157129
atgactaaagcacgtcaaaagggggtatggaaagaaaataggggagatgcttgccacctaggcgagctaggttgcttcctccagaagcaatcgccttctggaggaattttctggaaggcccaagtgggcctgaactttacggattgcgcactaacactttttaattttcggcatgtcgcggaacttcacggattgtgctacaatgctttctttcgacttctggcacgtcacagaactttacgaattgcctaa

SEQ ID NO: 65445 - DNA, 501 bp, Glycine max
  misc_feature (19)..(19): n is a, c, g, or t
  Peptide Sequence Number=SeqID_157130
atgcctgcaggtcgactcntagaggatccccgcatggtctgcattgaccaggcagatatgaccggtagactgctttccggttgtccaatcgactgggcccatttgattcgttaccgcatgcataaggcattgcggtctagtgaacctctaccttaccctcagcttgtgactttatttcttcaacattttgaaattcctttgaattctgagccctttgtgcaagttaaacgttcatttgctattggtgtcggtgcggtaacctccttcgactaccataaggacatggatgggcaatggttgaagaaggatgtgcaacctccgcaagatgaacgtactccctctcctctgcctcaacgagatgactcctcagccctcatgcatgaagttttttcggagttacgaggcccccacacctatgttggtgagcgctttgattccttggatggttgtatcgatgtcattgatgctcgctttgcaggcatggatacccacatcacttag

SEQ ID NO: 65446 - DNA, 657 bp, Glycine max
  Peptide Sequence Number=SeqID_157131
atggcttctagaaaacgcaaaagtattggttcaagacccacaacacaatatgatacaaggagattttcctccatagatgcttggaaccggtacacatacaatgtcttggggagaaacatcttgcctaagaggaaggtagaactctatcacactgagctagatgattttaaaattgaattggagaggcgtaatttccataaatgcctcaccaatttggttgatgggagcatagacttggctttggtgaaagagttctatgcaaacttatacaactttgagggaccttcaccaaagcaatccagagtcagaggccatttagtgaagattgatgctgacaatctcaacacattcttggagacacctatggtattggcagaaggtgaaactttacccatatactccagatactgcaggttgcccacagattacaaagagattgaggctgccttatgcataccaggccgagggttcatcttgaacactgagggtcatcttgggaagattctcatgaaggatttgactactctagctcaggtgtggagtgttctctcatactccaacctggcccccacatcacatacctctgatctgatagtggacaaagctaggctgatctttggcctagtctctcgcatggacatgaaggggatcctctag

SEQ ID NO: 65447 - DNA, 132 bp, Glycine max
  Peptide Sequence Number=SeqID_157132
atggcatatgagcacgaccagaggactacccttgaggactattcaagtagctcggagaggccaagaggtggatccactcattcaaaggtaacagtcttaaaacctgggaagaagttctggaaaagttcctaa

SEQ ID NO: 65448 - DNA, 570 bp, Glycine max
  Peptide Sequence Number=SeqID_157133
atgggcgtggtcaccgacttcggcaggatggtggctgcgatttccggcgtcgcccccatccacagcgcgatcgccgtgccggacaccatggcgcggcagcgccagcgccaccacggcgggctgcagcagctgattaagcagcgcgctgccggcgaaatagcgcgcgtagggcaggtgcgtcagcagcagcagtggaataatgatcgccatggctaccagcagcggattgacgatagagaggttgattctggctgccagacggcgtgccagcagatacgccactacggagacgacaatcgggccaaactgtgcgctgaggatatcggtgtagcccatcacgccaacgctgatcggcacaaacagcagcgccatgtagcggatcaacagctgacagccgggtttcacccacgttaccgggataatctgcagcgccagcagggcaaacagcaacagcatgccaaggatgctgccgggaatggtaaatggcagcagggcagcaaggccgttgccggcatacagcgcggcatagacgatggcaaaggcgcgcagatagcgccagcaggcagatag

SEQ ID NO: 65449 - DNA, 306 bp, Glycine max
  Peptide Sequence Number=SeqID_157134
atgaactatgagcctcactgggtgctattggtcaagattctgaatgaagttcatggtacttctagctgcacactattgcttgatagaagaagagcaagatggaaaaccttggtacttcgacatcaagcgatacatcgaagacaaggagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 65450 - DNA, 594 bp, Glycine max
  Peptide Sequence Number=SeqID_157135
atggtctgggacaacaacgtcccgggggctatctcaggcggttttccagtggaagcacagaccgcgctggtgtttgcgcctcatcagggcatcaaatgctactgtgtcgtggaaggtagctgctgggtagcggttgacggaatccagcagcctctgttactggaaaccggcgactgtgtatttctcacctctggcaaatcctttagtctggccacccatcccgcggcgaaaagacagccttttgtaccgcccgacagcgaaacgggcgcgctgacgcagcgcactggcagatatcctgctgcaggctctgcccgcgatcattcccgtcaggcagggcacgggaaccaacattatgcgcagtgcgatggaatgcctgagagaggagatacaaacttcgcagccaggcggcgttttactctcgcagcaactggtgcagattatgctggtgcaggcgctcagggtatttcttcagcaggaagggtgggggatgacgccgatgcgatacctgtcgaaatggcgaatgctgctggcaggcgagcgcctgagaagctcgcgcgaacctatttcgcagatttcattttctgccggatatga

SEQ ID NO: 65451 - DNA, 264 bp, Glycine max
  Peptide Sequence Number=SeqID_157136
atggtggtagaggttctaggtcaagggttgttcaattacttggtggtgaatttagttttgaacgagaatttgttaatggtgtttgggagtggcgagaatctgcaaaacaagttgtcaaatcttgaggaacttccgaacgcgtcaaactttagttggaactatgtcatctttaagcaatttttacaatcaaagtatggggattgggttttggggtggggggatgggtgttgtagggagccaagaaagggagaagaggttggataa

SEQ ID NO: 65452 - DNA, 192 bp, Glycine max
  Peptide Sequence Number=SeqID_157137
atggcgccaaaaacttggttgaactcggcaagtgcatcggatcgcacaagtagtataaaatggttaattaggcaagtttgtgaagtgctgattttgatctgctcgctaagccaatttgtcggcttagcgagccatccattgagtgcaccactcttgcgactgagcgcaaggaagaatctggaagaaggatga

SEQ ID NO: 65453 - DNA, 770 bp, Glycine max
  Peptide Sequence Number=SeqID_157138
tacacatcctcccctttagagggctacacgcccccaccttcagaggactatacgccttcgccttcagaggactacacgtcctccccttcagaggactacacatcatccccttcagaggactacacgtcctccacttcaaaggagtacatgtcctccccttcagaggactacacatccttgccatcaaaggactacacgtcctccccatcagaggactacccgtcctcaaattcagaggactacacttcctccccttcgaagggctacacgccctcgccttcagaggactacagatcctcggctttagtgggctacacgcgctcaccttcgtaggagtgcatgcccttgccttcataggactccacatctgtgccttcagagaactcaaggtaagtatacacgtggctcaattgatttctgatgtcatccactatttacatggatcgcgcccacaagacacccagtggacccagagaagtccaacagggccctggggtttccagctctggttatgggcctctgccagtcctaccgggtgcccgtccccccagcaagggatcacgcccgcaagacacccagtggacccggaggagtccaacagggtcctggggtttccagctctgattacgagcctctatcagttctacggagtgcccgtcgcccctagcatggtcatcaggccccctactaaccaagctttcatcaagaagtattgcgcccccaggcaagcgcagtgcgtgacaccacaacagcctggggatggctggtag

SEQ ID NO: 65454 - DNA, 1323 bp, Glycine max
  Peptide Sequence Number=SeqID_157139
atgaggatgaggaacaaatacaggaaaccaacaactttacgttgcaatgcagggagcagatgttcaacgtctgttgtggtattgagcttgttaggatgcttatatttgcttcatttttatacccttattcatcacagagatagaaatggtgaagagtctctattgcgtattagtaatcatccccaattccgtgaacttcaagaagtggaagaggaagatgttcaaatccccccaccaaggggaaagaggtcccctcgggcagcaaaacgcagacctaaacggacaaccacgctgattgatgaattcttggacgaaaattcccaacttagacatgtgttttttcctggtaaaaaaatagctatagatccaatgcagactgctgtgaacgaaagttattactactaccctgggagaatttggttagataccgatggaaatcctattcaagcccatggagggggcattatatatgataaaagatcaagaacatactattggtatggtgaatataaagatggccctacctaccaaattcacaagaaaggagctgctcgggtggacattattggagttggttgctattcttctaaggatttgtggacctggaaacacaaggggattgtattagcggcagaggaaacagatgaaacccatgacctgcacatgtctaatgtgcttgagcgaccaaaagtgatttacaatgagaggactggaaagtatgtgatgtggatgcatattgatgatgccaactataccaaagcggctgttggagtagcagtcagtgacacacctgatgggccatttgattatcttggtagccaaagaccccatggatatgaaagcagggatatgacagttttcaaagacgacgatggtgtggcatatctaatctactcctctgaagacaatagtgaactgcacatgggaccccttactgaagattatctcaacgtgacatctgtcatgagaaggattctggtgggacagcatagagaagcaccagctttgttcaagtatcagggcacatattacatgatcacgtcagcctgcactggatgggtcccaaatgaggcattggctcatgcagctgagtctattttggggccttgggaaacagttggaaatccctgtattggaggaaacaaaatgtttaggcttacaaccttctttgctcagagcacttttgtgcttcctctacctggcttcccaggacctgttgatcagcctcttgagtacagttttgaatttccattgtggtcaagagtgtctatctattggcaccgaaaatggagactgcctcacggctggaacggcttcaaataa

SEQ ID NO: 65455 - DNA, 183 bp, Glycine max
  Peptide Sequence Number=SeqID_157140
atggtcatgatgaaccaggcagtgcttctgattcttctattgttgaaggaaaagatgcgtcttcgaggaataatcatgacgtcgggcaggttgagaatgagaacattgattcagatgtattgttatttggccaacatgaagaacaatacatcttcatgtggccaatacgtatcaaatttatag

SEQ ID NO: 65456 - DNA, 234 bp, Glycine max
  Peptide Sequence Number=SeqID_157141
atgaacaattgcttgttgacaaagtctatgaatacattagaggtgtcaagcctacagaaatctcttcaagtttgggctcacattcgtgacttggctccttttggtaggcgtttcacttcttctttacagtgcattactgactctttaattaggggcagatccacatcaggtgttcaaggaaaaactacgttgtctggctatagcaattacagtctactgcatctggctgtctag

SEQ ID NO: 65457 - DNA, 1152 bp, Glycine max
  Peptide Sequence Number=SeqID_157142
atcatggaaattgcgtacaactactacttgcctgaacttgaaattgaggatccaaccttctttgatcaataccagatggattcatttgcttgtccacttgatgactttgactttgagtctttctccggttcccctgagagcaactcctcatatcatttcaactccgaaagcacaccaaattgtttcccagctgaaagtcatgatcagtcttttacccctgcaagaccaaccaagaggctcaagaacacttgtgccagtgacttcatttcccacaaggtttctgctttttcatcctcccaacttatttcctttgggcacttcaatgccccgtcaccatcacatgcttcccagcaatttcaaaacctggacttcgatgagaaagcgtctagtgagaacatggattttgcagctttcgtttctcagggttcgtatgaggacaaaagtttcctaagttctgataatagaacgaaccaggttggcataaccactaggaacccaatccaagctcaagagcacataatagctgaaagaaaacgaagggaaaatatcagcaagaggttcatcgctctttccgctatcctccctggcctcaagaagatggacaaggcttctgtgttgggagatgctgtcaagtatgtgaaacaactacaagaacgtgtgcaaactctggaggagcaagcagcgaagagaacacttggatcgggagtgctggtgaaaagatctattatcttcgctgatgatgaaacttctgacagccactgtgagcattcactccccgaagtcgaagtcagggtttctgggaaagacgtactcatcagaactcaatgcgacaaacacagtggacatgctgcaatgatactcagcgaattagaaaagctttacttcattgtccagagtagcagctttttgcccttcggcaatagcaaaactgatgtcactattattgctcagatgaacaaggaaaactgcatgacagcaaaggatctcctaggaaggttgcgacaggctttgggtcatatcgtgatgatgttgggtagttgtgccagcaatgtttgggttcacagggttgacagtgatattgggtggatgatagcaatagaagtgacagcagtagtcatcaaacgaacccaagcaccagacccaaatgcgtag

SEQ ID NO: 65458 - DNA, 918 bp, Glycine max
  Peptide Sequence Number=SeqID_157143
atggcggcgaacttgttagcaactctgggggatctggagagggactccttcgtgcctcttctctcgaagctgattggtgaatcgaagcacccgccggagcttattccgcaagaggacagagtggtgaagcacgtcttggacattctgttaccgttcagcaccacctccagcggtggccccttgctcgtcaaccacgtcacataccacgccggcagagggaacctcatcatcgagtaccccggcaccgttcccggcaaaatcctctccttcgtcggatgccacatggacgtcgtcaccgtcaatcccaacgactgggatttcgatcccctttcgttgaccgttgacggggataagcttcggggtcgtggaactaccgattgtttgggacacgtggcacttgtcaccgaactcgtgaggaaactcggggaaaccaagtccaatttgaagtcaactattgttgctgtttttatagccaatgaagaaaattctgcgataactggtgttggtgtggatgcactcgtcaaagatggcctcctcaataagctcaaggatggtcctctgtattggattgacacggcggataaacaaccaggcgtagggactggtggtatgataccctggaaacttcacgtcaccgggaggctctttcacagtggattagctcataaaggccataaatgtgctagagctagccatggatgctctaaaggaaattcagttgtgattttatcgagacttcccacttcatcctcaggaacaggtttatgggtttgcaaccccttcaaccatgaaaccaacccaatggagttatccaggaggtggaatcaatcaaattccaggggaatgtactatttcaggagatgtcagattaactccattctacaagtaagctacatcctacagtacagtcaaaagtag

SEQ ID NO: 65459 - DNA, 1037 bp, Glycine max
  Peptide Sequence Number=SeqID_157144
gtgtttgcattcccacactctcctcatattccaacgcctccactccgcgatccgctatggattctcgtgaacagcctcagccacaaccgccaaacatgatggtgggacccaccgtgtacccttcgatgttggcccccgccaccgctagattcccttacagcaacaacaacaacaacaacagcaatcctcctcctccttcttcggagcctctcaacagcgacgccaacaccaaccataataacagcacgttcgaggcgttgaagccttgtgcgctggccgcctcggaatcgtcgaagaagaagcggggccggcccagaaaatactcgcccgatggcaacattgcgttgggcctgggcccaactcacgcccccgcttcctccgccgacccccccgccaaaaaacaccgcggtcgcccccctggctccggcaagaaacagatggatgctctcggcattcctggaactggttttactccccatgttatcaccgccgaagttggcgaggatattgcttcaaagcttgtggccttttgtgagcaaggacgtcggacagtttgcaccctttctgcttctggtgcaatccgcaatgtcaccattcgagcaccagacatgcctgctggtattctggcctatgagggtcaatttgagatcatatcacttaaagctgctacgctacaatctgacaataacagaatggctgccttgagtgtgagcatagcaggtcctgatggacgattattgggtggcgaagttgttggagcccttactgcagcaacggcggtgcagtctagctcaagtaacctgaaatctggacgttcttcgacgccatcatctcagatgttagcctttggtgcttctccgactccaactacgcctacctctctagggccttcaactgattcatctgaggataatgagaatagtcattttagtaaggggccaggtggctcaggactctacaataataatgctagtcagcccattcataccatgcccatgtaccaacatcaactatgggctggccatactcagcagtga

SEQ ID NO: 65460 - DNA, 552 bp, Glycine max
  Peptide Sequence Number=SeqID_157145
atgacggtgaaaacctctgacacatgcagctcccggagacggtcacagcttgtcggtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttatgttgttgatgcggccgatccagataacattagcatatcaagaagtgagcttcatgatttgctgagcaaaccttcattgagtggcatccctttgctggtattggggaacaagattgacaaagcggaggctctgtctaaacaagcactgaccgaccaaatggatttgaagtcaattactgacagggaagtttgctgcttcatgatctcatgcaaaaactcgaccaacatcgactctgttattgactggcttgtaaagcattccaaatcaaagagctga

SEQ ID NO: 65461 - DNA, 192 bp, Glycine max
  Peptide Sequence Number=SeqID_157146
atgtgttgctcttcctacagggtgactgatgttattaaggatcctagtcctaatcaagcgtcatcctcaaatccctcttgttggcgctcgcttagcaaggtagtgctcgctcagcgcctctgtacagctcatccttcttccaaaattgtccatccgcttagccaaaaaatgagtggcttagcgagttcatga

SEQ ID NO: 65462 - DNA, 432 bp, Glycine max
  Peptide Sequence Number=SeqID_157147
atggcatccaggaagaggaagagtatggcttctagacccgcagctcagtatgataccaggcattcccaatctttggaagcttggaacagatatacggacaacattctcggccagaacatcattccggagagaaatgttaagatttatcatactgagtttgacgagtttaaagtggagttggagaggcgtaatctccataaatgcctcaccaacctccaagatggaagcatagatgtagctatagtgaaggaattttatgttaacctatacagacaagaggaaccagctcctaaacaagctagagtaagaggacatctgatcaagatcgatgcagacagcttgaatgactttcttcaaactccattggtgttagaggagggggaatctttacccacttactctaggttttgcaggttgaggactaagcactag

SEQ ID NO: 65463 - DNA, 150 bp, Glycine max
  Peptide Sequence Number=SeqID_157148
atggaggattggaagattttctccaccgaatccttgaggaggattctgaggattctactccaattaaagtgttcctcttcatgtgggggttcaatggaaagcaacagcggctcgcgggtttgggtggcgttttggagaagaggagagtga

SEQ ID NO: 65464 - DNA, 573 bp, Glycine max
  Peptide Sequence Number=SeqID_157149
atggccagcggacctgccgctcccgcagttcatcatccagcgtcagtaacgcgaattcccctctctcgccgagaaccccgccctgccacagcagccgttgcgcctgctgccgcgcccacggcgattcactcttccaggccagcaaatgcagcagcgactgctgtaagcaaacgctgtgcgaatggttgtcccgcagcaatcgtcgatacaccggcagcgagatactgcgtacgctgtagaaaccgctgcgcgattcactatcagcctgcgccacgctggcgcacatctgcccggcgagatcgcttaaacgattatgcgtcagcggctggcgcagcgcatccagatgcccggcggcggcgcaaagcaggccgctcctttgccgctcatgcgtcagcgaacccagtaacgccgctaccgtttcagactccccggtctgcgcatgctgaatacctgcgtcataacaacagacaaagaaatcatggctgccacggacgactggcgggcgcgccagcagattcagcgccggatgcagttgttcaagctcctccagcgacgccagagtgtcatcaatga

SEQ ID NO: 65465 - DNA, 672 bp, Glycine max
  Peptide Sequence Number=SeqID_157150
atggggacctataccattgctccccggcatctccgctttgccattaagcttgcatgcgcggtggtgctggcgctgtttgtcggctttcattttcagcttgagacgccgcgctgggccgtactgaccgcggctatcgtgaccgccggcccggcatttgccgccggcggtgaaccctattccggggcgattcgttaccgtggaatgttgcgtattgccgggacgtttatcggctgtattgccgcgctggcgatcattatcctcatgatccgcgcgccgctgttgatgatgctggtctgctgtctctgggccggtttctgcacctggatctcctcgctggtgaaggtggaaaactcctacgcctgggggctggcgggttatacggcgctgattatcatcatcaccattcataccgacccgatgctggcgccgcagtttgcggttgagcgctgtagcgaaatcgtcatcgggatcgtcagcgccatcgttgctgatctgctattttccccgcgctccatcaaaaaagagatcgacctcgaactggataacctgctattggatcagtatcgcctgatgcagcttgtgtcgcccatggcgatagcgaggtggtggacaaagcctggggagcgctggtgcgccgtactgccgcgctggaaggaatgcgcggcaatctga

SEQ ID NO: 65466 - DNA, 396 bp, Glycine max
  Peptide Sequence Number=SeqID_157151
atgaaaaattcaagtcggtcactacagacatccggaaagagtgtgccgggttacgagaagaaaatgcagctaccgcaagagcccttgaacaagaaaccaagagtgcttgcaaggaagagcatggctgagacaaattccatggagctttgtggggcagcaacagtccaaaagaatcttgtctcagtgtttatgcgagacaaagaccaacatgctagccatcaccaagaagaactaaatctagccacggcccatgggcataaagtggcagacgagtatgcccaagtgtacgcgaaaaaggaggctagaggaagggtgatcgacgcgttacatcaagaggcaacaatgtggatggaccgatttgctctcaccttgaacgggagtcaagaacttcactga

SEQ ID NO: 65467 - DNA, 267 bp, Glycine max
  Peptide Sequence Number=SeqID_157152
atggaaatatggaaaatgcttgaagtcactcatgaaggcactgcggatgtaagaaaggcaagaaaccacactcttgtatctgaatatgaagctttccgaatgaagaatggagaaaccattttagaacttcaaacaaggttcacctatattgtgaatcaccttcttcgtcttggaaaagtgtttaaagatgatgagctaaacatcaaaatccttatctgtcttacaagaacttgggaaccaaagatcacagcgatcaaggaatcctag

SEQ ID NO: 65468 - DNA, 435 bp, Glycine max
  misc_feature (10)..(10): n is a, c, g, or t
  Peptide Sequence Number=SeqID_157153
gttaaggttnttagttttagggttagtcagcttagaagcccattaggggcaatgtggctgaaaagggtgaagacccctgtggctaagcgcgccttgtgcgctaagcctgagtgtcattttggtgaggctgagctaagcacgctatgctgccctaagcttagactctcttctgctaagcgcgagtctgccgcgatggcatctaagaaaaggaaggctccttctacaccttcccaagtcagatatgatcagtctaggttcacatctcaagaagcttgggagagatatactgatataattgtgcctaggaaactattaccagagagaaatgtagtagtatattacactgagtttgatgagttcaaggaggaactcaagagaagacactgggatgaggagttgactgattttgctgactgcagcatagatgttgccatt

SEQ ID NO: 65469 - DNA, 295 bp, Glycine max
  Peptide Sequence Number=SeqID_157154
atgcacttgtcggtagattttgcatccacacaaacaagtagtatcccggagggcaaaacaagtgaattggttccattggatttacaaattgaagcaacctttagaagaaacaactcagagagaataagaaagcttctgcacgacaaaacaatagcatcaatccttgaagaggctcacttttctgagtcatcatcttctaattcacctatatccagggaatctcaaacagcagaaattgaagccgaagtcatggctgaagagcaacctcgacgagtgaccctggaagatgactcag

SEQ ID NO: 65470 - DNA, 1491 bp, Glycine max
  Peptide Sequence Number=SeqID_157155
atggatggtctggcgcagctaaaattcctgacgctgtttgcgctgctgtttggtgccggactggccctgcaggtgccgctcggcagccgctggatctcctcacgcttaacgctgctggtcttcatcgggttcatccatgcggtgttcctgtgggaaggcgacatcctgctggattatgggctgattgggttgattgtctggcgcatgctgcgtgacgtgccgtcggagcgggcgctattacataccggcgtgctgctctatctggtgggctgtgccgtgctgctggtgtttggcgtcatctccagtccgcagccgacgcgttcgtggctgcctggcgcggcagatctggagtatgagagctactggaaactggtcggcggctgggaagcggtgcagaatcgcctcgaacacctgtcatccggcctgatggcgctggcttcgcagtatggctggcagctggccgggctgatgctgatcggtgccgcgctgatgcgcagcggctggctgagcggccagtttagtctgcaacactaccgacgcgcggcggcgctgttacttaccatcggctggctgattgccatacccggcgtgctggcacagtggctgctacagtgggaatttcgctggagcggctttttcctgcaggtgccacgcgatctcgccagtccgtttatcagccttggctacgctgcactctgtctcggttactggccggccatcgccgccacgcggatcagttacgccattcagtgcgtcggccgcatggcgctgagcaattatctgctgcagacgctaatctgcaccacgctgttctaccgcttcgatctgttcctcaaatttgaccgcctgcaactactggcttttgtaccggctatctggctggtcaatattctgttctccgtgctgtggctgcgcgtcttcccgcagggaccgatggagtggctctggcgccggctgacgcagctcgccgccggaaaagcggataacgcctgtttccgatgccctgacagaatagcgccgttacgcgccagtcgcgccttttctcctctgtggaacaactgcatgataacgattcgtgatgtcgcccgtcaggccggggtttccgttgccaccgtgtcgcgggtgctcaataacagcagtgcagtcacctctgatacccgcgaagccgtgctgcaggcggttgaatcgctcggctaccggccgaatgccaacgcgcaggcgctggctacccaggtgagcgataccatcggcgtggtggtcatggacgtttccgatcccttctttggtgcgctggttaaagcggtggataccgtggcgcagcgcatgcacaagcatgtgctcatcagcaattcgtggcatcaggaagagaaagaacgccatgccattgaggtgctgatccgccagcgctgcaacgcgctggtagtgcacgcgaaaacgcttacagacgcggagctggcccggtttatggatcagttcccggtatggtattga

SEQ ID NO: 65471 - DNA, 621 bp, Glycine max
  Peptide Sequence Number=SeqID_157156
atggcgaccgcgctcggcctcgatcgctggattagctggcgaaccgcgccgtttatttatgaagatgtcgcttcgctgccgcatcgccaggtcggcgtggtgctgggcaccgccaagtattaccgcaccggcgtcatcaatcagtattacctgtatcgcattcagggcgcgctcaacgcttacaacagcggcaaggtgaattatctgctgctgagcggcgataatgcgctgcagagctacaacgagccgatgaccatgcgacgcgatttaatcaaagccggcgtcgatccctcggacatcgtgctggattatgccggtttccgtacgctggactcgattcgcttccactgtgaacgcgcactgtatatcgcccagcatctgggcattcaggcgcagtgctacgccgtgccgtcgcccaaaaatatgctgtcggtgcggttccgcgaggtgggtgcgcgcctcggtgcgctggcggatctctatctgatgaagcgcgagccgcgtttccttggcccgctggtgccgattccggcggtgcatgaagtgccggaagatgcgcagagctacccagcggtcacaccggaacagttactcgagctggaagagaagctgcggaaatag

SEQ ID NO: 65472 - DNA, 1167 bp, Glycine max
  Peptide Sequence Number=SeqID_157157
atgactcaagtcgctaaaaaactactggtaacgtgcgccctgccgtacgcaaacggctctatccacttaggtcacatgcttgaacacattcaggctgacgtgtgggtccgttaccagcgaatgcgtggcaatcaggtgttcttcatctgtgcggacgacgcccacggcacgccgatcatgctgaaagcccagcagctgggtatcgcgccggagcagatgattgcggaaatgaagcaggagcatgagaccgatttcgcaggtttcaacatcagctatgacaattatcactccacgcacggcgacgaaaaccgccagctgtctgagctgatttacacgcgcctgaaagagaacggtttcattaaaaaccgcaccatttcgcagctgtacgatccggaaaaaggcatgttcctgcctgaccgcttcgtcaaaggcacctgtccgaaatgtaaatctcccgatcagtacggcgataactgcgaagtgtgcggcgcgacctatagcccgaccgagctgattgagccgaaatcggtggtgtcaggtgcgacgccggtgatgcgcgattctgaacacttcttcttcgatctgccgtccttcagcgcgatgctgcaggcgtggacgcgctccggtgcgctgcaggagcaggtggcaaacaagatgcaggagtggtttgaagccggtctgcaacagtgggatatctcccgcgatgcgccgtacttcggcttcgaaatccctggtgcgccgggcaaatatttttacgtctggctggatgcgccaatcggctacatggggtcgttcaagaacctgtgcgacaaacgcggcgacatcgatttcgacgagttctggaagaaagattccagcaccgagctgtatcacttcatcggcaaagacatcgtctatttccacagcctgttctggccagcgatgctggaaggcagcaatttccgcaagccgaccaacctgtttgtgcatggttatgtcacggtgaacggcgcgaaaatgtcgaaatcgcgcggtaccttcatcaaagccagcacctggctgcagcacctcgatgccgacagcctgcgctactattacgcggccaagctctcttcgcgcatcgacgatattgacctcaatctggaagatttcgtccagcgcgtgaacgctgacatcgttaataaggtg

SEQ ID NO: 65473 - DNA, 1152 bp, Glycine max
  Peptide Sequence Number=SeqID_157158
atggagtcagcaatttgccagcctggcgcgtttcggtccaggctgtgggggcgaatcggcaggtgccggttcttttccagccatttatcaggagcgaacatgacggacatcgtacagttattgggtaaagaggcggatacgcttcttcaacatcgctgcatgaccattccagcggacagcctttatttgccgggcgcggattatgtcgatcgcgtgatgattgataacaatcgttctcctgcggtactgcgcaatatgcagacgctctacaacaccggccgtctggcgggtaccggctatctgtcgattctgccggtggatcagggcgtggaacactctgctggcgcctcgttcgctgccaatccggcctatttcgacccgaagaatatcgtcgagctggcgattgaagccggctgtaactgtgtggcatcaacctatggcgtgctggcctccgtgtcacgtcgctacgcgcaccgcatcccgtttatggtcaagctgaaccataacgaaaccctgagctatcccacgcagtatgaccagacgctctacgccagcgtcgagcaggcgttcaacatgggcgcggttgcggtcggcgccaccatctattttggttctgagcagtcacgccggcagatcgaggaaattgcagcggccttcgagcgcgcgcacgagctcggcatggtgacggtgctgtgggcttatctgcgcaacaacgatttcaaaaaggatggggtggattatcacgccagcgccgatttaaccggtcaggctaaccatctggcggccaccattggtgccgacattgtgaagcagaaaatggcggagaataacggcggttataacgcggtgaagtttggccacaccgatgagcgcgtgtacagcaagctgaccagtgagaatccgatcgatctggtgcgctaccagctggccaactgctatatgggccgcgccgggctgattaactccggcggtgcttcagccggtgcgaccgatgtggcggagtcggtgcgtacggcggtgatcaataaacgcgccggcggcatggggctgattctcgggcgcaaggcgtttaagaagtcgctgaaagagggcgtggcgctgattaatgcggtgcaggatgtgtatctggcaaaggatgtgacgattgcctga

SEQ ID NO: 65474 - DNA, 429 bp, Glycine max
  Peptide Sequence Number=SeqID_157159
atgaaggatgtggcgggttataaagcgcagcatcatcagccgattgaagatttgggtcaggagcgcaaggtgcgggacaaagccctggcggaagcgcgtgagctgggcctggacgatgccacggtgcagccgtttattcaggcacagatggatgtggcgaaagcggtgcagtatcgctatcgcgccgactggctggcaacgccggagccgcactggcagccgcgtccgctggatgaggtgcgcaaaagcattggtcattacagcgacgcgattctgacgcagcttgccgcgcagttgaaacagggcgcgacgctgcaggcaccgcaaaaggccgaatttatgcgcgacattcagcagcgcaacgtgtcaccgcaggataaagagttattgtggcgcacgctcagcgcggtaacgttacggcagccgtaa

SEQ ID NO: 65475 - DNA, 554 bp, Glycine max
  Peptide Sequence Number=SeqID_157160
gaacggggaagccgtctgatagcgctctgtgcgcgtactccgaaaggaatcgggttaaattcctgaaccgggacgtggcggctgacggcaacgttagggagtccggagaccctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 65476 - DNA, 74 bp, Glycine max
  Peptide Sequence Number=SeqID_157161
atgggggaggaggttgctgcccagctcgccaagacgagctggtggattagtttagaagaaacattctcacccag

SEQ ID NO: 65477 - DNA, 592 bp, Glycine max
  Peptide Sequence Number=SeqID_157162
atgggggatcccatcggcagactctccttccccgaaaacaacgagactttttcaagtctcacaagttatccagaactacgtaggtctgagttcctcattagaggatacgtaggagcaagagcctcgcttttgtcgaccataccgccttttgttgccatgactcaagagctggtagcccgcggagacaccttacggttatccgcacctcgtcattcagtcaccccaagtgtgattcacgagcagagaccaatatggtcatctgcgccctttccggagatgtcagcattttccgatggagacttttcaagtctcacaagttatccagaactacgtcatgtgacgtgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttagcggttatccgcacccttttgtcatccagaggcggcaggcccgatgacaagcagagaccaa

SEQ ID NO: 65478 - DNA, 246 bp, Glycine max
  Peptide Sequence Number=SeqID_157163
atgggacatcttagtgatcaaggggttcccatgaaccctaagagaataaaggtcattcctgagtggaccactccaccaagtgttgagggaagaagcccagagtttgaagaacctctggatttgaggtcaaatccttttcaagggggaaggaatgacgcaatcctaccccccccccaagggcattggatagaagactccaagaagattaagacagagatgcaagagaagaccctaggattctcatga

SEQ ID NO: 65479 - DNA, 399 bp, Glycine max
  Peptide Sequence Number=SeqID_157164
atgagcaagccgtacagtactggcagtagcattgggattgaactgacctcgactagcagcaacgagttcaacaccgagcagcaggcacatacgccattggtgctccacaccatcgtaccattatacaacaggcctctcgtactcgtacccttacgaacgccagcacattctcccttcttaatatgccaatcgaccagacctcatgaccaacgtcgtagtagttgcatagctcatatagctagttgcaatagagctagtacgatcaccgaatgcaccactaggcagatgggtgttgttggactagtattagctatggtcgcagctggctcactggcaagaggcaccatgagatgcactagtgaggttggctcttatgcggttggctcatttgctggctag

SEQ ID NO: 65480 - DNA, 993 bp, Glycine max
  Peptide Sequence Number=SeqID_157165
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggactcgaaatggaagctgtgtgtctggcacaagaaccaaaacaaataccaaactggagataaaaaagacgagactggttatcttgtctatggcaagtggatcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccctggcggctccctcgtgcgctctctgttcctgcctttcggtttaccggtgtcattccgctgtatggccgcgtttgtctcatccacgcctgacactcagttccgg

SEQ ID NO: 65481 - DNA, 522 bp, Glycine max
  Peptide Sequence Number=SeqID_157166
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcggaaaaggattggctctgagggctgggcacgggggtcccagtcccgaacccgtcggctgtcggtggactgctcgagctgcttccgcgcgagagcggtcgtcgcgtgccgtcggggacgattggaacgggcccttcgggctctcccgggcgtcgacagtcaactcagaactgaaattcaaccaagcgcgggtaaacggcgggagtaactatgactctcttaaggtagccaaatgcctcgtcatctaa

SEQ ID NO: 65482 - DNA, 189 bp, Glycine max
  Peptide Sequence Number=SeqID_157167
atggaaatggccccgaggaagctcgcctcgaagagatctaggaaggataaagcggctgaaggaactagttccgctcccgagtacgacagtcaccgctttagagtgttgtacaccagcagcgcttcgaggccatcaagggatggtcatttcctccggagcgacgcgtccagctcaggacgacgagtataa

SEQ ID NO: 65483 - DNA, 207 bp, Glycine max
  Peptide Sequence Number=SeqID_157168
atggacactctcgcccccgtttcaccatgggcaaatatatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 65484 - DNA, 435 bp, Glycine max
  Peptide Sequence Number=SeqID_157169
atggtggtgagcttcttcttaactcatcttctccttgaagtggcatctccaatcatctttcttccttctccattctgctaccatgatcttctagaagcaaaggactccattgatgaagaagatccaagtcctacaagctccacatggagctacatcaaaggcttaggcttactcgggtttctgtcactcaactgcatgcatacctcccattcatccttctttgtgctgcagatttcaatttgccccctgcttatcattccttacagtagctcctcagctattaggcatgtttccacatcgtgcgactcccatggatgttgtcattccctaatttcgtctggggataatcatttgcaagcatttggattcttgccagtccaattgagcttctcaacaccaattgtcacgcattccataaagttagtcaacatttag

SEQ ID NO: 65485 - DNA, 252 bp, Glycine max
  Peptide Sequence Number=SeqID_157170
atgagggatactcaagttgctctcatggacaccatctacgagaaggtgaggtcgtctttcttttcggccaccatatgctggagtgtagtcttcgccggtctccaggttatcaacaagataagacctatcacatggctacgagctctttccttactcagacagaccccaagcgggcacaatggcaagactttgatgtggggttcgaaagataggcttgcaacggattcaaccgatcgattccccgtggaataa

SEQ ID NO: 65486 - DNA, 663 bp, Glycine max
  Peptide Sequence Number=SeqID_157171
tctcacacctctttcatcatgaaagtagacccgtctgtcccctacaaggtcactgcttgtatgccgagaaggggaaggaaaattgggagcgactcttggctaggattctcaaacgtccccttgatgggaacaaggggttgtatcaattataaccccgtccttgccataagacaacttggctaccccatgagaggagcactgtcagaagaaagtatcgtacctttcatcgcgtggggtttcagtaaccccaatgcaaggatattacaaggagtccacaaagcatggagcacggtgcaaagaaaagataaagagcttaggggaagcaacaatgggatcatcggcagctatcataagtggctgaaggcttggacgcaagagttggattggctcctaaagctaaaggtttcaagcgaggaagaggctgaaacccctgaggagagtgaggaggtgaaagccttaaaggcgaaacttgaaagagcacaagcggtcaaggaaaagttcaagacgacgaccatcatggtccggaaagaatgcgacggattgagagacgtcaatgttgccactgtccgagagagaccagtcaagagtcgaaggcatgatattggaagacaagttgaaggcatgtcagaggttaaagaagaatttgtccgagcaattgagtag

SEQ ID NO: 65487 - DNA, 609 bp, Glycine max
  Peptide Sequence Number=SeqID_157172
atgaaaattttccatctcggctatctttgcttctcgacagcctggattatgccggatgacgaatttggcacccgcagcgcgcggctgctggcgcaaatgcgcgaccaggggtatgaaacctcgcttgacctggtctcccgcaagggcgacccgcgctatcagccgctggtgcaccctgccctgcgccatcttgattatctggtgattaacgaactggaagccggcgagtttagcggcctgacaatgcgtgatgaaaacgacgccccgcatattgcccatatcgccgaagccgccgcgcagctgctggcggcgggcgttcgccagcgggtggtcatccactgcccggaaggcgcatggggagaagcgccgggtgaaaaaggacgctggatcccctcctggatgctggaacagggagaaatcatcggcagcgtcggcgcgggcgatgccttctgcgcgggctttttatatggctgccatgaatcgctgccgctgacggagagtatttatctggcgcatgcctgcgcgcgggccagcctgctggccgcgaacgccattgacggtgcgaaaacgctggccgagctgcagctgtttatcaaagagcatcgttag

SEQ ID NO: 65488 - DNA, 357 bp, Glycine max
  Peptide Sequence Number=SeqID_157173
atgaaaaaagtcgtcacggtttgcccttattgtgcctcaggttgcaagatccacctggtggtcgataacggcaaaatcgtccgggcggaggccgcacaggggaaaaccaaccagggcacgctctgcctgaaaggttactacggctgggattttattaacgatacccaaatcctcaccccgcgcctgaaaacccccatgatccgacgcgagcgcggcggcaagctggaagccgtctcgtggaatgaggcgctggactacgttgccacccgcctgagcgccatcaaggccaagtatggtccggatgcgattcagaccaccggctcctcacgcggaacgggaatgaaactaactatgtga

SEQ ID NO: 65489 - DNA, 204 bp, Glycine max
  Peptide Sequence Number=SeqID_157174
atggtggggtacgcacattcaagctttgcggatttggtcttcgctggggaaaggatcgaagcgggtctgaaaagaggcaaatttgatcatcttgctttgatgaatgagaaaattggggcaaataaagaggatgagaaggagggagaaacccatgctgtgtgtggcgtccccaaaataatgactggtttaatagtaatgatttaa

SEQ ID NO: 65490 - DNA, 307 bp, Glycine max
  Peptide Sequence Number=SeqID_157175
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaacccccgttcagtccgaccgctgcgccttatccggtaactatcgtcttgagtccaacccggaagacatgcaaaagcacactgcagcagccactg

SEQ ID NO: 65491 - DNA, 378 bp, Glycine max
  Peptide Sequence Number=SeqID_157176
atggagatgaaggtcagacttctcaaatgctggctaagggaattttctaaattcattagaaaggtaagggttatttttcccatattggttagatattattgttccccgcatgagaactcacactcatacgtgcccaaagatgtcccaaaaggttacctagttgtctatgttggtgaggattgcaagagatttgtcatcaaagtaggtatactcaaccatccactcttccaagccttgttggaccatgcagagaatgtgtttggattcaccaattattctaaactccatatcccttgcaatgagaacattttccttctcattcttcagaatattgctggtgatcttgtccaggatcagaggctcttcaactgtttctag

SEQ ID NO: 65492 - DNA, 642 bp, Glycine max
  Peptide Sequence Number=SeqID_157177
atggttatgttttactggagcactgttaggattcccacattgagtaagctcaatgtgtcagaacttgaaattgaacctcggtatcctctatttggaggctggaaatcaacctttgtcattggttatgggctaccattgcaagactttctttttgagtctccagatggcagaagatacctcaattttacttttggttgccctcttgttgagacagtggttgacaagttgattgttgtgctgccagagggatccaaagatcccactgttgagattccttttgaagtgaagcaacatctagagatcaagtattcataccttgatgttgtcggcagaactgtggtggttctagaaaaaagaaatgcagttcctgagcataatactcctttccaggtatactacaggtttaaccccatattcatgcttgctgagccattgatgctggcagtgactgagcagatccaagggttccttattttggaaggtcatattgcattgtggcaattttgtgtggagttaagaggactaattgcagttatagatatacttgtttgtacaatttttcccaggcaatttgatcttgtgccattcatccaaactaactttgaaccattccttctatttaagaaacataggatatgttag

SEQ ID NO: 65493 - DNA, 1509 bp, Glycine max
  Peptide Sequence Number=SeqID_157178
atgtctgcaattacctggccaaccatatgcctttactgctttacattgatgctcttttttcaagcatcaacaccagccatgttcaatagcacactcacaaagaatgaagcatttttgtgtcctgctgatggatctattatgataacagcaagtcatcttcctttcaacaggaatggattcaaatttttcacaaatgctggtgggcttgggaaggctgacatcaaagatatcttagagcgagctgcggacatatacaatcgatttacagaagaaagtttgacaaattcagagagaaaagcttcactatctattaagaaagttgattacatgattgtttatacatctgatctagtaaaagcagttcgcaaagcagctggaaacataggcatgactttgttgaagtatttttataataagaaaccattggggggtttccatatagttgttgatgcaggcaatggagcaggaggcttttttgctgcaaaggttctggaacctctgggggcaataacttctggtagtcaatttttggagcctgatggtaattactatgcttggaggaatgatttcaactgggtatggcaaatggactttaattctttgagtaacaaatggcttttctattcaggcttgtttccaaatcatatcccaaatcctgaggacaagacagcaatgaaagctataacccaagcagtccttgataacaaagttgatcttggaattatttttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggcagacaccatcggttcaaaagaggctacaaaaatgtgattgatgaagctattcgtttgaattctattggtgaggagtcacatttggcaattgaaactagtggacatggagctctcaaggaaaatcattggcttgatgatggcgcatacctaatggtcaagatcttaaataaacttgcttctgcaagagcttctggaaagggtggtggaagtaaggttttgactgatctaatagacggacttcaggaaccagattttgctgtagaactgagattaaagataaaccaaaaccatccagatcttaaaggaggagctttcagatcttttcgggaatatggagaagctgtgctgaaacatttggagaactcaattggctctgatccaagtctgcacaaggctcctgtgaactatgaaggggtccgagtttctggctatggtggatggtttcttcttagattatcactccatgatcctgtacttccccttaacattgaggcacctagtaatgatgatgctgtgaagcttggacttgctgtgcttgcagctgtgaaggactttgcaggtttagacacatcagccttgaacaagtttgtaggagcatcataa

SEQ ID NO: 65494 - DNA, 531 bp, Glycine max
  Peptide Sequence Number=SeqID_157179
atgaattcgcctttgcgtttgttttcttccgagctcacatgtcctgcgagtgaatccatgcaatacacgaattcgtcattaagggtttcttgtttcattaagaaaggtggtggtgttcgagtaagtaatcgcaatggaaggaacgcgaaggcggtggtttgttgccaattgatgcatagccacaaggaggaggagtcgaatgaaagaaagagaaagctgcaggagcctgtgcttgtgcctgtgcagaaggcagattttgtgaggacattgttgattgacaactatgacagttacacatacaatgtataccaggaactctctattattaatggtgtccctcctgtggtgatccaaaatgatgattggacatgggaagaactttgccattacttatacgaagaaaatgcttttgataacattgtaatatcacctggacccggctctccagcatgcccggaagatataggtgaggatctcagaatgcccttgtggattgataatttcactacatttgcttcatgcttcaaatga

SEQ ID NO: 65495 - DNA, 1680 bp, Glycine max
  Peptide Sequence Number=SeqID_157180
atgagcgataaagaagcgaatcttcaggcgaagttggaggcaacttcaacatgggctgttgcagttgtgtgctttgtcatgcttgctatttcaatcctcattgaacatattcttgaagaacttggaaagtggttaaaaaagaaacaccaaaaggctcttcatgaagcgctggaaaaggttaaaggagagcttatgctgctgggattcatatcgttgctcctagtggtgtttcaagatcgcatttctactatatgcatcccaaaaagcattgcatccacttggcatccttgtgatcccgattataagagtaaaaagccagaaggatattatgataaatgcgcagaaaagggtaaagacctagttgcttttatgtctgaatatagtattcaccagctccatatattcgtctttgtgcttgctatttttcacatcctacagtgcatcatgacactgactttgggtagaactaagatgtctaaatggaggaagtgggaagacgaaacaaagagtgttgaacatcagttctaccatgatcctgagaggttcaggtttgctagggatacaacgtttggacgaaggcacttgagctcatggagtcgatcaccaatttccttatggatagttagcttcttcagacaattctataggtcacttaataaagttgactacatggcattgcgacatggattcatcgtggcacatttgactccagcaagtgaggcaaaatttgatttccagaactatatcaagagaacacttgatgaggattttgcagttgtggtgggcataactccaaccatatggttctttgcagtgcttattctgctcacaaatactcatgggtggcattcttatctttggattccatttatcccagtaattataatcttgttggtgggaacaaagctacaaatgatcataactgagatggcactaaggattcaagataggggggaagtcgtcaagggtgcacctgtggttgagccaggagatggattgttctggttcaatcgacctcgcttcatcctctttttgattcatcttgttctctttcaaaatgcatttcaactagcgttttttgcttggagcacatttgacaatggattcaaaataaactcttgttttcacagaactactgccgatattgtcattagacttacaatgggggttctcacacaagttctatgcagttatgtgactttgcctctttatgctctagtcacacagatgggttcaaccatgaaacctaccattttcaatgaaaatgtggcaacagcactaatgaactggcatcactctgctagaaatcacatcaaacacaacaagggttctacttctaacacaccattctcaagcaggccaggaaccccaacacatggcatgtctccagttcacttgcttcacaagcaccctagacacagtgacagtccaatagtttctccaatggcatacaattacgaaaatgaacaatggggtgttgaagggatacattccccaaaccaccatgcaagagatcatgatcatgatcatggagagaccatgcagatgcagcagcctacagctccaacagcagatttgcctcctagtggactaaatcctattcgaactcaacatgaaatcaacattgctttatctgaattttcatttgggaggggacaccacactggtagtaataactaa

SEQ ID NO: 65496 - DNA, 144 bp, Glycine max
  Peptide Sequence Number=SeqID_157181
atggaaaagaaagcagagaataatgagagaaccaatggaagtactacaaaaggatcaaagtccaaacatagaaacacaaatcccaacacaaagttgactgaagcagttggatacgcacatgggagcactaagattccattctag

SEQ ID NO: 65497 - DNA, 1596 bp, Glycine max
  Peptide Sequence Number=SeqID_157182
atgaggcctgatccaaaacgggcttcttccaattctaaaccctcttaccctcttcatcttgaggaaccattccccatcatttggcagcaagcatttcgtactagtggaacatttcatctccccacaaatctcaatctttgtgattacttcttcgggcctgatatcccaactggtatgggattctcccagcttccaaatctgtcatcaaggggctctcaaccactccaattactgaggaaagggaggaggttctttgaggagttggatagagatggggatggccaagtaactctggaagatctagaagttgcaatgagaaaaagaaagctgccacgaagatatgctaaagaatttatgagccgtgctagaagtcacttattttccaggtcttttggttggaagcagttcttatcattaatggaacagaaggagccaacaattcttcgtgcatatacttctctatgtctaagcaagtctgggacactgaagaagagtgaaatattggaatcactaaagaatgcaggactccctgcaaatgaagacaatgctgttgctatgatgcgatttctgaaagcagacacagaagaatctatttcatatggacatttccgcaatttcatgcttctgcttccctctgatcgtcttcaagaagatcccaggagtatctggtttgaagctgcgacagtagttgctgttccaccagctgttgaaattcctgctggaagtgtgctgagatctgcattggcaggtggcctttcttgtgccctgtcatgtgcattactgcatccagttgatacaattaagactcgagtacaagcatcaacaatgtccttccctgaaataatttctaagctgccagagattggaaggcggggtttatacaggggctctatccctgcaattcttggacagttttcaagccatggcttgcgaactgggatatttgaagcaagtaaattggtgttgataaatattgctcctacactgccagaactccaggttttcagattttgtgcattatataatttagtattagttaaagctgttagaaaagtggttgagaacatagctaaactctgtgctgtacggatcccctgcgaagtgttgaagcagaggttacaggcgggtctttttgacaacgtgggcgaggcttttgttgcgacttgggagcaggatggtcttaggggtttctttcgtggaaccggagctaccttgtgccgcgaggttccattttatgttgctggcatggggctttatgctgaatctaaaaaggttgccgaacgactactagagcgggaactcggtcccttggaaacaattgctgttggagctttatctggtggcttggcggctgttgttacaacgccgttcgatgtcatgaaaactagaatgatgactgcacagggccgatctgtgtcgatgactttgatagccttctctatactaaaacatgagggaccccttggcttgttcaaaggagcagtacccaggttcttttggattgctcctctaggtgctatgaactttgcaggctatgagttggcaaagaaggccatgaataaaaatgaggagggcaaggcaggccgttcagagtaa

SEQ ID NO: 65498 - DNA, 309 bp, Glycine max
  Peptide Sequence Number=SeqID_157183
atggttcatacaaagaggagaaaccactggcatcaaaagaagatgaatgacttagtttatgtgatgtacaacttgaagctgaaaagtgaaagtggtagtggaagcaatattgacttggttggaggaagtttaagtgatccaactttggatgcatttgatattgacaatttgattttgaaagacaatgttgaagatcacttctcaaccgaggaagagcttgaagatgacggtgatgatgatgatggtggtggtggtggtggtggtggtgatattggagatgatttaattagaggattgatggacatttga

SEQ ID NO: 65499 - DNA, 927 bp, Glycine max
  Peptide Sequence Number=SeqID_157184
atgcagaatccagatgcaaatcaacttcccgaagttgattcgttgccagatgggtttgttgagagtactacagagcctcttgctcctgcaactccatctcctgaacaagagaaacccctgaatagttacaaggatgatggtccctctgaccttattcattctaatgaacgatcaaatgatttgggagaaaaagagtttcaaaacaatcatgactgctcagcggagagtccctctagaagctctatgcagcagacagaaggggcacagattacacctcctgtagctaattctgttcccgagtctctgctgtccagttgctgtgaggaagaatgcaaacgtgtatcaactgaggggcaaaacttaaggctggacttgtcagccaagtttcaagatgcaatcaaggatgtcagcaataagcttgaggagcgaaaggatgagtgcctttctcagctaaaggagaatgacatgttaagaaacaagctaagacagctagttgaacaatatgaactctctgagcagcaacatgcacagaagttgaagcaaaaatcattggaactacagcttgctgatttaaaaattaagcaacatgaggaaaaattggttcaagaacggtcacagataaaagtatatgcagaacaagtatctcagttattagcaactgagaagagtttacggttgcaactgacaactgatggagaaaaattccaacaattccaggaagcattgtctaagagcaatgagatttttgaaacattcaaacaagagattgagaagatggcaaaatcaatcaaggaactcaagaaggagaatcaattcttgaagagtaaatctgagaagtctgatgttacactcatagagttagttgatgaggcagaaaggaagcaaaattcttcagagaacaagagcaataactcggttcaaacatga

SEQ ID NO: 65500 - DNA, 1728 bp, Glycine max
  Peptide Sequence Number=SeqID_157185
atggacggccatatgggaatgaggaaaatcagctctcactgctctatccctgatttggatgattctgatatcttacgtttgcttgaaaagccaaagttgaacattgagagacagagatcatttgatgagaggtcactcagtgagctctccattggtcttgcgagagcgggcttggataactatgacacttattctccaggaggaagatctggcttcaacacacctgcttcgtctacacggaactcgttcgagcctcaccccatggttgccgatgcctgggaatccctcagaaaatctctagtctattttagaggccaaccggttggcacaattgcagctgttgatcatcaatcagaggaagttctgaactatgatcaggtttttgttcgagattttgtgcccagtgctctagcctttttgatgaatggtgaaccagagatagtcaggaacttcttgttgaagacactgcatcttcagggttgggaaaaaagagtagatcggtttaagcttggtgaaggtgtgatgccagctagtttcaaagttcttcatgatcctattaggaaaacagatactcttattgcagattttggtgaaagtgcaattggaagagttgctccagttgattctggattctggtggataattttacttcgtgcctacacaaagtctacaggggatttatctttggctgaatcaccagattgtcaaaagggaatgaaacttatactgactctatgcttgtcagaggggtttgatacatttccaactttgctttgtgctgatggatgttgcatggttgatcgaagaatgggcatttatggttatccaatagagattcaagcacttttcttcatggcattgagatgtgctttgtcaatgctgaaacaggatgacgccgaaggaaaggaatgcgtagagcgtattgtgaagcgtttgcatgcactaagttatcatatgcggagttacttttggctcgacttccaacaactaaatgacatttatcgatataagaccgaggagtactcacatactgcagtaaataagtttaatgttattcctgattcaatcccagaatgggtgtttgactttatgccaatgcgcgggggctacttcattggaaatgttagtccggcccggatggattttcgatggtttgctttaggaaattgtgttgcaattctatcttctctggcaactccggagcaatcaatggctatcatggatcttattgaatctcgctgggatgaattagttggagaaatgcccctaaaaatatcttatcctgcaatagagagccatgagtggcgaattgttactggttgtgatcccaaaaataccagatggagttaccataatggaggatcttggccagtgctcctgtggctagtaacagctgcttgtatcaaaacggggagaccacagattgcaagacgtgcaattgaacttgccgagagtcgtttactgaaggatgggtggccagagtattatgatggtaaacttgggagatatattggcaaacaggcaagaaaataccaaacatggtctattgcaggttatctggtggcaaagatgatgctggaggacccctcacacttggggatgatttcccttgaagaagacaaacagatgaaaccgaaagtgagagatattgttgtttcaatacacggcactattcttggtgattcccttcctcgtaggcttgattggaagtttggcttgcttgtgtaa

SEQ ID NO: 65501 - DNA, 1371 bp, Glycine max
  Peptide Sequence Number=SeqID_157186
atgaataactctgtttcagaaaacagtttcatcattgagagtgatgaagaagatgaggagaaggatttgaataaaggtggagttgatggaaacgattctgattcttccaattactcaaatgaaaaccctccacagcgaaagcccagttcttacaacatttcatggcctcagagttacaggcaatctattgatctatatagtagtgtgccatcaccaaacattggatatttgggcacaccttctctgtcaagactaagcagttcttttctttctacatcattgacaaggaggcacactcctgaagcacttccttcagtggcaaagcctctgatacaagacacagaagatgagcagcatcagagacgtagctctcacaccttgcttcctcctcttccttctagaaggtcttctttgattaagaaggattccaaggttattcatcatgaagttccctctggccactgctcttttggacaagctgtgcttaatggcataaatgttctttgtggtgttggaatcctttctacaccttatgctgccaaagtaggtggatggcttgggctttctatattggtcatttttgcaattatttcattttatactgggctgcttttgcgttcctgcttggacagtgaacctgagcttgagacataccctgatattggccaagctgcttttggtactactggacgtattgccatttcagtaagtcatcatgctgatctctactcttatttgaagtgtccatgtcctatccgtttctcacatggcgacaatttgtcttccttatttccaagtgcacacttaaatttgggtggaattgaactgaattcacatacattgtttgctgtgattactaccttggctgttcttcctactgtttggctccgtgacctaagtattctaagttacatatctgctggtggagttgttgcatcaattttagtggttctctgcctattatgggttggcatagaggacgtaggctttcatagcaaagggaccacactcaatcttgcaactcttcctgttgctgttggtctttatggttactgctactctggacatgctgtgttcccaaacatttatacatccatggcaaatccaaaccaattccctggagtcctcttagcatgttttggaatttgtaccttgttgtatgctggagctgctgtattgggatacacaatgtttggagaagctattctgtctcagttcactcttaacatgcctaaagaattggtagcaaccaagattgctgtctggactacggcagcactttgcattacaattatcacagtaggtgttgtatgttctgcttttggatcatactccgcccttgccgagattgtgaagagtttgaggggatga

SEQ ID NO: 65502 - DNA, 2349 bp, Glycine max
  Peptide Sequence Number=SeqID_157187
atgtcacgtccagcgagtcacaatgcatttggtgatattatgggttcaactggcattgttgatcgtgaatcctttgagggcttgcgttcttcagcttctacccctggtttggttggacttcagaaccacagtctaaatctttctcatagttttgcacccgctgtaggtacttctccgtcaagggtgaaaacccctgaagcacaggttattgggagacctgttgcatctgcagcttcccaaatgggtaataaagttttctctgttgagaatatcggtatgggcttgggcacccagcatggccactcttccaatatgactgatcttactgatgtggtgtcttctttagctgggttaaatttgtcaggtgctagacatgcagagcaagatagtcttttgaaatctaagctgcaaatggaagttgacaatcatgctgatgttctattaagcacacaaagcaatgttaatttgcccagacgtaatgatattgcaacaaaccttaacacctttagttcaaatgagcatgtcaatctactgaaaaaaactgcttcttctgctaatcttcgctcaaaattgcattctactggaaatgcatcaagttttccaaatgcagacttcactggccatgttcctagtgcatatcttgtaaactcaaaattgaattctgtttacaataataatcttgagacagctttgaggcttcgcagagatggacaaagtttagatgcacaaggaaatcatgttggtcctgaacttcattcctcaactctgaacccacacttgatccaatgcttgcagcaaagttctgattactcgatgcaagggatgagtagttctggctatcctcttcaaatgagaaatttccctgatgcttcacatggagatttggagggacttaggaaagcatatcttgagacacttcttactcaacaaaagcaacagtatgagctcccacttctgagcaaatctgggcttactaatggcttctatgggagtcagccatatggtcttggcatgccatattctggaaagcagattgcaaattccacacttccttctcttggatctggaaatccactctttgagaatgaacgtatatcacgcttaaattctatgatgagaagttcagtgggaggttctggtggctcatggcatgctgatattggcaataatatagagggaagatttgcttcatccttactagatgagttcaagaacaagaaaaccaggccttttgaacttccagatatcattgatcatgtggttcaattcagtactgatcagtatggtagccgctttattcagcagaaattagaaacagcatcagtagaagagaagaccaagatatttcctgagatcattcctcatgctcgtgccttgatgactgatgtttttggaaattatgttatacaaaaattttttgagcatggtacagatagtcaaagaaaggaattagccagccaacttacaggtcatgttttacctcttagtctgcaaatgtatggttgcagagtgattcaaaaggccttggaggtggttgatgcggatcagcagggtcaactggtgtctgagctcaatggtgcaataatgaaatgtgtacgtgatcaaaatggaaaccatgttattcagaagtgtatagagtgtgtacctcaagataaaattcagtttattgtttcatccttttatgggcaagttgttttactttctactcatccttatgggtgcagagttatccagagggttctagagcattgtgatgatctaaatacacaacaaattatcatggatgaaatcatgcaatctgtcggcactttagcacaggatcaatatggaaattatgttattcagcatattgtggagcatggtaaaccacatgaacggactgctattatcagcaagcttgccgggcagattgttaagatgagccagcaaaagtttgcttcaaatgttatcgagaagtgtttggcttttggtagtcctgaagaacgtcagattttggtgaatgaaatgcttggtacttctgatgagaatgaacccttacaggctatgatgaaggacccttttggaaattatgttgtgcaaaaggttcttgagacttgtgatgatcgaagtcttgagctgatcctttctcgcatcaaggttcacttaaatgcactgaagcggtatacttatggcaaacatatagtttctcgtgtggagaagctcataaccactggaggtgagaaatgcaaagacttgggggtgtttgatttctatttcaaaaactgtttagttttcaaaatacaactaaacaaggctgttcagacagctggtggaaagtattgcaaggaacaaaacaaagtgttgaattga

SEQ ID NO: 65503 - DNA, 408 bp, Glycine max
  Peptide Sequence Number=SeqID_157188
atggatcttgtttcacagaccttgcaggtgaaaaccatagcaagatcatgccttgaggatgtcttcaaactggacttggcagaaaactttatagaagaggtctcattaacactaatagatgtagcaacttcatctgggtttggacttgactttaaggcggagttgcaaaggtggcagtggcacaaacgaagttgcaaaggtggctttgcgatgacgtggtggtggctagactgtggtagagggggtcgcaacggggaaggggaaggagggttcgaggtgaagtgcagggaaaggggagaaggattgggggtgcggcaaagaggaagggggaggagggttggtggcataggggaaggggaaaaggaaaagaggaagggaggaggctttgtcgatgatgcaaaggcatga

SEQ ID NO: 65504 - DNA, 195 bp, Glycine max
  Peptide Sequence Number=SeqID_157189
atgcttcaagacatttatagtagtcaagaggagactacttcttgcccttcctatagtggaactgaagctgatgtaaggggtgaagagtctagtgaggaagtctacccccatgaagaaggtgacctcttaatggttagaaggctccttggaggacctataggacactacataactccaaatggagcgtgtgagtag

SEQ ID NO: 65505 - DNA, 288 bp, Glycine max
  Peptide Sequence Number=SeqID_157190
atggtagcctggcctgggacccaaccttctcttcacaaggaagataaaggggaggaggcaggtgagacacaggtgagactggtagctgctgccactcctgagagatctcttaaggccacttcagagcctcctgcaccagtggtggacctaccctcacctcagcatacaacagatccctccactcctattctagagataccagaggacccgaccacaccagtcctggctatggacacttctcctccagctactctagtacttcatctaacagatgaggacgatgtttag

SEQ ID NO: 65506 - DNA, 240 bp, Glycine max
  Peptide Sequence Number=SeqID_157191
atgatgataacaaaagatgatgacaaaggtgatgacaaaaagctcaaagatcaatcaaagtcaactcaaataaatcaaagatcaattaagaacaattcaagagttcaagataagaatcaagaagaattcaagactcaagaagaaagtctagagacaagaatcaagattcaaggttcaagatctcaagaatcagatcaagattcaagaatgaagagaagactcaatcaagataagtattaa

SEQ ID NO: 65507 - DNA, 693 bp, Glycine max
  Peptide Sequence Number=SeqID_157192
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaacgtggccatatggacacttcttcgcccccgttttcaccatggcaaatattatacgcaggcgacaaggtgctgatgccgctggcgattcagtggtgcttttgcatgtctttccgggttggactcacgacgatagttaccggataaggcgcagcggtcggactgaacggggggttcgtgcatacagtccagcttggagcgaactgcctacccggaactga

SEQ ID NO: 65508 - DNA, 487 bp, Glycine max
  Peptide Sequence Number=SeqID_157193
atgaccgaccctctcgataagttgatctcttgctttctcatcagggtgaacccttgggtactagtacctatcacctccagagggcttcacgccatcaccttcagaggactacacgtcctcgccatcagagggctgcactccctcgccatcgtagggctacacgccctcacctaccaaggactgcatgtcctcaccttcagagggctacacgccctcaccttcagaggactatatgtcctcgccttcagtgggctagatgccctcgccttcagaggactacacgtcctcaccttcagtgggctagacaccctcgccttcagagggatacacgccctcaccttcagaggactacacgtcctcgcctttagcgggctagatgccctcgccttcagaggactacacgtcctcaccttcagtgggctagacaccctcgccttcagagggctacacgccctcacctttagaggactacacgtcctcgccttca

SEQ ID NO: 65509 - DNA, 177 bp, Glycine max
  Peptide Sequence Number=SeqID_157194
atgtctcaagaagttgatatggattatgaaaatgaacaagaatgtggtgtgaatgaaccacatgttgattgttcggatgcttttaatacttctcaagtctttggtacccgagatgatattctgcagtgggctccattggttgcccatgaaaacggatttgttgctgtaacaccctga

SEQ ID NO: 65510 - DNA, 213 bp, Glycine max
  Peptide Sequence Number=SeqID_157195
atgagtctcagcctgcagagtcaaggctttacttctttttcgtgccctaccccggaccagtttagggcagaggtcgcgtggcctggggattggcctcaggcccaggcagcagaggcaccagcaggggcaccagcagaggctcccgatgaggcccgcaaggacgaagagatgatagatttacttgatttcttaggagggagcggagccgcatga

SEQ ID NO: 65511 - DNA, 225 bp, Glycine max
  Peptide Sequence Number=SeqID_157196
atgaaggacttaggccttctccatcacttccttggtgtcgcaacctacccttcggcgggagggcgacgcgagactcgcgggatgcgtgttccacgaaaggaatacgcgcggagtcgccaccaacgtttatttgaggaaaacatcggaaaaaccggaaaagacgcgatctacgaacttttaagtgaaaggttcgggagttgtatttacgcacggggaaggtattag

SEQ ID NO: 65512 - DNA, 118 bp, Glycine max
  Peptide Sequence Number=SeqID_157197
atggcttctccacctgcctctcctcctcctcctccttctcctcctcctcctcctcattctactccttcagacgcatcggcttcgccatctgccgtgaagcggacacgcaaagcctcat

SEQ ID NO: 65513 - DNA, 304 bp, Glycine max
  Peptide Sequence Number=SeqID_157198
gaaagatattgagctggtagacgatgaagaaccacggattagtgctgattgttctagtgtaacctctaataaatctgagatttataacgaggaagcagggaatgcaacacagaagcataaaccaaagagagtggagagtgtcaatgttgatgcagaagcctttggtgatcactggaaaaataagacaggagattcaattgtgctgaagataagagattcggctaaagttgtgataaaacaagacatgaagggaggagagcataaatatgggtttaaaaacaataaacgtaagaagccagagaag

SEQ ID NO: 65514 - DNA, 264 bp, Glycine max
  Peptide Sequence Number=SeqID_157199
atggatgaccgatttatttggcgtcgatttcaaaacaccaaattcagcgaaatcatatttagcttttttacaacagttcgatgcaccatattcatttggagaacaaggcagagttgttcagctgcagcaaccgacaatgaatatactaacatagaacaacaacatcatcatgatgtgggagaacctgtcatacaggaaagaagaaatccacgacgtaatcagcgtccaccaccttgtgggacaggtcatcgtcttggtcattga

SEQ ID NO: 65515 - DNA, 138 bp, Glycine max
  Peptide Sequence Number=SeqID_157200
atgaacacaagtgaaaaatgtagacaaaggatcaagctgaatgttttgatgatgccaaaggatcacatgcttctcaaagctttattcaagacaaagaaattaaagatattcaagatggatgatcaagacagtctctag

SEQ ID NO: 65516 - DNA, 489 bp, Glycine max
  Peptide Sequence Number=SeqID_157201
gacttccagctagtgccaactgtgaaagagtttgaagaaatcctgggatgcccactgggaggaaggaagccatatcttttctctggggttctatccctccacgacaagagttgccaagggcaaaggccttggcaaaatcaaggcgaatgggcttcttttattgacatcttggcgcttttggtctttggaggtgtcctctttccaaatatggaagggttagtggacctagcagcgattgatgctttcctcgcctttcatcatggcaaggaaatcccggtcgtcgccattttggccatgcatgacacattcaatcagagatgctcgtctatccgctacaaggtcaccgctcgtgcgtcgaaaaaaagaaagacgaattgggaccaactcttggctagcatagagggccgtctgttaattggttccctcgctagaaggaaggaagaatcaggattctatcttcatgcgaaggatttccaaatgttcccttaa

SEQ ID NO: 65517 - DNA, 600 bp, Glycine max
  Peptide Sequence Number=SeqID_157202
atgggtgaaacagataaggtgcaagagtggataaaggccaacttggaggccatgaaagagcaaatggccataatgatggagggcatgatgagcatgaagaagataatgaaggtgaatgcggctatagttgccgctaccagtgccattgctgagagaggcaaagaattaggaagtacgcgcggcccccattttatgcaaggtcaaaacaagcattccttcccactgtatggtttggctcccaaccatacactgcccaatgttgcacacactcccaatgaggatgtcgacaactctgcacccatacccattgagagccaacaaccccaagctgatcatgcacatgtctttcaacccatgggggagacacatgaaattccccaccataatctaaccgacttcgagcctcacctcggatatgccattgaagagcaagcagttggtggaagaatccctcttgctatggtagagaagggaaagttggatcatatagaggaaaggcttggagccgttgaagggggtggaagttatgctttggctgacatggcgaaattgtgcttagtgcctttgcatcaccatcactccgaagttcaaggtgtctaa

SEQ ID NO: 65518 - DNA, 485 bp, Glycine max
  Peptide Sequence Number=SeqID_157203
tggacccttgggtactagtacctatcgcctttagaggactacacgtcctcaccatcagagggctacacgtccttgccttcagagggatgcacgccctcaccttcagagggctacaccccttcatcttcagaggactacacgtcctcactctcagagggcggcacgccccctccttcaaagggctacatgccctcgccttcaaagggctgcatgccctcacctttagaggactacacgtcctcgccttcagagggctacacgctctcgccttcagagggctacacgctctcgcctttagagggctacacaagctcaccttcaggccaccccctgatcccggaggagggccaactatgcgagcacaaccagaaagggaggctatcatgcaactactatgcgtaccggggcaagatttcacccgtgccgctgcaaagagacgagtgttgatcatgtgcaccaacatgaccactcttacacagatataa

SEQ ID NO: 65519 - DNA, 447 bp, Glycine max
  Peptide Sequence Number=SeqID_157204
gcttagcgagccatgctcgcttagccactgtgttgtttcagctaagcgagcgcgctaagcgagctagtctcgctaagcgcctaatggcctctaggaagagaaaagccacaacatctcggccccaagagccctatgacaccaccaggcggaactggcacaaggccttgacccagcatatggacggacacattgatgtggccctggtcaaggagttctacccgaaactgtatgatccagaagataaatctccaaaacaggggagcacctcacagcttattctagattttgccgaacgcgcactgatcctcaggagcttgcctccaagctttgtattccaggctcctgaggaaggacttgactaccttagctcaggcgtggagtgtgctttcatactccaacctcgccccccacctctcacacgtttgaccttactatggacagggcgag

SEQ ID NO: 65520 - DNA, 510 bp, Glycine max
  Peptide Sequence Number=SeqID_157205
atgaaggccgatatggaggccttgaaagatcaaatgacctccatgatggaggccattctaagcatgaagcaaatgatagaaagcaatgcgggtgcaattatcgccaccagcgctgcccctgtggcagatcctacctatacatctgccataaaccaagcgaatcaacccatcccggacatggtgggacaaggaggagaggtgttgggcagcaccggcggtccgcacacggggcataataggaatacttacccctatggcttaccccccaattataagctgcccaccatgcacatacccaacgagaacaataaccatgtcgttcctgttacctttgagggtcaacaaccccagcctgtaaggggcgcccatgaagaacctcgggagcatgctcaaggtgacttagacccatatcccacatttaccgatgagggaccagcctttaatgctatgtctcaacccaatgctgcgagagctcctcaaccccgccctctgcaaccgctacatttctta

SEQ ID NO: 65521 - DNA, 180 bp, Glycine max
  Peptide Sequence Number=SeqID_157206
atgaccacagattcacctccacttcctatgttcccatggacccgggtgaaaaagaggctaagttttaaattgcaaaatgtagcagttgggctaagcacatatccaccgctaagtgcagcttcagcgcgcttagcgcaaaggagaatttggcagagcatcagcatcaaagccgcacgctaa

SEQ ID NO: 65522 - DNA, 540 bp, Glycine max
  Peptide Sequence Number=SeqID_157207
atgagatgcttaaccgagacttgcgctcccggttacgggggccacggtttcctttcaacggttcttgggctaccccctgatattggagggcgaccaactgtgcgagcacatccagagagggaggctatcacgcatctactatgcataccggggcaagatttcccccgtgccgctgcaaaaagacgagtgcggaccatgcgcaccaacatgaccacccttatgtggatgacgttgctatttagcaacattctgtgccgtcatgacataggtaaggatcgcgcccacaaagacacccagtggacccggaaaagtccaacagggccctggggtttccagctctggttacgggcctctgtagtcctacagggtgcccgttccccccggcaaggtcacgtcatcatagggatcgcgcctgcaaaacacccagtggaccctaagaagtccaacaaggtcttggagttgtcaagctctaattacaggtctctgtcaattctaccgagtgcctgtcacctccagcaagggcatcaggccccttactaa

SEQ ID NO: 65523 - DNA, 102 bp, Glycine max
  Peptide Sequence Number=SeqID_157208
atgagtgagataggaaggtttggaggtttgggaatggaggaacgtcgcaaggagaaggggctgcgcaggagtttctggaaaatgccatctgttctagtgtaa

SEQ ID NO: 65524 - DNA, 618 bp, Glycine max
  Peptide Sequence Number=SeqID_157209
atggctccaaagaagctcccagccaagagatccaggaaagatgccactggagagggttccagtgcggccccacaggcagatatggactttgatagacacaggttctggagtgcagggcaccaacaacgagagaggcaagtccagctgagggacaaggaatatgttgagtttcaagaggagattgctcgaaggcaatggacccagctcgtatcacccatggctaagctcgatcctaacatagtcatggagttttatgctaacgcctggcctacagaagagggagtcagagacatgcgctcctgggtgaagggccagtggattccctttgatgagcatcccatcaatcagtttctggggcatccactggttttggaggaaggccagcactgtgagttctctcataggaggagtcaggccttcagcttcgatgaggaggctatcagtcagttgttatgcgttccagggcaggactttgcctggagcatagcgaggagacgggtgcggatcatgcgcactagcatgaccaccatcacgaagatctggatgatgttgctgcttaggaacattctccctagcgatcatacctttagagtcagaccagtttccactgttgaatga

SEQ ID NO: 65525 - DNA, 504 bp, Glycine max
  Peptide Sequence Number=SeqID_157210
atgttcgttacaaagtatcagggtgaatggaaaaaaacatctacacaggaatttatcaatcagggaaacaaaatatccaggggacttttaaagcttggaataaaacccggagataagattgcactcattaccaccaatacccgtacggaatgggcggtgatggatttgggactctcccagatcggtgttgtttcagtccctgtatatccaagcatatcccatgaagattacgaattcatctttaataatgccgaaatacaatattgctttgtttctgataaagaattgcttgctaaagtaatgaaggtgaaacataacattccttctttacaaggggttttcacatttgatatgatcagtggtgctccaaactggcgtgaaattttggatctgggtgaagatgattctacacaaattgaagtggaagatctttcgaatgccattaattctgaagacctggccaccattatttatacttcaggaactacaggaaggcctaaagga

SEQ ID NO: 65526 - DNA, 576 bp, Glycine max
  Peptide Sequence Number=SeqID_157211
atggatgaaatagaggaggtacaagagaggatgaaggccgacatggaggccatgaaagagcaaatggccacaatgatggaggccatgatgagcataaagaagatattggaggtcaatgcggctgcaattgtcgctaccagcatcattgctgaggtggacccaactcccccatctggcctcaaccaaataaatcatccaacctcggatatggtaggtcatgggggcaaagaattaggaagtacaggcggcccccattttgtgcaagttcagaacaagcatgccttcctgccatatggcttgcctcccaactatacaccactcaatgtggtgcacactcccaatgagaatgttaataactccactcctatactcattgagagccagcaacctcaatctgattatgcacatgtctctcaacccatgggggagacacatgaaataccccaccacaatctagtcgacttcgagcctcacttcggatatgccactgaggggcaagcagttggtggtgtaccctttccaaacactttggaggaccctcaattgtgcccacaaccacaactcttgcattttgcg

SEQ ID NO: 65527 - DNA, 236 bp, Glycine max
  Peptide Sequence Number=SeqID_157212
gcgatccacctcagcagaagagaagtctaataattgagatagaggaagaactcaagaatattacaaaagatgatgcacctcaacgggagagaagtcaaaaaatacagaaaaacaaagaactcaagaatattacgcaaggtgatccatctaaacaaaagagaagtcaaggaaataagaaaaagacaaaagacgacaatattactcaaggggtaactcaaagagaacaatggagataa

SEQ ID NO: 65528 - DNA, 201 bp, Glycine max
  Peptide Sequence Number=SeqID_157213
atgaagaacggtggaaaaccttcacaaaatcgcccacggaaacgtctcggaagcgttacggaagggaaaaaagggaggtggttgccgcctagctcgcccaggcgagctgggttgcttccaccagaaggcaccgccttttgttggaacaccctagaaggttcaagtgggcctgatttctatttgcacacccttgtttactaa

SEQ ID NO: 65529 - DNA, 267 bp, Glycine max
  Peptide Sequence Number=SeqID_157214
atgtgtctatcggggaaggagaatatgccgatgaaattttctcataaccgaaacactgggtccaacaaagataggagagaatcactcaaagtgtatcaatctcacacaggattgacattctcaccctgggtcaaggtttatgataagttgggattttgtctcaaggcttgtagaacggctggtcatgatatatgtcagggtttggccagcggttcggggataaaggggatgtcctacattatttccatgatacacatgcaacaatga

SEQ ID NO: 65530 - DNA, 546 bp, Glycine max
  Peptide Sequence Number=SeqID_157215
atgtctgttgaaacgattactcaagccattgggtgtgagcgatatggcacaaaattcatgaatagttggggagacgaactggaagaccatatttggcactctttgtggggacctaactgggctaagaccctaaggagatatggaacattgttcaacaaggctaaaatcttccaacagattgtcaacaaagctatcattcacaagcaaggctcaaaggattttttgtctaacacccacaagtttattctgtaccatctgatggaaggcactccctttgacttgccccagattctcttcaacttctttgtaagtaaagtgatgatggacaagtgcatcgagaaagacatataccatagtgttgtcctcactaagaaagccttcatccaagaaaaaaatttgaatatgaggctagtagatgatggctcattccaacaaactccccaggtggatgattccatactttttgaacttcatcaaaagtttggactcaacattaggcgagacaaccagttggatgcagtatgggaaaaatctgcaaaagaataa

SEQ ID NO: 65531 - DNA, 159 bp, Glycine max
  Peptide Sequence Number=SeqID_157216
atgtcgcgcttagcgccatcgtcgcgcttagcgccatcgtcgcgcttaacattctctcatcacgctaagcgcgctgtagctgcgcttagcggtagatgcgccctgagcccagaggttcggcttagcgcgattgctccttttagcactttaagactttag

SEQ ID NO: 65532 - DNA, 186 bp, Glycine max
  Peptide Sequence Number=SeqID_157217
atgcaattaataaggcaacatatatgcacttttgatagggactctgtcgaggttttttcttgcttgtggagcttctatggaggctggatctttgagcttcaatggggtcctttaatggtgattttccaccatggagatgcagcggaagacaaaggaaaagaggtgagaggaggcgccatccattaa

SEQ ID NO: 65533 - DNA, 252 bp, Glycine max
  Peptide Sequence Number=SeqID_157218
atgacaaaccttggtatttcaatatcaagagatatatcaaagacagggagtacccacacggggcctctgaaaatgacaagaggacactacggagaaaccatgatatggtgttacttcaatgtgtggatccaagccaagttgagcagatgctacgagagatgcatgaaagctcatttggcactcatgccaatgggcatgccatggcctggacatcgtcaagcgatactatccatgatgtttggggcaatttga

SEQ ID NO: 65534 - DNA, 201 bp, Glycine max
  Peptide Sequence Number=SeqID_157219
atgagtgatgagcaatccaatgacatagatcaagggaatgaacaagtcttacaagagataaatcataatgatttgatcaaactagaagctgatgatagtgatgatatcattgaagttacaatacctatggagaacattttaccacatgacaaggctgataattatatagatgatgatgagagcgatgcagacttcttttga

SEQ ID NO: 65535 - DNA, 675 bp, Glycine max
  Peptide Sequence Number=SeqID_157220
atgtacgactaccatgagaaagaaagaacccctgatcttgaaagtatattgtcagacttcatgacataccaagctagctctaagggttactgttattctatgcaacagcagggaactcaatttgaaatggactattcttctgcagattatcaaagggagtcacaatggcaaactaattatcacaatgaagcagaaggatttcttaatctgaatgatctgttaatgcaatttagggatacagtagagtcaatgcaacaagcctttagaaggattgaaactcagattagtaagttggtagataacatgactaatgcggtggccataaaagaggaagagcatgcagagattgaaatacatcaagaaagcattcttcaagttacctcaatccatcatcaattgaccaatgaagaagaaaagcatgaagtctccaacaccccggaataccactgcttggccactgttggttatgttggagggaaagataaaggtgatgcttgtttcgaggaagaagaggtggagcaggaaatagcattattagcttcaaccatggtactacagtctcctttggaaagagaacctggttatgggatagattgtttagtttatgatgaagagcttgatgatccaaaagacaattgtgttgatcatgtggttttgaagaatggaaaaaattag

SEQ ID NO: 65536 - DNA, 336 bp, Glycine max
  Peptide Sequence Number=SeqID_157221
atgggacagtgtgccccagtggttggttcaagagttatattgtttggtggagaagatatgagcaggaagctattcaatgatgtccatattctcgatcttgaaagtatgacttgggaaatgataaagactgctctcattctatcttcttcaatgatcttcatttattatacatgcaaatatcttaagttaaaaacagtcacaacctaccctttggggggagggcgacgcgagactcacaggtgcgtcttccaaggaaggaaggcgcacggagtcgccaccaacgtttattcgaggaaaatgtcagaaaaaccagaacgtgtggtctacgaactttaa

SEQ ID NO: 65537 - DNA, 291 bp, Glycine max
  Peptide Sequence Number=SeqID_157222
atgagaaatggattacaaattcagaaaagtgagattgcaccttgttgtagagttaagtgtctgctcaatatgttatggttgcttatgcaagaacattacatcatgcaggaacattacatcaatcatatagtgaaggaaggagctttgaggtgtcataccctaatttcgtccggggatcatccgttgttgggatgcgaccctcatttgaccacttcgaggtatttggcacccatcgttagacaatttgtgaagttccgagacatgccggaagccaaaagaaaagcgtcatag

SEQ ID NO: 65538 - DNA, 588 bp, Glycine max
  Peptide Sequence Number=SeqID_157223
atggatccgcctcctcccaagaagttgaataagtcagccatgtcttcatcttcttgggctttgtcctcgactccgggggcccctgcgagtcctgcccctgctcaatggcctagccgaagcggcctgccgaggtggcggcggtgcgtctgctgcctgcggctggggttctctgtcctgtacttgtcggggagtacaatacttctcaacgaaggccctagtgataggaggtcagatgaccttgctgggtataacgggcactccgtagaactggcagaggcccgtgatcaaagccggaaaccccaaggccctgttggacttctccgggtccaaggggggaaggttagagttgtggtcgctagggaggatgttgttgagcagcagcgtcatccacatctgggtcagggtggtcatgctggtgcgcatgatccgcacccgcctccatgtggcagtccgggcaaaatcatgccctggatcaacgagtggtccaacaactggttgagggtgtctgcgtcaaacggaacccattggccccatacccacgagcgcatgtcacagataccttcttcggtgggccaggcattggcctag

SEQ ID NO: 65539 - DNA, 624 bp, Glycine max
  Peptide Sequence Number=SeqID_157224
atgattggccctctcgatgagtcaatctcttgctttctcataagggtggacccttgggtactagtacctattgcctttagagggctacacgccctcgccttcagaggactgcacgtcctcgactttagagggctacacgtccttgccttcagaggactacaggtcctcaccttccgagggctacgcgccctcgccttcggaggactacacgtcctcaccttcagaggactgcacgtcctcaccttcagagggctacacgtcctcactttcaaagggctacacgtcctcaccttcagagggctacatgacctcgccttcggaggactacatgtcctcgacttgagagggctacatgtcctcgccttcagaggactacacgtcctcgacttcaaagggctacactcccacgcctttagagggctacacggctacatgccctcgcctttagagggatgcacgtcctcgccttcaaaaggctacacgccttcaccttcagagggctacagttcttcgccttcgcacgattacatgccctcgccttcagagggctacacgccctcgcctttagagggctccacactcgcgcctttagagaacttaagttcctctgcccttaatgcttaa

SEQ ID NO: 65540 - DNA, 2268 bp, Glycine max
  Peptide Sequence Number=SeqID_157225
atgagttttctattatggaaaaatgaaagaactcaagctttgttgacaagtgctgcatatgttcatttaaaaagtcttcacttttccaagcacaccaggaacctcccaccagcaagcagggctattttgctatctggtccagcagaaccttaccagcaaatgcttgccaaagctttagcacattactttgaatcaaagttgctgttattagatattactgacttttctgtgaagttgcagaataaatttggatgttctagaaaagaaccatctttcaaaaggtcaatatccgaggtaactctggagagaatgtctggtttgtttggttccttttcaatgatttcttcaacaggagaaacaagaggaattctgcgtcaacaaagcagtgcatttgtaagttccaatcctccaaagcttaggaggaatgcctctgcttcatctgatataagtagcacttcttcccaatgtggtccaacatttccagctcctttaaagcgcacaagtagcttgtgttttgatgaaaagctctttgtgcagtcactttacaagcttttggtttttatcacagaaactagttccatcattttatacatcagggatgttgagaagctcgttctccaatcaccaaggttatataatttactacaaaaaatgataaagaaactatcaggttcagtgttgatccttggttcccagatattagattcagaagatgattgcaaagaagttgatgaaaggttctctgcactattcccctacaacattgagatcaaagctcctgaagatgaaactcatcttggcagttggaaaggccaactggaaaaggacatgaaagatattcagttccaagataatagaaaccacattgctgaagtacttgcagcaaatgacattgattgtgatgacttgaactcaatctgccatggagacactatcttactcagtaattatattgaagaaattgtagtatctgcattatcttaccatttgatgaataccaaggatccggaataccgaaatggaaagctagttatatcagccaatagtttgtcccatggattgagtctgttccaggaaggcaagagtagtgggaatctgaagactaatgaatctaacaaggaaaatgctggagaagatattactggtgcaaagaatgaagtgaagtgtgacaaccaagcacctgaaaacaagagtgagacagagaaatccataccagtaacgaagaaagatggcgaaaatcctacacctgcaaaagctgaagttcctgacaacgagtttgagaagcgcataagaccagaggttatccctgcaaatgagataggggttacatttgcagatattggtgcgttggatgagattaaagaatcacttcaagagctggtaatgcttccccttagaaggccagacctcttcaaaggtgggcttctgaagccatgtagaggtatattgctttttgggcctcctggtactggaaaaacaatgctagcaaaggcaattgcaaatgaagctggtgcaagtttcatcaatgtctcaatgtcaaccatcacatcaaaatggtttggagaggatgaaaagaacgtccgagctctgttcacactggcagctaaggttgccccaacaattatctttgttgacgaggttgacagtatgcttggacagaggactagagtaggagagcatgaggccatgaggaagattaaaaatgaattcatgacacactgggatgggctattaactggacctaatgagcaaattttggttctcgcagcaaccaacaggccatttgaccttgatgaagctatcataagacggtttgagcgcaggatcttggttggtcttccatctgttgagaacagggaaatgatcttgaagactcttttggctaaagagaaacatgaaaacttagacttcaaagagctggcaaccatgacagaaggatatactggaagcgatcttaagaatttgtgcatcactgcggcttatcgacctgttagagaactaatacagcaggagagactgaaggacatggaaaagaagaaaagagaagcagaaggccaaagctctgaagatgcttcaaacaataaagataaggaagaacaagaaattaccctgaggcctttaaacatggaagacatgagacaggccaagagtcaggtggctgcaagttttgcgtcagaaggatccgtaatgaatgagttgaagcagtggaatgatttgtatggagaaggaggttcaaggaagaaacaacaactcacttacttcctatag

SEQ ID NO: 65541 - DNA, 118 bp, Glycine max
  Peptide Sequence Number=SeqID_157226
atgggtggagtgacaaaagctttagttcactgctttgaagtagtgcacgatatgcttccaaaggaaaacatgttgcctaaaagttactatcaggccaagaagatactgtgtccgattg

SEQ ID NO: 65542 - DNA, 67 bp, Glycine max
  Peptide Sequence Number=SeqID_157227
atggaaggtttgtactttgtgttgaaactctttgctttgtggctctttttgaaaggaatgtatgctc

SEQ ID NO: 65543 - DNA, 1794 bp, Glycine max
  Peptide Sequence Number=SeqID_157228
atggaaaacaacataaacattgaaatttcagaacaaggctctccagaagttccatcactcataaggtatatatcatcaagtgaagttgctggctttgacactgctgattctcaacttcccagcgcatctgcccaaggaagtgaagcaaactcaccaacaagacaacatgatgaacctatagtcatcaatcatcaaaggaagtattctatcagcatgccactttcttctgaagaagttcagcttcaaccaatggacaccaaaaaagatggtattcccatttcctcttctcaatcaggaactgctagctctaaccatccgcaggcatcaaaatgttactctcaaccaatgccaaaatgccatgtgccccaagaggctgataatggagtcaaaataaataaccatccgggcatcaaagatttcaaggataagaggtttgactcttttaaaacatggtctgggagacttgagagacaattaacaattctacgtggaaagtcaccaagagcaactgcacaagatggtaacaacaactccaagagcactgataggcctttacctgtggatcggtactttgatgcattggaaggtccagagttagaaactctcaaggcatcagaagagacagtgcttccacaggacaagcaatggccatttcttctacggtttcctatttcatcctttggtatttgccttggagttagcagccaagcaattctttggaaagcactggcaacatctccttccactcaatttcttcacataagcctcaaagtcaacttaatcttatggttcatatccattgctcttgttatcacagttttcaccatctatcttctcaaaatcattctctactttgaagcagttcatcgggagtactaccatccgatccgtgtcaacttcttctttgcaccatggatagctctcttgttcttggctattggagttccaccatcagttaccaaagacctgcaccatgctccttggtacattctaatgacaccaatattgtgtcttgaacttaagatctatggacagtggatgtctgggggtcaaaggaggctctcaaaggtggctaatcctaccaaccatttatcaattgttggaaactttgtgggggcattacttggggcctctatgggcctcaaagaagggcccattttcttctttgctattgggctggcccactacatagtcatgtttgtgaccctctaccagagacttccaacaaatgagacactcccaaaagaactccatcctgtgttctttctgtttgttgcagcaccaagtgttgcttccatggcttgggccaacattcagggttccttcgattatggatctcggattgcctatttcattgccctctttctttatttctcattggctgtccggatcaattttttcagaggattcatattctctcttgcatggtgggcctatacttttccaatgactggtgcagcaattgcaaccgtaagatactcaaatcaggtcacaaatccagttaccaagaccctgtgtgtcatactgagtctcatatccacactcatagtaatagcactgcttgtatcaactatattgcatgcctttgtcttcaaaaacctattccccaatgaccttgccattgccataagttacagaaagagaaggccacaaaagaagtggctaggtcttagatacaggagccatgactccaaagagatcgaaaattacctgaagtgtgtgaactcggataaaattgatttagaagcttctaccccactaccagatggcacagaggattcaccatctatctga

SEQ ID NO: 65544 - DNA, 249 bp, Glycine max
  Peptide Sequence Number=SeqID_157229
atgaggaatgatggatgggaagaacttatatctaaggttatggaaatttgcaataagcataatattgatgtgtctgatttggatgcactgtatgtgcaagggaagaaatctagacgacatgctaccacttctagtgtttctgatttgcatcattataagcatgattatttatttagtgttttagatttgcagttgcatgagctcaatgatagatgtgccggaagtggtggtgcgacatcagcttcataa

SEQ ID NO: 65545 - DNA, 1962 bp, Glycine max
  Peptide Sequence Number=SeqID_157230
atgctgtgttttgaaggtatcatacgagctcatcctctggtgttcctcgttgacggaggaagcacccataacttcgttcagcagccactggtctctcaattgggactaccatgccgttccacaccgccactgcgagttatggtgggcaacggtcatcacctgaaatgcactacaatctgtgaagctattcctatttcaattcagaacattgaattcttggtgcatctttatgttctacctattgtcggagccaacatcgtggccttccaccagctcgagaaaccgatcatcacatacacttactaccctaatcagaacccggccctcaatgctgtcatggtccaagaccagttcccaattcccacaatagatgagctcttagatgagctcggaggtgggaattacaaaacaggggaagcttctgcaaatcctttcccagatcgccttgcttggaattgtgatcctgctgagcaattcttatcaataaaacgcatgccactttgttctgaagaagctcagcttcaaccactggacacaattacagatggtattcccatttcctcttctcaatctggaactgctagctctagccatccacagccatcaaaatgttactctcaaccaatgctagaaagccatgaccataagcaccaagaggcagagaatggagatgaaacaaacaatcatcctgaaatcaaagcattcaaggacaagaggtttgactctttcaaaacatggtctgggagtttaaacagaaaactattaattctacgaagaaagcgacaaagagaaactccacaagatggtaacaacatctccaggagcactgataggcctttacctattcatcggtattacgatgcattggaaggtccagagttagaaactctcagggtggatggacagaaatatagaaatggcaataacggaagctacagggctccaaatgaggtgattccaaaacgaggtgaaagggtgaagatgaaaggaaggaaagaatcactctttccagtgagggcaacacacaaaggttgtaaaagtcctttgacacagccaggcccttgtcataggtcctccaagtccttcaagtggatccttgcccttgctcttggtcatgtcctcatcaatggttgtgcttcagaagagacggtgcttccacaggacaggcaatggccatttattcttcggttccctatttcatcttttggtatttgccttggagttggcagccaaacaattctatggaaagcaattgccacatctccttccactaagtttcttaacataagcctcaaaatcaacttaatattctggttcatatccattgctcttattatcgcagttttcaccacctatcttctgaaaatcatcctctactttgaagcaactcttcgtgagtactaccatccaatccgtgttaactacttctttgcaccatggatagctctcttgttcttggcccaaggggttccaccatcagtgatcaaagacttgcccaatgctctttggtacattctaatgacaccaatattgtgtcttgaacttaagatctatggacagtggatgtctgggggctcaaggaggctctcaaaggtggccaatcctacaaactatttatcagttgttggaaattttgtgagggcattacttggggcttctatgggcctcaaagaagggcccattttcttctttgctattgggctggcccactacgtagtcgtgttcataactctctaccagagacttccaacaaatgagaccctcccaaaagacctccatcctgtgttctttatgtttgttgcaccacctattgttgcttccatggcatgggcaaccattcagggttcttttgattatgggtcacggattgcctatttcattggcctcttcctttatttgtcgttgttagaaataatcagcgccggatctagatccgaggtaagtgggaggctatttgtttag

SEQ ID NO: 65546 - DNA, 348 bp, Glycine max
  Peptide Sequence Number=SeqID_157231
atggctagtgcagcatctgcaacagtaagatacgcaaatgaggtgacaaatacagttacaaagacgctgtgtgttatactgagtctcgtctccacactcatagtagcagtaatgcttgtatcaactatattgcatgccttcgtcttcaaagacctcttccccaatgaccatgccattgccataagtcatagaaagagaaggccagaaaagaagtggctaggtcttggaaacagaagccatgactccgtagagattgaaaattacttgaagtttgtgaactcatcggataaaattgatttagaagcttctactacctcactaccaaatggcacagaggattcaccataa

SEQ ID NO: 65547 - DNA, 471 bp, Glycine max
  Peptide Sequence Number=SeqID_157232
atggaggaatctgtaggtgaaagctgggaggactgttttgacaaactgtggagtgtaaagctcacagaaacttcatgcccgttttgcagaaacagcgaggaggattcagcccacttatttcttcactgtgatagaatccagcctatttggtggaaaactatctcatggctgaatttaaaaggtgctgtccccttcaccccaaaacagcatttcctccaacacatagatgttcaggctgatggtgttaggatgcagagatggcaatgctggtggttggctctaacttggtccacatggaagcttaggaacaacatagtgttctctaatgcaacctttaatgctaacaaactgtttgaagatgcaatattcactctatggacgtggctcaggcactttgagaaagattttactatccattttaatcaatggtcaagtagcattagacacagcttttgcatcagtagaggatag

SEQ ID NO: 65548 - DNA, 345 bp, Glycine max
  Peptide Sequence Number=SeqID_157233
atggaatatgctagaaatatggctaaagaaggacctttgggtgtgcttcgtccagacacagatttaacatctttacttataccagagcccccaaagctaatcagccgaaagtattatactgttaaaggatcaagggcagtccttagctcccgtgcttataatggtcctgaagttaggagtggggatttgccacaaccaattacattaatgcctggtcaggaattcacttttactattcagagaggtgttggaactgctgattgtgttagtgtgaactacgatgattttgtcaatgatgtggaagtgggggacatgcttcttgtcgatggtatggttatcaactga

SEQ ID NO: 65549 - DNA, 585 bp, Glycine max
  Peptide Sequence Number=SeqID_157234
atggctaccaatagaagatggaaaatatggtggttggcagctacaaagtcaatttggaagcttagaaatgacatggtttttcataatcaaacctttgttatctctaagctggtggataatgcaattttcctcacttggtcttggctgaaagggatttcaatgtaccttttcaacaatggagatgcttcactcctgcttctactatgtagtacccctgagcacagaagcaagcaaaaaagaaaggtacctaatgtagagatcggtgacatcaagggagagctgcgcgtgccaatcgggtttgtgaacgacccagagggctctgtcctccttgctctggcagaagccgaggctccggagccaggcctcaatgcaggggaggctgtgggaatagagcggcttcgacttctccgggagcttctgcagccactcgtcttcctccggcggcggcgcggcctcatccgcctccgtgccctcgggggacttgcagagaagcgggggaaggaatggtggtggggtttgaattcgcagatgaggaaaagggaggggtttggggaaaagggtgtggaaaagtgggagtttttgtga

SEQ ID NO: 65550 - DNA, 1206 bp, Glycine max
  Peptide Sequence Number=SeqID_157235
atggttcaatgggttgatgctgattgcaagcaactcctggtggtagtgagactaattaggaggtttcaaaatagaaatgactggaatgctagatcgtttagaggtttccgtcagaggcagtttaactaccatgaccaagttcctcataagattggtggaggcaaaacagctgtgacatatgatataatggcaccatcacctgtggtggggtctagtttcaagcttgtatatcagcaaatcttagactcacaggctcaattattggaaggcaaagaatatcataagattcaaaatcctactgtagaaacaaatgatcatccacatgcccctgcagattctaatatttacacccaaccagaagatgtgagttctgattctgcagcaagagaactaagaccaccaaaagtgggatactgtaaaatttgtgaggttcatctaccctattgcaaaacattggaaatgcataaccaagaaaatagtcatcaaagaatattgaaactatatgaggaaatacagagactaaaaacttcaaatgggcagaggccgaattctcaaaagaatttggtagttctacctaagacagttcatatatctgggaaaaatggtcacccacaaaaaaatatgagttcagaagctagtattttgaagcacaagaattacctgaagaaaggtatggggctgacttgtgaaattccagctaaaggacctgaagtgaaacctagggataatagtggggcacagggtcatggtttcaagcagaatattaggggtcccaaaataggtaaatcaagtttcaagcgacagtctcaacgcattttagcttcacagacacctgtatcagaacacaaagagcatgctatacatattggaacagaatcccaattatcaaaagacacagcagattgtgagaaccaaagttgtactgatgagaaaaacaatcagctgctgccatcaattgtagtggagttcaattccccttcaggttccagtactaacacccaaactacagatgaatgttctaaagctgaacaaaggatagagattctcacccatcagtcagggacaactcagctgtctcaggtagctgtttgtcttcagtgtggcaatgcaggatttccagagacacttgtgttttgcaacaagtgtcagcaatatttcatcattcagatgctgcctcttctaatgtgccagagggatattctttaa

SEQ ID NO: 65551 - DNA, 783 bp, Glycine max
  Peptide Sequence Number=SeqID_157236
ggtgaagttgccgagacattgcagtatatggtgtcaccacaagggcgaaacacatggacagttgatgatctcgtgccatatgtggaaaagttagcgattatatcccaagagcaagagaggatcattgagcctgtgacacatggtccggcatcagaggagattgtccaagcagaatatttttcccaacaaatggaccagcgtggccatggaatgtattacacgccaccaacattttctcagtatccttcacagatgtatcagtatcctttcgagggtcatgacactgatatgtctgcaagcgaacattcgtttggtggtgttgcggaaacacatcctcatttttcatggccgaccatgaccccttcgcagcaacatgatgacccaatggcaacacctaatgccccattaggtccgcaatgggatgtacccggagcaatacctgatatgggtgacttattaggtgttgatttacatcacgagttttctgcagaggctgagcaacaagggcggagacagcgcaagaagaaatccggatcgtcaagcccgaagtgtggtgtcaggtcaccttatgtggtggctcgtggtccacaggtgtatcccttgaatcttcccaataattggtatcagagtcaatgggtcgaccaggttccggctcagacgagtatacaagtaccgcaggtggccagaatggctagcggcacagcgtgccccgtaggtggagcggggtggccagaatggctagtaggcagggcaagtaccgcagatggccatggctatacttga

SEQ ID NO: 65552 - DNA, 618 bp, Glycine max
  Peptide Sequence Number=SeqID_157237
atgacccaatccaactcctttcggcttggctttcctgcacttattactgccttgtgcatagccagaggagtggtcccagattctctcacatttgagtccctaagccctgccattaatttggcattcatgaggaaaaactgttggaacccggatgatcccccgatcacctttccagggacccgcaaagctagggctcggggaccattagatgcttctgccccttattcctcagcttattcttcttccgctcctccaacaccagcttcaccaactccaccttccactcctgcacctccacatgaaggatttcatggcccaggtggcctggccaggaatccagcctttcctttgggggaaggtaaggctcctacaacccaggagcagcagccagaggtcgaggccactccggagggcacaccaaaggtctcacctgctgccacaccacttgtggagatcgtagaggatgaggatggtgccgaggacacagattatgcagttgacatggcagtggcacaaagcacttgggatccatggcccactacaacacaggatacacctcagccagcccaggatgctccttcctcaccttatgatgagcctacactggtgcaggattga

SEQ ID NO: 65553 - DNA, 495 bp, Glycine max
  Peptide Sequence Number=SeqID_157238
atggttaacgttaatcctaccactaggagaggatcaggcccccagaaagaaaagttccatagttatttgggggttgtagcgcgtgaaaaaattcttattatccactccaattggaatgatgtacaagaatctttaaagaacctagtttgggatgacattttgggaaaatttgacatccctgaaggtaacaagggtaaaaagaaggtgatgtcaacaatcgctactagatggatgcaatttaagtcatccctaacgacaaaatatgtttatgctaacaatgacgatcatcaaaaagatgatccttctgttaagtatggtattgatgcaacaacatgggcagaatttgcaaaaacctgcgaaacccttacctggcaggggatacggaaaaaggcttgggaaattcaaaaatacaatgactgcccacacttattgtctcgtgggggactctttagaagaatagacgacctggggaagctttgttccgcatggtcgtga

SEQ ID NO: 65554 - DNA, 576 bp, Glycine max
  Peptide Sequence Number=SeqID_157239
atgtctcaccttctatctgttgctactacttcttctcgtttccaactcttgaccctcaacaacacattcacaacccaacctccctttctcggattcaagaagagaggggccaatatctcctgttctatgaatatgtcagcacaacaatcagatgatcatgggaaaatgaagctggaccaattaatagacaaagtgcaaaagctttgggacagttctcctgaaccgatgaagaaattcccgcataacaaggcttcagacaacttcattcaacttattcttgatcttattttggttgttgtcaaatacctagttgtacctgtatttgcagttactgatgcaagctccattggagcttgtaggcctaggatcttcttcatcaatggattcctttgcttcttggaagatcaatggcagcggaatggagaaagggaaagagagaggagacgccacttcaaggagaagatgagtctagaagaagctcaccaccataggaggccatggataagagcttggaggaagaaggagatgaatgaagggaaagggagagaagagcacgaaattttgtgctctaaatga

SEQ ID NO: 65555 - DNA, 415 bp, Glycine max
  Peptide Sequence Number=SeqID_157240
ggcttcccggtatcaacagggacaccaggatttatttattctgcgaagtgatcttccgtcacagtggcttctgtttctatcagctgtcccctcctgttcagctactgacgggggtggtgcgtaacggcaaaaagcaccgccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctctatccctatctc

SEQ ID NO: 65556 - DNA, 211 bp, Glycine max
  Peptide Sequence Number=SeqID_157241
atggggtggcagtggatgggtggggatggggttggagtgtggggacgctggctgaatggaaagggtggcgagatgttcaagcatggagtccattttctggttcatggaagactgtgtttgggccagggaagcgtgttcgtgggtgagggtggcctgagcttgcgtaagcttggcgacggcatcctccaagcgttcgagggtggtctggcgg

SEQ ID NO: 65557 - DNA, 348 bp, Glycine max
  Peptide Sequence Number=SeqID_157242
gccgcaggcgcaccaccgccacctcattgggctggcccggctgggtcatttgacatggagcagtatttacggcatttggttcgccagcaggcggccaaccactgggcacatgtacagacccatgattgtctgtaccagctgagcctcagcatgcagagccagggcttcacttctttttcatgccctactccagaccagttcagggcaaaggtcacatggcccggggattggcccgaggcccaagcaggagaggcacccccagaggttcctgacgatggagaggaggcccacgaggacgaggagatggccaatttgcttgacttcttgggagggagtggagctacatga

SEQ ID NO: 65558 - DNA, 441 bp, Glycine max
  Peptide Sequence Number=SeqID_157243
atggtagaattctccgtggaagcaattgcatcccttactcagtattatgaccagcccctaaggtgcttcacttttggggacttccagctagtaccaactgtggaagagtttgaagaaatcctggtatgtctactgggaggaagaaagccacatctcttttcggtgttctatccctccatggcaagagtagccaaggtaattaagatttcggtacaagagttggactatgtgaagcaaaataggaacggagcagtcgaaataacaaggaagcatttggaggaaaaggcgaaggcattggcaaatcaaggtgaatgggcttcgtttattgatgtcttggcactgttgatatttggagtcatcctctttccaaatgtggaggggttagtggacctagcagtgattgatgctttccttgcttatcaccatagcaaggaaagcctg

SEQ ID NO: 65559 - DNA, 99 bp, Glycine max
  Peptide Sequence Number=SeqID_157244
atggctggactttgtggagtgtccaaagagtgtccaaaggttcaagatgaaaaaatacaggaccttgagatggacttgatggagttggctatggtttaa

SEQ ID NO: 65560 - DNA, 561 bp, Glycine max
  Peptide Sequence Number=SeqID_157245
atggcctctaagaaacataagagtagtgattctaggccacaggatcaaaatgataacaggagatttcaatcagaggaagcttggaacgtgaaactttatcattctgagttcgacgagtttaaagtagaattggagaggcgaaaccttcacaaacgcctcgccaaccttcaggaaggaagcatagatgtggcagtggttaaagaattctatgccaatttctatagtccagcagatcaagctcctaaatgtgctagaataagaggccatttaatcaggatagttgtagacagcttaaatgagttcctccagactccagctagtctgtgcattccaggcaagggctttattctaaacacggagggccaaccatggaaactcctcaaaaaagatcttaccaccctggctcagacatggagcttcttttcgtgctcaaacctagctcctacctcccgcactttagatttgaacacaaacaaagctaggttggtctatggcttaatcacaaggatggacatgaacattggtggtttgatctctggacaaatgaccatgatggcttag

SEQ ID NO: 65561 - DNA, 123 bp, Glycine max
  Peptide Sequence Number=SeqID_157246
atggctcagcgctcaagaggggtgagctcatcctccccctctgttggtgctggtgctggtggctccttagtcataggctcctgggctgcagaggccccaccccctccagaagaagagggctag

SEQ ID NO: 65562 - DNA, 1284 bp, Glycine max
  Peptide Sequence Number=SeqID_157247
atgcggatgttaaagcgtgatatgaacattgccgattatgatgccgagttgtggcaggctatggagcaggagaaggtgcgtcaggaagagcacattgaactgattgcttcggaaaactacaccagcccacgcgttatgcaggcgcaaggttcacagctcaccaacaaatatgccgaaggctatccgggcaaacgctactacggcggatgtgaatatgtggatattgttgagcagctggcgatcgatcgcgccaaagcgctgttcggcgcggattacgctaacgtgcagccgcactccggctcccaggctaacttcgcggtgtacaccgcgctgctgcagccgggcgacaccattctgggcatgaacctggcacacggtggtcacctgacccacggttcgccggtcaacctgtccggtaagctgtacaacgttatcccttacggcatcgatgaaaccggcaaaatcaattacgaagagctggccgaactggcgcagacccacaagccaaaaatgatcgtgggcggcttctctgcttactctggcgtgtgcgactgggcaaaaatgcgtgaaatcgccgacagcatcggcgcctggctgtttgttgatatggcccacgttgccggtctgatcgctgctgatgtgtatccgaacccggtaccacacgcgcacatcgtgacctcgaccacgcacaaaacgctggccggtccgcgtggtggcctgatcctggcgaaaaacggcgacgaagagctgtacaaaaaactgaactccgcggtgttcccgggtggtcagggcggcccgctgatgcacgttatcgccggtaaagccgtcgcgttcaaagaagccatggagccggagttcaaggcttatcagcagcaggtcgcgaagaatgccaaagcgatggtggaagtgctgctggagcgcggttacaacatcgtctcaggcggtacttacaaccacctgttcctgatcgatctggtgagcaaaggtctgaccggtaaagaggcggatgccgctctgggccgcgccaacatcaccgtgaacaaaaacagcgtacctaacgatccgaagagcccgtttgtgacctcgggtgtgcgtatcggtacgccagcagtgacccgtcgcggcttcaaagaagcggaagtgcgcgaactggcgggctggatcgctgacgttctcgacaacattcaacgacgaagccactatcgagcgcaccaaacagaaagtgctggatatctgtgcccgtctgccggtttatgcctgataagcgctaaacccgcagtgtga

SEQ ID NO: 65563 - DNA, 699 bp, Glycine max
  Peptide Sequence Number=SeqID_157248
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaatttttttaagcagttattggtgcctagaatatttatctga

SEQ ID NO: 65564 - DNA, 199 bp, Glycine max
  Peptide Sequence Number=SeqID_157249
ccctttcgctccgttcatggggagcagaatcgtcttaggcaatggtcagaggtcgagacaagctcaaaggcagaaaccaatcaaggtacttagggacggacgcaaggagaggctagggtcacgaccaataggtcgtcatcgtttgcttagcccgggacaaacgaaaaacgtcgctgcaaagcagccccgtatcctttaa

SEQ ID NO: 65565 - DNA, 372 bp, Glycine max
  Peptide Sequence Number=SeqID_157250
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcgggttcaaagagttggtagctcagagaaccttcgaaaaaccgccctgcaaggcg

SEQ ID NO: 65566 - DNA, 282 bp, Glycine max
  Peptide Sequence Number=SeqID_157251
atggatcagctccaacatcaagctttctgcgagacctatggaaagatctgggatctagctatgatagaagtctctgttgaagccattgcatccctcactcagtattatgatcagctgctaaggtgcttcacgtttggggactttcagctagtaccgaccgtggaagagtttgaagagatcttgggatgcctgctaggaggaagaaagccatatcttttctctgggttctacccctccatggcaaggatatccaaggtggtcaaaatcttggcacaagaatag

SEQ ID NO: 65567 - DNA, 546 bp, Glycine max
  Peptide Sequence Number=SeqID_157252
atgaatatgaatgtggggtacctcttctcccaccagatctccctcatagcacaacatgacacatccagactaggattctctcccttgatcacaactttatgtatagctaggggagttcaatcagattcgaggtccctggagagtctgagtgttgccattaaattggcttatattaagaagaactattggaatcttgatgatccaacaataactttcagaggacccaggaaggccaggggtaagatatctgaggccccttccacttcagcatcagaggcaccaacaccttcttcttctacagtacctctctcttcatccactcagattctagagtttaatgctcaggtggcctggccaggagaccagccctcttcttctggagggggtggggcctctgcagcccaggagccagagactgaggagccaccagcaccagcagaggagcaaactattccagttcagaccccacaaccatctccatcctctgcacctgctcctgagcagacccagacatcggcactggatttgaatgaagaccaaccatag

SEQ ID NO: 65568 - DNA, 445 bp, Glycine max
  Peptide Sequence Number=SeqID_157253
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgtatggccgcgtttgtctcattccacgcctgacactcagttccgg

SEQ ID NO: 65569 - DNA, 174 bp, Glycine max
  Peptide Sequence Number=SeqID_157254
atgcctcctatagtagtcatgactcttgcaagagtgttgaacaactttttgcttgccatcatattagcgaagagagaaaagttccattggctacccttagctttcaagggtatgccctctattggtggacttcccttgttaaggaacgaaggattcatggggatcctccagtag

SEQ ID NO: 65570 - DNA, 447 bp, Glycine max
  Peptide Sequence Number=SeqID_157255
atgggtattggactcaggttgttcttatcatatgtgtccacacagaagctggttcgtaacaatgcttcttgcaagttaataggtataggctctatacaaatcaaaatgcatgatggtatttgtcgcaacctacccttcggcgggagggcaacgccagggctcacgggtgcgtcttccaagaaaggaaaacgcgcggagtcgccaccaacatttattcgaggaaaacgtcggaaaaaccggaaaaggcgtggtctacgaactttaagtgtgaaaggttcaggagttgtatttacgcacggggaaggggtgacaaagctatgtgttgattttaggcttttaaaaaatccacgtttaaccaataaaagcgaaaaagaccatttcaaggcgttggaccttaaaaatgtttttttaggtgataacaaaagcttgatttatgaattgatttga

SEQ ID NO: 65571 - DNA, 256 bp, Glycine max
  Peptide Sequence Number=SeqID_157256
atgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtcatttcgggacaagcggatcatttatgatgaagaggatgagcttcagagatgattcagagttcttgcagg

SEQ ID NO: 65572 - DNA, 582 bp, Glycine max
  Peptide Sequence Number=SeqID_157257
atgccgtcctctttgctggccgagttgggcacctatcgttatagcgtctttgcgcgtggcgagggctggtcaattccgccgcgactcagcacgccgggacaggagtacgatcgcttcgatcgttccgatgtcacctggctgattgcctggactgcgcgtcagggcatttgtggctgcgcacgtctgttaccgtggcacgagccggaagtgccggagggcatggtgctgccttttgaccagcaaaaagtgtgggaaatgtcgcgctattcggcccgccttgaagtggatgccgaactgccgctgaacatcttatggcattcggtacagctggcagagctgagcgggatggagtatttgatcagttcggccacgccgatgctggagaagatgtttgaacagcatcaggtggtgtacgagccgctctcgccgggactgatccagtcagaagacaatctgtttgccattcgtattccggtgcagcagccagcgctggcggagaagtatcgcggcacgcgtcgcttcagtccggaagaagtgctgccctcgctgggcgtgtcggtcaactggcagtcacacagctaa

SEQ ID NO: 65573 - DNA, 1410 bp, Glycine max
  Peptide Sequence Number=SeqID_157258
atgccctcttgccctgtgcaacagcacgttattcaacagccagcagagctgacacaacatcaagacaggaaagatatttttatggttgatcaatctaaagcggcgcccattgaggccgaacagccggaaaaactccggcgcaacctgcataaccgtcacatccagcttatcgccatcggcggtgccattggcaccggtctgttcatgggctccggtaaaaccatcagcctggcgggtccgtcgatcatcttcgtctatatgatcatcggttttatgctgttctttgtgatgcgcgctatgggtgagctgctgctctccaaccttgagtacaaatccttcagcgactttgccgccgatctgctcgggccgtgggccggttatttcactggctggacttactggttctgctgggtggtgaccggtatcgccgacgtggtggcgatcagcgcttatttccagctgtggttcccggacttctcaatctggatgagcgcgctgctgtgcgtgtttgttttccttgccctgaacatcgccacggtgaaactgtttggcgagatggagttctggttcgccattatcaaaatcgtcgccatcgtggcgttaatcatcaccggtattgtgctggtcagcctgcactacccttcgccgaacggaagccacgcggcgctgagcaatatctgggatcacggcggcatgttcccgaaagggctgagcggtttctttgccggcttccagattgcggtgtttgcctttgtcggcattgaactggtgggtacggcggcggcggagaccaaagatccgcataaagttctgccgcgtgccatcaacgcgatcccgctgcgcatcatcatgttctacgtgctggcgctgctggtgatcatggcggtgacgccgtggaaccaggtcatgccggatcgcagtccgttcgttgaaatgtttgtgctgattggcctgccggccgctgccagcatcgttaactttgtggtgctgacctccgcagcctcctcagccaacagcggcatcttctccaccagccgcatgctgtatggcctggcggaacagggcgtggcgcataaagcgtttggtcgcctctcagcgcgcgcggtgccaaccaccggcctgttcttctcctgcctgtgtctgctggcgggcgtggcgttgatctatctgattccggatgtgatgacggtcttcaccatgctacctggcctaccgcaaacagcatccgcagcggcatgcggcgtcacgcttcaaaatgccacttggcaagctgatgtgctgggtgtgcatggctttctttgcctttgtgctggtgctgctgacactgcaggaagatacgcgccaggcactgatggtgacgccactgtggtttgtggtgctgaccatgggctggctgctacgccggcgtaa

SEQ ID NO: 65574 - DNA, 961 bp, Glycine max
  Peptide Sequence Number=SeqID_157259
atggctcaacatcgtggaggatcaggcaacttcgcggaagatcgcgaaagggccgcggaagcgggtcgaaaaggcggtaaaaacagcggcgggaatttcagaaatgatccgcagcgtgctgccgaagcaggtgaaaaggggggacgcagccgcgcgaaaaaatacaaaaatgtgcgccagtcctctattctggtgcgttatgtctgcttccacttcccgcctcagcctgcgtattacgcgtcaggagctggtacttatttttatcactatggtctggggtggcacctttctggtggtgcatcgcgccatggcgcactcggggccattcttttttgtcgggctgcgtttcgctaccgcctctctgctgctggcctttttctttcgccgctatttgcgtcacattacctggctggaaatcaaagcgggcgcgctgattggcgtggcgattgccggtggttacggattgcaaacctggggtatgcaaaccatttccagcagccagtcggcgtttctcacggcgctttacgtgccggtggtgccgctgttgcagtggctgtttctgcgccggccgccgggcctgatggcgtggctgggcattttgctggcgttcaccggtctggtgctggtggcggggccgcaggatggcagcctgacgctgaatgccggcgagatcgccacgctgctcagcaccctcgccattgccgccgagatcattcttatcagtcgctacgccgggcaggtcgatgtgcgccgcgtgacgctggtacagctgctggtggcttcggcctgcgccttcgtgctaatgctgcccaacggcgaatctttacccacgctatcggcgccgctgctgttcagcgcgctgggcctcggcgcggccagcgcgctgattcaggtcaccatgaactgggcgcagcgcagcgtctcgccgacgcgcgccacagtgatttatgccggcgagccg

SEQ ID NO: 65575 - DNA, 542 bp, Glycine max
  Peptide Sequence Number=SeqID_157260
atactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggaaaatcatacaggtccggttcagtctctttttcaatccgaaaagatcaagatcaaatga

SEQ ID NO: 65576 - DNA, 391 bp, Glycine max
  Peptide Sequence Number=SeqID_157261
ggttgtcaactataggaataagagcaatgagggtatccgcaaggcctttacaaaactgcccagtagcaattgcattagccaccaaatcccaaacttcgtggcatacagtgtcccacaaggtcttgtagcttggaaaccatcaggaattggatctttaaagggggaatacttgtacttggggcatctcactcagtttgcaactcccttaaaactcaagctgatcaccatgggggaagttgtctgtgtacgacagggtgacctcgacacttactgcctagttttcctaagtgagagtgtcgtgtggacacgcttacgctatttcctgataaatggtaccacattgcatttgagagttgatgtcaagtgcatgcatcatactcagcatgattga

SEQ ID NO: 65577 - DNA, 129 bp, Glycine max
  Peptide Sequence Number=SeqID_157262
atgaggaaatgggcacttgcagccgacaaggacggtgtggacgacactgtttgtgaaaaatacgacattagaaggagaaatgggcctagttttgtcagacccgtagaaaccctgcgtgggaggatgtga

SEQ ID NO: 65578 - DNA, 282 bp, Glycine max
  Peptide Sequence Number=SeqID_157263
atgcatgagaacgaatggcacagagcctgtttgctctttgcccctattcgggaacctataggacaatatctaggggtctctaataactactccccaacaattcataactcacacagttgttttctagagaaccagtcgccaactgtcgcaacgtgcccttcgcgggcgagcgagggcgaggctcacgggtgcgctttccaaaggaggaaagatgcgcggagtcgccaccaacgtttattcgtggaaaacgtggggaaaaccgaaggaaaccggtcaaaatga

SEQ ID NO: 65579 - DNA, 433 bp, Glycine max
  Peptide Sequence Number=SeqID_157264
ttggaacctcttcgtgccgatcaacgtctcattttcgccaaaaagttggcccagggcttcccggtatcaacagggacacccaggatttatttattctgcgaagtgatcttccgtcacagctgtcccctccctgttcagctactgacgggggtggtgcgtaacggcaaaagcaccgcccggacatcagcgctggcaagtgtagcggtccccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaaaaagtcgctagcgcacgggattttggttggtaatcaaagggagaagaccattttaggtcgtg

SEQ ID NO: 65580 - DNA, 240 bp, Glycine max
  Peptide Sequence Number=SeqID_157265
atgtcttcagccaggctcagcgcacggctggcgctatgcctgaatccactttcgcgcgctaagcacgagggtcgtgctaaggtaggcagaagatttgcacagattctagagcacaccacagtgcctatttcgggaatagagctctggaggcagcaagaagagcagcttttgcagagatacctaggttttttaagtgactttagcattgggaaatgtactgttgccttagaacttgattga

SEQ ID NO: 65581 - DNA, 347 bp, Glycine max
  Peptide Sequence Number=SeqID_157266
gagcttcattgcctaacaggccaggttacaaaagcaatccccaagagactcaacataaggatgcacatgccaaagttgagtatgtgaaaagattgtatgaccaagtgaaggtgcaatttgcaaagaagaatgaaagctatgccaaacaagccaacaagattaggaaggaagaggtacttgaacccggtgatgatcctggacatttgagggaaaatgttgtccaagaaggagggaatgatgagaatcttaaaactgcccaaatacagggacctatgaccaggagtaaggccaaacagtcaatagataccctccaacaaatggtagcagacatacttagcaaggcctaa

SEQ ID NO: 65582 - DNA, 363 bp, Glycine max
  Peptide Sequence Number=SeqID_157267
atggcaatggggcgggtcggatacgggtattgtcttcccaatcccttatcccgactcctcatatccccatacccgtacccgatactcgacgggtttgagtttattgtcccatccctgtacccgtcggattttaagtggcggggcgggttcgagttcggagttgggacaagtctagtaatctcatacccgtacccgtacccgacttttggttatcggggaaaacccgaacccgtacccatacccggtcaactcgagtattacccgtcaaagtcgggacggattcggacgggtgttagaattggcattgacaccccttattggttcactgttaaccaaaaaaccatggttttatgccagccttag

SEQ ID NO: 65583 - DNA, 306 bp, Glycine max
  Peptide Sequence Number=SeqID_157268
atggaggttatagtctcttctccttctctctggagcttggaaactctaacagagcaaacagaggaaaagaggaagaataagaaggttgcagtagctggtgtctcgctaagagaggcatatgcgcttagcgagcaacatccgctaagcgaggcatcggctcgcttaatgagtgaggagaatctggaagagaatctatcacgcatgcacgcactcagcgcgctatcagctcgtccagcgagtcatttgtctattcttgcgcccagcgcgcctaactcgctaagccaaaaatcactaactcacacttag

SEQ ID NO: 65584 - DNA, 1155 bp, Glycine max
  Peptide Sequence Number=SeqID_157269
atgccggatgttcaagcccttgttaatgattttgtgaatctgcttaagaaacgggtctcaagccacagcaaagcagacagcagtgttgctacgctcggtgatttcacagcagcggagttagctgtgggaaatatcgtgaggcgtgttttgcacattataagggaggaggatctttcccttgtgacagatgctgtggctggttttgggatgtttgctggaagtgatgatgaggatgatgttgagcgagatgattatcctgctttatccgcggcttctgttgcagctgctgcaagaagcacctcgcgtccaccgtcattgcaaactcttcttgaggatgtgactgattcagctgttgttccaccaacaccttcatcaggcggtgactctgaagggataagtagaactcttgaaaaaggttcaagtggtcggaagttgaagcatgatgtcattgaagcagtcaatgaactcatccaagacataacctcttgccatgaacaaatagcagagcaggcagtagaacatattcatcaaaatgaggtaatattaacactaggtagttcaaaaacagtgttggaatttctttgtgctgcaaaggagaaaaagagatcatttaaggtcgttgttgctgaaggtgccccaagatatcagggacaagtccttgcaaaagaattggctgctagaggcatacagaccacagtaattgctgattctgcgacttttgctatgatttcccaagtgaatatggttatagttggagctcatgctgtcatggctaacggtggagtaattgccccgatagggttacatatggttgcacttgcagctcaaaggcatgctgttccttttgttgtacttgctgggagtcacaagttgtgccctttgtatccacacaatcctcaagtcctactgactgagctgagatccccatctgagcttcttgactttggggaattctcagatttgatggattctgcaactggttctggttctcttcatgttgttaacccagcatttgattatgtgccaccaaaccttgttagtctctttattactgacactggagggcataacccgtcatatatgtaccggctcatagctgattactactccgctgatgatttggtagtgaaacaaagacctactacagggagttga

SEQ ID NO: 65585 - DNA, 792 bp, Glycine max
  Peptide Sequence Number=SeqID_157270
cgccgatgccagacaggtcattggacagctgctgctcgcgcatatcttcttcacctactgggttgcactctgtttgctaataagagtgcaaccaaggtcaatgttgtctacttggaggcccttcgtgacctcaatatgacagagaggtacgcttggggagtggctgctttggttcatatgtacgaccagctgaacgatgcatctatgagccacagtcgacagcttggcggttacatcacactactgcagtgctggatttacgagcgttttccctcggttgcggagtccactgctgatcaggacttcgacgaggcttctccacatgcgtgcagcgcctggacccactccggattccggatgtatgttggatcccgtatggggagcatcgggaggtccaggactttcacgtcagatcatgctattccgaccattcatgctcctcctgtcgattcaagggtctcgtatgatgatatacacgacaggtggatgcactacgatgatcatatcgtacttgcaagtgagccccgagtcatccctcaggccccgcagacgaatatccatcgcgtgccagagccaggagcatcgtcgacatctgcggaggagcccagacatgcagtggaagtttgtgatgacattgctgagaggttggagcgtcatctgagtctaggggtggtcacgcctggctcatcgacacatgagcctgacctacggctggacctaagaaatctcaacccacgagaatatggattgacttgggctagtccgatgggtcggcataacgaccttaaatag

SEQ ID NO: 65586 - DNA, 972 bp, Glycine max
  Peptide Sequence Number=SeqID_157271
atggcagcttcagagaaaactctaacaaacaaatgcacaacaaatgaaggttggactgtagttttaccccgtcgcagcagacaaagaagaaaagctaccaaatctggagttttggaggaaaaacaagagccatggactccaacagattctcagactgacccaagcaaagaagcaacattggtgcagaaaatggaaagatgtataaataggattgagagatctgaattctatcatactttcagggatcaaattcaaacatctgttgttgattacttcaatagagttttgggctcagagataaagatgcaaatggtcatttatggtattggcagcatcaaattgtatgagccccctcgactgcagcttagtcttgcaatattgatgagaagagatttcagttggattggaaacatagaggtatttgatcctattctttctgcaactgagtctcgggttttggaagctcttggctgttctgtcatgtccataaatgagcatgggaggcgagaggctctaaagccaacaatgttcttcatgcctcactgtgaagcagagctatataacaacctgttgcaagcaaattggaaactgaatctcttaaaaaacatggtattatttgggaacagctttgaaacatatgagcagcacgtgtcactgtgtaagaactcacctattcttaactcgatggggcatattttggctgctcaaggattcacaaatgaatttagaatccaaacagtttcagatgattattataatgcattccatgattcaaggatgtatatccgtatcaacgtggctgtacatcatgttgtcataattattgatctagttatgcttgtttatccttgcactgttgcacgtgtggtctctgtctgtgatgatcctgtatctagtgtatgtggggaacagatgaataggaggcggtcccttgtcgttggagatttcacggatatgcgtatctggacgtaa

SEQ ID NO: 65587 - DNA, 462 bp, Glycine max
  Peptide Sequence Number=SeqID_157272
atggcggaagaacaccgatgtgaaactcccgaaggagcaagaagaagtgtcaacgaaattcacaatcgaaattgcgctatcttcttcctcctcgacgaaaccgtcgtcgtccacgtcacctctgccgtcagtgtcgatgtgctcatcgaatctgaatctgcaccgccgtttgcagcggaggttgaggttgcgatcacgatcgcagtggtgtcgagttctatttccataagctcagcgagtggggctgaccgggttcaagtgcaggtgcggagtgacgttttgcagggctcacaggctgtgatgatctctagggaggaaggaggcgacgacgatggaataggacgtgtcgtggtggtgtgttggcgtcatgatctgtggtttggtggtgtgggtcattgttcgatgctggtgatagtgcgtggagagcttggaaaagagaaggaggtaggttttctgatgtag

SEQ ID NO: 65588 - DNA, 1527 bp, Glycine max
  Peptide Sequence Number=SeqID_157273
atggatgagtttaacactcatctggattctgggattctatcagctgatgtgaaggatttcatgctaaagattcacactgttaattatgctgaggaagtttgcttcaatggtacattggttataaaggcattcagctctggtatagaaataggcagttgtaattggatcctaaatagtccaaagggagatattgcttatctttcaggatccagcttcatttctgcacatgcaatgccttttgattaccacagtttacaggggacttgtgtgttaatttattcagacttcttatccttgggtgatactcaagatggtgagaatggggataattactctgtttcaactgctgataagttactgcctattagttctcaagatttggctggattcaaccataactctgttgagtattcagaagaaaaggaaaagctggttttcatatgctcacatgctatggaacatatcaaacaaggcggttcagttcttattccttttgatcgacttggaactattttgcttcttttggaggaaatgacagcatcacttgaagcttcagatacaaaggttccggtttatataatttcttcagtggctgaagagttactagcgttgcttaacatcatacctgagtggctttgcaaacagcggcaagagaaactatttgatggggaaccattgtttgcacacctcaagctcctaaaagagagaaaaattcatgtggttcctgctattcattctcatgaactcttaattaattggcaggaaccatgcattgtattttgtcctcaccggaatttgcgtatgggtcctgttgttcatttgcttcgacgatggtgtggtgatccaaaatctttacttattcttgaggatgttttgaatccactatcacttttaccttaccagcctgttgcaatgaaggttcttcaatgtgtatttcctgttggaatagggttgcatgaagttcaacctttactaaagacattgcagccgaagactgttctgtgtccggaggagttgagactgcatatcaacttttcaagtgaaaagaagtctttctccgttttgtattatactgaagctgaaactttaaaagtaccataccgaaaggacagttcagagttaaaaattgcaactgatttggcttcccacttttattggaaaacattcaaaaaggaagaaatcaatatagcaaaattgaagggagagctattaatggaaaatggtaggcatcacttgctatttgataatgataacaaaaactccttgagtaataataggtctttggtacattggggtttgcctgattcagaaaaacttatggctgcattatcaaagatgggcatcagtggaaatatacaacatggtgtgagtgatgctaaatcacaaactgtgtgtatagttcacatacaggacccttacaaagcctcgatagagattggaaccactagtacaattattactactgctgatgagaatgtggctgccttcatttataaaattgtggacaacattttggatggagtttga

SEQ ID NO: 65589 - DNA, 864 bp, Glycine max
  Peptide Sequence Number=SeqID_157274
atggcgcggccttccactgctatcaggagcctgagaagtagcggcgatggagatataagggtgtctccccgcatgcgacatagcctaagtgcttggttgtcgtcatccactccgaccgttgttggctatgagtgggtgagggacgatgttttgaagtataagtcttgtctgacctcggcagcgagtggcggtgcctggttgtcgcctttctttttcatgtacagatgtttgtttgaggtcctgggtgtcattttacccttaaccacttttcaatgtgctctgttggagcacttgaatgtggccctttcccaacttcacccgaacagttgcacgatggtgagggcttttgaagttttgtatcctttctccaacatctggcctagtgtactggtcttcttatttttcttccaaatgaaattgtctggcaagattggatgggtctccttgaacagtatgtctaagaagttgttcgagtttgactcaaacatctttcgctgttttaaggaccactttttcaaggttctggctactgatgtcgtggctgatagcatgccattgatgcttaacagggacggggagccctacttcctattctattggcaatttgatcccaccgggtttaagtctgatcctctcgcttccttagatggtattatgggtgactttgcttggaggccacttgtgaagcaggtcagacctgcaaatgggaccgtgccatcgtctactgctgctctatctgttggagaagggggccaacctgctagtgaggttggtcttgttgttgttactactgatgtcacccccaacactttttcctctattttggcaaagaggaaaagggataatgttgtcaagcagatcgag

SEQ ID NO: 65590 - DNA, 63 bp, Glycine max
  Peptide Sequence Number=SeqID_157275
atgactgattgtctaagggacgaagaggagaaagcttgcttgttcagtagaaaatccccataa

SEQ ID NO: 65591 - DNA, 435 bp, Glycine max
  Peptide Sequence Number=SeqID_157276
atggcttgccgaacgaagacccatatgcacacttggccacatacattgagatttgcaatacaaccaagattgtcggatgaagtggtggagaaatttttgaagaaatatttcaccgagtctaagacagcagaaggaaaagcagccatctcttcatttcaccagtttctagatactctcgaagtcgcaatccaagcagttgttggatgcttctgctgggggaagatcaaattgaagaccctggaagaggctatggaactcattgaaaacgtggctgcaagtgatcatgccatcttgcgtgatcggactcacattcccacaaagagaagcccgttggagctttcctctcaagatgcattactggcacaaaacaagttgctagctaagcagcttaagacattgatagaaacattgagtaagttgcctaatcaattgtag

SEQ ID NO: 65592 - DNA, 960 bp, Glycine max
  Peptide Sequence Number=SeqID_157277
atgacccaccctctccgagtcgcagtcatcggcgctggcgtggctggcctcgccgccgcgcgctccctccgccgcgagggcctcgacgtcgtcgtattcgagaaaagcaaccacctcggaggaacatggagctacgatccgcgaaccgactccgaccctgtgggcttggacccgaaccgggaggtggtgcacacgagcctctaccgttccctccgcaccaacctcccgaggcagctcatgggcttcctcgactacccgttcccgaaccgcaacaatggtgacccgagaacgttcccgggtcacgaggaggtgctgtggttcttgaaccggttctcggacgagtttgggctccgcggtctgacccggttcgggagcgaggtggttcgggtcgagctagtttcggaaaagagtgactcgtgggtggttgagtcgaggaggaatcgtgactcggttttgactcgggaggtttttggagcggttgttgtctgcacggggcacttcactcaacccaggttacccacaattcctgggattgaaaagtggccaggataccaaatacatagtcacaattaccgagtgccagaaccttttcagggtcagatcgtggttgtcattggatttgcatctagtgcctttgacatctcaagagaaattgcaaaggttgctaaggaggttcatatagcaactagaagtccagatgtaaaggttatgaagctagcaaatcatgataacatgtggcagcataaaatgacaagcctctccacatgcagtggtaatgctgcatttatctatccacttcacctcagcaggtgggagcctagtacttactttgtcctgcccttgataattgaaatactaataactagtgtaaaatgtgtgtctgaagataggttggttgcttttgacgatggatcctctgtgtatgcagatgtcttattctactgcactgggtatgcataa

SEQ ID NO: 65593 - DNA, 640 bp, Glycine max
  Peptide Sequence Number=SeqID_157278
atgttgggtgcccctagcaattccccaagcttaagtgtgtttggcccatcacgagaacgtctctttgtattccctccattttcgagtcgtggtctccctcgttctcatcatcaatccctccctccgccagtagtgaacgtttctcggcatttgttggtcattgccactcttcgcgcttcgctcttcacccaggttcacgtcataatggatgtcaagataactttaatattgcaccatggaggaagatttactccacgtgccagtgatggaaatgttgaatatataggcaaaaaatttgacgtttgggaggatatatctgcagattacatgaacacatttatcctatgtgatctggtgcaagcatgtaagaagtatagcaggataggagattgtttttggttgattgataaggacttagattttaatcatgggttaatgagttgtacaacagatggagatatattatacttagtgaaggatgctttggaaaatgagaatgagataaacgtttattttcatcatgaagtagatccaattccagaagaagtcccactgatgttggacttgaaatgtcatccaattccaaaagctagtaatgaggatgatttagatgatgtacctgttgctggccatgaggaag

SEQ ID NO: 65594 - DNA, 525 bp, Glycine max
  Peptide Sequence Number=SeqID_157279
atgcacgtggttggacatgtgtttaaagtaaccttgtacaaaaaactatttggcatggtatcaaggtatgctttaaatgaaattgctgctgagtttaagcgtgtagcttatgcaggcaaaaacccttcacgatgtggatgtgtcatgaggagtacccacggtcttccatgtgcatggttaagtgagacacaagcgaccataactgaggagatggaaatcatatcgaaacgctttgagaagctagatgtttgtgatggtaattatggttatcgtgcaatagctgcattattgggtatgagtgaagaattgtggtcattggtgaggaaccatttgcataaagaactgagcaactggtccgaagagtatatgaacctggttggtggcatagagagatttgaagaattaaagcgttatctacttgttgacgagttatctaaggttacgatgaataagtggatgaatattacggatatgggatacgtcattgcttcacgatacaacgtgatcgttgtttctttttcatga

SEQ ID NO: 65595 - DNA, 1488 bp, Glycine max
  Peptide Sequence Number=SeqID_157280
atggttagcactagaggtcttggtcgggctttagggcacgcaataggaaaagtgttagggaggagagacgagagtgacgatgatgtcccccagtggcgaagacctattgcatcagcctgtagacagagacaacaacaagttgttctcgtggaccctcctatggccgaggaggaattggtcgatgaccagctagaagcacatgttgaagaaggtgttgctgatgttgaatgtccagagttgaagttatcttcccatggaaggaagatgactaagtttgggaggcctgccccagagattgaaggccatgtggtggccagtggactgagtcctttgatcgcttattccctagatacatgcgatcatggactaatgtctgcttttgtggaatactggcataaggtaacaagcagtttccatttgtccgttagaaaggtgactatcaccttggatgacattgcgtctttgttacatttgcctactgtagaggtgttccacagcttcgagcaacttcatgtcgacaatgttgtcgagatgttggtggagttactcgaggttagtgctatagatgctagagctgagaccattcagtgtcatggatcttatgtgcaactatcgtggttgtgtgacttgtatgagctgaagattgaggcatgtgagtggattgtatcagggcgagcgtatttgttgcatctatttggatgcacactctttgctaacaagagtgtcacacacatgcatgtgtgttggatttacgagcatttttcgtccattgcttctactgttcctgtcgaggattacgacaagatgagactgcatgcatgtcgttggacctctggcaaggcactgcctgtggccacgtatcggaggcgtctagatagactgacccttgacgcggtgtgttggattccatacggtgaccaccgttcatttagagaatttgaggtcatctcattgtttttcgaccatctcagatgggcccccttgacagtcattcaccgaccgaagagggttgtacgaaaattcggctacatccagactattctaccacaccctgttgtgtctttgttgtccattgcagaaattgatgatagatggatgcagtttggtgagtatattgcacttgttgggcaattatgtgcagtgtcgggccattgttctccagattacctagattggttttacatgatctcgcacccattcatgagtccggcacaaccaggggatcctcctagagcaccgccgcagcacctaatgcctgcagcggcacctaatgaggcagacactgagcagcatgatcttcgacatgcagtggatgactttgtagcaattgctgataggttggaaaagctactgaacctgaggattttgaccgaaggaacagaagcctatactgttgttgaagattgtgtggccatcgcaagacgcttcactggtcagccaactgtagcccacaaatcgaggcgaaggcgacgtatggacggacattga

SEQ ID NO: 65596 - DNA, 204 bp, Glycine max
  Peptide Sequence Number=SeqID_157281
atgaaggttgaatgtccccggcagaagaagaagaagagatattatggggacaagatgaagaaaagtttgattgtcacttgggatgacttagacaatgaaaagagtaatagttcagccgatgaacaagccaacatttgtctagtggcagattcgaacgataaggtcgagacgatgaagaggattccctatgatgtgcttctttag

SEQ ID NO: 65597 - DNA, 333 bp, Glycine max
  Peptide Sequence Number=SeqID_157282
atggaagcaacttccattacgggcaatcactctaatggtattatgttcaataatatcatggagttcccccgtttcaggaaactacacattgtaggtcacactacgtgttgtcccgaacttacgacatgcggaggaatttttcaaaatcatatgggagatatgctaggttgttttgctcaatcaattcctgtatccattgccttccatggtgagcttcaggcagccatgttggcaattgagattgctgctaccaaagaatggatgaatatttggcttgaatgtaacttttctttagtagttcaagctttcaaagactcgaagatggttccctag

SEQ ID NO: 65598 - DNA, 855 bp, Glycine max
  Peptide Sequence Number=SeqID_157283
atggctaaaatagctggatgtattgcaagaagtaaggaagagatcaaagcctgcaacatggttttctactttctggtgggaaatgtgttcttctggagtgtgttatcaggatcccttcttgatttaattggacagttcattagtcatcccaaaaatgttccaagtcagcttgctggagccgtctccgcccaagcagatttctttgtgacatacatcttaacagatggtctgtcagggttttctttggaacttctccagcccggcatgctaatttgggatattttaaagtcttgtgttcatggatgtcaaagagagacaagtccttacctttattcattgccttactttagaataatccctttagtctctctctcagttctaattggcatagtgtatgcagtagtggcgccactgttgctcccatttctcatcctttacttctgtttaggttatgtcgtctatgtcaaccagattcgagatgtgtatgaaactacttacgaaacatgtggacaatattggccatacattcatcactacattctccttgcaatcattctcatgcagattacgatggttgggttatttggactgaagttgaaacctgctgcttctatatcaaccattccattaattttgttcacatggatgtttaatgagtactgcaagatgcgttttctcccttcctttcaccattatactctccaggatgctgctgaaaatgatgaacttgatgaaaagtgtggtctattggagttacattatgagaatgcaattaatgcctattgtccaccaggtttacgaccggtgaatttcatggcatcagaatccagctccacaccattagtttcttcgtga

SEQ ID NO: 65599 - DNA, 312 bp, Glycine max
  Peptide Sequence Number=SeqID_157284
atgccactttccctccgccaactacgtcctcctccaccagactgcaacttcttcactgacgactatgacaacgacttcttctccggcgcaacgacggctacttcttttccacctccttcctggcgacaaccaccaccaccacgccaccaaccttcaaggcctccatttcgatgcagcggcggtcctcgttgttggaagcaggcgaacacgatgccaaaacggcctcgcccaagttcttcaaacagttggtattcttctttcttcacagctactcctctcgatcgatctagaaccttcggggagtgcaaataa

SEQ ID NO: 65600 - DNA, 333 bp, Glycine max
  Peptide Sequence Number=SeqID_157285
atggcgctaagagagccttcgaggacagaaagtgatgagaatcctgaaattctttgttccataatcatggcaggagctggtgacaatggtggtgtatatcatcaactggacgaatttcagcgcttgttactggacgcgatgactacgcaaatgcaacgtttgttgaaccgtaataataaagtgctctacatgcgaatagaacgactagagccccaaatgaatccaaatgctgggagaccttatggtggcaaccaaagggtcactgatggattgaaccgaatagaggggccagacagaattgagggagtaaaacttcaatgtattctcttttaa

SEQ ID NO: 65601 - DNA, 984 bp, Glycine max
  Peptide Sequence Number=SeqID_157286
atgctgcgtagaaacatccgtttgaggagagagtatttgtaccgaaagagcttagaaggcaaagaacgcttgctctacgaaaagaagcgcaaaatcagagaagctcttcaagaagggaaacccatacccactgaactcagaaacgaggaagctgctcttcgccgcgaaatcgacctcgaagatgaaaacaccgctgttccgagaacgcacattgacgatgagtatgcttatgctgcggaaaaggatcctaaaattttgctgactacttccagggatccgagtgctcctcttcaacagtttgttaaggagttgagttttgtgtttcccaatgcacagaggatgaatcgcggtggtcaggttatctcagagattatagaatcttgtcgtgcacatgactatacagatgttgttttggtccatgaacatcgtggtgtaccagacggtttaattgtttgccatctaccatttggtccaactgcatattttggattactcaacgtggcaagtactagtcttacagttacaaggcatgaaattaaagacaagaaagccattggaacaatgcctgaggcttatccacatctgattctcgataatttctcaactaagttaggtgacagaaccgcaaacattctgaagcatctttttccagtgccaaaaccagacacaaaacgtattgtcaccttttccaaccagtctgactatatctcattcaggcatcatatttatgaaaagcatgggggccctaaatctatagaactgaaggaaattggtccccggtttgagttacggctttatcagtgctttaccttaaactccagtattcttcctaagtcgattgttgttgaaaccgggcctattcctcataatacaactctgaaacaaataaagttgggaacggtggatcaagctgaagctcaaatagaatgggtcatcagaccttacatgaacaccaccaaaaagcggaaatttctcagtaattga

SEQ ID NO: 65602 - DNA, 396 bp, Glycine max
  Peptide Sequence Number=SeqID_157287
atggatcgtgggggtaagtgcttgtaccatgttaatgttgataccttgagggaggtcgggaaaactttgcataacatagcattgtcgttggaatacaagtttaccttagtgaggtgtgtccacgatcccatcgataaaagggtgaaagtgaattgcatcattatggatgtctctgtccttgtggattgcatagacgaactgggtcccaagagagttttagatgagttgttgggttgtcctccttcgcttctcgtcccagtggaatctccgatcttttatcttggggtggggattcctgaacacaagggatgggttgtccctgtgtgttcagactttgtaatggattttacaaagatagtggaaatctcaagtgggttgcttgagtactggatgtag

SEQ ID NO: 65603 - DNA, 1559 bp, Glycine max
  Peptide Sequence Number=SeqID_157288
gcaccctcgctataattactccaaatgagtcaatccaaggcaataggaccctagtttcttctgctggaacttttgaagcaggattcttcaactttggaaattcacaaggccaatactttggtatatggtacaagaacatatcaccaaagactattgtgtgggttgccaacaaagatgccccagttaaagactcaacagcatttctcacactaacacatcaaggagatcctgttattcttgatggctcaaggagtactactgtgtggttctccaattcatcaagaattgctgagaaaccaattatgcagcttctagactcgggaaatcttgttgtgaaagatggaaacagcaaaaaagagaattttttgtgggaaagttttgattaccctggtaacacttttcttgcaggaatgaaacttaggacaaacttagtttctggtccttataggtctctcacatcttggaaaaacgcagaagatcccggttctgggtcatggactggctttgttttcagtggagtttcttggcgaagaatgcttagccttgtaactttttcgctagcgattaatgacaaggaagtcacttaccaatatgaaaccctgaaggctggaactgttactatgttagtgatcaatccatcaggctttgtgcaacgtttgttatggtccgaacggactgggaattgggagattttatcaactcgtcccatggatcagtgtgaatactatgccttttgtgatgtgaattctttgtgtaatgttactaactctccaaaaacatgtacatgcttggaaggttttgtacccaagttttatgagaaatggagtgcattagattggtctggtgggtgtgttagaagaataaacttgagttgtgaaggtgatgtgtttcaaaagtacgcaggaatgaaattgccagatacttcttcttcttggtatgacaagagtttgaaccttgagaaatgtgagaaattgtgtttgaaaaactgctcttgtacagcatatgcaaatgtagatgttgatgggagagggtgtttgctttggtttgataacattgtggatttgacaagacacacagaccaaggacaagatatttacatacggcttgcagcttcagagttagatcatagagggaatgaccagagctttgataacaagaagcttgtagggatagtagtaggcattgttgcattcatcatggtacttggatcggtcacattcacatatatgaagagaaagaagctcgcaaagagagagatgctaaaaatatttcactggaaatacaaaagggagaaggaagatgtggagttatcaacaatatttgatttttcaaccatctctaatgctacagatcaattttcacccagtaaaaagttaggagaaggtggctttggaccagtatacaagggtttattgaaagatggacaagagattgcagtcaagaggcttgcaaaaacttctgagcaaggagcagagcagttcaaaaatgaagtcattggttatatgcctcctgaagcacttctgggttctacacaggacaattcagtatcattcagctag

SEQ ID NO: 65604 - DNA, 941 bp, Glycine max
  Peptide Sequence Number=SeqID_157289
aacattcactcccagaacattcattcggagaggaatgttattctttacatctggagtacgatgagttccacagggaacttgaaaggcagaattggcataaagccttgaccaggcagatggatgggcacatagatatggccttggtcaaggaattttatgcaaacctacatgatcctgaagacaaatcccccaggcaggtccgagtgtgggggaagctgattaaatttgatgtcgcctctcttaatgcttttctggagacaccaccagttcttgagctaggggcgcagtataccccatataccagagggcacaccctggaagctcccgaggaaggatttaactacactgacatagacttggagcgtcctgatggacatggacatgggctcactcatatcaggccagatctcatagatggcccagaagaattgctggaacccaacccacatgatcccataatcacttttctggggacccgcaaagctagggctcggggaccatcagatgtttctgccctttattcttttgctcattcagttctagccttgtcttcttctgctctagctttcactcctgcacctccagtaccttctgacccatctgctcagaactcagatactgtggtaccaatgctgcagagccttcaccagggcttatgcctggtgatgcagagcattcataatgtagctcagcattggcccatcatcggcatggaggatttcatggctcaggctacaccaaaggtctcacctgctgccacaccgcttgtggaggtctctgaggaggaggatgacactacagacatggattatgcagctgatatggcagcagcgcagagcaaatgggatccctggcccacaacagtacaagagacatctcagcctgctcaggatgctctctcttcacctcaggatgatcaaataccggcgcaggatgagtga

SEQ ID NO: 65605 - DNA, 222 bp, Glycine max
  Peptide Sequence Number=SeqID_157290
atgtctttgcttggtaatgaaacctcgtggaccgctgattttagcaaagttttgcttttccctaaccttgtcaaacatgttgtgtactccttaagtgccaatggcaacaccttcccgaatcatgctctcagaaacgtttgtcacaatcgggtcgtaattgaaacggatgaggctgtgaatgcaaatgtttttgtcacagtggatcaaggtaatgcaagttga

SEQ ID NO: 65606 - DNA, 762 bp, Glycine max
  Peptide Sequence Number=SeqID_157291
atgggaaagaaatttttgcttgttttggatgatgtttggaatgaaaactattcgagttgggaggcactacaaattcccttcatttatggattttcaggaagtaggattcttattaccactcgtaatgagaaggtaacatcagtcatgaactcctcccaaatacttcatttaaagccactggagaaagaagattgttggaagctatttgcaactcttgcatttcatgataaggatgcctgcaaatatccaaatcttgtatcagttggtagtaaaattgttgacaagtgtggaggattgcctttagccataagaacattgggaaatgtcttgcaagcaaaattctcccagcatgaatgggttgagtttgacaaggatcagttaatccagttgtggatggcagaaggtttgttgaatttctggcaaataaataagagtgaagaagagttaggtgctgagttcttcaatgatctagtggcaaggaagcatagtgggtttgatgttaaggagttggggaatcctaacaatctccaaggaacactttcaattttcaagttagaaaatgttactgatcctacaaatgccatggaagctaataagaaagataaaaagcatttagaaggattagtgttggattggggtgacaaatttggaaggagcaatgaaaacgaggacaaaatagtcgaagggcatgtgttggagtctcttcatccaaatggtaatttgaaaaggctaactgttttacgttatgatggaaccatttga

SEQ ID NO: 65607 - DNA, 249 bp, Glycine max
  Peptide Sequence Number=SeqID_157292
atggctatttatagaaaacaaccattgagtgtagggaaattcacccaggcgagctatttgcttaggcctgaaggtatctactcgcccaggcgagtggcttgcttagggttgaagttaactcttagcccaggtgagctggatccttgggaactgaatcctccaagtgttggcattcataaattaccaatttctgcaaagaaggaaggtgtcaaggtagggaccttctcaacccaggacaacgccttatag

SEQ ID NO: 65608 - DNA, 432 bp, Glycine max
  Peptide Sequence Number=SeqID_157293
atgtcttctaccattgtagttcaagagggaaaaagagaagaacataagaagaagaagaagaagaagaagaattcaagagggaaaaagagaagaacagaagaagaagaagaagtgaaaagtgagataaagtgtagaagcaaatgcctttggtgttttgatgatgatcatgatgatttgatgcaaatgggattttcaagtttaaattcaagacaaagattcaagaatacaagccacaacatcaagatgatcactagtattttaggaagggaattcctaattgatatagcaaaagactgtgtaatcgattacacaatattggtaatcgattaccagcagttaatgaacgttttaattcaaattttgaaagctgtaatcgattacacaaattctgtaatcgattaccagacaagattttcagaaaaatatttctaa

SEQ ID NO: 65609 - DNA, 1410 bp, Glycine max
  Peptide Sequence Number=SeqID_157294
atgaccccagttcttgtagtagctgcaacgaggatgtccaagaccaccaccatgtccaccaggatgagaggagtgcgaaacaaggggagaggaatccctggtagacgtggaagagggtccaaaagtatgcggagtagagagacacaacaaccgctcttgaactacgtcgtaggttggggggaagagaaaaccgaaggacactgcataatgaggtatcaatttgcttccaacgagcaaaatagtagtaaaattaacagtaaaactcgcgacagtagtacaatcgggagagaggccatgagaagccacataaaaagtgccaagcatggggtggtagtcccagaccggtgttttggcaatttaaattctttggtcgtggaaggatgtgaatttttatcaaaaggcgtagtactaccttctcatttactttgtttcctaaataatttgaaagtgttgcaagtgcggaaatgtaattctgttcaggcggtacttgatcatacaactgatcttgtttccatccccctgaggaaactgattttggaccaacttccaaatttgaagcatgtttggaatggaggaagtcaaggaagtctcaaccttccacatctggaggaagtgttagttgatggatgtgaaaatatagaaagtttgtttccagcatcaatggccaatgatgagctacgaatacttgaagtggaaaactgtgtcagtttagtagaaattgttgcaaaagatgaagtagccacagaagaagtaaatacagagcgtattatattccaaagtctgactttgctgaggctgtggaatttgccaaaattgaggtgcatttatcctggaatgctcattctaaaatggccaaagttacaaaaattagatgttttacattgtgaagtgctgaggttttttgccactgaatttcaaaattccccagattcacatctagaggatcgaaatagttttccaactgaccagcaagaatctgtctcacttaggaagagatttgatgaatcagatgtatttccatttgttttcgtttcagagaaattggaggtgttaaaagacggatttgataaaggacatgatttaaattctgtgatcaaagaacaatctgatgatgccagtagtgtaatgacagattcgaacgacttctataattttgcacgcaagaggatatggtggagaactagaagcttgttatcattcccttgtctaatgcaaattttccagcagcaacagagcaggaaacctgaatgtgggtttagtcatttgtgtgcatttatttttccatcttgtgcaaagatgcatgaatatgatcgatacgatgagtgcaataagcagtggatgaaatacaatagtaacaactactgcaaaccaaatgctttgtttcagttggagtgtggtgttcgtgaataa

SEQ ID NO: 65610 - DNA, 612 bp, Glycine max
  Peptide Sequence Number=SeqID_157295
ccccgagtcgtccctcaggccccgcagatggatatccctcacgtgccggagccaagagcatcgttgacatctgcggaggagcctagacatgcagtgaaagtttgtgacgacattgctgagaggttggagcgccatctaagtctatgggtggtcacgcctagctcatcgacacatgaggcgatcgaagaatgcctcaggattcatgttaatgaccggatgtttctgcaggttttattcttaatgtcaacagcattaaatctatcaatacacgaagcacctcctcctatcgagctaggaggtgctttgacagttgatgtacgttcaagacaacaacgcatagctgaaataacagagatgattcatgtggcaagccttcttcacgatgatgtattggatgatgcagataccagacgtggtattggttcgttgaattttgtaatgggcaataaggcaatagccatccttgcaggccaaacaacagaagttgcaatgcttgcttttgagtatggaaaaaatctgggtttggcatctcagttcatagatgatgtgcttgatttcataggacatcagcttcccttggaaagggttcattgtcagacattcgtcatgtaa

SEQ ID NO: 65611 - DNA, 201 bp, Glycine max
  Peptide Sequence Number=SeqID_157296
atgatgacaacaaaagatgatgacaaaggtgatgacaaaaagctcaaaggtcaatcaaaggataagttcaagatgttcaagaaggaatcaagaacaattcaagactcaagaggaaaagttgaagaacacttcaagattcaagaagaagctgcaatcgattacaatgttttggtaatcgattaccagtgccttgaacgttga

SEQ ID NO: 65612 - DNA, 195 bp, Glycine max
  Peptide Sequence Number=SeqID_157297
atggcgaagcacgatggatggattccacggtggctttggcgtgcttacatatactctgatgctcaagtcaataatagctcaaggtggagtgaggaaaatgaaatggagttagttatcatactccctgtaatcattgagaaggctcataaggggaaacaagaccttggttctgggcagaccgagttaggggagtaa

SEQ ID NO: 65613 - DNA, 192 bp, Glycine max
  Peptide Sequence Number=SeqID_157298
atgggggaggggaaggggaagggaataagaaaatttaaagggaaagggaaggggcagaggggaagggggaaagggcgaaaggaagggaaggaggggaaggaggatacacatcttgttggttcgtggcttaatgtctcaatggatccaattgttgatgatgatcaagcaagagactacgcaaaagagcagtga

SEQ ID NO: 65614 - DNA, 243 bp, Glycine max
  Peptide Sequence Number=SeqID_157299
atgtcgtgtggtacacattgtagcctgaaagtgacctactccctgttgtcgcaacgtgcccttcgcgggcgagcaaaggcgaggctcacgggtgcgcttttcaaaggaggaaagatgcgcggagtcgccaccaatgaaggtattagcacctctcacgtcgacaaaagcggggctcttgctcctacgtaccctccatcaaagaggaaatcatacctacgtagttctttcttatgcgtgaatcaa

SEQ ID NO: 65615 - DNA, 627 bp, Glycine max
  Peptide Sequence Number=SeqID_157300
atgagggtagcaccagcgtgggcttgccaacctctaacgcaagaagccacagcattctccccatttgctcgcgctctcactcgtattacatctctctcttctatgccaacacagcgtcactcttcaaaccctaccccaaccctcttctccgctatgaaacttgactatgcaagacctcctctctcaatcataatttgcttttatttcacctttgaactaactaatatacttcttgttcaagggagttgtccaagaagatttatccgacgaggatttcgacatgagacctcttatcctatccctaatgaagttgtccaagcatatttttcatttttcaatcccaagcctaatgattttcccggagctaagaccttgctgcaaacattccttgacggccaggaacgggatttaactgcctttgtagacttgattttagcacaaaccactgtagcctttattgttaagattgaggatgatgacgatgaaggactcttcgctcttgttactgctcttaatttatatagatacaagctcaagaatgtagaacagaaaagaaaatggagcattgatagtgatgaagcaataatatatataaagattgaggataaaattttcacaaggcattga

SEQ ID NO: 65616 - DNA, 267 bp, Glycine max
  Peptide Sequence Number=SeqID_157301
atgtcttccaaggttattttgatgatgccaaagaatcaagagttaagcaaagtttcaagcaaagattcaagtttcaagtttcaagtttcaagattcaagattctagattcaagattcaagattcaagaatcaagatctaagaatcaagattcaagattcaagaaaaatcaagattcaagaaaaatcaagatcaagattcatgaatcaagagaagactcaatcaagataagtactaaaaagttttttaaaacattgagtagcacatga

SEQ ID NO: 65617 - DNA, 1101 bp, Glycine max
  Peptide Sequence Number=SeqID_157302
atgaggatgcatccttgggtttttggggtcatttgtctctgccaattgctctgtgtggtgaatactggtggaggagggcatgttaagtccaatttcaaatggcaaagatcacaagaagaacaagaacatgaattgagttgcaacatgtacgaaggaaggtgggagttggatgattcttaccctctctatgactcttcaacctgccctcacattcgtaaggaatttgattgcttgaaatatggtcgtcctgatcaacaatacctcaaatacagatggcaacccaacgaatgcgacttaccaatatttgatgggaaagatttcttgacaaaacttaaggggaagcagatcatgtttataggagattcagtcagtctcaaccaatggcaatcacttatatgcttgcttcgttcttctgtgcctcaaactgaaatattagagcagggcgatgtgaacgtatctaactacacattccaggactatggagtttcggttattatttttcattctacatatttggttgacattgaagaggaaaaaattggtcgagtcttgaagcttgattcccttcagagtggaagcatatggaaagaaatggacattttggttttcaacacttggctttggtggtaccgcagaggacccaagcaaccatgggattatgttcaaataggtgacaagatactcaaagacatggatcgcatggaagcttttaaacttggtttgacaacatgggctaattgggtcaatgcagaggtagatacaaacaaaaccaaagttcttttccaaggaatttctccttcccattacaatggcatggagtggaatgagccaggagtacgaaactgttcaaaggagacacagccaataagtggatcaacttaccctagtggattgccagcagcattatttgtattggaagatgtgctgaagaacataaccaaacctgttcatctgcttaacattacaactctgtcacagttgagaaaagatgcacatcctagttcttacaatggctttagaggcatggactgcactcattggtgcgtagcagggctgccagatacatggaatcagctgttgtatgcagcagtcacttgttag

SEQ ID NO: 65618 - DNA, 702 bp, Glycine max
  Peptide Sequence Number=SeqID_157303
atggcttcacttccatgtctcctcttttccatccatttcattgttatcatgtcaagttccttacccacaaatagtgatgaagtgtttgcaaaacagtctccaatgtctccatccacaaaacccgtggaaaaaatcacccaactacacttctatttccataacaacgtaacggagaaaaacccaactgctatgagaattgttgggcctcccaagggcttcattactcagtttgggactgttgtgatgatggatgaccctctaactgaaggaccaagtccaagttcaaagcttggtatttacaatggcagcaccctaagcattcttggaaggaaccctaccctcctaaaagctagagaagtggcaattgttggaggtactgggatcttcaaatatgcaaggggttctgctgtgcttaccacatatatgtttgattataaggctggtgttgcaattgttgaatacaacgtgaccgtccttcatgcggaaaacgccattgccactggcggcaaggctcaacccgccattgccagtggcggcaaagcaggagagaggggcttgccgccagaaggtctggcgggattggcagtgcagtgggactcgcccagggtgctggcgagacagccatgtcacgtgaaccaacttttcaggcttgcagggcttgtttctgctctccattgtttagggatgcagcatagcgtttag

SEQ ID NO: 65619 - DNA, 294 bp, Glycine max
  Peptide Sequence Number=SeqID_157304
atggaacccaatatggaagatgacaacaatgcatcagacttcaagcatgagtggtgggtagtttggatttgggtttgggcggtggcttgtcctgtgcatcacctgatgatgagaatgacgagggtcatcaaagaagaaaggtggcaaatttacgtggagagagtaggtggtatcgttactggtagtggcgatataggtggagagagaacagtgtcgccaatgggaatggcgacacccaagctgggactcgccgaccgtgatggcgagatagggcaagggcaatctcgccgttag

SEQ ID NO: 65620 - DNA, 117 bp, Glycine max
  Peptide Sequence Number=SeqID_157305
atggacgaagcgttgaaactgtcatgtgcgaaggacacgaaggagaggatcacgggtgtggattgctacatcgagcttgcaaatggaggtttggttcctgttagtgaagctcttaag

SEQ ID NO: 65621 - DNA, 204 bp, Glycine max
  Peptide Sequence Number=SeqID_157306
atggtacttatggttgaggcagaggtcgtggaagccatacatctagtggaagaggtagaggcagaagcacacaaatgtgcacttattataacagatcagcaaacctctcaagcctcttcctctcacaccactaataagttagttagttctcgtaagaatggtaattcaggacaactcctccttgaggacgattggaacagctga

SEQ ID NO: 65622 - DNA, 495 bp, Glycine max
  Peptide Sequence Number=SeqID_157307
atgggggaacacccaactgctatgaaaattgttgagcctcctaatgagtccattgctggttttgggactggttttgggactatttacatgatggatgaccctctaactgaaggaccaagtccaagttcaaagcttgttggaagatctcggggaatatatgctaaagcttctcaacatgatcttggaaatggggaagaagcagaacgacatccagaaaacggggctaggtcgagccctgctgtctcgcttctacaggaagaccctgtgagtattctttctcttcgttccgcattcatgcgcccaccaggttccgtgcctgatgaaacgacgacaccagaagaagcgaggaagcagcagaagcaagaagaggcgctccacgccagcaacctccgcgttcctcgccacccactgtggactcccaacatgtccgctgatgagctgaacgccagcgaaatgcaagctttcttggcctggcgccgcagcttggcgaggtga

SEQ ID NO: 65623 - DNA, 1386 bp, Glycine max
  Peptide Sequence Number=SeqID_157308
atggcccgtttggacatgcttgtttttgacaatgataacccgttttggccagcactaaaatcttctactctacaaagagacaattttggggagctgagatgggagtcacagggcttaaatccaatgatccttcttcttgactgtgctaaatgtgttgcatctggaagcatcaagaatgcagatattggccttgagtacatatctcagatttcatcacctgatggtagtgcagtgcaaaggatggtcacttatttcagcgaagcacttagttacaggataataaaacgtttgccaggtgtatataagtctctcaatccaccaaaaacatcactgtcttcagaagacatccttgttcagaaatacttctatgatctgtgtccttttttaaagttctcatacctgatcacaaaccaagccattgtggaggcgatggaattcgaaaaggtggttcacattattgatctccactgttgtgagccagctcaatggatagatcttctactaactttcaaaaaccgtcagggaggtccacctcatctcaaaattacaggcattcatgagaagaaagaggttttagaccaaatgaactttcatttgacaactgaagcagggaaattggattttcctttgcagttctatccagttattagcaaactggaagatgttgactttgagaagttgcctgtgaagataggagatgctcttgcaatcagttctgttcttcagcttcattctcttcttgccactgatgatgacatggcggggaggatctcaccggctgcggccgcgactatgaatctgcagagagcagtgcatatgggccaaaggacttttgcagagtggcttgagagagatatgatcaatgcatatatcttgagtcctgattctgcattgtcacctctttccttaggtgcctcacctaagatggggatctttctcaacgctatgcaaaaactccaaccaaaactggtggtgattactgaacaagaatcaaacctgaatggatccaatttgatggagagagttgatagagcactgtacttttacagtgcattgtttgactgcttggaatctactgttttgagaacatcagtagagagacaaaaacttgagagcatgcttctgggtgagcagattaagaacatcattgcttgtgagggtgttgatagaaaggagagacacgagaaactcgagaaatggattcgaaggcttgaaatggctggttttgtgaaggtacctttgagctacaatgggaggatagaagccaagaatctgctgcagagatatagtaataaatacaaatttcgagaagagaatgattgtttacttgtctgctggagtgatacaccaatgttttctgtatcagcttggagttttagtagatga

SEQ ID NO: 65624 - DNA, 795 bp, Glycine max
  Peptide Sequence Number=SeqID_157309
atggagaaccgaaccacccaggttcggtgcccggagaaccaggagctggccacctacgtgtggaacaagtggaaggaaatggcgcagcaacccaaaggcatttctgacaacatcgacatgaccctttccaaggcccactttaatctctgtaactccaaaacccccattcgaaccatcaaagatttctctcaagtcaagggtgtggggaaaatgattttgaagctcatgcaggggttttttgggactggttctgaaccagaagacttgactaaaaagggaaaaagaactaaaggaaccaaacgttatatgcctcagaggaactctgtggcatatgcattgttgataaccctttacaggggaacttcaagcgggaatgaatttatgcataaacaggaactaattgacgcttccgaagcaagtgggctatctcgagtgccgattgcgccagaaaaagggaaaggaaaacctggacattttggaagttcttcacgggattggtatagtggatggagttgcatgaagaccttgatagctaagggattaattgtaaaatcaagttgccctgctaagtacatgctaactcaagaaggtaaggaagcagcacgcgattgtcttgcaagatctggaatggcagaatctatagagatgtcgtcttctgttgaaattccttcttgtatggataaccaaaacttgttggatgtggagctcaatggtcatgacttggaatcagaggtgttgtcacccttgacccagcaaaagaagccaatagatgttcctcttgattgccttgagagg

SEQ ID NO: 65625 - DNA, 201 bp, Glycine max
  Peptide Sequence Number=SeqID_157310
atggcgcgatgcatgtgtcaaaagttgtccagaacaaagaagaagaagaagatcgtgtattacgatctaggcgatcctaaagccaataaggccaaggtggttacaatggttctgatgggtggaggttgggtgcagtggtcatggaggtataggggagaggcaactgcttggaaggggaaggataagaatgaaatattatga

SEQ ID NO: 65626 - DNA, 636 bp, Glycine max
  Peptide Sequence Number=SeqID_157311
atggcattggtctctggaagaagttctgctctgaacccaaatgcacctatgttcatacctgctgcacttcgtcaggtggaggatttttcacctcaatggtgggatcttgtgaaatcttcaacatggtttcgtgattattggttgagccaacataaggaggaagaatttgaagaagttgccaatgactctactaatgatgatatggagaatatgctctcggaaacttttgatctaggcatggaagaagacttcaatgttctagaaaacgagtttgagcagttggtgatgttctctgaagctctagatcattctgttcaggatgatcctaatactggaaaagggtctcctcagagtcttaacaaggatgttaaagcttttcttattaacttgacaccaaaatcaccgagggaaaggggtcccaagtctccttcagggcttgcaaagcaccttgagaagccagcacagcacgtgaatgtgaaaaacatgtatggtgctgaactggccaaggagaaaacgcttttgatgctttgctggttacatgcacggacatttggatttgctggtctagaacaaggtaaagagcatttggaaagagaaatagcgaagtggaatttgctcattgataggcctatgtag

SEQ ID NO: 65627 - DNA, 231 bp, Glycine max
  Peptide Sequence Number=SeqID_157312
atgccatatgttgacttactcccatatctgctcgataatgcaatggcagttataagcccaacaaagatttctcaacctctgtttcctagaggatacaaccccaacatgacatgtgcttatcatgagggagttctagggcattccaatgagcattgtatgaccctgaaacataaggtgcaaagtctgattgatgcaggctggttgagatttaaggaggagaatcgctcatga

SEQ ID NO: 65628 - DNA, 330 bp, Glycine max
  Peptide Sequence Number=SeqID_157313
atgacgaccttgttctgcgtctccaatccaatctctcacctctccgcatttgcttccttgagggccccgcccttcttcttcaactctccggcgcttcgcatccacgccggcggccgggaacggcggggctcggcggtggcgactcgtgcgggtcccagcactagcagcatcctctttgccattgcgctcccgtcctctctcctcggcgtcaccattttagctgcacttcgaatgggcgataagctcgaccgagactggcttgaagagtgtcaaagcttgtggatatctcaaagtcccagagaacaaaaaagtcctatgtacggtgattaa

SEQ ID NO: 65629 - DNA, 597 bp, Glycine max
  Peptide Sequence Number=SeqID_157314
atgtttaagaagaattacgaccatcttccaaaggatacatactttggcatgtataaagattctgtacgtggcaatccaaactacttcctgacttacgggaatggaaaatcagctgctcggatacaagatcatcttcggcctaatgttcttctgaattatgctagtgaaatcaaattggaagaggctgctgttttacattacacatatgctaaattctcagacttaacttctagacgtgaccgctgtggttgcaaacctacaaaagaagatgtcaaaagatgcttcatgttggaatttgatagatctgtcataattcaaagtttaagggaatctggagtcttcagttctgtcattgcatctgccccgtcactttccaaagaaaactttctgctgtcaattgatagtagtaactcatcgagagccgtcgcctccgtaaccaccctcccttcaacttcaagaaaggttggaagaaccaaagaatctcaagcagctacaaggaaggctttatctattgaatctgttgcatttcaccaagtagctgtaccaccactgtctcccccaggattagataacaatggcctcatttcacacaattaa

SEQ ID NO: 65630 - DNA, 261 bp, Glycine max
  Peptide Sequence Number=SeqID_157315
atggcaagaaatgaagctttaatggaacttgaaacatatgatgacgatgacaatgatgataacgatgatgtcagcagcgaagaggatatgaaaaatctcgtcggacgcctaggagtatatgacaaggcaaaccatgcactagatcggtacagacttaaaggagcactcaaaccgggtgtatttacccctaaggcctacactccgaagagtccgtcagggtctctctctcctgattcaggtccaatgcataaaacattttag

SEQ ID NO: 65631 - DNA, 576 bp, Glycine max
  Peptide Sequence Number=SeqID_157316
atggacgaatttttcaagttacttgagcagatgcagaagttggattttcccgttattgctgatctccccaaattcttctctgttttggtggagaagaaaccgataattgcactagagacatttgttcaattgaaagaaaaaggtcatgttagtgttaaaatatataatattttgatggattctcttcacaagattggtgaggtgaagaaagtgttatcactatttgatgaaatgaaaggcttaagcttgaaacctgactcgtttgcttatagtattgtgattctgtgccttgttgaacttggtgaaattaaagaggcatgtgcatgtcacactaagatcattgagatgtcttgcattccttcggttgcagcttatagtagcctcactaaagggctttgcaaaagatgctggttcatgattgcttgcgcaatgttagtgatggaccaatctagtttaagtttagtcttaccattattcatgcataaaaatacagcagacttggtgctatcaagcttgaagttctttggtctagaatctaaactaaaagcaaaaggctgtaagttgttaccgagttga

SEQ ID NO: 65632 - DNA, 1128 bp, Glycine max
  Peptide Sequence Number=SeqID_157317
gaagttgtcgttgttgcagaggatgcttctcacatggatgatgtagctgaagaggtctttcaacatgttgaagaagttggtgttgatgcgcagggttttccaggtgggtcgcatgacacatcaatgttggttgcctatgttgatcatgttgcagtcattatttggaatggagaggaacgtcctgaattgaagctatcctcccatggaagaaaggttcagaaatttgggaggcctactattgagattgaagggttagtcgctatcacaggaataagtcttttgatcgcatgttcattggacactggcgatcggagacttatatcgacttttgtggagaggtggcataaggaaacgagcagtttccatcttccaataggagagctcaccatcaccctcgatgatatggcctctttgcttcagttgcccatcatatgtgcattccacagcttcaacacttttcatggcgacaaagcagtgttgattcagagtgtaagctatgcatggagagatgctgtcctagtgcatatgtacgataatttgaaagatgcttgtaagaacggcggcagacaacttgttggatatatcacactattacagacatctacaaaggcattaccagcattgacgtattggaagtgtctagatcgactaatgattgttgatgttgttggatgccttacggtgaccaccatgcagtttgagagtttgacctcatttcatacgattcctccacactctccgggttcaaggttatccttccaagatattgataacagatggatgcatttctctgagtaccttgcatcgcccgaggatccacccaaacatctacctggcatgcaagatgagacatatgtggaagcagatatgcctgagttcctgatgatgacaatatctatagaggaagcacatgcacatgcaccttctgatgtggagcagcctagacatacaatgacttgccaagcaattgcagaaaggttggagtggttgctcaacctaaggataatgactgaaggcatagaagcacacgatatcatgcaagactgtctaaggatcgctaggggtgtcactgtagatcacaatgtatatgtgaggtcgcgactaaggtggtgcacagatcacgcatga

SEQ ID NO: 65633 - DNA, 387 bp, Glycine max
  Peptide Sequence Number=SeqID_157318
atggttgttgaaatattggcgatcaagatttctatttctgcaaacataggatcgaaccaagcacagtcttttgagaagaggattttatcaagtcaaggtcaaagtatggaagtaaccaatttgcaaaagttggggcaaaagataggaacaaatgagggccgatatggaggccatgaaggaaaaaatgacaacaatgatggaagcaatgatgagagcatgaggaagatgatggaggataacactgctacaggtgttgctgcgagtactactactgagatggacccgattcacccggccggttttgataaagtgaatcgtccagtcttagatgtagtaggtcaaggaggcaaggcagggaaaaatgcatgtgggcctcatcatgtttag

SEQ ID NO: 65634 - DNA, 1131 bp, Glycine max
  Peptide Sequence Number=SeqID_157319
atggcctccaggaagagaagagcgtccacctcccgacctcaggaaccctatgacactacacggttcgtttttgaggagctcgagaaacgcagatggcacagggccttgaccaggcaaccggataaccacattgatgtggccctggtcaaggaattctacgctaacctctttgatccagaagacaagtccctgagacaggtcagagtgcggggaaagctaattaagtttgacgcggctacactgaatgagtttctggagagcccagtcgtcctagagcctgaggagagatattctacatactccagattctgtcacactcaccccgttccccaggagctcgccgccagactatgcattccagggcggggtttcgtacttaatgttgagggagcgccttggaagctccttaggaaggacctcaccatactcccacagacctggagtgtcctatcctactctaacctcgcccccacttctcatatgtctgatcttaacatggatagggcgaggttggtatatggactcgtcatgaagatggacatggacgtgggatcgatcatctctggacagatttctcagatggcccagtctaactcctttaggcttggtttccctgccctgatcacaactctatgcattgccagaggagttgtccctgatcccttaacctctgagtccttgagcccagccattaacttggcctacatcaggaagaactgctggaacctggatgatcctaccatcacatttcccgagtcccgtgaggccagggctcggggaccctcagatgcttccacttctgcccctgctcctactccaactctggttcctcctctagcacctctaggactctccggtccttccccttcttctgcgggggaaggtgagacttctacagcccaggagccgcagccagagccagaggagacgcttaagggcactcctactgccacacctatggaggtcacagatgagggatatggcactgtcgacacagattacatagcagatatcacagcagcgcagggcacctgggatccttggcccactacagctcaggacacacctatgccaactcaggatgcccccacatcacctcatgatgacctagcaccggctcaggatgattga

SEQ ID NO: 65635 - DNA, 2151 bp, Glycine max
  Peptide Sequence Number=SeqID_157320
atggcacatattgctgacaagataaaaaccattgatggatctaaagaaactctgaaacttgttgtaaggataactgagctctggtttgttgggacgccgggcaggtctaaacaagctgagatgatcatcgttgactctgatccgttaattagatatttttatgattcacagggtgatcaaatccatgtggtttgtaagcaagacaagttaaagacatggaaaatgaatttgaaggaaggttgtacttatgtgatgcacaattttagagtcagcatgaatgatgaacagtacagagtttgtgatcatccatataaattgacatttattggagttacggttgtcagacagtgtgaattcgatgggcttccttttaaaaattatagatttgcaaatttttcggatgtcgttgctagcctattatggagttcacagccttcgggttctgctcagttatcatcaagggaaacattcatttccaagtcagaggcaaagacaatttctgagataaacaacatttatgaacttgcattcagtgccataagaaaacagatgtctatacataatcgtttgtgtgcccatgtggcaagcataatgatcaagttgtgcttagcatttaacgctattatatatgtttccagatatagagttgaagtgatggtcaattataaagatgaaagcacaaaatttctcctgtgggatcatgaatgcactgaattgattgggcaatcagttgatgaagtcaacagcctcaaagtagaagatggtgatctggatttaaatgcctccccaaaagcacttgataaactactgggtcatctgctcgccttcaaagtcaaaatcaagccgcagtataaaaattatgttgttttgaaatgctcaattgacttaactttaattaatgatgttctcgacatgttgcttgatgctaagacatgtccaaagattaaagttacaacaccatctgattccaatgatcctgtccacgatgaatctcaatccatttctataacagcggaccatgatccacttattggacttcccttgataccaacaaaacgacaaacatttcatgaatttaatgtctccgacccatcagagaatgaaaattctggatcaacagaagaatctcaaactatttcttcagttggatatccaaactgtgaatcctcacatcatgatccttcaatggacacaggagcatattttgatcttggtgaccagctcatgcaatgtagacattgtaatgcaaaaatgtggtataatgaaagaatattaaaacgttcaaatacctcaagcccacgattcagcctatgttgtggaaatggcaaggttgaacttccattgttacagaatccacttaaatttctgcaacaagttctatttgagcaaaatacagctcatgcaaaaaattatcaacagaacataagaacttataacatgatgtttgcatttacttctgctggtattaaatttgacaaaacaattagtcatttgagaggccctcctacaatcagaattcaaggtcaaccgtgtcacggaattggaagtctattaccaatgcctggaaaagaacctaaatttgcacaattgtatatctatgaaatagaaaatgaagttcaaaatagaattaacaccatgagccactataatgaaattgagacacatattgtctcaaatttgcgagaaatgctggatgaaaacaatgctcatgcaaagagtttcaggatggcaagggatagattgaccggcactgaagtgcataatgtcagacttaaattgattgtaggttgggaaaaagattgtcgtacatataatgtaccaagtgttgcagaagttgttgcacttattgcaggaatttgccaggggattcttcactcaatttcgagcattttgacatattatgggcctcaaatggacattcctatcaaaagttatacatgtttcaagtttaaaaaaatccataaaaaagcatttggcctttatgaatggtgggacccgccacgtggacagtgtctcgccatctctactggcgagttccaccagctgctgccacgtgttcaactcgccaactccattggcgagttccctccaaaaatagaccccctctggaaaaagtttcgaaacagcccccttttgggaataagtttctaa

SEQ ID NO: 65636 - DNA, 252 bp, Glycine max
  Peptide Sequence Number=SeqID_157321
atgaagaacacaacccgcacaagtcaagaatcccaaatccagaacccccaatcacaaatcacaacccaaatcacaaattcatctcatagatcagagtggcaaatggaggtcgagcatctccttggggagcttgtcgatgttggtgatgatgagaacgagattgtcaacaaggggcagagcttgttggcgttggtggagggagaccgagcatctcaaacgcatgcatgttctggcgttgtctcacaggagtag

SEQ ID NO: 65637 - DNA, 240 bp, Glycine max
  Peptide Sequence Number=SeqID_157322
atgacgttgcaattgacgaatttttcggcagatccatcttctcctcacttgaattttcagagctctgcctggcaccacaattctcgacgaccggcatggaggtccgatgagatcaatggtgaaggggaggaattcgacaagatcgagatcatgaaacaaaagtgtggcaccagaaattgttcggcattgtcttcgaacttcttcgagttcgacgtgtacaacacatctacctgctcctag

SEQ ID NO: 65638 - DNA, 291 bp, Glycine max
  Peptide Sequence Number=SeqID_157323
atgtattatcacccatcccaatggtggaaagatatacaacatatctcaaactactgtagtgcaagatacgactggttcgaggatcttgtaacaaggaaagtcagaggaggcttacaacaagaatctcatattcatggagctagaccacagatgaaggaaatggtttctctgtggcttcaatatacaaacatcttttggaaagatacaagcttgacctcaactggcagaatcctcctctgctctcccctaagttttgggacaacaaaacatcatcacccaatgcatgtttaa

SEQ ID NO: 65639 - DNA, 108 bp, Glycine max
  Peptide Sequence Number=SeqID_157324
atgcggttgcaggctcttgaatcccttgaaaaatctaacatcaagattgactcttatggtggttgtcataggaactatgatggagatgttttcttgtgggaattgtaa

SEQ ID NO: 65640 - DNA, 243 bp, Glycine max
  Peptide Sequence Number=SeqID_157325
atgtctgtcgggggtgcggagggtgctggggccggggcggctgcggtggagggcgtggccggggcggtcggtgccgcggccggggactgggctaaggtggtggtagagtgggaaaagaaaagttcagttgttggcatatctgcatgcttatacatcaataaaaggtggtgtgtcatagagatgcattactgtgatagccagtgggattttgcttgggaaggcaggaaatacagtgagatctaa

SEQ ID NO: 65641 - DNA, 144 bp, Glycine max
  Peptide Sequence Number=SeqID_157326
atggagtggttctacatgatatctcgtcccttcatgagtccaacacagcctgggaatcctcctagacatccacccatgctaatggtcacaacaactatggcagaaccacgtgcagctgcacctactgatgtagaccagccttga

SEQ ID NO: 65642 - DNA, 2517 bp, Glycine max
  Peptide Sequence Number=SeqID_157327
atgcgagggacacagatactgttcgttggtttgctttggttcttctgcgtttatgctccttcttcgttttgcgcaaatgtcacgtatgaccacagagcattggtcatcgatggcaagcgccgtgtcttggtctctggttctattcattaccctcgtagcactccagagatgtggccagacctcattcagaaatccaaagatggaggacttgatgtgattgagacttatgttttctggaacttacatgaaccagttcaaggccagtataattttgaaggaagggcagatttggttaaatttgtgaaggcagtagcagcagcaggtctatatgtgcatctccggattggtccatacgcatgtgctgaatggaactacggtggtttccctctttggctacattttattccgggtattcagttccgaactgacaacaaaccattcgaggcagaaatgaagcggttcactgttaagattgtggatatgatgaagcaagagagcctctatgcctcacaaggaggacccattattttgtctcaggttgaaaatgagtatgggaacattgatgcggcctatggtcctgctgctaaatcctacatcaaatgggcagcatcaatggcaacatctcttgacacaggggttccttgggtaatgtgccaacaggcagatgctcctgatccaattattaacacgtgcaatggattttactgcgatcaattcacaccaaattctaatgcaaaaccaaaaatgtggactgagaattggagtggatggtttctttcatttggtggtgctgtgccttacagaccagtagaagatcttgcttttgctgtggcacgcttttaccagcgaggtggaacttttcaaaattactatatgtaccacggaggcactaattttggccgaactactggtggacctttcatttctactagttatgattatgatgcaccaattgatcagtatggaattattagacagcctaaatggggccaccttaaagatgtgcataaggccataaagctttgtgaagaagccttgatagcaactgatccaacaattacatctcctggaccaaatatagaggctgcagtttacaagacaggatctatatgtgctgccttccttgccaacattgccacatctgatgcaacagtgacctttaatggaaattcatatcacttgcctgcatggtctgtgagcatcttaccagactgcaagaatgtagtgctaaatactgcaaagattaattctgcatctatgatttcaagcttcacaactgaatctttcaaagaagaggttggatctttggatgattctggctcgggatggagttggattagtgagcctattggtatttcaaagtctgattcattttcaaaatttggattactggagcaaataaatacaactgctgataaaagtgattacttatggtactcgataagcattgatgttgaaggtgattctggttctcaaactgtccttcacattgaatcccttggtcatgcccttcatgctttcataaatgggaagattgcagggagtggaactggcaacagtggcaaagctaaagtcaatgtggacatccccgtcacactagtggctgggaagaattcaattgatctcctgagtttaactgtgggacttcagaactatggagctttttttgacacatggggtgcagggatcactggtccagtgatactgaaaggtttgaagaatggaagcactgttgatctctcctcccagcagtggacatatcaggttggccttaaatatgaagatttaggtccatctaatggcagttctggacagtggaattcacaatctaccttacctacaaatcaatccttgatttggtacaagacaaactttgttgctccctctggaagtaatccagttgcaattgacttcacggggatgggaaaaggtgaggcttgggtgaatggacagagcattggaaggtactggcctacatatgtttctccgaatggtggttgtaccgactcatgcaattatagaggggcctatagttcatccaaatgtctcaagaactgcggaaaaccatcacagacattataccacataccacgatcatggttacaaccagatagcaacacacttgtattgtttgaggagagtggaggcgaccctacacaaatatctttcgctacaaaacagataggaagcatgtgttcacatgtatctgaatctcaccctccacctgttgacttgtggaattcagataaaggaagaaaagtagggcctgtattgtcactggagtgcccttatcctaatcagttgatctcttccattaaatttgcaagttttggaacgccttatgggacttgtgggaacttcaaacatgggcggtgcagaagtaataaggctctatccattgtgcagaaggcctgcattggatcaagtagttgtagaattggaatatcaattaatacattcggagatccatgtaaaggagtaacaaaaagtttagctgttgaagcttcttgtgcatag

SEQ ID NO: 65643 - DNA, 1236 bp, Glycine max
  Peptide Sequence Number=SeqID_157328
atgacgcaggggatgataatcgcagtacaaggatcaagaaacatgaatgcaagaaacagatttgagaacagggacatcataagcactatgccagatgatatcttagggaacattctttctcggttgacaatgaaagaagctgttaggtctagcgtgcttggaactaaatggagacataactggacctttttctctggggtcttggaatttgagcagtcacgtaggaattttcacttgcgccgagaacatgttggaatcttgactaaatgcaatgtttttgtaagtgagtgggaaaggttcatgacccatatgtcaaaagtgatgaaatcactgaaaagctcatccatgcaaggactgagaatctgcatggatttgggtgacccttggagggcagctgaatgggttaagtatgctgctgagaaggatgttcaaacgttggacttggatttctcatatcacttctcagtaccaatctataaaatgagtgagctcactattcacaatgtttttccatccaggggttatgaaatgaagtcactatgtaacctgcgtttgtcttctgtggacaaagttcagggtgaggcactgagactgaagcatttggagttggttgattgccacattatggatctttacatctctgctcaaaatctccaaacattaaggtacctaggagaattcggaaagttcaagtttcaaaacattccaagcctcgtggaagcttcctttggaggaatcttttgtagtttcctgcaatctgacattggccgtgttgatttttatgaaggttttattgaaggcatgcctgtgtttgataatgtgaagcagctggaaattcgaattcctcacaggagtggagcgtcgcttgatcatcatgtttatttactaagttcattcccttcagtacgcgtgcttaagattaagttccaaaggaacgatctgagggaagtgaaggagaagtggaaggccaatatggaacatgagtatctaaacctgagggagctggaagtgtcaggatacagaagagaccctagtcaaatggagttgcttatcaacatatttgagaaggctcctaatctcaacagggttgttgtggatcccttgtcttcaatgcatgtggataggtcacctgatgtcagggctgagtatagagaaatgaggcgtgagaccaccaaatggcttgctgattctctcaaaccacatctgtctcctttaactcagttgattgtactctga

SEQ ID NO: 65644 - DNA, 189 bp, Glycine max
  Peptide Sequence Number=SeqID_157329
atggcaaaattgtctgtacagcacaattccttctcctcctatgccgttcttcgtcttcgtcttcctcctccgcttcctctgttggtgcttgttgcttgttcatgttcctctattggtgcttgttcctcttcctctgtcaccattggtgcttgttcctcttcgtcttccgctgtgcacctcttcgtttac

SEQ ID NO: 65645 - DNA, 183 bp, Glycine max
  Peptide Sequence Number=SeqID_157330
atggagaggcaaagggggaagaagcaatgtgcgaagaaccaacctaggataggagaagaggggaggacagtgccaatggagtcgtggaaggaaggggaggtgaggaagccactgagggtggtagaggaggaagaggtgtcgtcgtcgtcaatgacacataatcacattttagacgaagactaa

SEQ ID NO: 65646 - DNA, 192 bp, Glycine max
  Peptide Sequence Number=SeqID_157331
atggcaaagagagagagagagagcgaaaaggaagagaatgaagcggagtatgaattgagaataagagaactcacgggagaggaggaagagatagaggcgagcttccagaacatgagggagaagaaggcgcggaacatcgaggaagctgaaaaccctaatttggagatcgaaaaggttcgagcgaggcggtga

SEQ ID NO: 65647 - DNA, 264 bp, Glycine max
  Peptide Sequence Number=SeqID_157332
atggatattgaactccggtccggaattgacaatgagaaaagagttggtgaggactcactctggagtgtgggccccatcctgtcagatcaaaggaacagggacaaggacgtaaatgcgccgaaaattataaagaaaacctccctcccatgtttctcgatcttcgtgctcttctcatttttctcactttattccctctctcacccttcttcattcaactccaacatgtttatgcttcttagggtttcttcttctttaccctcttaa

SEQ ID NO: 65648 - DNA, 2545 bp, Glycine max
  Peptide Sequence Number=SeqID_157333
tctgagggatagagctcaggttgagcaattgctacgctacatcatagaagaaccactggaggatgatgaaaacaaacgggtcttcaagtttcccttcatttcctgtgagatctttacatgtgaaattgatgtaattttgaagaccttggtggatgaagaagagctcatgaacttattattctcctttttggagcctgatcgttctcatagtaccttactggctgggtactttagtaaggttgtcatttgcctaatgatacgaaagacagtaccacttatgaattatgttcaagcccatcagcatgtttttcgtcaactggtagatttgataggcattacatccattatggaggttttggttcgattagtaggtgctgatgaccatgtatatcccaattttatagatgtgatgcaatggttggctgagagcaacctgcttgagatgattgtcgataaattaagtccatctatgatccatgggatattctttgacctacctcacatagccattctacacttgcccggtgttaaaagtcctcctgaagttcatgccaatgtagctgaaactttgtgtaccataactcgagttgcatcatctactctagctattaagctttcaagtccaagttttgttgcaaaaattttgggttatgcattggaagattcacaatcaatgtctagccttgtcaactctctttcagtgtgtatttctttgttggatcccaaaaaatcagctatttcatctccactttttcattcattccgaagtcaaaacatgtatgagccaccaattcctgtaaaccccgatactattggtgcaatgttacctaaacttggtgaattccttgtgcttttggatgtgtcatctgataataaggtactgcctacaacatatggtgaattgagacctccgcttggcaagcatcgattaaagatcgtggaatttattgcagtacttctaaaaactggaaatgaagtggcagaaaaagaattggccaactcaggaaccattcgacgagtcattgatcttttctttgagtatccatacaacaactcattacaccatcatgtagaaagcatcatatcatcatgcctggagagcaaatctaatgccatcattgatcatcttcttcgagattgtgatttagttggaaggtttctccaggcagataaacattgtattctttcagtggaaagcagtcagcacacagtacctgctgctggaaaacggggaacacgtgtaggaaacattggacatattactcgaattttcaataaacttgtccacttggctcgtaaccaaagccacattctggcatgtctccaggagaatagcgagtggaatgagtggcaagctacagttcttcagcagcgtaatgtggtcgagaatgttcaccgttgggcttgtggacgtccaacttcattacaagataggatgagggatagtgatgatgaagaccttcatgacagagactatgatgttgcagctttagcaaataatttgagccaggcttttagatacaaaatttatggaaatgacgataatgaagaggaacatggtggtcttgatcgagatgatgaggaaactaggtattttatgacagaaattagggagaaacccttgttacaaagatcagaatcacaggatgtctactttgacgatgattctgctgaagtagtcatatcttccctgagacttggtgatgatcaagggagtaatctgtttacaaactccaactggtttgcattccaagacaacagaattggtgatgcacctgggggtacatcatcctctgagatgatggatgagataaaattgaatgcagctgcaaatggtggtagcaacagtagtgatgatgaggtagtggtcggagaggatgaagaattggtggacagcaaaaatactgtgaatggtacatctagctcaagcacagacttctttagtggattaactggcagtgattccttgaatgggggcactctaaacattgaaagtgagaagacaagtccttcacatgatatgggatttttcaggtttgaggcaccagacaatgaggacttgtttggagatagacctttacctgattgggttggatggggtgaaccatccgaaatgcaagatgctggttcaagtatgaacccctttctggataatgacgagtctggtagtaatttgcctattaagcctcaagaaggtagtcctaatctgagttctccttcaaatggggaatccataccttcaaatgggtcaccaactactagcgattcaatcaatgggagcagtgactccagtccaacatctgtagcggtaccctcactatttgaagaggatgtggaatttgtaggtgtagaattagaaggtactgagaaggcaatggaccaggctctcaaagaaggggtagttggggaagcaggaccactgaaaagaaacgtagtctcaaaagttccagaaaaggaaaattctgaagaaggcagtcctggtgtgaaggagttcaacgatgcaaattactggagggttgacaacgaggttgctgttctagagtga

SEQ ID NO: 65649 - DNA, 1503 bp, Glycine max
  Peptide Sequence Number=SeqID_157334
atggatcctgctctcaagctctgcgtcttgttactcattcttctcggattagtgaatggttcttttgcggaaaatgattatggacgctgcgaaagcgttgttaagagttgggcgcgttcttcgctcgatgaggaaatgacaaaagatgataagcacacattaagagatttgctgttttttctgcatgttcctagaacgggagggagaacctattttcactgttttttgaagaaattgtatcccagctatctggagtgtcctcgctcgtatgataagttgcgctttgatccaagtaaaccaaaatgcaggctgttagttacacatgatgactatagtataacgtccaaacttccaagggagagaacttctgttgttaccatacttagggatccagttgaccgtgtttttagtacttatgaattctcaatagaggttgcagctagatttttggtgcatccaaacttgacgtccgcaacaaagatggctttacgcctaagctctaagactaaaggagtaagcacactggatatctggccttggaagtatctggttccatggatgagggaagacctatttgctaggagagaagctaggtacagtaggggactgaatatcattgaaagcaatgattcttatgacatggaagattttgcaatgccattacaagaatacatcaatgatcctgtggctgtggatgttgtacataatggagccacattccaggttgcaggtttgacaaacaattcttatatagcagaagcacatgaagtgcgccattgtgtacagaaatataagactcttggtaaatatgtgctacaagttgcaaagcatgtgcttcagtgcttgtacatcttgcagaagagactggatgagatgttatatgttggtcttactgaggagcacagaaaatctgccacaatgtttgcaaatgtggttggtgctcaagtgatatcacaacttaatgcaccaaacactagcctggaaactactgataagacagaaaggagttcatttacggataatgatcccgatagcagtgaacatcagaatagtaccttggacagaggagaaagtgcggttacttcaagtgaagggggagaagcaacagaatttaatatgactgttggagaactaatggatgcttatgaagtctgcatttccaatttacgtaaggcccagtcacgccgacgcatctcttctttgaagaggatttctccagtgaactttacaaaggaggcacgtcttcaggttcctgaagagattctccacaagatacggtctcttaatgaccttgacttacagctctatgaatatgcaaaagccattttcaataaacaacataaaacctcattgctgattactgaggagagttgggacaacatatcaggcagtgcatatggcctctggagggtcgttacgctagcaattacttgtgtcttcttcattttcttattcttactaattgtaaatgtgagaagaagaacgtccaaagttaagaagtga

SEQ ID NO: 65650 - DNA, 921 bp, Glycine max
  Peptide Sequence Number=SeqID_157335
atgggtccaaactggaaaaggccatctcctcctgccccaggagtgcttccgtctcctatgcctggtagagtgagagattctaaaggtttgaggatagatggtgctttgcgcattggtgatgctccattttctgtaaggaatatagaacagacatttgaattgatccagttgatgatggaggtggttctggtccaaagagtccttggtccatttggcactaggatcacatctggagtacctgggatagggattgagattcctgatgttgtagattgcgctggtaggactgttttcaggactggtgctgtgaatgctgcatctggatctgcttacgctgagtttggaaataccaaggtcattgtatcagtatttgggccaagagagagcaagaaggcgatgatgtacagtgatatagggcgtttgaattgcaatgtcagctttacaacgtttgcaactccgattcgtgggcagggttcagaccacaaagagtactgtgcgatgcttcataaagctttggagggtgcaataatactggaaacattccccaagacaactgtggacgtttttgcattggtgctggaatctagcggcagtgatctcccagttgtcatatcatgtgctagccttgcccttgcagatgctggaataatgatgtatgatatagttgcctcagtttctgtgtcatgttttaataagaaccttgtcattgatcctattttggaggaggaaattggccaagatggcagcttaatgattacttgcatgccttctcgctatgaaatcacccaactcaccgttactggggaatggtccaccacaaagattaatgagggaatgcagctgtgtttggatgcttgtgcaaagcttgcgaagattatgaggtcatgtttaaaagaagttgcttcggattcccaggagtag

SEQ ID NO: 65651 - DNA, 186 bp, Glycine max
  Peptide Sequence Number=SeqID_157336
atgttgagaggaaacaagagcttaaaagaatggggaggagtttggagcgtgatgatgaagaagaagggcttaatgaagtcacaagagaaacgattgaatgatgaggcgctgctggaaggtagcaagagctacagagaagcaagtgctaaggtggcaaaccttgcttactttctcaaacacgtgtga

SEQ ID NO: 65652 - DNA, 405 bp, Glycine max
  Peptide Sequence Number=SeqID_157337
atgactgtctgggaggagtatgctcttcagcttgatgatgctatagagaaaaatcatattgataggaagccattggtgattatgttaacacttgctaagatcaaagatcctaaaggtcattatcatgaaagtggtgatgaggtcaaggttttccctccttgtgttgatgaattattgggaaagacttgggctctcaggttcaagtaccgtgtacaaattcgtcaatcatctgtcttggatgttactgaagacaaagatattattcagacaatcacgtcaacaattggtctacaggtgttagctgattatgatcttggactttctgcgtttgtcacttctgccaaaagaatgtctgatcagcaagctagtagtgaattccattctgatgaatacacaccgtactag

SEQ ID NO: 65653 - DNA, 778 bp, Glycine max
  Peptide Sequence Number=SeqID_157338
atggctgagaagacaaagaaaaaactggaggaagctgctcagtctggaagcactgagggcgtcattgaccctccatctcccatcagacgacatgtgaaatcgaagatggcccacaccaagaaaattgggcagatgacgtctgaggcagcaaaggaaaccacagagaagattgcatcacaaggtttgtttgtcccccatggacttcaggatctcctaactgctgtcattgggcgaccagaacactctggccgtgtgcgtgctactggatccagtgtcaccataaagcaatacttcggattggctccacgaagctcccgtaattcttcctccatggctcccgaagaactcgagcagctgactaaacaaatcagggaccagctggaggagtcgatcatggaaagacctgaggttggtccctcagctgctcgtgtcagcataaaggggagttgtgttgatccctcatcgaccgatccagacacgggtgactcagacaaatgcaggttgtacatcaaggaaaatccttctcacctggttaaagatgcagaggctctcattcctgtacccactgacgatgttattttagtagggcaggcaattaacaccttccttgcttggccgacacatctcgtgaagcgtttatcagaacaactgtgtctccagcaaaacctccagataggctggatcatgaggtcgaggatcccctatatttgtgacattgaccatcccatagctttttttgaagcctctctaggttatgtgggatgctaccgtgttcatg

SEQ ID NO: 65654 - DNA, 996 bp, Glycine max
  Peptide Sequence Number=SeqID_157339
atggatatgaatgctggattgggtagttttgctgcagttattcgttcttcaaatctatgggtcatgaatgtcgtgcctactatatgtgttaataatattttactattatcatcgtctttttcagatgcaaactatttgacaaatgggcatttagactctgccattgaattgcaacaacctacactacagctaaacgtcagaattttaggaccagaagtggttattggtcagaagcaagctataactcaatacaatcaatacttagttaaagcttacagagttggagtgcaagagggtgtggctggagggtttggctttggtttagtttgtctatttatttattgtacctatggtttggcagtgtggtttggagggaagatggtactagacaaagatgatatttctggagatatagagcttaagaaggtctattttagttatacttctagacctgatgagcaaatattcaatggattttcaatttcaataccaagtaccactactacagctttggtagggaaaagtggaagtgagaaatcaataattattagattaattgagagattttatgatccgcaagctggtgaaattctcattgacggtatcaatctcaaagaatttcaactaaaatggatcagacagaaaataggacttgtcagccaggaaccagttctctttgcttgcagcattaaacagaatattgcctatggtaaagatgggccaacagatgaagaaatcaaagatgcaggtaaacttgctattgctgctaagttcatagataaatttctccatggacttcacacgatggttggcgagcatattagaacaagcactaatttaagaggggcaatgggatacattgcacctgaatggctaaggaatgcaccaataactggcaaagttgacaaatatagttttggggctaaggaatgcaccctgcttccggtgtatgtttgtgataacactaccctacccttaggagagtttcgatcatag

SEQ ID NO: 65655 - DNA, 342 bp, Glycine max
  Peptide Sequence Number=SeqID_157340
atgatgattcaaattgtgaactctgaagaaacgatcaagaagattaaggtaaaagttaggggagtcaatagcttacctagagagttacgcatcattgtgaattttgatgaccaaggacaagcaattggtgaagcacaagccttgtttgcaggatttcttggaacactagcagctgattgcaaattatttcctatggattatgatagatggtctggaccttcaggcgtacctaaagcttattttgatgattgctttgaaacaattttaaagccaaatgatgcttcaagtgttcctaatacacctttggatgcaagaggatcttctggtgctagcaacccttag

SEQ ID NO: 65656 - DNA, 252 bp, Glycine max
  Peptide Sequence Number=SeqID_157341
atggctacaccgtctagctctcctcctcctcctcctcctactgatgcaacatcgtattcaccgtctaccttgaagcggacaagaaaggccacacgcctaagatcattggcgactataccaattggggcagagagagcccaggtccatgtggatcctgctaccgggaaagtggacggtccccacaaaaagaagataagaacatatttggggatcgtcacttgtgataaggtggatgtgacatacgagaattag

SEQ ID NO: 65657 - DNA, 675 bp, Glycine max
  Peptide Sequence Number=SeqID_157342
atgtggaataggttgcgtgatatattccaagacaataagaattctcgggttgtaactcttgagcaagaattctcccataccaacatggaggatttcccgaatgcctttgtgtatcgtcaatggctcaaggaattgtccgatcaactcaagaacgcttacaatggggttgccacactcatttgccaaagcgatcctcttccaccattctatcaagctcactctatgctcaccttagaagaagttggtctcacgaagaaggttttagctggcgggggtgctgccatgggggttcacgacaatgatgactctcactccctctccaaaaattctcatcaaaattggaatcatggtggtaaaaaggatcaaaatcacaacaacggtggcaaaaacaatggtggcaatcgcggtggctcaagagtagcgatggtggtggtcacaatagtggctgacaacaacaatccagctagcaacaaccggggcaccagcaatggcctaccggataatggcacaagcccaacagcgctagaaaggcatccttgggccaaaaccaccacagacctacacggcgacagcagctccacccactttgatagcattgaagtagcgatggacactcttgggcttaatcctttggatgccaattggtacatggacactagtgccatctgtcggtaa

SEQ ID NO: 65658 - DNA, 240 bp, Glycine max
  Peptide Sequence Number=SeqID_157343
atggagatgattaaacttggtgatcaaatgagaagaatgagttatgacaatgaagaaaggaaggagagaatgagaaaggagaattatgagaatttaggaagaatacacaagagtagtgaagctttaagtataagaggtattgagaggatgaaggaggatggaggaatgaaagttatagggagagaagaaatcatagaagatatggaggtagacaaagagaggaagggattgagggagtga

SEQ ID NO: 65659 - DNA, 774 bp, Glycine max
  Peptide Sequence Number=SeqID_157344
atgaaagatgggtttttgaagcatcaagaacttaaaggtcaacctcaagatgctgtaaaacttcatgaggaaataataaccttaaagactacattatccaagtttgtcaatggaataaacaatcttaacaagttgttaggatattgtagaagttctattgacaaatttggaaatgaatataagaggaaggcatatgttcatgatgaagataaaattgtatgctatctctgtagaaaaattggacatatgacgtctagatgcgaggattgtcctaagatgggttcactcaaccccttcatgacttacacgaaaggacccaaagagatttggatacctaagaaaagaatttttcatgttacaaatatccttgatagcaggatttggctgctcacgacacgtcttaatcataacctactgagcataagtcaattatgtgacatcggatatagtgtatccttcaacaagctaaataagtccattgcagatttacagttggatgatagcacaacaattactatctcatccagaaagaaaatagaaatactcgcgtccactcaacaagaagctcaaaaccatccacagagtcaaatcataagttatccaatagatcatgttcaagctagattgtcattagaaacacaaggatacactgcactgatctctaagatggagcctaaacacattgacgaggcaatgcaagatgacaactgggtgaaagcgatgcaagaagagcttgaccagtttcaaaagaatgatgtctggaatctcatctaa

SEQ ID NO: 65660 - DNA, 573 bp, Glycine max
  Peptide Sequence Number=SeqID_157345
atggttgttgatggggtttacccttgcttaccagtatgggatgctgccacgaagaagggatttgagctatattgcaaggaacaattgccttcaaggcaaatgaagagtcagataatgtggatgaattcccaaaaagcctccgcctctagcaatgatggaagtgatattactgtgtcatgcaatgttgttcaagtgttacaactttccaggaagtatcataccggtgaagcgtccaatgcggctatggctgatggagttgaaccactaattttggatctagtgtctaaaaagtcaataacttcaaatgaagccacttctcgagataaggatgaccatgatgtcctaattgtctactcaactagttctggcactaccattcttaattatgctcaatctaccaccatcatttgtgatcagaatgtcattacaatgcaattttccaaccttggtgtcatcctttcactgaacatccaacaagctcaactgaaaatgcttggagttgttgttgcacctgcacctgcttctgctcctacaccagtatctcaacccgattctatcgaacctccaccataa

SEQ ID NO: 65661 - DNA, 162 bp, Glycine max
  Peptide Sequence Number=SeqID_157346
atgaatgaaaatttccttgagttttcccttcttgtctttggaggtactggtcctcgtacaactttttttccatcatgtaagaaaactccagtacttttccaattggttggactcatgaacactcatgatgaggacactcgccagtttttcaagaactcttaa

SEQ ID NO: 65662 - DNA, 897 bp, Glycine max
  Peptide Sequence Number=SeqID_157347
atggcatccttcatccagcttcagtcgcagatgcaatctcagggacttgcaatgcctcctaagcttctggttggtccctcaggaaatgatcctgagacgggtgactctgacaggtgcggcttgtacatagaagcatatcctgccctcctggttgccatggggagagtttatgagggatccactattgttcataacactcctttgtttcctggccaagtaaaggtgagtgtggaggaggttacagatgcagatgctcctgttcctgtacccactgatgaggtttccttagtggggcaggcacttcacaccttccttgcttggccgacacatctggtcaagtctttatcacagcaggtagttgtgtctccggcaaaaccacctccgaagcccgatcctgaggtcgatgatccgctttatctgatgacattgaccatcccagagcttttcttgaggccttatcaggttagatgggatgccaccgaaatcgcacacggtggtcaatgtctcagcatatcagtgttacagttgtggattctgtatctcactgaaacatgtatgcgagtggggaattctgatatctatggattcctcgagccacaatccattcagaggtctgggcaatcgcagtttgagtttgaaagttacataaagagttggatgcagagttcacaacgcgatgtctatcttggagcttacctaaatgggtcagacaactaccttaaggggattattaatagtgctatcaagggtcttgatgatgctccacagcctaaatcaaaggcttctgctaggtggattgtcatcaagtattttaacgatcctataccattggagccagagagattaaaagcattgcggatccaatgggcacagttttatctccgagttagagattag

SEQ ID NO: 65663 - DNA, 93 bp, Glycine max
  Peptide Sequence Number=SeqID_157348
atggggagtgcaatgaccggttggatatcccaggagaaagaaggaaaaatgctggtacttgagggcatatcactcggtttggaactcccttga

SEQ ID NO: 65664 - DNA, 1494 bp, Glycine max
  Peptide Sequence Number=SeqID_157349
atggctgagcagcaaatctttagtgattttgcttcttcctctaactcttctagaaaatatggtgtttttctaagctttcgatgtgaggacacccgtaagaacttcacaagccatctttatgaagctttgatgcaaaagaaaattgaaacctatatggactaccagcttgaaaagggagatgaaatctctccagcaatcgaatgcaagaaaaagcaagcacaaattgtcataccggctttctacaatatagatccatcccatgtgaggaagcaaaatgggagttatgagcaagccttttcaaaacatgaggaagaacctaggtgcaacaaatggaaagctgctctgactgaagtaaccaatttagcaggatgggattctcgaaataggaccgaatctgaactccttaaggacattgttggagacgtcttgcgaaaattgactcctagatatcctagccaacttaaaggactgaccacccttgctacggctctatatgtcaaactgtctcatgagttcgaaggtggttgcttcctcacaaatgtaagggaaaaatcagacaaagaaaaacaacctaaacatgggtatgaagatctatcaagaagtgtaatttcctattgcgaaggtattcctttagctttaaaagctctgggtgcaagtcttcgtataagaagtaaagacatatgggaaagtgaattgagaaaacttcaaatgattcctagaaaaggaagagaatgggtagcaagtatactggaagcttgcaatttctttgcagcatctgggatagaagtccttttagataaatctctcataacaatttcaggttgcaataagatagaaatgcatgacttgatacaagcaatggatcaggaaattggaactgatgttgttgaaggcataattttagatttggatacattaaccagggatctaggtttgagctctgattcccttgcaaagataactaacattgaaagccttcatgttcattcaaaatctctctgtgaacttgatcttaatggtagtttatctctcaaggaattctcagtgatatcagaggaaatgatgggttgtaacaatcttaacactgaactgagtctgtcattcttacaagcactccctcacaagattgccaatttatcgtctttacaaatgaaacttatgtctctgccagagcttccatcatccctgaaagaaatgagggcctttaactgcacttctttggagacagacttcactcaacggctagtgttacaacacatgttacagagccacctgcacaacttacctgatggcgaggattatgacagtgggtatttcatcttctcgggagaccatgtcactgatgagttgtatccctcagaattggggttgaagctgtttggtagtagtagcaaggaaatatttgaattggaaatcattactcaaatctcggataatgagtcacagtctagagcaattggaaatggagttggaggttctaatacagaaaattaa

SEQ ID NO: 65665 - DNA, 1698 bp, Glycine max
  Peptide Sequence Number=SeqID_157350
atgggaatgaagggtgcccccgtctgtctctccgtcgacgacaacgtcgttctcaagtccccaaacgaccgtcgtttgtatcgcctcatccacctccccaacggccttcgcgccttgctcgttcacgatcctgagatttaccctgaggggcctcccaagcatgctccaaatgaggatgaagttgaagaagaagaagaagatgatgaagaagatggagaatatgatgatgatgatgatgatgatgaagatgaagaagaagaagaagaaggagaagaagaagaagaagaagaagaagaagaagaagaagaagaagaaatggatggggtgaagggtggtggtgctgttgctgctcagagcaaaaaggctgcagcagctatgtgtgtaggaatgggcagcttttctgacccggatgaagctcaaggactagcgcattttttagaacacatgctcttcatggggagtgatgaatttccagatgaaaatgagtatgatagctatttgtccaagcatggtggctcatcaaatgcatacacagaaactgaatacacctgctaccattttgaagtgaagcgagagtttctgaagggtgccttgaaaagattttctcagttctttatttcacctcttgtaaagatggaggcaatggagcgagaagtacttgcagtagattcagaatttaaccaggttttacaaagtgatgcttgccgccttcaacaacttcagtgccatacttcagctcataatcatcctttaaatagattcttttgggggaataaaaagagcttggttgatgcaatggagaagggtattaatttgcgcgagcaaatattgaaattatacaaggattattaccacggtggattgatgaagcttgttattattggtggagagtctctggatgtgcttgagagttgggttgtggaactgtttggcgctatcaagaaaggtcaggcaaacccagtgttcacagtggaaggtcctatctgggaatctggtaaagtttatcggctagaagctgtcaaagatgttcatatccttgatttatcatggacattgccctgtctacaccaagagtatttaaagaagccagaggattatttagctcatctccttgggcatgagggcagaggaagcttgctctcctttctcaagtccagaggatgggctacatctctatctgcaggagttggggaagaaggaatttatcggtcatctatagcttatgtctttgtcatgtccatacacctcacagactctggtatagaaaagatctttgatatcattggctttgtctatcaataccttaagttgttgcgtgaagatactccaccagaatggatatttaaggaacttcaaaatattggaaacatggatttcagatttgcggaagagcagcctccagatgattatgctgctgagcttgcagaaaatttgcacttttatccaccggagcatgtaatttatggtgactacgtgttcaagacatgggatgaacaattgttaaaacaagttcttggtttcttcgttccggaaaacatgagggtagatgttgtttcaaagtcattccttaagtcagaaggtgcatttttttttctcccttgtctaattggaaattgcttgttggcctttttcctttcctgtatcattgactggcaaaggtctaagctactgactaatggctatcgttatgcacgctaa

SEQ ID NO: 65666 - DNA, 216 bp, Glycine max
  Peptide Sequence Number=SeqID_157351
atgaaccagaacccgcaatcaagtgatggaaggaacgatgacgattctgctctctctgatttcctcgcttccttaatggattatactcccactatacccgatgaattggtggagcattacttggccaagagcggttttcaatgtcccgatgttcgattgtggctccttcagaaaattggaacactggaattgaattttgtgcaaggtttcttgtga

SEQ ID NO: 65667 - DNA, 1254 bp, Glycine max
  Peptide Sequence Number=SeqID_157352
atgcttcagagagaagtgagtacaaagagcacgtacgcggaagcacagagttacaatgaagacatgaagcttaccttgaacccaacaccgacaatggcagcgagactggcaatgaaatgtaccttaggtcaccacgagttccccaatccttgcagcagaaaccagaaaaggtccttagcgcaatggagaacaacaaccttagatgttaacggagaagaagagagcatgagaggatacacagagaagaaaagagcgcgacaggaggaagtaattgaagatgacaaaataagccaacaaagtacggagctaattctctcccttccaagagagaaaggttggagaacaccatatgtgtatctattccaagggttttggtgccaaccacatgaaatacaagccataatcacttttcaaaagcactttcaagccaaggacagtgatgttcttgtggccactgtgccaaaatcaggcaccacatggttgaaggcccttacctttgccactgtgagccgccacaacttttcttccttcaacaagaaccaccctcttctcaatttcaatccccatgaccttgtacccttttttgagtacacagtttatgataagcatgacaaggttcctgacttgtccaacatgcatgagccaagactctttggaactcatgttccatttgcttcattgtccaaatcaatcaaagagtccaattgcaaggtaatctacatctgcaggaacccttttgacactttcatctcttcttggttttttgccaacaaaatcaagccagggtcactacccacattggcacttgatgaggcttttgaaatgtactgtaaaggggtggttggttttggcccattttggactcacatgcttggttattggaaggagagcatagagaaaccaaacaaggttctgttcttgatgtatgaggacctcaaaggggacatcaattttcacctgaaaagggtagctgagttcttgggttgtcctttcaccttggaggaagaaaatagaggtgtgattgagaacataatcaagttgtgtagctttcagaaaatgaaggaattagagggtgaaataggggattgggttaattatctttcgccttcgatggcgcagaaattaaccaaagtcatggaagacaagttaggtgggtctggaaatggaaataatgaaagtttcactatgaaggaagggaatgttgatagtggtggatgggagtgtgttgataatgggaggactgaagatctttaa

SEQ ID NO: 65668 - DNA, 289 bp, Glycine max
  Peptide Sequence Number=SeqID_157353
cacccaaggggctaactccgctgtccgcgacacctgccgcgacaccatgggcgccctcgccgtgcaggacggtggtggggcagttcgtgaagctgctgttcgaggcaatgggggagcagaacaagggggtgtaggcgggggtggcagtgtgcatggccaagatggtggagtgtggcggtggcggcggaggaggggaggcggtgccagtggcagcgtttcaaaagctgtgtccgaggatctgcaagctgctcaacagtcccgtatccgagccgtattggagttgtattga

SEQ ID NO: 65669 - DNA, 524 bp, Glycine max
  Peptide Sequence Number=SeqID_157354
gattgaaaactactactaacctgtcacaaagtgaggctacagagtactcagtgatcacagttggttcaagtcactgtggcaaatatcacattcgtcaggagcaagatcctataaatgtgttcagatatggtgcccaagcagtgcaacacagtcaaacgatgattgcaccaggcaataatggacctacgagtggaacagctaatattgatgatgctgacagtggcaaagcggccaaacaagcattagaattgatgggcaagtgggaaatgattgatgtctgtgatgcactagaacttttgtcgcttgtttttgaaagtgaagagtggttcttccatagattgaaagttggacgcccaattcctatccccaacttaggactacagataacccaacttggtcatgttaaggatttggcaaaagcttttatccatgttcttggtaatgagaaggccaacaaagaagtattcaacatctcaagagagaagtatgtcatgtttaacggattagcaagagcatgtgctaag

SEQ ID NO: 65670 - DNA, 1011 bp, Glycine max
  Peptide Sequence Number=SeqID_157355
atgtttgtgttgggtgtttcttcctcctccttcgccgccgccgccgcctccgccgctgcaaccaccaccacctccactcaccaccttctctgtggaacccttcactctgcttctttcctctcaactacccatccctttcccacaacttcgttgcggtcatcttcactgcacttcaggtgtgttcccatcagagccatggctgagattgatactatatcagtgtcaaaatctgcttcttcttctgctccaggcagcaagcaagccttgatatcattgtcagacaagaagggtcttgcatttgttgggaatgggctccaggaattaggatactctattgtttcaactggaggaacagcttctgcattagagagtgctggagtagctgttactaaagttgaacagcttactaagttccctgaaatgcttgatggtcgcgtcaaaactttgcaccctaacatacatgggggtatcctggctcgaagggaccaaaaacatcatatcgaagccctcagtactcatgggattggtacttttgatgttgtggtggtgaacctgtacccattttacgataaagtcacatcagctgggggcattgaatttgaggatggaattgaaaatgttgacattggtggtccagccatgattagagctgctgcaaagaaccacaaggatgttttgatagtggttgatacagaagactaccctgcccttctggaatttcttaaaggaaaccaggatgatataaagttcaggctaaagcttgcatggaaagcttttcaacatgttgcttcctatgactcagcagtatctgagtggttgtggaaacagagtgtgggagataaattccctcctagcttgacagtgcccctctctctcaaaagtcctctccgttatggtgaaaatcctcatcaaaaagctgcattctatgttgacaaaagcctttctgaagttaatgctggtggaattgctacagccatccaacaccatggaaaggtgggaatcacctactaa

SEQ ID NO: 65671 - DNA, 699 bp, Glycine max
  Peptide Sequence Number=SeqID_157356
atggaatacaggatggacacgtgtaccttcaggaagttgaagcctataaggagcctttccaatgcgttccaagatttgatagggcccataatatctcttagcaagcttagagtaagctaccagagttccgaaaagagtggattgatgatgagagtgcaatttcaccatgacccagttctcgacattaaaattgacatccctctgtttagtatcagcaagttgcttcataagggcttgtgccttcaaaagattcttcttgatttaagtgaaaatgacttccctattagaagttctggcaatgtattgaggaatgttgaaaggcttcttgccgaaagatcattctacccagttccaaaatttaccccacgaggatggcttcttatgaacgaaagctcaaaggctacgaggtattctgtgaatcttgccaacaatctccatgaagagaacaacgacaatgccaacaacgaagtcgagagaaataatgaggacatcaaagaccatacccaagcccagaaggaagcccaagacccaatacaaggcataggagggcctataacaagatcaagagctgaaaagacccaagaagctttgcaagaaatagtggctaatatgaggacaatccaattgtatgaggggacccaacatctagaggcctacatgcgtgggttgctagtcacatgtattgcttgcttggagtga

SEQ ID NO: 65672 - DNA, 126 bp, Glycine max
  Peptide Sequence Number=SeqID_157357
atggcagaccaaaatggaaatatggtagacaagattgccagctcagcttccaacggttcagacatagtccttgaggcttgcattaaaaaaacacatgcctgtaatgagattagcatactccaatga

SEQ ID NO: 65673 - DNA, 1463 bp, Glycine max
  Peptide Sequence Number=SeqID_157358
atttccaatatgaaccttggtttggttctcgttacgttgaagaagatattgctcaaagtttcagggagttatggagaaatcctccagaaattgatgcctcactgcatcttccttcccaaaatgagtttattcctagtgacttttctatacgtgctagtgacacctgtgttgatgattttgcaaattcaacttctcctagatgtttaattgatgaggcattgataaaattctggtacaaaccggatagcactttcaaagttcctcgtgcaaatacatattttcgaattaccatgaagggtggctatgctgatgtaaagagttgtgtattatccgaattgtttattcaccttcttaaagatgagttgaatgaaatcacatatcaggctagtattgccaagttagaaacttctgtcacttatgttggtgacatgcttgagctgaaggtctatggtttcaatgaaaagcttcctgttctgttatctaaattcttttcagtatctaaatcattcatgccaactgatgatcggtttaaggtaataaaagaagacatgaagagagctttaaagaatgccaacatgaagcctctaagccattcaacatatttgagattacaagttttgtgtgagagtttctatgacgctgatgagaagctgcattatctaaatgatttgtttcttgatgatctgaaggcatttatccctgggcttctctcccagatatacatggagggtctttgccatggaaatctgtcaaaagaagaagcaattggcatagcaaaaatatttaagatgaattttccagttaatccactccctattgaattgaggcatgctgagcgtgttatttgcctcccatccagtgccaatttagttagagatgtcaatgtgaagaataagtcggaaaaaaactcggtggttgagctttattttcaaattgagcaagattttggtctggggacaaaagagcagcttggttatgttgttgaatgcagcccacgagtaacatatcgtatctctgggttttgtttctgcgttcagtcatctgagtaccacccagtttacttgcaaagtagaattgaaaacttcttaaatggcctggaagaattgttggatgggcttgatggtgattcctttgagaattacaaaagtgggttaatggcaaagctgctggagaaagacccttcactcacatatgaaagcaatagattgtggaaccaaattgttgaaaaaaggtatatctttgacttgtcaaagaaggaagcagaagaattgaagaacataagtaagcatgatgttgttgaatggtacaagacttacttaaaaccgtcgtctccaaagtgccgacaactacttattcggctatggggttgcaacacagacttgaaagaagctgaagcactacccaaatctgtgcagtcttgtcatgactgctggggtaccatccatatacttataatgaactaa

SEQ ID NO: 65674 - DNA, 177 bp, Glycine max
  Peptide Sequence Number=SeqID_157359
atgaaagaaatgaaaagagaaaaacatgtctcctatagtagtcatgactcttgcaagagtttaagtgaagaactgagcgactatttgataatttctattcaaaagtttaagaaaggaagatttggaagtgttgctgaagagctcgctcagcgagccagattagctaagcgaggctaa

SEQ ID NO: 65675 - DNA, 372 bp, Glycine max
  Peptide Sequence Number=SeqID_157360
atgaacatttatctcatttcagatagacacccctcaattataagtgcctacaacaacccaagttacgcatacacgaaaaagatgcactggcgacatcttggggatatccgtgcgaataagccaaagactcaatccccacttcaaacacccagaccacctagaaggtttagagtaatgttacaatcccaaaagtgtgattgtggtgaatatcaggctaaacacttaccgtgttctcacgtcatgactgtctataaatttgtcaatgttgatcccatgaactatgtgctgacactattcactttacaacacattttgcacatctatgacactcctttggtttactgccaccacgaatcattgtgcaagatatga

SEQ ID NO: 65676 - DNA, 351 bp, Glycine max
  Peptide Sequence Number=SeqID_157361
atggtgaaaattaggaaggcggagagtgaagtgagaaatagtggagtggatgggttttacaaattcttaggctgtgaatatggaaaaagaagtatctacaggcttgctaaacatagagaaagaaaggaggatcctgaagtagcaaagtttagaaagcaaggcctcaaattcttacctgagatggaattcctttttaagggtattattgctactggttttgcaacatatgcaccatctgaagattcaagacaaaatgaaggattcaacataagaacagaagagacaaatgataacattgatgataacactgagttggaagtgaatgagcctgagataaacacgacaacttag

SEQ ID NO: 65677 - DNA, 171 bp, Glycine max
  Peptide Sequence Number=SeqID_157362
atgaagaagaagaaggttgaagcagctagtgtctcgctaagcgaggcatatgcgcttagcgacaagttggaagaatctggaagggaatctgccattcatgcacgcgccatcagctcactcagcgagtcatttgtctcttctcgcactcagtgcgcccgacttgctaagtga

SEQ ID NO: 65678 - DNA, 228 bp, Glycine max
  Peptide Sequence Number=SeqID_157363
atgggcagaggcatgtcagttcatcaagtggatgaagaaagtgaagggtctccaaagaagagaaaaacaaaggcttatgaaacatggcaaaaggatgtgatagtcaatgtgcttagcaagaagattagcctcaagttcttacataatagattcgataagatgtggaagccaaatggagtaatggaaggcatagacttggataacaaatacttcttgattaggttgtaa

SEQ ID NO: 65679 - DNA, 522 bp, Glycine max
  Peptide Sequence Number=SeqID_157364
atggcagcaatttacagtctttacatcatcaataaatctggtggattaatctattataaggattatgggtctgctggacgaatggataccaatgatagcttgcgggtggcgagtttatggcactcaatgcacgctatctctcagcagttatcacctgtttcaggttgtttaggaattgaacttctccaagcagatacatttgatcttcattgctttcaatcactgactgggacaaaattttttgcggtctcggagcctggagcacaacacatggaaagtttattgaaatttgtctatgaattgtacacggactacgttttgaagaatccgttctatgagatggagatgcctatacgttgtgagctcttcgatatcaacctaacacaggcattagttgcaatgttccatgtaactcttactcagctgattactggaaattccaatcagtttactgttctcaacgatccaaatctggttatggaaactactactgttgctctcccggttcagaaacttaaatga

SEQ ID NO: 65680 - DNA, 366 bp, Glycine max
  Peptide Sequence Number=SeqID_157365
atggacacctcatcacgaggttttgcattcgctgtgaaagggtgttacgacgacggcaacaacgatcgacttcttcagacaaaatcttcttcttcgatgacaacaacaatgatcaacttctcttacaatgatgacttcttcttcttcaatgacaataacacccactccgaactaggatttgaatgcgaaagagaaagatggggtgcgacctggcaacacaaccccttgatccctttgtgcctcctcttctctgatggtggcttgttcatcttcttcttcgaaggtgatgacccacaccccaactcgaatttgatttggatgcgaaagagaaagatggggtgcggtatggtgtactgtgtagtttag

SEQ ID NO: 65681 - DNA, 420 bp, Glycine max
  Peptide Sequence Number=SeqID_157366
atgaggtctttcagcaaactcatttacaaaagaatactggaagaatttgaggctagactatctcaagctaggtctgatgctgcatcaagtgttggtgaatcacaattcactcctttagacctggctgaagaacaaagacttaggagtcggtgttgggttgtagttgtgggaccaaagcataagggatacctttatggtactggagacctaggtcatacttataaatgtgtaaatgacatcttcatgcagcatacgcaaggatcttccatttgcgctcagaatgctgcagagattaaccaattgagggaggagttgcgtcaatcaaaggaggagatgcgtgtatttcagccagttgtgcttcaattcctacctcctggagcgcaaaacattattcatcaacatcaacaacctcaccaataa

SEQ ID NO: 65682 - DNA, 342 bp, Glycine max
  Peptide Sequence Number=SeqID_157367
atgggaagatccccatgctgcgatgagaatggccttaataaaggtccctggactcccgaagaagatcaaaagctagtccaacatattcagaaacatggccatggtagttggagagccctccctaagcaagctggagagctgttgaaacgggcaagtgttgtcgactttactgatgaatctcagccccccttggctgatcctacaaggaccattgaagtggacaatggatttaaaaaatcaaagttgtggaagcccccaagatacaaagacacacgggttgatgaagtatttgctgccaaaaagtccaagtttaaaattgcatctggcaaggaaaatgcaaag

SEQ ID NO: 65683 - DNA, 255 bp, Glycine max
  Peptide Sequence Number=SeqID_157368
atgggcttcgggagtagcgagcaccgggggagggaggtggagaaaggaagcaaggacgtaggagaagttggtcttggccttgggcccacgaagtgttatggcgacaacgtcgtaggccctaacggcttcatcggtggtgtcaaaggtgccaagccactttcagactttgatagagagagtgagggagaggtgggtgcccttgatggggtcacagtcagagagagcgaaggggataagggtttgggttttgggtga

SEQ ID NO: 65684 - DNA, 486 bp, Glycine max
  Peptide Sequence Number=SeqID_157369
atgatgaatgaagaggatgagtcttcatttaggtgtcattcaagtgaaacagctgcttcgggtttggagggcataatagtaggagaagggttatgcggcgatttgggagcttccttttatgtgttgggtgatgcgtatggtaatgtatttatggatgaagatggagaggataaagttgaagatgatgacaatgacaataaggaagatgaggagtcgattgagtataaggtggaagaggattatgattttgatagtattagatgtggaagaagtggtggtttttatgcagaagatgctataagtataaatcatcttgttaatattagaaagtttgacattcatgcaatgacaactagagatgtagcacaattggatttttgtgatttgaagatagcatatcaattttattgttggtatgctaagcttgttggtttctttgttagaatggaccatattgttagaaacaaatttagggaaattgtgtag

SEQ ID NO: 65685 - DNA, 879 bp, Glycine max
  Peptide Sequence Number=SeqID_157370
ctacttaaggtcaccccagacgaggctacagctgagacacgtcaggcagctcggatgtacctccttcatttggttggttgcactcttttggctaacaagagtgcaacccatgtccatgttgtgcacctgcaggcattcagggacctgggtcaggcaggggcattctcttggggagcgactgctttggtccacttgtacgatcagcttaacgaggcgtcgcaggcccctacacggcagatggtcggttacatttcactacttcagtgctggaattacgaacactttccatcggtccatcggtgtgtcgttgatgatggttatgctgaggctagcccacgtgcctataggtggcatacggtgaccaacgtctgttggatgccgtatgctgagcatcggggagttcggggctatgacttgatctcctcgtacacggggcaagtcagatggggtactgatatagacgaccggtgggtatactttttagatcatgtggtgcctacaggggagctctgtgtagttcttgggcaggtggccccagactacatggagtggttttttcagattttgcacccttttgtgacgctgacggaggacactgctgagccgagacctgcgcctccccccccccccactcatgatgatgagttcgtcgagccacctgtccccgaggttccagtcgcgtcggatctccctacacattttgtggttgattgcacaggatgtgtaaggattgctgagcatttggagcgggccatcaacctcaggatggtgactaaagggactgacttatatgatatcatggatatttgtcagaggatagctagaggtaacgacccagatgacagtcttatgccgcgacagagacaccgcatatattaa

SEQ ID NO: 65686 - DNA, 165 bp, Glycine max
  Peptide Sequence Number=SeqID_157371
atgaagtttttcgaaaaaagagcaccaacgattgcacaggcaatgactccaaagaagcttcttactaaaagggcaaggaaggacgccgcaagggagggatccagtgcagccccacaagtagaaattgaatttgatggacaccatttccgaagtgaggagcattag

SEQ ID NO: 65687 - DNA, 357 bp, Glycine max
  Peptide Sequence Number=SeqID_157372
atggcctgtgattcgggttatagagctattattattgacactgattgtgctgaagttatcaagcttgtggaggatcctagatatcatgaagcccaatttgtagatcttgcctctgagattgtgaagaccaaggaaacatttacttcttgttccattgtccatgtactttgccaggcaaatactatggtagattgttttcccaaagatgatttaaccaacgataggaatgtaactttctatgatagcttacctaattttgctggaacttccatgagggtggatgcaaatagtggtgtcactagttctgataagccatatgataaggtgacaaacatcaaagtgacgtctcccaagtaa

SEQ ID NO: 65688 - DNA, 150 bp, Glycine max
  Peptide Sequence Number=SeqID_157373
atggctttgagcaatacaacaagaggtggttggcatcatggagttgggtgtgatactccaatggaggagagggatgtagaggaaatagaaggagaaaaggagaaaaaaatggcattgtcgttgaaaatcacctccaatgacaatgtgtag

SEQ ID NO: 65689 - DNA, 342 bp, Glycine max
  Peptide Sequence Number=SeqID_157374
atggatggtatattaaacttacttcaagccactatgatccctactcatgatgccctgctatattacaacgggaggtggaatatgccacggcaacacgactttgtgggttactcgttcacaggaaaaaatccaaaaagatttgacattccatcgggatttaccatcgatggactaaaggatgtgatcaagcaagttgcacctcaagggattccccattatgctattcatgaatcacaaaagataagacgattattttttcgacagccaggtcattctgagtattcagacaaagttatcaaatttgaaattattaagctaaaaactgacgatgatgtgctgaag

SEQ ID NO: 65690 - DNA, 900 bp, Glycine max
  Peptide Sequence Number=SeqID_157375
atggccgtagaggaattgaacgaagagcagcaagaagcacctgttgaagaagttgaatatcctgagctaaagctagtttcccatggaaggaagatgactaagtttcggaggcctgctttagagattgaaggccttgtggctgctagcagactaattcctctgatcgcatgttccctagatatgagcgatcaaggactaatgtatgcttttgtggaacgctggcataaggaaactaatagtttccatttgcccgtcggaaaggtgactatcaccttggatgatgtggcatcattgctacatttgcctattgtaggagcgttccataacttcgagcaacttcatgtcgacaacgttgtcgagatgctggtcgaattactcgaggtcagcgctgcagagacaaaaatcgacgcatgtcactggattatagcagcgcgagcatattttttgcatctacttggatgcacactctttgctaacaagagtgtcacacatgtgcacgtggtattcttggatgcactacatgacttgacgcaaagtgagacttacgcttggggcactgctgtacttgtgcacatgtatgataatttaaatgaggcgtcaaagagcatggtgaggcagcttgcaggacatatcactctgttacatgcatttctcgtgtcgacgtatcacaggcatttggacagactgacccctgacgtaatgtgctggatttcgtatggtgaccatcgttcatttagagaatttgaggtcatcacgtcatttttcgaccatctcagatggggtcccttgacggtcattcatcgaccggagagggttgtacgacagtttggatacatccagactattccaccacatcctactgtgccttcagtttttgttgaagaagtggatgatagatga

SEQ ID NO: 65691 - DNA, 606 bp, Glycine max
  Peptide Sequence Number=SeqID_157376
atggctagattcagtacagaagcagagtataaaagccttgctcttgcttctactgaagtgtctcttgacataaactttagtgaccttaggccactggtctacatgaaatctcctcccttcaaacctgacatgtctccaccccatcatgaaaagaaagacaaaggaaacaaagaagaagccaaagataaaaagaagaaagaggagccaccaccagaaatagtgctcaaagttgatatgcactgtgaggcctgtgcaaggaaagttgcaaaagcattgaaaggattccaagagacaaatgatgatcatactttagaaagtaaaacaggagtggaagaggtaagtgcggatagcaggacaaacaaagtggtagtgaaaggaaagacaacagaccccataaaggtgtgtgagaggctacaaaagaaaagtggtaagaaactggagctgatttcacccttgcctaaacctcagaggagaaagaagaaccacccaaagaagaaccaccaaaagtggagaaaaaaatatgagcctttctcgctcattgaccttgctaatgcttacatcattcttcacttggtgggaggatatcagcaaatgagtgatccttag

SEQ ID NO: 65692 - DNA, 213 bp, Glycine max
  Peptide Sequence Number=SeqID_157377
atggtacaacacctggtctcttggcttctggggtttgtcggcactcagcagttgaacttcaaggtttggcgtggagaagatataaaaacgggaggtgtaacaagcaaaaagcgcgcgtcacgcgcaaagcctgcaacacgcgatccaacagaagcacgtgctaagcctgcagcacgcgcgctaagctcgcgatccaacaaaagcacacgctaa

SEQ ID NO: 65693 - DNA, 405 bp, Glycine max
  Peptide Sequence Number=SeqID_157378
atgaatttgcgtgtgggattcatgaagcttgcaatgaggcatatagcccttggacttgcatatgcgtcagagatgaaaaacgaattttacatggagtcgctgaaggatttccttgatgagctcaatatgaaaggggagaaagggttggatggcgcggtagtggcggtttacgacggcgatgatggtttccgttggagaaaggaaaaaaaagggagaaagggaaaggttcggtttggtgcataccatgatggaggtgcaaccagcccgtctaatgatcctttacaagggattggaggtcctatgataaggtccaagactaagaagatgaagcaagcattgcacggtcggattctaaagatcaaagacaaagaagaccaatgtgaactaagggttgcacctaattga

SEQ ID NO: 65694 - DNA, 393 bp, Glycine max
  Peptide Sequence Number=SeqID_157379
atgcaccacgcgccacgacagctatatatactctccaaaaccattccaccgctctccataattaagctttcccaaacccaaagttcagaaagcagaaagcacgcacttgcggaagtgaagttacggttttgcccttcttctggtggtgtcggagaggaacatgtccgtaggaacaacaacatcgatatcgacatggcgcgttgttttggtttaggttccgttctggttctggcggcgctcgcggcgtcgatggtggttctgccgctgatgctgccgccgctcccgccgccgccactagttcttctcttcttccccgtcgggatcatggcggcgctcatgttgctcgcgttctcgccatcagatcaaaacggcgtcgtttacgcgtcgacgtag

SEQ ID NO: 65695 - DNA, 927 bp, Glycine max
  Peptide Sequence Number=SeqID_157380
atgggtcttctcctcacttatatggtgctcaacttttccacttctactcgatgtgggacttcacctcacactccaacacgtttgaccctacactcggcccttggcaagtctatatattgggtacctcaactcaagctcaattgtgatgcatcagtcaataacaatggtgcaacgagctgtgttagggttatgagagattctcatggtaaagttttattttcctttacaaccaatctagatgagctttgtgccctatttattggttccaatatagcggaggaggccgaaaatgaaagagctaaaagggttctcgaagaggagactgtgaaatcatccaacatcattgggaccccagagaaagaactccaaaatgcgcgaggcagcatgtttggacttgatggatcagtatcaggtagggagacctcctgcgaagctccatcaaggatgcctcagtcacacaaaattgagaggccgtatgtgtgttctgctggtaactgtcaggcatgttaccgaaggaaggaccacctgacttgtcatcttttacagcatcaagggaaggtttttaaatgccctgttgagagttgcaacactgagttctctttgcaaagcaatatgaaaggacgtgttgaggagacccatgaggacagttctacctctaccagtgacaaaagttacaagcagcatgcatgtcctgaaactggctgtgggaagaggaggatttttgaaaaagctgatgaagagttcaggtcaaggccgaggggagggaggaagagaaaatgccctactgttgaaatgttagttaggaagagggttaacccattgagtcaattggagagttggtggttatgcatgcaggatagtgaccaaggtgaattgagcattgctatgtttgaattggcgttcgaaggtgatagatatgcttcttga

SEQ ID NO: 65696 - DNA, 228 bp, Glycine max
  Peptide Sequence Number=SeqID_157381
atgttgttgaattgtgcagcagaacttttcaacatgtgcagaaaatgcttgtgcattgttggttatgggaaaggggttgatggggacccggtgttgagaggaatgaggataaggactacgtgggagtgcgtgagctcagttgaaggtgggcaattggggatggtgggttcatgtttgatttgtggaagtgggagagttgatttgcgccatcgcccgaacgccacctag

SEQ ID NO: 65697 - DNA, 159 bp, Glycine max
  Peptide Sequence Number=SeqID_157382
atggtagcaaacgatgacaacacctccacaggcaaccaaagagtaccaccactagggcaggtggcaaacttgtttagcatgcctaccatgggaacccctaaaaatgggagcccagagatggaagacctccaaaggaagaacaccgcccttaaagaatag

SEQ ID NO: 65698 - DNA, 174 bp, Glycine max
  Peptide Sequence Number=SeqID_157383
atgaccaagagcaaggacaaggatctacttgaaggacttggagggcctattacaagggctagagcaagaaaagtcaaggaagctcttcaacaagtgttgtccatactatttgaatacaagcccaagtttcaaggagaaaagtccaaggttgttaatgacattaagttattttaa

SEQ ID NO: 65699 - DNA, 294 bp, Glycine max
  Peptide Sequence Number=SeqID_157384
atgaccacgcttcctaacggccttcacattgccactgagtccaccctcggcgcccacaccgccatcgtcagcatctggatcgacgtcgggtcacagttcgagactgaggagaccaacggcaccgcgggaacattccctgtggagcaaggagatctacacaagaggtggaagttggtaacttatctagtggactctgtaggcatcgcgcaattctcttcaagagattggctggtagttggcagtttccgcgttgatggtttggttgttgcttctgttgctatatgtcgatgctga

SEQ ID NO: 65700 - DNA, 87 bp, Glycine max
  Peptide Sequence Number=SeqID_157385
atggacatagtggaagatgaaaagaacatagggtttgtgaatgagaatgagagtgagagtgagagggagagatgttacaaatactaa

SEQ ID NO: 65701 - DNA, 306 bp, Glycine max
  Peptide Sequence Number=SeqID_157386
atggatcacgagttttactggttggagacaccctctccaactcggatcttaaatgatctgaagcatgcattctggccttttcaacatgatcacaccaaaactttattcttgagggcggcaactgctgctaactgtgttgacagatctgattttgttggagaaagtggctcacaaattgcattagctaaggctgctcaacataggctagatcgaggtgtttggaccagtgtgcgttttggggacatgaggcgatctttgtcggattcagatttggttcctctccctctagacgtcaagaaatattag

SEQ ID NO: 65702 - DNA, 315 bp, Glycine max
  Peptide Sequence Number=SeqID_157387
atggattttgttgcctcaaagcacatttgtagagatcgagagatgcttgacactttgaaaaccgatggagaattcgacaatttcaagttagggaatggtggaaaaataaaggttgaaggcatagggagcatgaggatgaagctctatgatggtgctattcgaagtttctcaaatgtgaagtttgtatcttctattgttgttaagaaaaaagaaaaaaagagcaacatagatagaaacattgcgttaccgggttccaattccggttggcttggggcatttttggtgattgatgcaaacccgattcctgatgtttag

SEQ ID NO: 65703 - DNA, 318 bp, Glycine max
  Peptide Sequence Number=SeqID_157388
atgccccaaccacatgggatcaacgtggacttaaaggagcactcaaaccgagtatctttatccccaatgcctaaactccgaagaatccgtttgggtctcaccttcatgattcaggcttgtgctcgcgtcgtcgttcctgtcggtggttgcatcgccgttcgtgccgacattggctgcgttctacgtgcagactgcagagggtgtcgcgactgggtgcggctgggtgcagttgggtgcgggagggtcgcggtatggacgctgggtgctggggagggtgcggctggtttgcttttggttggagagctgcgttttgattaa

SEQ ID NO: 65704 - DNA, 165 bp, Glycine max
  Peptide Sequence Number=SeqID_157389
atggagcttgcaaccaagtacatgacaatcagaaaggagaagaagctagtaggtggtggtgcaccagtagatgatttggaggttcctccaattgttgatgatgatgatgaaggtagaggaaatgccattaaagaggacgaagatcatctggaggatgacagatga

SEQ ID NO: 65705 - DNA, 309 bp, Glycine max
  Peptide Sequence Number=SeqID_157390
atgggtcatgaagatgaggagggggatgatgataacaacaataacaacgatgatgatgatgatggtgatgatgatgataacggtggtcatcatattgatggattgtcgataatcgatttcatcaccggtgatcaacttctcgttgatgctaatgatgttgtcattgcacagcatgctagagctcatatcatgatgattataggcggttatttgatatcagatacatcagctctagatcgggtcgtgcttgtgaagccagaccaaacaaaaattggtggatgtttgttattgctacagtcatgggcgtga

SEQ ID NO: 65706 - DNA, 3261 bp, Glycine max
  Peptide Sequence Number=SeqID_157391
atggacctcactagggtttctgcaacatgtcatcatttaagatccttggctgcttcggtaatgccttataccaagttaaatctgtttcctcatcagaggacagcagttgagtggatgttgcatcgtgagcgaaatgctgagcttttgccacatccgttatttgtagctctctcaactgaagatggctttagtttccatgtaaatactgtaactggtgatattgttactggggaagctcccaccgtcaaggattttcgtggaggaatgttttgtgacgagcctggcttgggtaagactgtaacagctctctctcttattatgaagacgcgaggtacattggcagacccgccagatggggcacaagtagtctggtgtcaacataatggtaatcagaaatgtggatattacgaggtcagtgttagtggtaatcacatcactggttgtactaccttgggtaagagggatgtgtgccaagataccagcagaactaatgataaccatgattactcctccaaaagagccagattgatagatcctgatcagcaaataactaaacttcatgattcatgttccagggaagaaaacaaatcacctgttgatgcatgtttcaaggaatctatgcattcaaatcagttcactgggagtttgagtcgcataaagaaaaatctacatttcacatttgaagatgaagctatgatttccaaggaaagagaaattggtgaaggattaattaaagcaaagcatgcattagatgttacatctcatgtatctcaaaacaagtcgcctgggaagcctaaaggtgactgttttgagtacaatgatacatggattcagtgtgatgcttgtcacaagtggcgaaagcttgtagacaatagtatggctaattctagtgcagcatggttttgtagtatgaacactgaccctctgtatcaaagttgtagtgtccctgaacaacattttcataatatctgtaagataacacacttgccagggtttcatttgaaaggaacttgtggaggtgagaaacaaaatgtttcttttttcactagcgtgcttaaggagcactactccttgataaattctcagacaaagaaggccctgacgtggttggctaaaatttcaacagacaagcttgcaggaatggaaacaaatggcatcaggggtcctattttaaacatttgtactgcatctaatagacatttccacaaaatatttcaagcatttggcctcttaaagagagtagagaaaggtgtttgcaagtggtactaccctcaacatcttaacaatttgacttttgatgtggctgcccttggcatggctctccgtgaaccattagattttgttaggttatacttgtcaagagctaccctggtagttgttccagcaaacttggttgatcattggaaaacgcaaatagaaaagcatgtgaggcctggtcaattgcgggtttatgtttggactgatcatcaaaagccatctgtgcattgtcttgcatgggattatgatgttgtcataactacttttagtcgtttgagtgcagagtggggcccacgtaagaggagtgctttgattcaagtgcattggtttaggataattttagatgaagggcacactcttgggtcaagcctgaacttaacaaacaagttgcaaatggctatttcattgatagcttcaaatcgatggatactaacaggaactccaacgcctaacactcctaacagccaacttcctcatctacaaccattgctaaggttccttcatgaagaatcttatggactgaatcaaaagtcatgggaagctggtgtgcttaggccatttgaagcagagatggaggaagggaggtctcgtctgttacatttacttcaaaaatgcatgattagtgctagaaagatagatttacaaagcattccaccatgcacgaagaaagttgtttatctagattttaatgaggagcatgctaggagttacaatgaattggtaatcactgtacgacgtaatatattgatggctgattggaatgatccttcacatattgagagtctactgaatccaaaacagtggaaatttcgtagtgcaactttaaaaaatgtgaggctttcatgctgtgttgctggacatattaaagttacacatgctggagaagatattcaagaaacaatggatatgttagtacaaagtggtctggaccctacttcaggagagtatacctccgtaagatataatctcttgtatggtggtcactgtgtcaggtgcaaggaatggtgtcgccttccactcattaccccatgtcggcatctgttgtgccttgattgtgtttctatagacaataccaagtgtacttatcctggctgcagtaaattgtatgagatgcagagtagagaggcccgacctgaaaatcctaaaccgaagtggcctgtacccaaagatcttattgagctacaaccttcatataagcaggcatggttaatggagaactcagataattgggatcctgattggcaatctacatctagtagtaaagtctcctatctcgtccagaggttgaaagctttgcgaggaaccaatgaagagacatacttcaatacagaaaatagcaatgatgatttgcatattgagaatagtttgcatagaagtgatgacaaatcatcaattcagacatgttctatgagcagcactaagaccaatttgaaccctgagaaagttctgatattttctcaatttcttgagcatatacatgccattgaacagcagttgactattgctggtatcaaatatactggaatgtatagcccaatgcattccagcaacaagaagaagtcattagccatgttccagcatgattcaaattgtatggcacttctgatggatggaagtgctgcattgggtcttgacttgagttttgttacgcatgtatttctaatggagccaatttgggaccgaagtatggaggagcaagtaattagtcgtgctcatcgtatgggtgcttctcgtcctatttatgtggaaacattagcaatgcgtggtacaattgaagagcaaatgctagactttttacaggatgctgataactttagaagatcaccaattaaggatgctaccgaatctgttgatgatagtgggggacgaggatatagatcattgcatgattttgctgagagtagttatctactgaaacttagatctgtgtatactaatttggaaagtccaaaaggaagtatgtccgagcactttaagcctgttgaaactgatggcatgctctga

SEQ ID NO: 65707 - DNA, 444 bp, Glycine max
  Peptide Sequence Number=SeqID_157392
atgggtgctgggtgccccagcaaaaatgttgggtgcaccaaagccgaagcttttgttgggggatttgctaggggcacccagcaaattttaaaattcccaaaaatgctcttcatgcttttttgcaaacttgttccgttgacaggggcggaagaaatcttccgtggaactgcggaagaaccttcttccgtgggactcaatggaagaaggttcttccgtggagtcccacggaagaagttacacacactccagtcacacacttcttcctctctccatttctctaactctgaccatgcaattggcgttggtctcattgcattctctgtagaaaggacgaacaaggccaaaggaaaagacaaggaggttgccgaaaaaggttctgccggcaagcgcaagggcgccttcgacgacaacaagatcggtggcggccgaaagagaaacaagtga

SEQ ID NO: 65708 - DNA, 955 bp, Glycine max
  Peptide Sequence Number=SeqID_157393
atggagccagcggaagaaggtgttcttctgcgggctcctgcggaagaaagggcggggatggaaaaaccctgtcatcatgcctacttgaatagcagtggctctgctattcaagagacacaggattaccactgttcaaggcttgatgtggctgaggatgttccttggcgtcgtaggcccactgcctcagcacgtaggcaacgggttacccagagagtcgaggatgttcctcagttggctgaggatgtgcctcatgcgtctgatggtagcccagagaggacagcagctgccgatgatgccgagatagatcgattggctagtgatgggacagctgatgatgatgaggggttccccggtgggccacgtgatccatctattttgataggatttgttgatcatgtggcacacaacatatggagtggacagcgacttgatctcaagttggtctcccatggtaggaaagtagataaatttgggagaccgactgctgagatcgaaggtatgattgcggccaccggattggatccattgatcaggtgttctgtgatcaccactgatcttggactcgtatccgcctttgttgagaggtggcttagggagacgagcagcttccacctcccagtaggggaggtgacgatcactctagacgacgtttcgtcgctgctgcacattccgattactggcgcgctgcattcattcgagccgctggctacatctgacgtagtcgccctgttgacagagctacttgaggtcaccccagatgaggctatagctgagacatgtcaggcaggtggccctcatgcagtgggttgctgcagctcggacatacctacttcatttgggttggttgcactcttttcgctaacagagtgcaacccatgtgcacgttgtgcacctgcaggcattcgagacctagccagcagggcattctcttggggagcagccgattggtccactt

SEQ ID NO: 65709 - DNA, 720 bp, Glycine max
  Peptide Sequence Number=SeqID_157394
ggttttgtgcgctccaatggaggtatgatgcttttgtcggaggtctgccctattagggagagttccaatgatgacctatcccactgtcacaacggctctaacaccactagtgaccatgtttcaagtgtccctgctggtgacgttgtcgctgccaatggcatgacttgtcatgatgttgacgtcgcctcagccaaatcatcgtcaaaatgttattcctgggttcatgaagaagtcggatcctacgcaaatagtttcttgacttatgagtcaattatcatctttcttaaaagtgtcgagtgttgtcatgtcgatcgtcttgatgggatgatcatcaagtcttgcctagtgagtgaacatgtctttatctgtgcttctctaggtgagattcatttcatgtatatgtactccaccctcttattgaatcttcacctcattgtcccttttgacaagtttgaggttgatgctccatgtcgcgtgagctgtggaagcttcgagactccacctgacggcaccattagcgttagggatttgttaggcttcattgtcagggcagcactagtgtgggattttcgacctccaacgtgtgaagtcgtggcgacaatgcacttccttgctgccgccagatccaaaagaccttcaacaacatcaagcacccaaggtgagttattagtgagtgaacaaggaacaccttcttcttcttcttcttcttactactactag

SEQ ID NO: 65710 - DNA, 885 bp, Glycine max
  Peptide Sequence Number=SeqID_157395
atgacagcggccggtggcggcggacagcagtcggaaccagctctggttattaggcaaaagaaccttctgaaaactcggaaaaaatcacaggtaaaacaagaggagaataccttgcaggatttctatggtaattggtctccttcagcagcaccagcaaaacaatttcagaatcaattggcaccttctgtcatacaatcttctccctcttcaatttttgggcaaccaaagcagatccaaggagctgaaaccctatatcagaatatcataaatccatatgtgacttcttctgtgtatgggaaccttactaatacatatcctgctatgccaatgctatcgcagactcagccagcactttctggctacgaagtgtctcctggtatagtaaatcgtgtgaacaattctgtggactcagtcaagccccaaatcatgactcctcaggagaaaattgaaaaattgaggaggcggcagcaaatgcaggcaatgattgctattcagaaacaacgccaacaattgggccatcaagttcctagtaaatcaagcactcaaaaatgtcctccagaaattcaaagtcaccttagtgatgggactgatgaagatctaagaacttttcctgcgctagatccaccaattgaacaagatgattctaatacaatgtcagtggcagttggtaatgatttcgttgaagacaccgtactgtacgggcttcagcatattatatcaaagttagacatcaaaataagactctgcatcagagatagtttgttccggttggcacaaagtgcaacacaaaggcattatgctagtgatactagcagtacaaacaaaagtagcagagaagaacttgaagttgctgcaagagaagaaagcaatagccaaaacaggtag

SEQ ID NO: 65711 - DNA, 108 bp, Glycine max
  Peptide Sequence Number=SeqID_157396
atggcgattttgaaagttcagaagatgggaaatggtagtgtggatgatgagggtagtggtgctgcattcattgcaaaagcagaacagacagaagagcataaagattaa

SEQ ID NO: 65712 - DNA, 342 bp, Glycine max
  Peptide Sequence Number=SeqID_157397
atgagggacataaaatgcagagaaatcgagcgcaaaaagagaaaatcacggagagtacttcgccggaaaacgcacaaacaatggttacctcgtcggaaaagggagagagaagtgagaccgcctcggacagtgccggaaaagggagagagaagactgaagagtgaagagagaactcggaccgtgccgaaaaacgaagtaggaagcgccgtcctccggtcgtcacctttgtcgtgcctccggcgtgataaagggagtggcgttgttgaagagggaagtcgcgtgaaagaacggagagaccgaagagggaataacgtgttccctatcctttcaggatttttttaa

SEQ ID NO: 65713 - DNA, 411 bp, Glycine max
  Peptide Sequence Number=SeqID_157398
atgtatcagtatccttttgcaggtcatcatactgatacttctgagacctcacattcgttcagtggtgttgcagaaatacaacctcatttttcatggcccactatgactccttcacagcagcacgatgcccccattccaacacccaacgccccatttgctccacaatggaataggctgagcaagcagaagcggggagacaacgcggcggcagaagaaatcctgatcatcatgcgcgaagatgggatcgaccatgtggcacatcttcacgacatcacggacaccataatgactgattttgatggtttggaggatgggttaggtttagagggtttatgggttagggtttggattaagggtttatgggttaggtttagagggtttggattaagggtttatgggttaggtttagag

SEQ ID NO: 65714 - DNA, 752 bp, Glycine max
  Peptide Sequence Number=SeqID_157399
ttgatgatctcgtgccatatgtggaaaagttagcgattttatcccaagagcaagagaggattactgagcctgtggcacatggtccagcatcagagcgtcgatttcccccacaacagtttcacatgcttcagtcaagtgttgaaactcgaggttttgacagacgaagggagattgttcaagcggaagatttttcccaacatatggagcagcatggccatggaatgtattacacgccaccaacatttgctcagtatcattcgcaaatgtatcagtatcctttcgaaggccatgacactgatatgtctgcaagtgaacattcgtttggtggtgttgcggaaacacagcctaatttttcatggccgaccatgaccccttcgcagcaacatgatgccccaatggcaacatctaatgccccattaggtcagcaatgggatgtacccggagcaatccctgcaatgggtgacttattaggtgttgatttgcgtcacgagttttctgcagaggctgaggaacaagggcgaagacagcgcacaagaagaaatccggatcgtcaagcccgaagggttatggggttgtgttatgagtttgggttagggttatgggttagggttagggttagagtttatgagttaattttaggacgtagggtttatgagttagttgtaggggggttaagggttaggggtagagtttgtgaggggttaagggttaggggtagagtttatgaggtagggttagtggatggggtttag

SEQ ID NO: 65715 - DNA, 210 bp, Glycine max
  Peptide Sequence Number=SeqID_157400
atgttgtcttctgctactcctaatcctcctcctccttcatctcaagacaaacaaggtaatactaaagccaaatttgatgacttgtctttacaatttgttgttgagcaaacaaagaacaaaattttcaaggaagaaaagaatagtgttgaagacaaattgacatctactaatgaagaggttgccaacttaaagaagattgttgcaagatag

SEQ ID NO: 65716 - DNA, 330 bp, Glycine max
  Peptide Sequence Number=SeqID_157401
atgcaaagtgcaagggaagctcatccggttcgacgcttagatgttgaacacctttctggagacaccgatagtccttcaggggggagtggtaccccattttctctcaattcctccacgtgtatcccgaccatcaggccattgcggcaaagctgtatggatatggacttgggcagtatgatctcctctcaaatcactcagattgcccagtccaacttttcccagcttagtttccctacgttgatcaccgccctctacgatgccaagggagtttcttcaaacaccttgacctttgagttcctgagccccatcatcaaccttgcttatatctag

SEQ ID NO: 65717 - DNA, 456 bp, Glycine max
  Peptide Sequence Number=SeqID_157402
atggggtaccactcccccctgaaggactatcggtgtctccagaaaggtgttcaacatctaagcgtcgaaccggatgagcttcccttgcactttgcattgcttgggcgagccgtcttctgggtcatagatatttgcataaaattcattcacaagtgccacatcaatgtttttctccggcagtcaggtgagcttcctgtgccagtgcctcctccaaaaacttgtcatactgtgtgtaagccaactccattcccatatgggttccaccccctgaggtctactggtggaagctcgacgtttcttagaggccatctgcaaaaagaaagacaacaagaactggtgctgagcaccactctagcaaaagcgaggagaggcttagcaagaggatacgcgcttagcccaaacattgcaaataagcgaacaaagagggttttgggcttagcacgattggcttgctaa

SEQ ID NO: 65718 - DNA, 213 bp, Glycine max
  Peptide Sequence Number=SeqID_157403
atgaaagaaatatttgcaatcaccgccatacataatcagcaatttaagctcaatggtgccctctatgattgcaatcacagttcaaaagaaattccatttccagaagagtttctcaaagtccttattctctcatatgcattgctgcctagcgagagaagtatagaactcgaactggagaaggcaggtgtcaaagggggcatcaatcaccaatga

SEQ ID NO: 65719 - DNA, 747 bp, Glycine max
  Peptide Sequence Number=SeqID_157404
atggatcatgaggatccatacacacattttcctaccttcatggaactatgcagtactatgggagcttttgacgaggatgttgaagttgtctacctcagagcttttccattttcattagcaggtttatcaacacaaaatatgttattgcgacattttcacaaggatatgacgaacctctctatgagacatgggagagattcaaatctttgttgcgaaggcactatgatgtccaagagtccgaaggaagccattgtaatcattgactccatagtagccagtgattatcaaagtcatcatgatagagctccgactcaaagaaaagctataatggagcttgacactcaaaatgcaattctagtaatcatcaaaatggccactgttcaacacctggagatagacaacaagaagaggaagcccattatctgcagaaccaagccagacctcaacaaaactttcaaggaagctaacaaggctatagaggtagctcaggttcaaatcagccttatggctagagaccacaaaatttcggtcccactaacacttcttttgcaggtccttctaacaactcttatggaggataatgacgagaaaaagaataaagaaggagttgaaaaagaaaacaagaaaaatgatgaagtgttgactagtgaaaaagtggaagaaaaagtgcctgaggataggcctatttttcaggaaaaggatgaagacatggcagatcctgttgattatttcattggaggagactga

SEQ ID NO: 65720 - DNA, 213 bp, Glycine max
  Peptide Sequence Number=SeqID_157405
atggacagttccaagcgtgaaactaccttgacagcgagaagtccaaatccaattgacggcgtccaagcaggtggtgacgttgacggagtggtcgcggcaacggcgaaggtagtccttttccagcatgtggtgtggctcgacgtcgaggagtccggcgatggcggcctcatgggcgcaaaggaagggagggtccgacaagagaggcattgttga

SEQ ID NO: 65721 - DNA, 597 bp, Glycine max
  Peptide Sequence Number=SeqID_157406
ggtcttcgtactgaggggacaccaaaaatgtttatcgacccaaacaatgcaaacacggctacattgggtgaagttgcggagacattgcagtatatggtgtcaccacaagggcgaaacacatggacagttgatgatctcgtgccttatgtggaaaagttagcgattttatcccaagagcaagagaggatcattgagcctactgttcaagcggaagatttttcccaacaaatggagcagcgtggccatggaatgtattacacgccatcaacattttctcagtatccttcgcaaatgtatcagtatccatttgaaggtcatgacactgatatgtctgcaagcgaacattcgtttggtggtgttgcagaaacacatcctcatttttcatggccgaccatgacccattcgcagcaacatgatgccccaatggcaacacctaatgccccattagcttcgcaatggaataggctgagcaacaagggcggagacagcgcgcaagaagaaatccagatcgtcaagcccgaaggtgggatcgaccatgtggtacatcctcatgccatcacggacaccataatgactgattttgatgtctctatttaa

SEQ ID NO: 65722 - DNA, 984 bp, Glycine max
  Peptide Sequence Number=SeqID_157407
atggagaagatccagcacagtgaggtggaagtaaagggactgaagctgcacgtggcagagattggaagtggtcattttctgagtgcatattggaacacacttcaaaacagctccaaggcagtggtgttcttgcatggattcccagagatctggtacacatggaggcaccaaatgattgctgtggcaaatgctggttatagggcaattgcctttgatttcagaggctatggactctctgagcaaccagcagagcctgaaaaggaaaccatgtttgatctggttcatgaaatagtgggtcttttggatgctttaagcatcagcaaggctttccttgttggcaaggattttggtgccatcccaggacatcttactactgcagtacacccagaaagagtagctggtatcataactttaggcattcctttcatgctcccgggtccctctgcagtggagagccaccttctgctccccaaagggttttatattactaggtggcgggagcctgggagggcagaagcagattttggccgctttcctgtgaaatcagtgataaggaacatctacattctcttctctagaagtgaggttccaatagcagctgatgatcaagaaatcatggacttgtttgacccatctactgccctacctccatggttctctgaggaagaccttgcaacatatgcatcattatatgaaaaatctggattcaaatatgcattgcaggttccttacaggagtattaatgtggatgctggcttaagtgatgtaaaagttactattccatcacttctgatcatgggtgagaaagattatgtgttcaagtttccaggcatggaggactatattcgaagtggggcagtgaaaaattttgtgccggacttggaaatcgtgtatattccagaaggaagccattttgtgcatgaacaaatgccagagaaggtgaaccagttcatcattgagttccttgacaaacaaaatatatga

SEQ ID NO: 65723 - DNA, 114 bp, Glycine max
  Peptide Sequence Number=SeqID_157408
atgggttctggtaatagggaaaaagggggaggtgttgggttgaaagtgaagggagagggaaagatattttgggtatgctctattaaaggaccaaaagataaagttagaacttag

SEQ ID NO: 65724 - DNA, 1137 bp, Glycine max
  Peptide Sequence Number=SeqID_157409
atggcggatcggttcttccccaacccgatgcccgagttcgtacccgaaacgacgccgtccactcctcaggaagaagaagaagccctcacagtgggcgactcgctcccgaagctcctcgccatgccccacgcgccactcttggagcgtctcaaacgcgccgctctcgacctcaaagaaaccgtgcgcgacttcactctctattgcggcgttctgggcaccgcgtttctgctcttcaagtcttaccgagtgaccggcaacgggaacgacctgtctctctgctccgagattgtaaaggcttgcgatgccgcttcggctcgttccagggacgtcacgttcatttgtgggcgtgctggtgtgtgctctctcggagctgtcgctgcgaaacacgctggtgatgacgagtccctaaagtattacttggctcagttcaaaaagattaagctgtcaaaagatcttcctgacgagttgttatatggaagggctgtggttgtcgatgaagtcattaaaaatggaagggcattgggtaggaagggaagatgcccgttgatgtttgaatggtatggagagaagtactggggtgctgcgcatggattggctgggattatgcatgtgctgatggatatggagttgaagccagatgagcttgaggacgtcaggggaactctcaagtacatgataagcaaccgctttcgcagtggaaactatcctgttagtgaagatgataggaagagcgatgctcttgtgcattggtgtcatggagctcctggaatggcactcacacttgtcaaagcagctaaggtttttggagataaagaattcctggatgcagctatagaagcagcagaagtggtttggaatcgtggtctgcttaagaaagttgggatatgccatggtattagtgggaatgcatatgtctttctgtcactgtaccaacttaccggggatgtgaagtacttatacagggccaaagcttttgcttgctttttgcttgacagagctcataagctgatatctcgaggggaaatgcatgggggtgatagaccatattcaatgtttgaagggctagggggcatggcttacctctttttggatatgagtgatccttccttgtctaaatttccagcttatgaactctga

SEQ ID NO: 65725 - DNA, 369 bp, Glycine max
  Peptide Sequence Number=SeqID_157410
atggtggtaggaaatacaatcatagaaaaacctagggatcaatgggatggggaggaaaagaagttagtacaatataatctaaaagccaaaaatataattacatctgcattaggaatggatgaatactttagggtgtcagattgcaaaagtgcaaaagatacgtgggataccttacaattacaagaacatgaaatggaattaatgagattgaatcagcatgaagagaaggataagaaaaagaaaggaattgctcttaaagcttcatcatcaatccaagaaggaagtgataaagaggattcaaatgaaatagacgatgatgatgatcttagtctttttgtaaaaagattcaacaaatttctaaaaaactga

SEQ ID NO: 65726 - DNA, 837 bp, Glycine max
  Peptide Sequence Number=SeqID_157411
atggcaccgcaaggggaagatcctttaaaccttaaacctaattttgatgcaacaactatgatgctcatgactgacggggtggatcaaccatacctggctagtactgagaatagttcgtttgggatttcaatgcttgccaagaagactgcaagatgtaagcccaatagcgccaaacaaaacaaatcgagccaaagtgagtccaatactaataaacctcatcaagaaggtaggaaaaagacccaccagaaagataaatgtgggccaaacaaggggaaaggctctaaattttccacttttcaaaaagatattcatgaatcttcctcccccatggaaaaggaatccaacatgtttattcatgaagtgccttatttggaatgtttatggtgtagggaagagagcttttccaatctgattaaagacttgctcaaaatgtatcagcttgatttcattgctattttggaaccttgtattagtgggcctaatgctgataaggtcatcaacaagattggtttggatgggtgttttcgtgttgatgctaatggcttcttagggggcaattggtgtctttggagaacttctggcaccaatatctctgtcatgggatccttcccttatcatgatcaaaacattgaagctctaactgttaccctgaaaatgtggaacaatgatacttttggaaacatttttcagaaaaaggaaaagattcttgtgagattagaagaagtcaacaaggagatattcattaatcccaataacaacttaagtggtcgaaccatggggatagaaacacaagatccttccatcaatcctttctcaacagacgcaaaaggaacatag

SEQ ID NO: 65727 - DNA, 585 bp, Glycine max
  Peptide Sequence Number=SeqID_157412
atgatggaatccttcagccagatgcagtcacagtttcagtctcagatgcaatcacagggaattgcactacctccagagccagaggttggtccctcgggtcctcgtgtcagcacaaaggagagttgtgttgctccctcagggaacaatccagggatgggtgactcagacaaatgcggcctatatattgaagaaaatccttcccgcttggttgccctaggaagactttacgagggatccacaacagttcacaacatcccgttgttgcatggtcaagtcaaggttggtgttgaggaggttaaagatacagaggctctcgttcctgtacccactgacgaggttaccttagtggggcaggcacttaacactttccttgcttggccaacacatcttgtgaagcgtttatcagaacagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 65728 - DNA, 306 bp, Glycine max
  Peptide Sequence Number=SeqID_157413
atggtggtttatcaattatgtggaagtgacaatgtctgctctgaggaacttgtatatatgaaaattatcaattttagcttgacctgtccattgttgggactggttctctttgttttgggaggatcgagtggaactcatgatcaagtgccagaaaagggagacgtgactgctgatcaagtgaggagagaacctcatggatcaatagtggcaacagctggtcatcgagccattgcgcagagtaataatttagaaattttcgtgggccttagagcatgtgacatgcaagccccgaaggagtccaagtag

SEQ ID NO: 65729 - DNA, 216 bp, Glycine max
  Peptide Sequence Number=SeqID_157414
atgggttgtttggttcttgcctttttactcgtacaagtggcatttatggttgttgtacgtctagttgtggttaacaactcagcacttgcccttctaataactgtcattggaggtgtgtacacttccctcatcttcttgggtctttttggatttttcccagtaggaactcgcctttttccatttcgtcaacttgaaagcgaacaaggacaaggatga

SEQ ID NO: 65730 - DNA, 534 bp, Glycine max
  Peptide Sequence Number=SeqID_157415
atggctgccttcgcttcttccacgtccattacagaccacatagacgctgccattgtgaaactcaccttcgatcaattccacttcatcgctactcaaaactccatgtccaccaaattggacaaaattcttcagaggttgacccttcttgaaatccactatcagttttccaatgtgctcttgccttcttcgatcccttcatttgagaaacccgtcgccggtgtggttcctcagtcgaatactgaagacagagccgcgaagtttgaatcgagcttcatggaagagtcgctgaactcggtttctaatggttccaaattcacactgggaagtgatcagaaaccagtgttcagacgaggctacggattcggcaaccacgactgcacagtgtttcatcgccacatgcccttcaaacttgaccattcagactcagaggatacaaatgttgtttcattcgaagtcatgaaggagaaccctttttgggtgtacgacagagaagcacttcggctcttcagaaagttaggcaaaggtcacttgtaa

SEQ ID NO: 65731 - DNA, 306 bp, Glycine max
  Peptide Sequence Number=SeqID_157416
atggtgagcaaaggggaatgctcgtggggaataaaaggaaagagtcaagatggtggaaaacaatgtgaagattggaagatggttcttggggagctaagaggcagtgatgagagtggaactggtggtggaaaagagagctctttcaatggaaaaagtagttatttcaggaatttaaatagcaggtggaaatacaaagattatcatccacagagcaagacaaatggatatggaaaaggaatctcaaaggggatatatggttcattcatcttacgtgactatgaaggaaaaaggtgtgacaacaaatag

SEQ ID NO: 65732 - DNA, 411 bp, Glycine max
  Peptide Sequence Number=SeqID_157417
atggaattctcaaccttgcaagaggatgatagtccatgggagagagggaatgtattgagcaatcttgcactctatgtattcactctgcatatccctttcagctttggaggcttatccgtggttgctctatttaatggacaacctgttgttgacccacaaactgaggccttatcacttctcaccattcagattctggagcttagtggggctctgcttttattgaagtacactgctaagccacaatacaagttttcaaatttcttcaaaaagaacaaactattgagcaataggaactggattttgtcatgggctctgggatttgggtttcttgttcttctgattttcctaacatatctacttgctgacagattatttgactcccaggttggattacatgtttttttccagtaa

SEQ ID NO: 65733 - DNA, 276 bp, Glycine max
  Peptide Sequence Number=SeqID_157418
atggctgtctgtgctgctaacaagcagggactctctttattattggcaatgatactcaaagcactagggccacatcaatattatgacagtgatgatgaatatgctcctgacagggtgccactcttgaagaatgctccacctcattatgttgttgatccaggatatgcacatggaaatgatacatggaggagacaagtgccatggaaggtaggagaggtagtcctttcggatgccagttggcttagaaaaaggacttgtatgctggagatggattag

SEQ ID NO: 65734 - DNA, 147 bp, Glycine max
  Peptide Sequence Number=SeqID_157419
atgaagggttttagaattagggctttttcagtttttcctcttctgaatccatcgccactgcagcgtggacggaatcggagtgcagccatagcagaagcaatagaagccctggacatgttcgcaattagtggcttttatcaggtttag

SEQ ID NO: 65735 - DNA, 684 bp, Glycine max
  Peptide Sequence Number=SeqID_157420
atggttagaacacgaggtttaggtcatgctttatctagggttataggcagagatagacaggatgagcatgatgcagtcgatgttccccagaggcgtaggcctactgcattagcccgtaggcgacgagtacatattatggttgatgagggtgttcctcaggtgactgaggatgttcctcatatggcagaggattttcctcaggtgactgaggatgtccctcatatggctaacgatgttgctcagatgagtgaagatgcgcctcagatgaccgtggacgtagatgggactgttgtagaggacttaggtcgtgatggtgctgaggagtcacatgttgatgagggattccctggtgggccccgtgagccatcagttctgatttcatttgcggagcatgtcgtacatgacatttggaatggacatgagtgtcctgagctgaagttggtgtcgcacgggaggaaggtggcactaattgggaggttagtgcctacgattgaagggctggttgtcgccacaggattaagtccattgatcgagtgttcagttgtaatcggctatcctggacttatatccgcatttgtggaaagtggcgccttccacagcttcgaggctctttccgtggacgaggcgttatttttgttgatggagttgctcgaggtgtctggtgaggaggctagagctgagaca

SEQ ID NO: 65736 - DNA, 516 bp, Glycine max
  Peptide Sequence Number=SeqID_157421
atggcggctggcggcgtgcgaaaggtggtggaggtggttgcgctagaggcggggtatctagtgttgcggctctggctcaagctcgacggggccccgagaagatggcttgatgattcgggtacgtgtgaagatactaggagtacgccggatattcttcttcgcaagcaaggaagaccgggtgtcaagggagccgttgatctagaattccttgaccagagcaacgtcaatctgcttctctgggagtttagtgagtacccggtgtcactgccttcattggagctctccgtaaaattcatcaatgttgtcttgatacctgtgccaagctatctctatagcgaagcaagaggaatcccaggtggattccccgccttgagtgggcaccgatcttcatttcctcacttagcgccttgtcccgagtctctgggattagcattgcaatctcgcttagcgcaagctaggcgccaagcgagttcatcccaattcataagtgcgctaagcgcattgatgctcgcttag

SEQ ID NO: 65737 - DNA, 258 bp, Glycine max
  Peptide Sequence Number=SeqID_157422
atgggtgccaagtacctcgaagtggtcaaacgagggtcgcatcccaacaatggatggtccccagacgaaattaggtcctgcatcagtacaacccctattccaacaccagaagcatcacattcaatttcgaaagctttatcaaaattaggcaaacaaagcaaaggtgcattgatgaatggcaacagaatggagaaggaagagagagaggatatgccacttcaaggagaagatgagtctagaagaagctcaccaccatag

SEQ ID NO: 65738 - DNA, 180 bp, Glycine max
  Peptide Sequence Number=SeqID_157423
atgacagaactcaaacagattttttttgacacaaagtctgaaagacataagaaacaagaacaagaacaaaaacgtgacaagaacaagaacaagaatgaaacaaagacacaaacaagaacgcaacaagatgcaaacaagaaaacaaataatagaacaaggacaaaacatgaacttggataa

SEQ ID NO: 65739 - DNA, 540 bp, Glycine max
  Peptide Sequence Number=SeqID_157424
atgacgcctactagacaccctctggacacagagaagtccaacagggccctggggttttcggctctgatcacgggtcttcgccagtcctacggagttcctgtcacccccagcaaggtaatccgaccgccgatcacccaggccttcatcgagaagtactgcatgcctaggcaggcgcagggtgacgcacatcaggccgcgggcgcaccgccaccacctcgacaggccgacccgactgggccactgggtgtggagcgttatctacaacatttggttcgccagcaggcggccaaccaccgtggacaggtgcagatacatgagtgtctctaccggttcagcctcagtcagcaggggcagggttctgctccttttgtatgccctaccccagagcagtttggggctgaggtctcatggcctggagactggcccgatgcccaggcaggggaggagcctacaggatcccccggtaaggcggatgagtcccatatggataaagatatgacggacctgctcggtttcttgggagggagtggagccacatga

SEQ ID NO: 65740 - DNA, 339 bp, Glycine max
  Peptide Sequence Number=SeqID_157425
atgattgcttatatgagacagttgaagatttcatatttttcatatgtgtcgcaacgtgcccttcgcgggcgagcgagggcgaggctcacgggtgcgctttccaaaggaggagagatgcgcggagtcgccaccaacgtcgacaaaagcggggcttttgctcttacgtatcctcctttggagaggaaatcagacctacgtagttctttcacatgcgtgaatcaagtgattcttttttacttgaggggtgatcatcttaaggcgttggaccttaaaaatgatccattttacttgattttcaacgtggttacggcacgaccgaacggtcggaattcattttaa

SEQ ID NO: 65741 - DNA, 369 bp, Glycine max
  Peptide Sequence Number=SeqID_157426
atggtgggagcaggtttgaaaaaggatcttagagtgtctagggttgtgccaggagggtctcttaatgccttcctttttcttctcatcggagttatttcacaaagacttgccatggtaaagaagaaggggaacaagcacacttggagagcgcagtacacggatagtggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 65742 - DNA, 930 bp, Glycine max
  Peptide Sequence Number=SeqID_157427
ccaatcgctgaactggaagcgaaaatcgactcgctgaaatcgattggtcgttcggatgagaaacacgatattaatctggatgaagaagtgcagcgtctgcgcgagaaaagcgtcgagctgacccgtaaaatcttctccgatttgggtgcatggcaggttgcgcagctggcgcgccatccgctgcgtccttatacgctggactatgtccgcaatgcgtttgacgattttgacgagctggccggtgaccgcgcctatgccgatgataaagccattgtcggcggcatcgctcgtctggatgggcgtccggtgatggtcattggccatcagaaaggccgcgaaaccaaagagaaaatccggcgtaacttcggtatgccagcacccgagggctaccgtaaagcgctgcgtctgatggagatggccgagcgctttaagatgccactgatcaccttcatcgacacgccgggtgcctatccgggcgtgggcgcggaagagcgcggtcagtctgaagcgattgcccgcaacctgcgcgagatgtcaggcctgaagatcccggtgatctgtaccgtgatcggcgaaggcggctccggcggcgcgctggcgattggcgttggcgataaagtgaatatgctgcagtacagcacctattcggtgatctcaccggaaggctgtgcatcgattctgtggaagagcgccgacaaagcgccactggccgcagaagcgatgggcatcaccgccgggcgtctgaaagagctgaagctgatcgattcgatcatcccggaaccgctgggcggcgcgcaccgtcatccggtggacacggcggcagcgctcaagcagcagctgctggccgatctggccgatctcgatgtgctgagcacggaagagctgcttaaccgccgctatcagcgtctgatgagctacggctacgcgtaa

SEQ ID NO: 65743 - DNA, 420 bp, Glycine max
  Peptide Sequence Number=SeqID_157428
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaagcacactggcagcagccactgtaattgatttagagagtagtcttgagtcatgcgcggtaggctaa

SEQ ID NO: 65744 - DNA, 591 bp, Glycine max
  Peptide Sequence Number=SeqID_157429
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgctgatgccgctggcgattcaggttcatcatgccgttgtgatggcttccatgtcggcagaatgcttaatgaattacaccagtactgcgatgagtggcagggcggggcgtaatttttttaaggcagttattggtgcctag

SEQ ID NO: 65745 - DNA, 138 bp, Glycine max
  Peptide Sequence Number=SeqID_157430
atggccctctatgggtcggcgttcgcttactcgaacccactcaagcggcgttttccgctttgtccaaagctaggcaaaggatgccgatctatcggccgtgaccctagcctctatttgcgtccgtccctaagtacctga

SEQ ID NO: 65746 - DNA, 222 bp, Glycine max
  Peptide Sequence Number=SeqID_157431
atggaaaagtgtcttgtgaagttgcaaaccaaatttcaaaaagattcaacggttaacgtaggctgggcagcatttttaccgaggcagcttcataacaaatttcgcgaagatccaacggttaacaaaggctgcatagcatttttaccgaggaagcttcacgtagctttctctagaagcttcattaagaggcttcctccagaagcttcctcgtggcttctttga

SEQ ID NO: 65747 - DNA, 624 bp, Glycine max
  Peptide Sequence Number=SeqID_157432
atggttagcaacccctccagagctcagaagaaggacaagtcctcgaagaggaagcaaggagagtgttctcaggctactctcaataggcttgatacatggttcacaaacgagaataagaataacgacttcaagatgatatacgcaatgaagaatgtgagaatacccaacacagggtctgtccaagcttgtgcagatgaaaggaactttctacacggaactggtaagagttttctatacctgtgctcacagcgatatggaagtttgaagaatctactgatgattataacaagatccagacttatagaggtatgctccttgaatctgaggaatcacctaggtgtaggtggtttaactgctgaagacagaatgttcgtgtaccacataacctatattctcaaccaaggtccaacgaccacacacaggtattcaaatgaattgggtactcttgatcgaagacatcatgttgaagagccatcgataaccaaaaggcgtctcaagaagcttgtgaagaggttttttgaacacgaatggaacatggatggagagccaccagcaacagcaaacatagaccagatggaaaaagaagcgaaagacgaagctcagcaagagctagcacaccaatga

SEQ ID NO: 65748 - DNA, 231 bp, Glycine max
  Peptide Sequence Number=SeqID_157433
atggcaacagaatggagaaggaagagagagaggagacgccacttcaaggagaagatgagtctagaagaagctcaccaccataggaggccatggataagagcttggaggaagaaggaaatgaatgaagggagagggagagaagagcacgaaattttgtgctctaaaagagctctaaaatctgaacccactaatacaagatcaattccaagattctccactaagtgtgcttag

SEQ ID NO: 65749 - DNA, 468 bp, Glycine max
  Peptide Sequence Number=SeqID_157434
atggtgctgagggggtcacacgctgatgagggattcctggagcgtcctgagctaaagttggtgtcgaacaggaggaaggtgacattgattgggaggccagtgcctgagattgaagggctggttgccgccacaggattaagtcaattgattgggtgttcagttgtaaccagcgatccaagacttatattcgcatttatggagaggtggcacagggagaccgacaccttccaccttctagtaggagagttgacgatcacactagataatgtgtcgtcactcctccatctccctatcagtggcgccttccacagcttcgaggctctttccgtggacgaggcagtatttttgttgatggagttgcttgaggtgtccagtgaagaggctagagccgagacagtacgagcgtgcggggcatatgtacacctctcatgggttcgggagatctatgagatgagatgccaggcatga

SEQ ID NO: 65750 - DNA, 489 bp, Glycine max
  Peptide Sequence Number=SeqID_157435
atgtgggtctttcataccgggcgtcaacttgactgggcacacttagtcagatatcgcatgcataaggcattgcgattaaatgctccattgccatatccacaccttgtcactctctttcttcgccattttcaaatttctcttgattctgaaccttatgttccaattaagagatcctttttaattggtgctgctgtgattgattcttttggttaccgcaaagagcatgatggctcttgggttaaaaagggtgctcaacccgttgataatgaaggcaacctaccagtgaaagataattcctctcttcttcgaaggcttttggacaagtttgatggtcttcagacttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcctcttag

SEQ ID NO: 65751 - DNA, 545 bp, Glycine max
  Peptide Sequence Number=SeqID_157436
gactacatgccctcgcctttagagggctgcacgtcctcgccttcagagggctacacgccctcgtcttaagaggactacacatcccgccttcagaagtacacgtcctcgcgttcagagggctacacgtcttctccttcagaaggctacacaccctcgccttcagagggatacacctcctcagcttcagaggcttacacgtcctgactttcataggactacaagtcctcaccttcagaggcctacacgccctcgccttcagagggaaacatgccctcgcctttagaggactacacatcctcaccttcagaggactacacgtcctcgccatcagagggttgcatgccctcacctacagaggattacacgtcctcgcctttagagggctacacgtcctcaccttcagagggctgcacgctgtcaccttcagaggactacacgtccttgcctttagagggttgcgccctcaccttcggaggactacacgtcctcgccttcagaggcctacacgtcctcgccttcagagggctacacgtcctcgcgtttag

SEQ ID NO: 65752 - DNA, 501 bp, Glycine max
  Peptide Sequence Number=SeqID_157437
atggctactccacctgcctcgcctcctcctcctcttcctcctcctcctgcagacgcatcagtgtctccatctacattgaagcggacacgcaaggcgacacggctacgatcattggccactagactacctggggcagaaagacctgtggtcaacgtcgatcttgctaccggcaaggccgacgatacccaaaagaagaaattaagaacatatttggggattgtcgctcgtgataaggtcgacgtgacatatgacacctggaaggaagtccctactgctcagaaggatttgatatgggaggatattcaggatgtgcagaaaaaggcacaggccatccagaagcaaaacactgcccctcacgtgttgtctcatgggggttatcaatatttagaacaaaagctcatggctgagaagacaaagaaaagaaaagactggaagaagctacccagtccggaagcactgagggcatcattgaccctccatctcccattagacgccatgtga

SEQ ID NO: 65753 - DNA, 288 bp, Glycine max
  Peptide Sequence Number=SeqID_157438
atgcctgcgccaatgccgcagaaacggcgcgcctgcagaaaggtgccgagtccggaaaccaacagcgacatgctgatgagatacgggatccaggcttgtaaccccagtacggaaccgataatcagcggcggcgtgatgataccgaccacgctggccagcacgtgctgcagggcggcaaagaacgccggtgcaggaccgatgcgggcatccagcccgtacaacaaacctttctcttcttctgggtgcgacatagcagggctccggcaaacgatttatcagtttgcctga

SEQ ID NO: 65754 - DNA, 1185 bp, Glycine max
  Peptide Sequence Number=SeqID_157439
atgcaatcaacaaccgtttcccgtaaaacagcctggctgcgcgtggtgctgctggctatcgctgcttttgtcttcaataccaccgaatttgtgccggttggcctgctgtcggacatcgccagcagctttgcaatgaaaaccgctgatgtcggtatcatgctcaccatctatgcctgggtcgtggcgctgttatcgctgccgttaatgctgctgacgcgcaacgtcgagcgccgcctgctgctggccatcctgtttattctgtttgttgccagccacctgttatcggccgtggcgtgggatttcacgtcgctggtgctgtcgcgcattggcattgcactggcgcacgcggtgttctggtcgatcaccgcctcgctggcgattcgcgttgcgccagccggcaagaaaacccaggcgttgagtatgctggccacgggcacggcgctggcgatggtgctgggcgtgccgattggtcgtattgtgggtcagtatctgggctggcgcaccacctttggtatgatcggcctgtcagcgctggtactgctgattatgctggtgcggatattgccgcgcctgccgagtgaacacaccggttcgctcagcagcgtaccgatgctgtttcgccgcccggcgctggtggcgatgtacattctggtcaccgtcgtggtgaccgcgcactacaccgcttacagctatatcgagccgtttatgcaggtagtggccagcgccgatgagaacttcaccaccctgttacttctgctgttcggctcagccggcattctgggcagcattctgttcagcacgctgggcaataaattcccgtccgcgctgctgatcgccgccattgcgctgattaccctgtgtatgggtctgctggtgtttgctgcggtacgcccggcagcgattaccgtgctgtgtattatctggggaatggcaatgatgatgatcggcctggcgatgcaggtgcgcgtgctatcgctggcaccggacgccaccgacgtcgccatgtcgctgttttccggtatttataacatcggtattggcgcaggcgcgctactcggtaaccaagtcagtctgcatctgcagatggcagacgtgggcaacgtgggcgcaatcattggcctggcgggactgttctggtgtatcgccattttccgccgttatccgcagctgcgctccaacggctag

SEQ ID NO: 65755 - DNA, 735 bp, Glycine max
  Peptide Sequence Number=SeqID_157440
cgcttccgacagctgaatcgagagcgaatcgcttttgcgactttcgcgctccagctggctgatgacgccgcgcgccagcgccatgccgcgcgtggtcagacgccagctggcgggtgtctcttcatcctgtggcggcagcaactgctgccagtcgagcgccaggctgaagcgctcgcgacagtagagaatattgtcgagcgccagatcgttgacgctatcaaagctgtggcaatcacagtcgcggatgtaaaacacatcgccgcaggtgatcagccacggccgatcgttgaggatatgcaggccattaccgcgccagacaatcacaatctcgctgaactcatgccggtgcggtgggaaagagggctgcggcatgcgttctgccacggcaataggcaaattgctggccgggaaggtggagaagtgattactgtcaccaaacccacactgataggcgatgtccgtgatgcgcatctcgctgtggcgcaacagccgattgagatagcgctgcggcgtgctgccggtctgctgcttcatctggcgatgcaggccagtccagcaagcggtgcaggcgggcatcctggtcctgcgcctgatcgttgtgcgccgcctcgcgcagcagcaccagcagctgcaaaaagtgctgttcctgctgcgcctgacgttccagcgaccagctggccggctgcttcatctgcgtcaccagctgcagcgcctgcgccatcactttatggttga

SEQ ID NO: 65756 - DNA, 239 bp, Glycine max
  Peptide Sequence Number=SeqID_157441
tgagttcctttggttaccgtaaggatcggaatggtcaatggctgaagaaagacgcactccctcctcaagatgagcgtactccttcacctcctcctcagcgagaagattcagcactcatgaatgaagtccttacggaattacgaggtctttgttcttatgttggtgaatgtttcgactcattggatacacgttttgcgccagcatggatattcgcctcacacagcttgaagaggatgtag

SEQ ID NO: 65757 - DNA, 846 bp, Glycine max
  Peptide Sequence Number=SeqID_157442
atgtacaacatcaaagatgttcttgatgaagacattatcattggtatcaagaatatgctagataacaacaatcattatgcacaaaagttcaaaatagcaagggacaaactacaatcttctgcggtttctaacctcaagctgaaactcatttgtgataggcagtcagatggaagattatataacatgccaaatactgctgaagttgttgctttgattattggtgatgagcacatagactgcaatcaagggacaatgaagctcaaacaatactacattcaaggagattgtttcaacaatggattgttgatggctagtgaactcagagttgacaagtacatgaatttgagtgcctataataatgaccccgaaacacttggcaatcaaaaaggaatgagagttatacttcctagttcttttgttagtggtaagaggtatatggaacaactatattttgatgggatgacaatttgtggccatattggatttccggacctattcttgacattaacatgcaatccaacatggcaaaaaatacaaagaaaagttaggaaatccaatctgacacctcatgattgccctgatgttgtctcacgggtattcaaaatgaagctaaatcaattgatgaatgatctcaaacgtggacatgtctttggtgccattcttggatttgtttacacaattgagtggaaaaaaagaggattgcctcatgcttatattttaatatttctgcaaccttcaaacaagtatcccaatccaaaagacattgataacctaatttctgaagagataccaattaaggacacatatccagaattgtatgtgttggatcaagtggcctcaaaataa

SEQ ID NO: 65758 - DNA, 993 bp, Glycine max
  Peptide Sequence Number=SeqID_157443
gtagaaatataccatacggagttggatgagttcaaggctgaattggaaaggcgtaacttccataagcgcctcaccaatttagctgacagcagcatcgacctagccttggtggaggagttctatgccaacctctatagccccgaggggccttcaccaaaacaaggagaatccttacccgcttactccagatactgcaggatgcccactaatatcagagagattgaggcagctttgtgtatacccgaccgagggtttgttttaaatgctgaaggccatcctcggaagatcctcaggaaagatctaacaactctttctcaagtttggagtgttctctcatactccaacctggcttcgacttcccacacctcagatttgactgtagatagagctaggttaatctttgacctagtctctcagctggacatgaatgtaagagctctcatctctggccatatcacatctatggcccagtctaactcctctagacttcggttccctgctcttatcacagctctatgtaggtccagaggggttgcttctgacagcctggtcttcgaacgcttgagcccggtcattaacttggcctatatcaggaagaactattggaaccctgatgatctgacatttactattagaggggccaggagagcaagggcaaggccagctgaggctccttccttccacatctacagctcctcctccaacactttacagctagtagaacctccagactctattccttctatagagcagtttaatgagtgggtagcctggcccgggactcagcctccccttcataaggaagacgaaggtcccaccgctcaggtaccacaacagatggaggatgagtcatccgagacttccactccagagcccctaatcagaaggaagacggtagttgaaaaacaagaagctgcagccacttctgagaaatctcttgaggccacccctaagcctccagcaccagtggcagatacaacctcaccgcaatag

SEQ ID NO: 65759 - DNA, 204 bp, Glycine max
  Peptide Sequence Number=SeqID_157444
atggaaaatcttcacgaaatcgcctatggaaacatctcggaagcgcctcggcttggattttcttcacggaaacaatttttctcactaatttcaagggaaaaaagggaggtagttgccgcccagctcgcccaggcgagctgggttgcttccaccagaaggcaccaccttctgttggaacaccctggaaagtccaagtgggcctag

SEQ ID NO: 65760 - DNA, 483 bp, Glycine max
  Peptide Sequence Number=SeqID_157445
atggatgatccaaagggtagttcctcgtggttaaaaagtctaaatataagtgacatatttggctggaaaggtcatggagaatatggagctctggcagctatagtcatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 65761 - DNA, 839 bp, Glycine max
  Peptide Sequence Number=SeqID_157446
tgtatggaaagattctagatttgaccgcagcggaggtgtttacggaagctgtcgtatccctcgcccaatactatgaccagccgttgaggtgcttcacgtttggggacttccaaatggtaccgactattgaagagtttgaggaaatactaggatgccctcttgagggaagaaaaccgtatcttttctccgggtttcttccctccttgagcaagattgcagctgtggttggggattcggcaaaagagttggatcgcatgaagcaaactcgcaacggcgtcgtaggcctgccacggaaatacttggaaggcaaggcaagggatatggcgagccaagagaagtggggcccgtttgcggatatactagttttgttgatttttggggttgtcatctttccgaacgtggacggtttggtggacttagccgccattgatgctttcctcgcatatcaccacagcaaggagagtccagtggtggctatcttgacagatttgtttgacacctttgaccggaggtgtgagaaaaacagtgcacggattgtctgttgtttacccgctctctgtgtgtggttggtttcacacctattccaacaagacacaagacacccgtgtccgcttcaaagttatcgctcatgcgccgaaaaaggaagagtcgattgggaccaacatttggctgggataggaggcaacgcaatcaattggtttcctcgttggaaggaaggcaaggagggagttcttttctcgtgtggggactaccctaatgttccattgatagggactaggggatgtcctttaatggtgattttccaccatggagatgcagcggaagacaaaggagaagag

SEQ ID NO: 65762 - DNA, 234 bp, Glycine max
  Peptide Sequence Number=SeqID_157447
atgaaggcccagaggcagagacactatcaagactatcaattgttgctgaaggcccaaactaatttgaaggcccaaacttatcaaggtaatccttgtggcgtctaccctgacttatcttccttcatcggaagtggcgtctaccttgacttatcttccttcaccggaagtggcgtcatccaaaccttcgtagcctgtatcaaacgatccgctcctactcaggttcacatcatatag

SEQ ID NO: 65763 - DNA, 1260 bp, Glycine max
  misc_feature (1251)..(1251): n is a, c, g, or t
  Peptide Sequence Number=SeqID_157448
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgaagtggagggtttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccngggatgtga

SEQ ID NO: 65764 - DNA, 411 bp, Glycine max
  Peptide Sequence Number=SeqID_157449
atgactgagcaggacttcacaaaccctatccctgatttcatctctgatctctacactcgcctcctcattcatctcaacattctcctcgaggaagacaaggagcaagtcaaattccatgccgtagagcatcttcaaaaccctgattttcacgtggagtccgttcgcgcctttaaactctacaaccagatcaatgaggttctcacaacgctcgaggacgcgagaatgaactctgtctcagaaattgtggaggaagtgaatgctgtagaggcacaacagacaaagttggaggagaacataatattgcaggagagaaacgatgttgaaagaacaggttactacatcgatgttggcgtaggaaatgttgtagaaagtgcaagttactacattggtgcctccaccaaaacgatgtag

SEQ ID NO: 65765 - DNA, 924 bp, Glycine max
  Peptide Sequence Number=SeqID_157450
atggcatccttcagccagatgcagtcccagattcagtcccagatgcaatctcagggacttgcactacctcccgagcctctggttggtccctccgctcctcgagtaagcacaaaggggagttgtgttgatccctcaggaaacgatcctaagacgggtgactcagataggtgcggcttgtacatcgaagcagatcctgcccgcctggttgccctggggagagtttatgagggatccactgttgttcataacactcctttgttgcctagccaagtaaaggtgggtgtggaggaggttacagatgcagatgctccagttcttgtacccactgatgaggtttccttagtggggcaggcacttcacaccttccttgcttggtcgacacatctggtcaagtcattatcaaagcatgtagttgtgtctccggcaaaaccacctccaaagcccgatccggaggttacatgggatgccaccgtgttcggggtctttaatttagatttcccgctctacataaagcacgaagatttgtccgaaattgcacacggtggtcaatgtctcagcatttcagtgttacagttgtggattccgcatctcactgatacaagtatgcgagcggggaattctgatatctatggattcctcgagccacagtccattcagagcggacactggcaaatggtggtcatcctacccaaggaacacctagttgtctggttttgttcattgcataacaggccagacaactaccttaaggggattattaacagtgctttaaaaggtcttgatgatgctccacaacctaaatcaaaggctcctgctaggtggattgtcgtcaagtgtaatagacaaaaaggaagtactgagtgcggctactatgtcatgcactggatatcccccatcattttaggaacttttaggaataactag

SEQ ID NO: 65766 - DNA, 162 bp, Glycine max
  Peptide Sequence Number=SeqID_157451
atgggaatgatggaaacaaagaaggagaactttaccaagattatctgccaaaccatatggggggattctaatgtctcttgggatagtgttccctcagtcaggaaggaagctatgtgggaagagttgaggcagttaagagcttctaaccctaagggtttatga

SEQ ID NO: 65767 - DNA, 432 bp, Glycine max
  Peptide Sequence Number=SeqID_157452
atgtcgttggatctgagggtcagaatgctccccaaagccaattaccttggtgtggctgtggttgtccttgaagcagtctttgttaagtataatagatgggtagtgattgaacctcaggactatgtcactgtcaacctccctgatcaacctgctgaaaaaccatccattggcaagaatctcgaatcactccaacccgctaatgagttattcctagtcaagtgcaagtttcagctttgtgcttcctgtcttaaaaggtcaaacctgtctcaacttgtggcaaaattctcctctaccaaaagagtgattttagccattgttgatcctgcgctcattgttgtttccaaaagtgctcatgtgctcattgctggaaagtcaagtgtgctgaagtctccaactcaggccttaggggatgaatatgctgtttgtgcatag

SEQ ID NO: 65768 - DNA, 282 bp, Glycine max
  Peptide Sequence Number=SeqID_157453
atgcagcaaccttctccaattttttattctaacaagccaactgaagctgaacatacggaagcaaagcttcatgatgaatcaacaatgattcaaagctcaagtgaatcaaagaacatctcaagagaatcaagaacaagtcaagacttcaagattcaagattcaagatctcaagaatcaagatcaagattcaagtatcaagaatcaagactcaagatctcaagaatcaagatcaagattcaagactcaagattcaagaatgaagaaaagactcaatcaagataa

SEQ ID NO: 65769 - DNA, 141 bp, Glycine max
  Peptide Sequence Number=SeqID_157454
atgaagcaagtaattggagatgatgcaaggctagttaaggagttcaagcaagaaatgatgcaagcttttgaaatgattgatcttagtctcatgacttattttcttggaaatgagatcaagcatagtcagaaaaagtgttaa

SEQ ID NO: 65770 - DNA, 453 bp, Glycine max
  Peptide Sequence Number=SeqID_157455
atgcctcaagatgtagtagtggggtcatgcttagcgagatggtctcgcttagcgcaatgccattccaaagagggaattgggcttagcgggtatgacccgcttagcccaattggcatgggggtccaagcagagagaatcaggagtcaagcaaattccaaagattcaagaatgaagttttcaagaatcaagtttcaagaatctagaattaagaataatcaagatcaagattcaagactcaagattcaagaatcaagagaagactcaatcaagataagtattaaaaagtttttcaaaacattgagtagcacactgagtgagtggatgactgaaaaagtttttcaaaacattaagtattacaagataagtattaaaaagtttctcaaaacctgtttaccaaagagtttttactctctggtaatcgattaccagaatattgtaatcgattaccagtag

SEQ ID NO: 65771 - DNA, 465 bp, Glycine max
  Peptide Sequence Number=SeqID_157456
atgtttttcaacttgtatacaggtcaacaaagtcatcataatttaaattggaaaaagtacacgatgcaattgcatgcgagcaagtattatcttgctcatcaccaacatcaatcatatgcagaacctaatgtacctccagtgcatgttcctgaatttatgtcccaacatcatccatcacaagcacaatatcaatcaacaagtttttctggtcatgcgtctcaagaatatcaacaaagtgacatcagtcatgaagatgaggatgagaaggataacaacaataacaacgatgatgatgacgatgatgatggtgatggtgatggtgataatgatgatgacaacgaacaagaggaggtagaggtcacagacgaccaagaggacaacaaacacagacaaattcagtccaacaacatgagagacccacgcatatctagaagaactcgttgtgggacatcgtctcattattaa

SEQ ID NO: 65772 - DNA, 1065 bp, Glycine max
  Peptide Sequence Number=SeqID_157457
atgccatcatatggagtgttccctgagtatagagatcatccagatggcacacccattaccaaagaaatcagtagaattgggcatggtcctcttagaccagaatcaaatgaattctgcgccgctggatacatgcggatcaagttgatccgcaggatcatctacatacaacgaagaagacacaatagaagcatgataacgaacaacaatggaagcacgaaacgcctaccatcatctaagaccaactacacaaaacgaacaacaatggaagcacgaaagaaaaaggcacgaaatgcttacctcgacggagaagcacaaatgaagaagaagaacgaaagcaccaccacgacaccgtcaacaatggtgaacagcagcaccaccacttggtcgtggaagcagcaaagcgcaagagaagatgagaggaacgtggaagaagaagacgaactgagctcgcagaatagaagaacaggaacgcggaaaagaagaggaacaggcgcgctgctggcatgggcggacacagcatcgttgctggaaatgtctgatgctttgaaagaactgagaatttattgttgccccaaatatgaaatgtttagctattgtgaaatgagtgatgatggctgtgactctctaaagacttttcggctagatttcttcccagcactcaggacccttgatctcagaggctttcgtaatctacagatgattacacaggatcacacccataatcatcttgaatttctggccatcaaagagtgccctcagttagaatcattgcctggaagcatgcatatgctgcttccatctctgaaggagctacgaatatatgattgtccaagagttgagtcgttccctgaaggaggtttgccatcaaatctaaaagagatgggactctataaatgctcctccggactcatggcctcactgaaaggggctttcagagacaatccctgtctggaaaccttgtggataggaaagctggatgcggaatcttttcctgatgaaggaggcgaagactggccaaagattgctcacattccaaccgtggatatttttggtagtatacggtag

SEQ ID NO: 65773 - DNA, 138 bp, Glycine max
  Peptide Sequence Number=SeqID_157458
atgggtttgtcaggcttaaaggaacactcaaacccggtgacccccaaggcttacactccgaagagtccgtcagggcctctccctcctgattcaggtccaatccctaaaatcattttagcacacagacactgttcgtga

SEQ ID NO: 65774 - DNA, 303 bp, Glycine max
  Peptide Sequence Number=SeqID_157459
atgattggaagccttaaggaagagtggatgaatgagataattggaaaccttaaggaagtgtggaggaatgagttggaagaacaaaacaaatatagtttagagaaaaagaaacaagagttaaaggaggccatcaaaattgagttatccaaaaggagatcatatccaaagaaactggttgaacctgttcaaaagtcgaataatgttgctgcacatgatcccttgggtgacttcattaagaacctgtatgatatttacaagagcctattgagtgggatgagactaaatttgggattccaaatgtag

SEQ ID NO: 65775 - DNA, 1528 bp, Glycine max
  Peptide Sequence Number=SeqID_157460
atgaggtcaaaagaacacaagctggagcaattacaagaagattattgctggcaattgttcgcaaaacatgcattcagagatgataatcttccacgagatccaggatgcacagatattggtatgaagattgttaaaaaatgtaaaggacttcctctggccttgaagtcaatgggaagtctattacacaacaaaccatctgcccgggaatgggaaagcgtgttgcaaagcgaaatatgggaattaaaggacagtgatattgttcctgctttagcattgagctatcaccaccttcctccccatctcaagacatgctttgcttactgtgctttattccccaaggattatgtgtttgacagggagtgtttaattcagttgtggatggctgaaaatttcctaaactgccatcaaggcagtaagagtccagaagaagttggccaacagtacttcaatgatctactatccagcgatttcactattcagcaattaggagagctcaatcttcatggaagcctatttatggagttgcagaatattaagaatccgtcagatgcattagctgcagatttgaaaaataaaacaggccttgtgaaactagagtttagatggaattcgcacgggaaacatgatgatcatgccaaagaaagggatgtagttgtaattgagaatctacaaccttcaaaaaacctggagaagttgtcaatcaggaaatatggtggtaaacaattccctaattggttatccgataattctttatcaaatgtggtgtccttagagttggacaactgtcaatcttgccaacatttgccttcccttggacttttgccatttctcaagaaccttgagatttcaagtcttgatgggatagtgagcattggtgctgattttcatggtaatagctcctcttcatttccatcgttggaaacattgaagttctcctctatgaaagcatgggaaaaatgggaatgtgaagctgtgataggtgcttttccatgtcttcaatatctttctataagcaaatgtcccaagctgaaaggtgacctcccagagcaacttcttcctttaaagaagctacaaattagtgagtgcaaacaactagaggcttcagctcccagggctctagaactaagcctaaaagactttggaaagctgcaacttgactgggctactttgaaaaggctcagaatggccggacccagcatggaagcatcgatgctggaaaaatctgatactttgaaagaactgtttattcattgttgcccgaaatatgaaatgttttgcgattgtgaaatgagtgatgatggttgtgactctctaaagacttttccgctagatttcttcccagcactctggatccttgatctcgtaggctttcgtaatctacagatgattacacaggatcacatccataatcatcttgaatatctgataatcagagagtgccctcaattagaatcattgcctggaagcacatctctgaaggagctaaggatatatgattgtccaagagttgagtcgttccctgaaggag

SEQ ID NO: 65776 - DNA, 378 bp, Glycine max
  Peptide Sequence Number=SeqID_157461
atggtcttacaatcaaaggtcattctcaggaaccaccaacaagtgcagcaacaactaattaagtgggaaggtcttgaagatgatcaagctacatgggaagatacttcaacaattaaacttacttttcctgacttcaaccttgaggacaaggtttcttttaaaggggaaggtaatgtaacaagtgcaaccttagagggaaatgaagaaggaaaaggtgggaccaaagcaaaaagacatgtggcaaatgagaaaggagagaggcgtagcatgaggttggctgaggttcccgatgtgaaattgcaattctgttgcaattctgaatggagaatagcactaaaaacacctaaggaattgtatccaacctacatcctttcataa

SEQ ID NO: 65777 - DNA, 385 bp, Glycine max
  Peptide Sequence Number=SeqID_157462
atgagtggaagattgagagatgagattttagggaaaaagatagggttgaaagggggtggctattgcaagaagaagaagtttggggaaagagggagaaagcgtggagaccgtgcgaaacagcttgcatcaggcatcacatttctcaagcagcttggagacactgcgagactgcaacaacttgtggagaagaactcaaaagagcttgatgggttacatggttttcctcgtctgaccgttgggatcttgaaaacaacaactttaggtctcccgctaaccgagaatggcacgctaagcgcaattccaaccgaggggaattgcgctgagcggcccaaagctgcgctaagcccattttcaaccgagaggaagcgcgctgagcgcctagagg

SEQ ID NO: 65778 - DNA, 1143 bp, Glycine max
  Peptide Sequence Number=SeqID_157463
atgaaagcaccaagtgtaacagtgataccacaagcaacaagaaaaggacaagaaaaagaaatggaaacaggagttgtattcattaaaattccattccaaagtacaatgccactagctcaagccttttttggtggaacttgtgttttgctaagaggaatgatggaggaaattcctgggaatgaagaagctgctgagcctccagcatcatctcaatcacctgctgatgtgccacataatatggaaacagaacgaatgactgctacaaagtattctattatcagtaggaatggggttgggaccacaggaaaacacttacctttacttgtgaatctcttcgaagttgttgtaaatgttccagacacagtatttttccagtatagtgatttccaggtttctattaactttgaagataaacgagctgttgaaagcaagggcattgggagaaaagtgattgataagctttatcaaacatactcttctgaacttggttgcaaaaggtttgtatacgatggagggaaaactttgtacacagtgggtcctctgccgctaaataagtatgagctcaaagtgttgctggagaaatcatttacaaaacgttttaatatgaaggttaaaaatgatgacgacaatagtgaagggcagacagtggatattactgtttatgaatattttgccaaacgctgtggcatagagctgacctcatctgcttatcttccatgtcttgatgttgggaaaccaaaatggcccatctatcttcccttggagctatgttcacttgtttccctccaacggtatacaaaggttttatctccgatgcaaagagcgtctttagttgaaaaatcatgccaaaagcctcaagatagaatcaaaattctgaaaagtgctgtaggaaattgctacaacgatgatcctgttctttcttcatgtggcatttttattgagaaacaattgagtctgattgaaggttgtgttcttgagacaccaaagaacattgaacggccatatactttgatagaggaggaaccacagttgagaaaatctaaccctgttgcaagggttgaaagaatgtttgacctgcttgcatcaaaactgaatagagaaccaaagttgattctgtgtcttgccagagaggaaacattgtga

SEQ ID NO: 65779 - DNA, 150 bp, Glycine max
  Peptide Sequence Number=SeqID_157464
atggctaaagctaaccatcaagtggacaaaaagtggattcctcgtgaggagggcagacccaggttgggattcatgcgccactttcccaagttgaacaatcctggaagtgggagagagacaaagagtgatttttctctgggttccaagtga

SEQ ID NO: 65780 - DNA, 1332 bp, Glycine max
  Peptide Sequence Number=SeqID_157465
atgaatgtagaacaaaagatgtgtaagcttgccaaatatatggaaaggaaatcaagagatttgaaccaaggaacatttggagagataaaagaagctcttacgaggatgaataatgttggccctgatgggaatcaatttggatttatgccaagaaggtctacaacaaaagttatgtatctatcaaacatagcttacttggcaaagttgccaacttcacttgaaaaaagcccattgacgaatcaaatagagccgcataggttacgattacagaaggttcaatcatcaaatcctggcacaatattagttggtaatacagataaccaggaggagtctgccatggctgatgccagtcctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgggattttcatatcaagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcactccttgctatacatgactacttttcgcgtctgcgtgctctcagttcactctggcttgctcgccctagagattga

SEQ ID NO: 65781 - DNA, 348 bp, Glycine max
  Peptide Sequence Number=SeqID_157466
atggcttttattccaaaaggatacaacaaaatgaagccttgtaagatatcttaccaaaatataaaacaaaaaatggagtttggcaataaggaattgtctgtacttacaaatgagtttcactaccccggtagggaagcggtcaacgacaaacggattaccaaggagtccctctccttacaaaagtctctccttctgggaaaggttatacaacatttgtcctattatgaggaccccataaaggtgtttataccaattttaaagacctttgtctggcaaaggagggtattcaaagtccaatttacaaaggattctattcaagggaagaagcagaaaaaacccttgaattaa

SEQ ID NO: 65782 - DNA, 1777 bp, Glycine max
  Peptide Sequence Number=SeqID_157467
aactgttgggatagaagaattttcatatgatcctaatagtgatacattcataacaccaaataactatgaaccagcatatcatcctccatcaccaaaccaaccaagtccaccatcccatccccctttagattcagaggttcccatagaaaaacaaaactgtcacaagcgaaggagatccgagtatggagggagttcaagcgctgttgggatcaacaatcaaggcaacgttctggaaaaggcaaacatgaactccgctgacgatactgtcgctggttttacgagcactctcgccaagtccctggaagatcagggattcccggcgagagtgctcgtggaccaccgcgacctgaagaaagcagagattgagacagtgagggtgttcatcgttgtgttgtccgaacactatgcaatttgtccgtttcggttggataagctggccgagatcgtggatgggttaggtgcccggcagcgggttctcccggtgttctactatgtgcccacgtctgatgtgcggtatcagactggtagctatgaagtagcattgggtgttcatgagtactatgttgaacgtgagaggttggagaaatggaagaacactttggaaaaagttgctggctttggcggctggcccctccaacggactgggaagacatatgaataccagtatatcgaggagattggtaggaaggtctctgaacatgttgcttgctctgttgaactgcattctcgagtgcagaaagttaatgaacttctgtattctgaatctgatgatggtggagtcaagatggttgggatatgtggagaagatggaacaggtaaaacaacagtagcttgtggagtttattactccaatgctgctggaaacaggtttgactatttttgctttcttgataaggttggagaatgtttaaggaatcatggatttataggtctcataggtatgcttctctctggaatgattggtgacagcaacaacaacagtgatatcatgaaatttggaaatacaaacaaaggaatgtcaatattaaagcgaaaattcttcgaagaagaaaagaaactttttttagttcttgaagacatttatgatgaaaagcaattgcaagacattgttaggctaactaactgctttagttctaacagcaaagtcgtcattacaactaaggacaactctttgctacaccgtcatgagattagattgtacgaggtagagaggttcaaaacaaaagatgcttttcaattgcttagtttgaaagcttttaattctaagaatttgaaatctatgtatttgagcattttagaacgagcagaaacttatgcttcagggaatccattcattctagaagtgatgggttcctacttgcgcggaaaaagcatagaggaatgtgtatctgcattagatcaatatgaaaaagttccaaataaagagaaacaaaggatagttcaaataagctttgatgctttggagaaatgtcatcagaagatgttgtcttgcattgccttttacctcaatagacaagatttgcaagtggttgaagaaaaactttataggcagtttcgtgtcagtccaaaagatggtattaaagtgttgcttgataaatctcttataaagattaatgagcatggtcgggagcatgtcaagcaattgaagcaagaaatccaacctgcctcgaatgatggaagcatttcaacagatggaattgggagaaagtacggtaagattgatatgaatggtttggagtatggcatacaagaaatccagcctgcctcaaatgattga

SEQ ID NO: 65783 - DNA, 483 bp, Glycine max
  Peptide Sequence Number=SeqID_157468
atgaggggtcaagacatttatagtagtcaagaggagactacttcttccccttcctctagtggaaatgaagatcaagtaaggggtgaagagtctagtgaggaagtctacccccatgaagaagtttccaagttgaacctcactatcattccccacccaaaaccttataaacttcaatggctcaatgagcaaggggaaatgatagttaaccaacaagtgaagattactttcacccatcttggcactaaatttgtgttgcatcctcaaacaccttcacaagtggtcaaagatcaaccaactatgaaagttaagaggggtgaggaagaaaaactagaaaaacaaaagaaaaagaaggatagtaagaccttgtcttcaaaggccaaggggaaggaaaaagaggaaaaggattcctccaagaagattgttaagaaggaaaatcattttacaacaaaaggtgatatcaaaggagcactccttcttaaataa

SEQ ID NO: 65784 - DNA, 1474 bp, Glycine max
  Peptide Sequence Number=SeqID_157469
taatgggaattctatggaaggctatacagagcttaaaaatgagcctggtactcaccctgctggggatgttgctgagcctaactgtcacttaggaagtgagtttcttgagccttccaatgaattccacacaaaacctacttatcaccaaaattacagcacctggacgccctgccattttaactctcacaaggtgcagcaatgccaaatgaatgcttttgagagccattattatccttatcctgttgagaacccacttcagtatgttcctattaatatggttgcacaaggttacccgcgtgagcaatatcaggaatttcagtattttgtggtgatagactttgaggctacttgtgacaaagataaaaatccccaccctcaagaaataattgagtttccatctgttatagtgagtagcatcactggccagctggaagcgtgttttcaaacatatgtgaggcccacctgcaatcagcttctgactgatttctgcaaggatctgactggtatccagcaaattcaggcaaggaaaaaaagggaggcttggatggagatgggtagactggggtcgagccagttggggtactctgttgttgatctaaggttgacaacagtgattgcagcaattggaaggtggtggcagctagaggttggcacccctgagagtggcggaagaagtgccatagtatggacatatggtgcggttattgcttctaatgcaattttgcatcccttcatcttcagcgtcaactgtgtgcatgggtgtgttaggcaagaaagtcaaccacaatctgagccaaggggccatttccttgtgagaaaggagagtgctcctttgtatagtgctgtggacagaggtgttacattgagtgaggctctacttaggcatgacaaatggcttgagaagaagggaataaagaattccaactttgctgtggttacatggtccaactgggattgtcgggtgatgcttgaatctgagtgccgattcaagaagatacggaagcctccttacttcaaccgctggatcaacttgaggattcctttccgtgaggtatttggtgctgtgaggtgcaatctaaaggaagctgttgagatagccggcttggcctggcagggacgtgcacattgcggccttgatgatgccaaaaatactgctcacctattggcacttctcatgcaccggggttttaaattttccattaccaattccataatgtggcagacagctgatcgaccactgatgtggaaacagtcaccagaacaaccaattgttttcccgcattccccctataaagcaaaggatatcactatccccgtggttcagtatcaccctttctgcttttgtggggtgaaaagcagcaggggcatggtgaggaagccgtgtcccaagcaagggagtctcttctttggatgtggaaattggactgcgactagaggtgcttgctgccgttactttgaatgggcttctaactga

SEQ ID NO: 65785 - DNA, 1668 bp, Glycine max
  Peptide Sequence Number=SeqID_157470
atggaagaagagaatgccatagagcttctccagagataccggagggaccggagagtgcttcttgattttatactctcagggagcttaatcaagaaagttgtaatgccacctggtgcagttacactggatgatgtggatctagatcaagtcagtgttgattatgtcctcaactgtgccaaaaagagcacattgcttgagctttcagaagcaattagagattatcatgatcatactggattgccccaaatgagtgatacaggttcagtcggtgaattttatttggtcactgatcctgagtcttcaggttcacctcccaggaggccaccaccaactgttcctattcctgcagtgcctcctgtcgctgtttccactcctcctcctgtttttccaccatccccaattgtttctaatgtatcgagatcggagtcttttgactctactcaagaaaaggagctaacagtggatgacattgaagactttgaggatgatgatgatgttgcggtggttgaaggcttcagagctaaaaggactcttaatgatgcttctgatcttgcagtgaaattgccttctttctccacaggcatctcagatgatgatcttcgtgaaacagcatatgagatcatcttgggttgtgctggagctacagggggtctgattgtcccatcaaaagaaaaaaagaaggataaaaaatccagcttgatcaggaagcttgggcgcagcaaaagtggaagtgttgtatcccagtctcagaatgctcctggattagttggcttgttagaaaccatgcgtgttcaaatggagatatctgagtcaatggatatcagaacaagacaaggcttgctaaatgctctggtgggaaaggtggggaaaaggatggatactctattgattcctttggagttgctttgctgtatttcacgttcagaattttctgataagaaggcttttatacgttggcaaaagaggcagttaaaagttttagaggaggggcttgttaatcaccctgccgttggatttggtgaatctggacgcaagacaaatgagttgaggattctgttggccaagattgaagaagcagagtttctcccatcttcaactggtgaacttcaaaggacagaatgcttgagatccctaagggagattgccattccacttgctgagaggccagctcggggtgacttaactggtgaaatatgccattgggcagatggttaccacttaaatgttagactatatgagaaattgcttttaagtgtatttgacatgctagatgaaggaaagctgacagaggaagtagaagaaattctggaacttttgaagtcgacttggagagttttaggaatcacggagacaatccatcacacctgctatgcatgggttttgtttcgtcagtatgttatcacaagggagcacagggttttgctgcatgcactcgagcaattaaataaaataccactgatggaacaaagaggccaacaagagaggttgcacttgaaaagcttgcgttccaaggttgaaggtgaaagagatatgtctttcttacagtctttcttaacaccaattcagagatggactgacaagcaacttggagattaccatctgcacttcaatgaggtttgttcaactgttaggttgttagatattcttagaatgtgggtttgggtctaa

SEQ ID NO: 65786 - DNA, 198 bp, Glycine max
  Peptide Sequence Number=SeqID_157471
gtaacgtcatccgaggaagaccctgaggaggatctcgaggagctgcctgctgtggatgctcttgactttctagagggtgatgaggacccactccctgagatggattctcccgaggacgtcatgtcggcatccgaggcagactctacggaggatagtggccctggagagatggcgatcagtggaggctcttcatcatag

SEQ ID NO: 65787 - DNA, 390 bp, Glycine max
  Peptide Sequence Number=SeqID_157472
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatcatggccagaacacgaggtttaggtcgtgccataggtagagttgtaggcagagatagacctggtgatgaggatgctgctaatgttcccgagagacgaaggcctactgcctcagcccgtaggctacgcgttcatcagatgacaacggagggacgcgatatggctaaggacgtcgctgacatgactgacgatgtccctgagcaggctgcggaggcacctgagatgcgtgcggacgcatag

SEQ ID NO: 65788 - DNA, 746 bp, Glycine max
  Peptide Sequence Number=SeqID_157473
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcgagcccgggcggagcggtcgtcgtgcagatcttggtggtagtagcaatattcaaatgagaactttgaaggccgaagaggggaaagggacgggggaagcccgtctgatagcgctctgtgcgcgtactcccgaaagggaatcggagttatcttttctgtttaacagcctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 65789 - DNA, 249 bp, Glycine max
  Peptide Sequence Number=SeqID_157474
atgcccaacattgtgaatttaatgtgtttcaacttcaatttcagcgagaatcacacgctaagcgaggcactcagcccgcttaatgagttgggagaatctagagaagaatttgagaagcatctgcgcgttcagcgcgtcatcagctcgctcagtgagacatttgtctcttcccacgttaagtatctctgttgggaaattctggcgaaacttgatgctaagttcaatgagacatctgagaatgaggtttaa

SEQ ID NO: 65790 - DNA, 303 bp, Glycine max
  Peptide Sequence Number=SeqID_157475
atggcagagaaaaaagaaaaacacgtgccatcaccaacagcatgggttaccaaaacatttgagatacaatataatcctaaatgcaacataaccaatgctcccaacacgatcggaaagagtagagtacgcgacgagaatctccatgaattcgtcagcggacaagtttttttggttgatggccgccacgtcggggtggtagactttggccagtcgccagtatatggccttgatttcttggttagaggtgtcggcgggaatatcaagaatatcataaagcgacgagcaagaggacttcagatatga

SEQ ID NO: 65791 - DNA, 210 bp, Glycine max
  Peptide Sequence Number=SeqID_157476
atggcggggtgtttcagaaccaaccagaggatactggtgagaaaggggaataaagatgaactgggtaaaacaataggaagagaacaggagaaacctcccaagtctcaaattggttgtgagaatgggtccaaattctctaattggccgaatgagagagaagtgagatggaagggttttggagaaagccacgagctgatatggaaaatgtga

SEQ ID NO: 65792 - DNA, 540 bp, Glycine max
  Peptide Sequence Number=SeqID_157477
atgagcattcacatggctcagttaatcgctgatgccatctatctatttgcaggtatggcgcctaccaggcaccctctggacctggataagtccaacagggccctgggttttcccgctttgatcacaagactctgccagtcgttcggagtccccgtcgcacctagcaaggtgattcgaccgcccatcacccgagcttttattgagaagtattgcacgcagagacaagcccagggggatgctccgcaggccgcagacgcgccaccacctcatcaggctggcccagttggatcatttgatacggagcattatttacggcattttgttcgccaacaggcggccaatcaccgggcgcatggttttacttcttttccgtgccctactccggatcagttcagggcagaggtcgcatggcccggagattggcctgaggcccgggcaggagaggcactagcagaggctcccgacgaggaagatgaggcccgcgaggacgaggagatgaccgatttacttgatttcttaggagggagcggagccacatga

SEQ ID NO: 65793 - DNA, 396 bp, Glycine max
  Peptide Sequence Number=SeqID_157478
atggccataacttttgctccgggtgttgctcacaaagggctccacgccctcgcctttagaggactatacgtcctcctcttcaggaggctacacgccctcgccttcagaggactacacgtcctttccttcagagggttgcacgccctcgccttcagaggacaacacgtccttaccatcagagggctacaagtcctcgcctttagaggactacatgccctcgccgtgaaagggctacacgccctcgcctttagaggactccacgtcctcgccttcagaggactgcatgtcctcgtcttcagaggactgcatgtcctcccatttagaggactacacgtcctcgccatcagagagctgcacgccctcgccatagaggactacacgtcctcgccttcatag

SEQ ID NO: 65794 - DNA, 270 bp, Glycine max
  Peptide Sequence Number=SeqID_157479
atgacaaaaggagtagagcccaacctaaaaggtacaagcaacgctctggaggttcttacccaatgtcatcaagtttcagcgggatcgatagacccttggcatcactctatgacttgcacataccaaagtatgacaatccattgccatccttcaatggggcacacgatcgatctcaaagccttatgtttccttgctgtgcagaataatagaaggttttcaacagaaagaaagggaaaaaccctaggatcaatatttcaattgattgcgtaa

SEQ ID NO: 65795 - DNA, 81 bp, Glycine max
  Peptide Sequence Number=SeqID_157480
atggagacaacaacaaagataaaactccaaatcatgctcaatgctttctatgtaaagaggattaatctggttgtggcatag

SEQ ID NO: 65796 - DNA, 297 bp, Glycine max
  Peptide Sequence Number=SeqID_157481
atgcggggttactgtatggttacccgcaccttttgtcaaccaggggcaaacgagcccattgacgtgcagagactaacatcgtcttctgcaccttttgtcatcctgacccgtgaagccaggttttactctcgtcgtccgaaaacattcaagcccggcgacgcgcgagattcttttctgttgggcagggacgatcaagtgcaatggcgaagggaagtgtcatggttttccaactttgtcattttcaagacactgaagtttgtttatgcttctgatgccttttcttttctttttgaatga

SEQ ID NO: 65797 - DNA, 186 bp, Glycine max
  Peptide Sequence Number=SeqID_157482
atgtctacccatggtacagatgagatgggtaagggtgtgtatagctcatcaagcattaccctagacttggcttgtaaacaagccacacacctagtagtgctaagggaggtttcccttgataggaaaagggggctgcccttgctcctacgtatcctcaggtgcaatgaggaattcagacctacgtag

SEQ ID NO: 65798 - DNA, 432 bp, Glycine max
  Peptide Sequence Number=SeqID_157483
atgcaggcagtgattgaaacagaacgcttacgactggaaccctttgcgctaagccacctcgccggcttgcgcgcgatggatgatgacccggaaatcatgcgttatatcaatgagggacaggtgaagagtgaggacgagacgctggcgaccattgagcgcgtgcagcaacgctggcagcgctatgcatctggcccatcaggaacaggcgccgctggaaattggctggcgactgttgcgcagcagtcaggggaaagggtatgccaccgaagccgctacggcgattgtgcagtttgctaccgggcagatcggcgtggattatctggtggcggtggcacatccggaaaaccttgcatcccatcgggtgatgcagcggctgggtatgcgctatcgcggtatcgagcagcattacgaccagccctgtgtggtttatga

SEQ ID NO: 65799 - DNA, 868 bp, Glycine max
  Peptide Sequence Number=SeqID_157484
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacaggggacttgggcccggtccgccactgaggacgcttctccagactacaattcggacgccgagggcgaccgattttcatggtgggcttttcccgcgggtagccccgctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 65800 - DNA, 309 bp, Glycine max
  Peptide Sequence Number=SeqID_157485
atggatcttcgacgtggttggcagcacaagcccagatctacgatcgcgaccaaaaacaagggtggatatgtgtcatcgggtggttgggcggtggatacatgtgaccaagaacaagcgtggttgggcagtggcctagtggaagctagcgccattcaacgaagcaaacactgtcgacgtggtgaaatagatttaggggttactgtacgcgtgcgctatcttctccctatctatgaaaaactaaatctccttcatgtcatcatctacaaagaaatgtgtgaagataatcattgtacgttggatccttcataa

SEQ ID NO: 65801 - DNA, 459 bp, Glycine max
  Peptide Sequence Number=SeqID_157486
atggataatgaagagggcgtgcaggaacagatgaaggccgatctatcggccttaaaagatcaaatggcttccatctcggaggtcatgtcaaaactccagaaaaccatagaggataaagccaccgcaaccgcctccagtacagttagggaagcggagccggtgctgcaacccgccttgaatccgggcctagacagaaacacggccgtgttcggtcgaaggtatagtccggaagcttatccttatggcctgcctccgaacttcaccccccgtgccaccccggaagatttaagccaagccccgacctttgaggggcaactcccaccttatgaagactatcccgggcaagacgatggggaaggagatacccatcttggccccctgctccacctcaaagatccatccccgcatgaactaccccagccgaacatagtccgccacatcccggcctcacccacaccc

SEQ ID NO: 65802 - DNA, 93 bp, Glycine max
  Peptide Sequence Number=SeqID_157487
atggggtctccaaaggtccccacgtggagccaaggaatggggcagggaatggggacgggacaaaaaatacccccaccacagggaacggggtaa

SEQ ID NO: 65803 - DNA, 744 bp, Glycine max
  Peptide Sequence Number=SeqID_157488
atgccgctaaaaaagatgttctttaatcgccgtatatccgtgcctttcgtcttgtccgtaggcctgcacagcgccctggtggcgggattgctttacgcttcggtaaaagaagtggtggagctgccgaagccagaggacgcgccgatcagcgtcatgatggtcaacaccgccgcgatggccgaaccgccaccgccggcgccggccgagccggagccgccgcaggtcgaacctgagccggagccagagccggaacctatcgtggagccgccgccgaaggcgatcgtgaagccggagccggtcaagccgaaaccgaagcctaagcctaagccgaaggtcgaaaaacaggtcaaaccggagccgaagaaagtcgagccgcgcgagccgtcgccgttcaacaacgattcgccggccaagccgatcgataaagcgccggtgaaacaggcgcctgctgcgccggtgcagggcaactcgcgcgaggtcgggccaaggccgatcagccgcgccaatccgctctatccgccgcgggcccaggctttgcagatcgaaggcaacgtgcgggtacagttcgatatcgacagcgacgggcgcgtgagcaacgtgcgtatcttgtcggccgagccgcgcaacatgtttgagcgtgaagtgaagcaggcgatgcgcaagtggcgctatgaagccaaagaagcgaaagatcgcaccgtcactatccgcttcaagctgaacggcacgactgaattgaactga

SEQ ID NO: 65804 - DNA, 219 bp, Glycine max
  Peptide Sequence Number=SeqID_157489
atgaagtcaggtgacatgcgggggtaccgtatggttattcgcgcctttcgtcaaccaggggcaaacgagcccgttgacgtgcagagactaacgtcttcttctgcaccttttgtcatcctgacccttgaagcctggtgttacttttatcgtccagagacattcaagtccgacaacgcgcaagattcttctctgctaggcaaggacgatcgagttcgatag

SEQ ID NO: 65805 - DNA, 249 bp, Glycine max
  Peptide Sequence Number=SeqID_157490
atggtgggagtttggagtgtcttattgatgatagtcttaaggtgcctaatttttttggtgctggctagtttggagaacagtgacattgtcatgacctttgaggatgattcctgcctcacttcccttcacattggacgcgtcgtcaacatagaggctccaccagtcggggtggtttcgtcattcctggagaattctgccaggaagtattccatgaactgtgtcttcatggggacacggggttcgtactag

SEQ ID NO: 65806 - DNA, 195 bp, Glycine max
  Peptide Sequence Number=SeqID_157491
atggctgatgccaagtttgcggggctgcttggtttagcccattgcttaagtttttccatgtgccccggtggtcgggtcggcggtgctgggttatggccccgtgctaagtttcggattggttggccccctcctcccccccgtgatcagttttgttgccaggattttgccaactttggcttgcgccccgttggctaa

SEQ ID NO: 65807 - DNA, 193 bp, Glycine max
  Peptide Sequence Number=SeqID_157492
atggtgtcctttttttacgtggaacacatgcaagtcgcaggaggcattggtgcgtttcgtgacgacgtgacacctgacactagtgtcatcaatgctgttagcgcgttgcaggaggttggactcgccagtcaaactggcgagttgagggtaggggagttccgagggtgcaggccagcagaggccatttccgagg

SEQ ID NO: 65808 - DNA, 312 bp, Glycine max
  Peptide Sequence Number=SeqID_157493
atggcggagatgaagatgaagaggaacttacctcgacaatgccaacgtgaggacgcagcaacaccaccgtcaacacccacagaagacgaacgaagcatgcgattggaaggtcacgaagaagaccagcaaaggtcacgaagaagaccaacgaaggtcacgaagaagacgcaaccaagctttttcaagaggaagaagaagaccaacgaagaacaaatcagattagacctacctagaaagcctaatctgatttggtcatactggaaattgcctagaaaatgcaatgctttgattatttgtcatttcgttcagtaa

SEQ ID NO: 65809 - DNA, 258 bp, Glycine max
  Peptide Sequence Number=SeqID_157494
atgaacgagcaagtagaaaaaaaatgtggactttgccggcaacatggtcatagcagaaataattgtcctaatgaagaacggaagtcggggtgtgagatcccgacttccgtgaagtggccaaaacagagttgcggcggaggaggtgtgggtatgggtaacgaggaggtgagatgggaggttagggataaagtgggaaacagagagaaaaagggcataaaggaaaagaaagaaaaagaaaaagtgtcagcctttggttaa

SEQ ID NO: 65810 - DNA, 222 bp, Glycine max
  Peptide Sequence Number=SeqID_157495
atgcagagctcatggattatatgcctgagtgttggtagtactccttgtttacagggaaaggtggttgattgcaactatattcggggtcccaagtatttagaaattgatgttgatattggtttttctactgttgctaatggagttttgggtctggttattggtgtgattacaacattggtggttgatatggcttttcttgtacagattgtggagacctgctaa

SEQ ID NO: 65811 - DNA, 216 bp, Glycine max
  Peptide Sequence Number=SeqID_157496
atggaaaaggccagagtagctgcagatttggctataaaggataacagacagctaatggagattgagtttcccacagctggactcgggtctgtgccaggtgatggggaaggtggaattgaaatgactgagagcatgcaattgattcgtgaattttgtgaccgcttcattagttcagagaaagtcacacgaacaagaatagtaatcttcttgatttaa

SEQ ID NO: 65812 - DNA, 189 bp, Glycine max
  Peptide Sequence Number=SeqID_157497
actttgtaaaagactttttacaagatagtggaaatctcaagcggattgcttggggactggacataggcacagggcgtggccaaaccaaggttatagatctgaatatctgggaagccatagagatcgagccttacattcccactatggtggcaggaaatacaaccatagagaaacctagggaagaatgga

SEQ ID NO: 65813 - DNA, 702 bp, Glycine max
  Peptide Sequence Number=SeqID_157498
atgccccagagaaacgtagtcacctggacggccatgatcaccagcaacaactcccgcaacaatcatatgcgtgcatggagtgtgtttcctcaaatgctcagagatggggtgaaagctctttcatgtggccagttagttcattctttggccatcaagattggtgtccaaggatcatccgtatatgttgataattcactaatggatatgtatgccacttgctgtgatagtatggaccgtgcaagaatggtttttgatgatatcactaccaagactgatgtctgttggactacattgatcactgggtacactcatagaggagatgcctatggtggtcttcgagttttccgtcaaatgtttctggaggaaggagcgttaagcctcttcagcttctcaattgcagctagagcttgtgcctcaattggctcaggtattttaggcaagcaggttcatgctgaagtggttaagcatggatttgagtccaaccttcctgtcatgaattccatactggacatgtactgcaagtgtcattgtgaatctgaggcaaaacgattattctctgttatgactcataaagataccatcacatggaataccttgatagctggatttgaagcattggattccagagagtctctatgcatattttcacgaatggtgtcagaaggtttagtccagattgcttctcatttactagtgcagtag

SEQ ID NO: 65814 - DNA, 240 bp, Glycine max
  Peptide Sequence Number=SeqID_157499
gtggcgtctacccagacttatcttccttcactggaagtggcgtctacccagacttatcttccttcattggaagtggcgtctacccagacttatcttcctttactggaagtggcgtctacccagacttatcttccttcaccggaagtggcgtctaacctgacttatcttcctccaccggaagtggcgtctatcctgacttatcttccttcaccggaagtggcgtcattcaaaccttcgtag

SEQ ID NO: 65815 - DNA, 351 bp, Glycine max
  Peptide Sequence Number=SeqID_157500
atggttaaaatgccttcttcaatgatttcctatcagagaataaaagagcttaaacacacgctcaatttagagctaacgccaaatgcatcgcgatataacattggaaagcccagaaagcatcaggcaaactttacattcccgaaaaaaagaagcatagcaaaattgaaaatgggagaaaaggggaaggaagattgggtgtggcaaggtgcagtcacaagatcagaatgtgcagccacagaacaagaagaagaagcagagcatggaaacgagagccacggactcgaacgccgtcacgactctccacaccaactcgtcaacaatggagacactcatcatccccgaccaccttag

SEQ ID NO: 65816 - DNA, 582 bp, Glycine max
  Peptide Sequence Number=SeqID_157501
atggcacatgcacaacccggaccagttgatggctccttgttacacttacaagacaaccatatattcaaatcaagtgtgggaaggccaagagagaatgattcgtctgaggatgtggccctacagttgagcttgaagattgatggattgtcggtaaccgatttcattatcggtgatgtacgtgttgcttgtcagacattactaggggaaactcaacctgataagtatgtaaagggtaaaatgatttacctaatttggttgcggcaaaattttcaacaactttccgttgatgctgatgatgttgtcattgcacagcatgctagagattctcatcatatatgtcccaatactcatttcaagtcccttctacctcaaatgttttttgatggccattcacaaatgtttgccaccactttcaacactccaccatatgcatataatctaccaccatcgacttcttggtattgtccattattacctactcaaatgcgtgacatggatcatgaagatgaggaagatgatgatgataacaacaataacaacgatgatgatgatgatgacaacggtggtgatcatgtcccttaa

SEQ ID NO: 65817 - DNA, 999 bp, Glycine max
  Peptide Sequence Number=SeqID_157502
atgggtttcttcaccaaagtggctataattgttggtggtcccttggttggcaaacttatggaccattttccaagaatgtctgcatataattgcttaaccatcgttcaggcaagttgtttgataatctatacaaactataaagtcaagcaagatatagctcttttcctaaaaggggtcattctttctattttccaggcagcagctcagttgctatctgcagcgatgattattcatgcccattctgtgcaacctacttcattttctacactgcttctgcgtccatggtttgtcgtattggtttcagcttgggctattgagaggctttgtgtagtagctttgggggttgcaaatgagcgtgattggattgtgctggtattgtcattcagaactttgtctgttcccttgacatttccatctactggcaaaccagtgtttaaaggtctggaagccatcaagctcggctggaaggagtatctgggtcagcctgttctccttgctagtcttgcatgggtgttcctctactttaacattgttctcatgccaggcagtttgttgacagcatttttaacacagcgtggcttacatccgtcaatcattggaggattcagtggaatgtgtgctttaatgggtgttgcagcaacatttgtgccttcaactctggtcaagcaatttggcattttaaaggctggagcagttgggttggtatttcaagctttacttctcagcatggctgttgctgtatattggagtggaacaatttctcatcagagcccccttcttaccttcttatttctgatttacaatgtgcatttgttagcaaacaaggcttggcttgtgttgaaaaaagttgcaacaggggcgcagattctccagacaggaatcccatcatccaaagcaaatctcattgggatgacagagattgctgttgctagtttggtggagtctataatgctgggtgttgcaataattgcgaatgatctttctcatttggatgtttag

SEQ ID NO: 65818 - DNA, 1467 bp, Glycine max
  Peptide Sequence Number=SeqID_157503
atgaagccaaaagtcatgtctcgcaaagaaaacctcctatgtgaactgtatacaaagaaaggtacctggaagattttcgtgcgaataactaatatgtggtgtcttaacaaacataatggtcgacaatccattgagatggtgttgatggaccatacgggtacaaagattggggcaactctatggcaagaattgttccctgaatttgagcccaagttgcgttgtggtggtgcatatgttattcagaacgcgaaggttgttgatactcattttgactacaaaacaacgtctgtcaaagaggtggacagacctgagattcctcctaatgttcatgccattacttcatttgctgatataattttaggcgttgcaaaacctgatactttagttgatattgtgggtgttattgctaaagtgattgaacgcaaaacagttaatccaacatacatagtgactgtcaagttgagagacaacagtcatgttgagatcatcatgactgtgtgggaggaatatgctcttcagctggatgatgctattgagaaaaaccattttgtgcaaaagccattggttgttatgctaactcttgctaagatcaaagaaaccaaggacaagtatcccctcagtgtacagaatataaagcatggttcgaagttgtatgtgaatggtgacaaaaacgaaattcaacagttccatgatagtttacgtgtgccattttatattggcgctctagatgatgacggtggcgtttctcagtcacagtctacccagaattgccaagataagtttttgcataatgattgttactgtttgactgtgggcactgtcgatgaggtgatgattgatacaccatggagttatgacagttgtccatactgtacaaccacttttgatccattaaaaataggtgccgcctgccgttcgtgccagaatcatgttactcacactattccaaggtataagttagttgtcaagatggaacagaacggggagaaggcaaacttccatttttgggatgcagtatgtatcataatatttggtaaaactgcagatgaatgtcgtcaagagttgattgcgagtggtgatgagatcaaggtgttccctgcgtgtgttgatcaattgttgggtaaaacttgggttgtcagattcaaacaccgtatacagatgcaccaatcatatgcgttggattttagtgaacaggaacatcatatacagtcagtgatatccacgctaggtctacaagatgaacaatgtataagcaacaagtctgccgctgttggtgttgcatcttcatcacaacaagattaccatcctacaccttcattgtcacagtcatctgaatatgatcctggaaatgttgcctttgtaacttctgcaaaaagaacgtccgatcagcaaggaagtagtcagtttgatagtgacgacttcacaacatatgaactatcgaccaacaagcatataaaagttgagtaa

SEQ ID NO: 65819 - DNA, 1818 bp, Glycine max
  Peptide Sequence Number=SeqID_157504
atggggtctctggttgctgaaacagccatgaagaaaccaatgtggttgtatccaaaggttttgggttttaatccttctgaaagatgggggcactcagcttgcttctctggggggcttatgtatgtctttgggggctgttgtggggggctacattttggagatgttctgtgtttggaccttgaaaaaatgaattggagcaaacttgccaccacaggtgaaaagccaggcccaagagatagccacagtgctgttcttgtagggcacaaaatgatagtttttggtggcacaaatgggttgaaaaaggtgaatgacactcatatattggaccttgttaccaaagagtggatttgtccaaaatgtgaagggactcctccttctccaagggaaagtcacacagcaaccctagttggtgatgaaagactagtgatttttggtggcagtggagaaggtgatgcaaactatttgaatgatttgcatgttctagaccttcgaaccatgaggtggacttctcctgtggtcaaaggtgatttgcctgtgcctagggacagtcacagtactcttgcaactgggaacaagcttattgtttatggtggagactgtggtgatcagtatcagggcgatgttaatgtgcttgatatggatacaatgacttggtcaaggttgaaaattcaaggctcttccccaggagtcagggcaggtcatgcggctgtctacatcattggaggggttggagataaacgttattataatgacatatgggtcttcgatatctgcacttgttcgtggactcagcttgatattcgtggtcaacaaccacagggtcggttttctcacacagctgttgtagcagacatggatgttgccatatatggcgggtgtggggaagatgaacgtcctttgaacgaattgttagtgttgcagcttggagcagagcatccaaatgggcgttacaacatttccatgtgcaaagtttttggaacttgttggaaccatgaaaagaggaccatacacggaggagcagataccaactcgacaactccacgcaatgggaataataatatggaagtcttaggcacttcacaacagaagaggaggagaatggctgttgcaaaggtgtgggatgttgattcagaacaagaagaacattctctttcactgtcccagcattcatctccatctcaatctgatcaagaacagaccccaggtcaaaaagcaaattttcctgtcatggattctcagaggtatcattggttcaaacagatcaataaaagtccaagctattgccagcttgacaatatcccaagtaataacacagttttgaagaatattacacaaagaagtgttcatctcatagaaaatcaaccaaaagatgagcagtatcttcatgttgatgaggatcgaaaaggagctcgacatactcaacatctgattggtgctgaagttcgggggaaagttgatggagcctttgattcaggtttactcatgactgcagctgtgaatggaagagttttcagaggagtcttatttgcaccaggagcaggagtattctctacatgtgttgagccaaactgttctctatcatgttcatttccctccactcaaccatttatgaactcaaatcatgtgagggattcccagcaagtaactaattgttcgcatgcagagccctgccacggcttaaggcaacctgtgctagctcagccaacaccaatcatgagaggcactactgcgtctttagccaaagagcataaaatgaggagtgaccttcaagggttggttttgacacttggagggcctgcaagtggaaaccatgcttga

SEQ ID NO: 65820 - DNA, 183 bp, Glycine max
  Peptide Sequence Number=SeqID_157505
atggctggtggagctatttcatggaggactgttaagaagactttgactgctacttctaccatgaaagctgagtttgtctcttgctttaaggctacatcacatggtaataacaaaagtgaaagccaaagtaagcacatcgacattaagtacttagtcatcaaagaaagagtaaaagacaagtga

SEQ ID NO: 65821 - DNA, 105 bp, Glycine max
  Peptide Sequence Number=SeqID_157506
atgtgttttcaatctacgttttttcagcaaattatgcagcttcaccatcctgttaagaaacaatctaaggttataataaaaattgcaagaaaaacagaactttaa

SEQ ID NO: 65822 - DNA, 720 bp, Glycine max
  Peptide Sequence Number=SeqID_157507
atgatgaaccctccaccggcgaaacccgctcctccgggaggagacacgaccctgaagggagaatgcggcaactgcggctggaaggagcgtcggctcctccaccggctctggattcgcggcatgaaccgcttggtgtgtacctcctgcgtcctccgcctccacccctccttcttctgcccctcctgcttcgacttcttcgaccaccctctctccaacacctcctccgccttcgcccaccgcttcgtctcctgcaccaagtgctcctccctcacccacctctcctgcctcccttcccctcccccctctcccttcctctgccccccctgctcccaacacaacttctccttcttccccgattccaccgcccccttagataaacgccgcgccctcatcctcctctgcgcctgcaagctcgccgcggcctccgtcgctaaatccctcgccctcgcccggaccagagtcgaacgcaccgtccgcgaggccgccctcgccagaaagagggcccgggacgctctcgaccattgctccaccgtggagaagatcaagcgcctcggcctccaaggcaccttcgatgcttctaactctaagtatttgggaatgggaacgatgaatcataaccataataatgttactgttttgaatggcttcgtgggacctcagggcaaggttaaggctgatgtcaacaacattgatgccaaattgcccaatcgagtagcgtag

SEQ ID NO: 65823 - DNA, 255 bp, Glycine max
  Peptide Sequence Number=SeqID_157508
atgagtcaaactcaagccttgcgtattcaactcaagccgaactcaagttcagtaaagcttgacttgacttggctcattttcatccctacttacactctttcaacaaggcagttatcacaatacagcatgacataccacagaaataagctaattgccatagacattttatcaacttgtagaaggacaaggaatgaagagagcatctcttcattgacatatagtgaaacacttcaatggcatcttcagaatgcttga

SEQ ID NO: 65824 - DNA, 420 bp, Glycine max
  Peptide Sequence Number=SeqID_157509
atggaaatcttggtttctgaactctatgggtgcatactgagtctcgtagtgacaaatgataccatcagaatagtgaagccaacaaaaggtctcaaactcacagaacgcgaggccgaagtggtatttacaacaggagggctatcagaagcaaaacctggcattatacctgacgctggattgcttgaatttaacactgaagggcctgttcctgaagatgaagatgttggtggtgctgttggaatagatggtgcaggtgttaatggacttggtggtggtagtgttgttggacttgattgcgtaggtggtgttgggggtgatgatgactttggcgttgttgttgttgttgatgatgatgatgggaagatgcacgaacccgtgcctattcacaattcagaacaaccagttaaaaatgggcactag

SEQ ID NO: 65825 - DNA, 537 bp, Glycine max
  Peptide Sequence Number=SeqID_157510
atgggagaaactcaaaacaatgaccctcataactttaaagattcccaagacccatattcccagttttcgattcgacaaaagcaaaaagcctcagaggaaactgatgaaactgaaacagaatctgagagatcttcgtcagaaactgaaagatcttactctgatgaagaagaagtgactggatacatggacatctcaaatatattgatgatgcgctccacagaagaaccattctatgattcacctgtagaagaagaaccagtgatttctaagagttcatcttccaagccaaatgcaggaccctggtttacccttgatgatactactccaagggagtggaggaaaaaactcatcgagatgggagcatggctggacacaacattcatgaaagatgtcgatccttacaaagtgattaaagaattttgttgtcaaatgatgggaacactgaaggaatggtaccacaatctaggagctgtgcgtcaaaatcagttccatgaactaggatctaccgcagctgttctaggaactctccatcaataa

SEQ ID NO: 65826 - DNA, 243 bp, Glycine max
  Peptide Sequence Number=SeqID_157511
atggaatacgattcgctttcaagatgccttggtggtgaaatggtagacacacgagactcaaaatctcgtgctaaagagcgtggagaacaattaaataattttacctgcaatgttccttctgtgggtgaaagaaatagcaactacaatttcgaaacctgcagcaacggagcttcatcaacaacaacacaaataataatcactaagaacaaaggggtaattgcgaataggctaactcacctctga

SEQ ID NO: 65827 - DNA, 766 bp, Glycine max
  Peptide Sequence Number=SeqID_157512
tgaagggactagtgccgcccccgagtttgatagccaccgtttcaggagcgccgagcaccaacagcacttcgaggccatcaaaggatggtcattccacagagagagacgcgtccagctcagggacgatgagtacacaaattttcaggaggagatagctcgccgacattggacgtcgctggtcactcccatggctaagtttgaccctgatatagtcctggagttttatgctaatgcttggcccacagaagatggagtgcgagacatgcggtcatgggtgaggggtatgccacccaccaggcaccctctagacccggataagtctaacagggccctggggtttccgacattgatcacgggcctctgccaatcattcggggttcccgtcacacctagtaaggcgcagggtgatgcaccacatgccgcagatgcaccaccaccacctcatcaggctgatcctgcttggtcattaggcatggagcggtatctacaacacttggttcgccagcaggcggccaaccaccgaggacaggtgcagatacatgagtgtctctaccagctcagcctcagtcagcagggccagggtttcgttccttttgtgtgccctactccaaatcagtttagggctgaggtcgcatggcccggagattggcccaaggcccaggcaggggaggcacctgcaggagctcccggtgatgcagaggaggcccgtatggatgaagagatgacagacttgctcggtttcttgggaggaagcggagccatgtga

SEQ ID NO: 65828 - DNA, 348 bp, Glycine max
  Peptide Sequence Number=SeqID_157513
atggtcgtcattgtcaatgcggaagcttgtggttacgtgagcatgaactactaccaatatatagatgttgtttatacaaacgagcacatcttaaaagcttactccgcacaatggtggcctcttgggaatgaagcagctattcctccttctgatgacgcatggacacttatccctgacccaactacaattcgtgcgaaaggtcggccaaaatcaacaaggataagaaatgagatggattgggtcgaaccatctgagcaccaaccaaaatgtagtagatgtggagccgaagggcataataggcgtcgctgtccaatgcaatctgagcgtgggagttgttcaaatcgttga

SEQ ID NO: 65829 - DNA, 468 bp, Glycine max
  Peptide Sequence Number=SeqID_157514
atgcatgcattcttttcgtttttctgtgtcggacgaggtttggcttctctgttagcttatcatgtttctctgttcctgattatctacgaaaaaccatctaccaggaaagtttctgtctttggcattagttttgtgcatttttgcgcatggtttgttgctgactctggcacttgcatgggaattctttttgtgactcatgcgatttttccttcagaaggtcgtgcaacaagaagcatgatggcatgttctccagacaagataaggaacatcaacggctcaaaagaaactcttaaacttgctgtgaagatcagtgatctatggtttattgggacgcctaacaaatttgagcaagctgagatggtttttgtcgactctgatgtttattattacttattgttcagcccattgtgttgtaactttaacggaatccagggtgatgagatccatgctatttgtaaacaagactaa

SEQ ID NO: 65830 - DNA, 549 bp, Glycine max
  Peptide Sequence Number=SeqID_157515
atgatgatgaggagccaagatatttatagtagccaagatgaggctactacgtcaccttcctctagtgaaagcgaagaagcaaaaggggaagaatctagtgaagaaatctacccccaagaagaaggacaacctttaatggttaaggaggagtgtaaggagacacttgttagcactgccacacctcttgggcttgaggttattcctcaagtaaaggagttgttggatgagggtttggttcttaagagcttaaatccttgtgctttgttggtgcccaaaataggggttcccacagaccctaagagaataaagatcattcctgattggcccactccaccaacaccattcattgagttggtgaggaaccatgttccctcatgggaagatgcccatgaaaggagtatgaagaacctcgggattttgaggtcaaatcctttccaaggtggaggggatgatgcaatcctaccccctaagggtacattggatagaagactccaagaggcttgggctagagctactaaagaaggccctagggttctcatgaaccttagg

SEQ ID NO: 65831 - DNA, 204 bp, Glycine max
  Peptide Sequence Number=SeqID_157516
atgtacaaaaataattggatccaacctaggcccatgggctcagaaatctaccctgaggttcatgagaaccctaaggccttcttcaacagctctagctcaatcctcttggagcctcttgctcgtggctctagtgactggtcccttcctagggaggattgcatcaaccccgatgccaaaatacatgaaggaagaaagcttccttga

SEQ ID NO: 65832 - DNA, 384 bp, Glycine max
  Peptide Sequence Number=SeqID_157517
ggctgttcatgtgttctccactttcgagtttggggctgtgtttcatgattgcctaagagaggaccctcaaggcaatcctccatactccacctttgttcggagcaccatgaatgtcattgccttgcgctgttcatgtgtctccattatcaagtgcgaagcttatggtgattgggaagcacgttattctgttgttttccagatcgaagaaaaagaagaagtagagatgagagtcgtcatcacggaaggggcaggacggacgaaatcagtgtcctatctttgctttcctcttatcttcgatgagagtcccgagacgtctcagaaattgaaaggaagcaggcttgcgtggttcgtgaaattccgtaatgtggcgaaaatcgaaaagat

SEQ ID NO: 65833 - DNA, 546 bp, Glycine max
  Peptide Sequence Number=SeqID_157518
atgccgctcagccccgtgatattggttactttggctgatagcgagctgatgtcggtgactccttccttcctttggcttggaggcacgtacctccacagaactacgtggctatttttgtatggaaatggaataggtctaactaccgaggggtgtcagggcatttggggagctacatccctggtgaaatgtatcaccaaaggttcaggctttctaagaccttcctcatctgtggattgcatgcatatatgctgctcttcacccccctcattgccgacttccagtcggccttggtctatcatttgttgcaacaggtctcctactgctaaacatgcttccatgttatgtgataaaccttatgggggtcgtcacgtccttcaaaggtttggacctacgcggcctacccggctcgatgacattaacagctccccctccatgattgttaagcgggtttgtctttacgttgggtcagtactcttgaaacgtcagccatccggcttctatcaaacattggtccttgcgtttgaaggccatgcactgttcggttga

SEQ ID NO: 65834 - DNA, 414 bp, Glycine max
  Peptide Sequence Number=SeqID_157519
atggccgcaatgatggaggccatgatgagcataaaggagatgatgaaggtcagtacagcttaccgagcccatgctagagctaagagtaatggatatggtaggcaaagatttgggaagtacggacggccccgtgatgtgcaaattcaaaatgagtacgccttcccgctatatggcttgcctcccaactatacaccacccaatgtggcgtacactcctaatgaggatgtcaataactccactcccatgctcattgagagccgacaacttcatcatatacatgtctctcaacccatgggggagacacatgaaattccccaccactatctagccgacttcgagccttgcctcggatatgccactaaagggcaagcagttggtggtatacccctgcaaaacactttggagggcccttag

SEQ ID NO: 65835 - DNA, 924 bp, Glycine max
  Peptide Sequence Number=SeqID_157520
atggtaagcatttgggacctagctagggtagaagtctccatggaaccaattgcctccctcgcccagtattatgatcggccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagggagtcctctttccaaatgtggatgggttggtggacctggcagcgatcgacgtttttctcgcctatcataaccacaaggaaagtccgctctctaggtggggctggtttcacacctttttctccaagaaggcaggcccgcctatccgctacaaggaaggaagaatcaagattctatcttcatgcgaaggatgtccaaatgttcccttgatgggaacaaggggttgtattaattataatcccgtccttgccataagacagcttggctaccccatgagaggagtgccatcagatgaaagcatcacgcctttcatcgcacggggtttcagtgaccacaacgcgagggacagagagcttaggggaagcagtaatgggatcatcggtggctatcataagtggttgagagtccgaacacaaggactggattggctcccaaatctaaagactgtgagagacgatgaggttaaggcttcggaagaaagtgatgaggtacaagccctaaaggcagagcttgaaagagcccgagtagtcgaagagaagttcaagtccatagccatcaaaggcagcaatagtgagctcaaactccgaagaggtgaaaggaatcatcacgggtcaaaggcatga

SEQ ID NO: 65836 - DNA, 1041 bp, Glycine max
  Peptide Sequence Number=SeqID_157521
atggtggcgcagcaggcgagcctgacctggccaatccgcctttcactgaaagaggatattctcagtatctgtcaggggcagcagctgaccctttcgcagcttggacagctggatgtccgcctgggggcgctgtttgcggatgcggtgcaggctttgatgcaaaaagaacatcttcgtccgcaggatgtggttgccatcgggtgtcacggacaaacggtctggcatgaacccatcggcgatgccccgcacaccctgcaaatcggcgataacaaccagattgtggcgaagacgggcgtcacggtggtcggcgatttccgtcgtcgcgatattgctcttggcggacagggcgcaccgctggtgcccgcgtttcatcaggcactactggcgcacccttctgaacggcgcatggtgctcaacattggtgggatcgccaatctgtcgatgcttattccggggcagccggtccggggctacgataccggcccgggcaatatgttaatggatgcctggatctggcgtcagtgcgggcaaccgtatgataaaaacgcagagtgggcgagcgagggtaaagtgattatccctctgctgcagtccatgttgagcgatccttattttgccttaccggcgccgaaaagcaccgggcgagaatacttcaactttggctggcttgagcgccagctggcctccttcccggcgctcgcaccacaggatgttcaggcgacgctcgccgagcttacggccgtgtcggtctccgaacaggtgttgctcagcggcggatgcgaacgcctgctggtgtgcggcggtggcagccgtaacccgctggtgatggcgcgtctggccgggctgctgccgggtaccgaagtgacgacaaccgatgcggcgggcatcagtggcgatgatatggaagccctggccttcgcctggcttgcctggcgcaccgttgccggactgccgggtaatttaccgtcggtgaccggggcgcgcgaagccagcgtgctgggggcgattttcccggcgaatccgcgtcataatcagagttaa

SEQ ID NO: 65837 - DNA, 741 bp, Glycine max
  Peptide Sequence Number=SeqID_157522
atggagaatttgatggcaagcagtaacttgattaaacaattgcaagagcggggcctcgtggcccaggtgacggacgaggaagcgttagcagagcgactggcgcaaggcccgatcgcgctctattgcggcttcgatcccaccgctgacagcttgcatttggggcatcttgttccattgttatgcctgaaacgcttccagatggcaggccataagcctgttgccctggtgggcggcgcgaccggtctgattggcgacccaagctttaaagccgctgagcgtaaactgaataccgaagataccgtgcaggagtgggtggataagatccgcaaacaggttgcaccgttcctcgacttcgactgtggtgataacgccgcgattgccgcgaacaactacgactggtttggcagcatgaacgtgctgaccttcctgcgtgacatcggtaaacatttctctgttaaccagatgattaacaaagaagccgtgaagcagcgtctgaaccgtgacgaccagggtatctcctttactgagttttcgtacaacctgctgcagggctatgactttgcctgcctgaacaaactgcacggcgtttccctgcagattggcggttctgaccagtggggtaacatcacctccggtatcgatctgacccgccgcctgcatcagaaccaggtcttcgggctgaccgttccactgatcaccaaagccgacggtaccaaattcggtaaaacggaaggcggcgcg

SEQ ID NO: 65838 - DNA, 156 bp, Glycine max
  Peptide Sequence Number=SeqID_157523
atggagaccggaaacacatacttttcacatgagatgcagagagtagaaaggtttacccgtgcatggatccttcgattcattggaggtgtcttatttgttgacaaaagtagtaacaaagtttcggtggctgcgacgggaaaatcaacatattggtaa

SEQ ID NO: 65839 - DNA, 192 bp, Glycine max
  Peptide Sequence Number=SeqID_157524
atgtattttcgtgaagaaaatccaagtcgaggtgcttccgcaatgcttccgagacgtttccgtgagcaattccgtgaagattttccttcgttcttcgccattcttcggtcttcaactgatcgtcaatggtccaacaccttaacgtttctctcctttcaaaaccaagagatcattaaaggtccaatgccttaa

SEQ ID NO: 65840 - DNA, 249 bp, Glycine max
  Peptide Sequence Number=SeqID_157525
tttctctctgggttccttgttgaaccaattatcagacttatcaaggtaatccttgtggcgtctaccctgacttatcttccttcactggaagtggcgtctaccctgacttatcttccttcactggaagtggcgtctacccggacttatcttccttcaccggaagtggcgtctaccctggcttatcttccttcactggaagtggtgtcgtccaaaaactctacagcctgtatcaagcgatccaccccgtaa

SEQ ID NO: 65841 - DNA, 3605 bp, Glycine max
  Peptide Sequence Number=SeqID_157526
atgccgaactacccgccgatggattttaaagatccggccaccaatcagctgagcggcgtcgattatgagctgggccaggcaattggcgagaagctgggcgtgaaggttaactggcaggagatcgcgtttgaacagatggtcaacgcggtggtgaccaaacgcgtcgatctggtgatgtccggcatgaccgacaccaaagagcggcagaaggtagttaactttatcgactacttcaaaaccggtccgcagttctacaccctggcggcgcgcagcgacatcaacagcgccaccgatctgtgcggcaaaaaagtaggtaccagccgccgcaccactttcccgcaggagattgctacctggtcaaaagcgcactgcgaagcggccggtaaacccgcgattatcgtggtgggagcggaaggcaccgccgatgcgcgcacgcagctgcgtcagcgtcgtctggatggcgcggtacagggcagcgaaaccctgccgtacatcatgaacctggaaaaaggcacctttaagccgctggataaagccttctccttccagtacaccggcatggcgctgggtaaagatgccggtgagctgaccacggcgattcaggcagccatcaatgccatgattgccgatggcagctaccagaaaatcctcagcaaatggggcctgagcgacaacggcattgccgaagctacgggcaagcgtggctgtatggcgctggcgtttgatcttgatggtcccactggcgatgccatgctcaatggcagcctgtggtcaacaccagagtatttcacctttggcgcctacgggccgtttcgcgcgctcggtcggctgctggatctgctgcgcgccttccaactgccggctacgttttttgtgccggcgtgggtggtggagcagtggccgcggcagtgccaggcgattatcgaacagggccacgaagtggcctatcacggttatcgccacgaatcgttctgggcgattacgccagatgaacagcgcgccgtgatggcgcgctctgccgccatctttcagcaacatcttggtatccgcgcctgcggttttcgtactccttccggcgactggcacgccgaaacgccgcagattctgcgggaagccggggtgatttactccagcagcatgcgtggtgacgatcggccgtacagcattgccgtcgccgggcatacgccgctggtggagattcccggcaaatgggagatggatgattacgcctcgctggcctacacgcgccagccggattttccacagggcggcgaccgcatcgccagctatgcgcacaccggtgacaactggcagcgcgaatttgacggcgcgatggccgaaggactgtgcctgaccacgctgttccacccgaaaatttccgggcagcccggccgtttgctgttgctggagcagctgtttgcccacatgacggcgcgcgacgatgtgtggagcagcaacatgactgaacattcacgctggccgtcgggcaaacaatcggcggccatcattaccatcgactatcacgatattcacggcatcctgacgcaggcgcctgcggttgccgggcgcgataaaaccctgtcggtgtggcgctatggcacgctgcgcggcgttgatcgtctgctggatctgctggcggagaaacagctgctggccagctggtgcttgccggccatcgtcgccgaagagcagccgcaggtgctgcagcgtattgtcgccgccgggcatgagatcgcctgtagcggtgagcgacacgaagacttctcggcgctgacgctggcgcagcagattgccagcgtgacgcgcggctgcgagcggctggcgcagctgaccggccagccgattgcagggtttcgcacgccggccggccagtggaaaccgggccttgctgcggcgctggcaacgcacggcatccgctggtcctccagctggcgcggtgatgatttaccctattttcaccccggcacccggctggtggagctgcccatgcactacacgctggaggatgcgccctattttgccttcaacctcagcccggcgattccgcccggacagtcgcgtatcgcgccctatggcgaaacgctggccaacctgacgcaggatttccacggttttcaccgtttcggcctgtgctacctgctgaggctgcacccggaaattatcggcaccgccggacgcattggcctgctgcgtcagctgctggagacgctgcagcagcatgaggtgtggatcgctactgccggccaggtggccgcgcactggcagacgcaggcggataacgatgccgatcatccggcagaggtatttgcccgggtcagcggagcgcaggcgaagcgccatctgctggatacgctcggcgcggcgctggcgggctgtgacagcccgatctggcgcgaatgccgggcgctggtggccgaagagggcggcagcgccgtggcgcaactgtgggggtgcgcacagcaagcttccccgcgccaggcggcgtggctcaacggcgtggctgcgcacatgtatgaactggacgacaccggcggctgcgatcactccggtgccgtggtgttaccggcgctgctggcggcactgccgctggcgacgcagccggtcgacggccgggagtttctcaccgcgatggtcgtgggttatgacatcggccgtcgcgtgctggaagcctgcggggggtatgcggcgcacaacggtgcgggctggcactcgactgccagctgtggcgtttttggcgcggctgccgccgtcagttgtttgctgcggctgccggccgcgcagtgtgcctcggcgctgggcatcgctgccagcttcagtggtggcctgtggggctttattcatgatggctcgcacaccaaaaagctgcacgcggcgcgcgcggcggaagggggcgtacaggcggcgctgctggcacaacgcggcatcagcggaccggccgcggtatttgaggcacgctggggcggctttctgcaaacgctggccggtgaaacgcaacagcccgccgcgctcacggaccaactgggcgaggtgtggaaactggcgcgctgttccatcaagccgtacgccgcctgtcgcggtacgcatgcggcgatcgatgcgctgggtctgctgcttaagcagcatgcggtggcgaccggggatattgcacgcattgtggttgggctcaatccgttcctgctggagatgtgcggcacgcgtgagctcaccagcctcgccgccgcgcaaatgagcctgccgtatgcgctgacggcgcgagcgctgttcggctctgcggagctggcgagttatgacgacagccgtcgcctgagtgcggaagctgccgcgctgatggcgcgtattgagctggagattgaccaccagcaggggcgcgatgatgagccgtgggtccggctggaaacggtgcagggccagcagtggcagcagcacgtcgcggtgccgtccggatcgccggcgaatccgctgagcgacgcggcgctgcacgccaaataccgcagcctcgccgcgcgcgtcttgccggcggcacaggtgcagcagctggaaacgctgtgcctgacgctggataacgtggcggatgtgcggcaagtcgcggtgttactggcgacccg

SEQ ID NO: 65842 - DNA, 1104 bp, Glycine max
  Peptide Sequence Number=SeqID_157527
atggaaagtaaagtttcccagtctggaaacaatgcgaataatcgcggcgataatgcggttctggcgctgagtaatatcgacttaaaattgctgcgggtatttaaatgcgtggtggaagccggcggattaaccgctgccagtcacgaattaaatattggcctggcggcgatcagtaaacaggtttctgatctggagattcggctgggcatgacgctgtgcagccgcggccgtgaaggttttgagctgacgcagtacggcatcaatgtttatcaggccacgctggagctgttcgtatcgctcaacctgtttcgcgagcggctgcacaatagtcgcaacgagctgctgggcgacatcgcgatttgcgtggtggataacaccattagcgatccgcactcaccggtcaccagtgcggtgcaacagttgcaccagaaagcgccaaaggtgcagattcgtctgcagaccgcacagctggatgatattgaacgcggcataagcgaagggcgttttcattgcggcattgcgcccgtgtatgaaatgaaaaatgagtttgattacttcgaactttataaagaatacgcaaaattatattgcgctgcgtcacatcctctctattgcggatcttgcgataaaaatatttcggtggatgtattacgtcagcagaaaattattaatcatttatatgttaccccacgcgatgaacgccgcctgattccggtgcaggagagcggtgtgcaggcggtgcaggtggaatcggtggccatgctgattttaaccggtcactttattgggtatttaccggaacattatgccgctccgtttattgcccgcggacaattgtgcgctggggttgagcgatgcggcggcggcgcactgatttggtgcgtgcgaccgggtttctgctggcacgggatgggaaagtgtacgctgatgccctcaccccggccctctcccaccgggagagggagacgcagcctgcgggcaagggagacgcagcctgcggataagggagaggcggcgtccggtaacagcaaccagaacgcttacgtcagccgcttatacatcaccgtggtagcatccagctcgccggctgtggattcggcatag

SEQ ID NO: 65843 - DNA, 620 bp, Glycine max
  Peptide Sequence Number=SeqID_157528
ctggagcgtccgctgtaccagcaggagagtttctggcagctggcgctggcccatctgttgctggtgatcagcggcagcgtgctggcgatagtggtgggcgttggctgtgcggtcttcgctacccgtcacggcggcagggcgttccgcccgctgctggagacgctggcggctgccggtcagacctttccgccggtggcggtgctggcgattgccgtgccggtcatgggctttggcgctgcgccggcggtgatggcgctgtttctatatgggctgttgccgattctgcagggcacgctggcgggactggacagcgttccggccagcagccagctggcgctggcggcaccggtgattatggcaggcgtgcgcacctctgtgatgatcaacatcggcaccgcgaccatcgcctcaaccgtcggggcggagagtctgggttcgccggtgattatcggtctgagcggcttcaataccgcctatgtgattcagggcgcgctgctggtggcgctgctggcgctgatctgcgaccggctgctggagcggttgcagcacgcactcagtggttcataggtaaacctgagaaaagtcatgaagtgcggcatgataacgcgcacatgcggtaa

SEQ ID NO: 65844 - DNA, 1161 bp, Glycine max
  Peptide Sequence Number=SeqID_157529
cacaccctcgccttcagaggactccacgtcctcgccttcatagggctacatgccctcaccttcataggactacgcgtcctcaccttcagagggctacatgccctcgccttcaaaggactccacgtcctcaccttcgaagggctacatgccctcacctttagagggctacacgtcctctccttcatagggctgcacgccttcgccttcagaggactacacgtcctccccttcagaggactatgtgtcctcggcttcagaggactacacgtcctcaccttcagaggagtacacgtcctcaccttcagagggccacacgccctcgcctttagaggactccacatcctcgccttcatagggctacatgccctcaccttcagaggactacgtgtcctcaccttcagaggcctacatgccctcgccttcagaggactgcacgtcctcgccttcgtaaggctacacgccctcacctttagaggactacacgtcttcgccttcatagggctgcacaccctcgccttcagaggagtacccgtcctccccttcagaggactacgtgtcctcaccttcagaggactacaggtccttggcttcagaggactacgtgtcctcacctttagaggactacacgtcctggccttcatagggctacacaccctcactgttagaggactacacgtcctcaccttcagatggctacacaccgtcaccttaagaggactacatgccctcgcctttagaggactacaggtcctcgcctttatagggctgcacgccctcgccttcagaggactacacgacctccccttcagagggatacacgccctcgccttcgtagggctacacggcctcacgtttagaggactacacgtcctcgccttcatagggttgcacgccctcgcctttagaggactacacgtcatcgccttcatagggctacacaccctcaccatcagaggactagatgctctcgcctttagaggactacacgtccttgccttcatagggctacatcttcagaggactataagtcctcaccttcagaggactagacatcctcgccttcaaaggactacacaacctcaccttcagaggactacacgtcctcgccttcagagggccacacgccctcgccatcgtgggcctacacaccctcacttttag

SEQ ID NO: 65845 - DNA, 483 bp, Glycine max
  Peptide Sequence Number=SeqID_157530
gtaaggtgggatgacatagaagctgctaggcgcaatagggtttccccattggaaattgagccatctggttctgcttcaaattccattaacttgatgtcagctggtttgaagtggaccaggattggaatgacttcagtgaagctggaatttcccactcccgctttatctgcacctttgactcttttggtggtccaaattctgttcagaaaactgaacaaaaggcataatagaaagaactaccaccctgttgctgacaccatcttcaatcagatgttgaacttcaacaggctgcaccattatatgactgatcttgctgccaagcacagggcttacaggctgctcaaccctttcagatatgaggtttacaccactgagccaactaatgttgagtatatactcaaaaccaattttgagaattatggaaagttgcctatgctaaagatactcttaggtggtatgggcatgtgtggagatgacatgtag

SEQ ID NO: 65846 - DNA, 156 bp, Glycine max
  Peptide Sequence Number=SeqID_157531
atggcagacagaggtagaggtggtggtcgtagaacatttaatcgtggtacaagacgtggtacccacagtttgagagatccaattaccaccaacccttccccctcatccattcacatatcaacctcagagttggaattaatgaagcattgggcttaa

SEQ ID NO: 65847 - DNA, 510 bp, Glycine max
  Peptide Sequence Number=SeqID_157532
atgcccatccagcaaagggcacccgctcaaccacaaagggctcccactcaaaacttggctcctacacaacctcgccccatcggcagctccaatcagagcacaagcgccaatctgggaaggaattttctggtaaagaaacttgcggaattcgctcccatcccgatgtcgtatgcaaacttgctaccatccttggtcgccaaccaaatggcggcggtccaaagtttgatcgacgcaagttggctgacgttccaagaggacggcccaaacataaagacaaaccctcttcccagtcatgggagaccagtggttaatgcggtggaggagtgcgaacctcagatgccgaagcaattgaaagacgtggtaacctctaggaggtttatattgaaggcgttgtgcgaggcgggaatcatttgctttgacgggggcgagggagataccttcttaatacacccgggggcagcacatgatgtagaggcttgccctgtggcagaggattgctgcaaggggtga

SEQ ID NO: 65848 - DNA, 333 bp, Glycine max
  Peptide Sequence Number=SeqID_157533
atgaacaattgcttgttggcaaagtctatgaatacattagaggtgacaagcctactgaaatctctccaagttttggctcacattcgttatttggctcctttccgcatgcgtttcacttctttacaacgcattactgactctttaattaggggcagatccacatcaggtgttcaaggaaaattacgttgtctggctatagcaattacagtctactacatttggctgcctaggaacaagctgatttttgaaaattatcaattttctgtaatagaggttattagcaagattaagtttcttatgtatagacaagcgcacctgttgcatttgttttag

SEQ ID NO: 65849 - DNA, 240 bp, Glycine max
  Peptide Sequence Number=SeqID_157534
atgcctcatcctaatactgcgggagcctctcaaccccacccgataccaccactacatttctccgtagggggaccaccttcaacaacgaaggaaaaaggacagctcgatctcatcaaagagagattgagagcagtcgaagggtccggtgattaccctttcgttgatatgaccgacttatgtttggtattggatgtcgtcattcctcccaaattcaaagtactagatttcgacagatactag

SEQ ID NO: 65850 - DNA, 390 bp, Glycine max
  Peptide Sequence Number=SeqID_157535
atgttcgacggtggaggagctgttacagcaactgatggaccaaggctggcggtcccatggagatacgcccctgagaagccaagcgaaaagaaagaagaggtcaccggcattaacttacttattgccaaagttaccaacatcaccggcctaagtggtgtgacccgtagcggtcgcgtcttcgtagtgcctaacccatcaatgcgacccatggatgccaaggggaaggcgaaggtggtcgtagaagagaccaaccaagcgggccccactctggatgaggacgttttgactgggagattcgctgagaaaggaggagactctagcggaaggaaggtagcaattgaagaagccaatgattttgcacatttaattaaaggttgccgtcccttgtga

SEQ ID NO: 65851 - DNA, 264 bp, Glycine max
  Peptide Sequence Number=SeqID_157536
atgacccctactcatgatgccctgctatattacaaagggaggtggaacatgccacgccaacataagtttgttggttattcgttcacaggaaaaaatctcaaaaagttttacattcctttcggatgtaccatggatgaaccgaaggatttgatcaagcaagttgcacctcatgggattcccccttatggtatgcatgaaacacaaacggtaatggaaatggaagacgacatgtcttggtcgcaacatgattcaatgcaaaattag

SEQ ID NO: 65852 - DNA, 542 bp, Glycine max
  Peptide Sequence Number=SeqID_157537
gcccttgtgatgaaaggtggtcagtggttctacacgggaaaacaattggtgttaatgttgaagatgatgattcatacattgatacttatgttagttctttgtccacacaaatgtcgcctaacatcgtcggagaagaagaagctgacgacgttcacgctaatcgtaatgatcatgatgaaggagaattaattaacatccaaatggctactccacccagctctcctcctcctcctcctcctcctactggtatagcatcacagtcgttgtctaccttgaagcggacaagaaaagcaacacggctgagatcattggcggatgaattgaagaactccacagataaacatgtttggcttggagtagttataggatgggtgaccttctggaaagtttcccaggaagcgtgtgagacattcattgatcctaaaagcagacaaagaagattgtcaatgtctcagaaaaggctatctacgatgggttctaattggtggagggttatgaccaacgaggagttgagtaaagtgtcatcgcgtgaagtgtcgtag

SEQ ID NO: 65853 - DNA, 165 bp, Glycine max
  Peptide Sequence Number=SeqID_157538
atggataagagcttgagggaagaagaagatgagtggagggagaggaagaaaaggagcacgaaattttgtgcctcaaatgagctatggttcaacccactaatccaagatcaagtccaagattctccactaagtgcgcttaggtatcatgaggcatgtaaagcatga

SEQ ID NO: 65854 - DNA, 343 bp, Glycine max
  Peptide Sequence Number=SeqID_157539
tggtgatggtggtggtggtgacgacaatgataatggaggaggttgctatgatagagatggcggtgagggtgcaatgacagtggtggtggtgatggtgattgtggtggcgactatggaagcagtgataagggtggtggtggcgaaagcaacgacattgatgatagggttggtgacaatggcaatggttgaaacaaaagtaatgacgatggtgatagttgcagttatagtggtagtgacagttcgagaagggcgtgctaagcgcaattccaacccgagaaggaattacgctgagcgagcaggggcacactgggcgcaattccaacctgagagggaattgcgctga

SEQ ID NO: 65855 - DNA, 330 bp, Glycine max
  Peptide Sequence Number=SeqID_157540
atgtgggaaaaactgcacattacaggaatgcatgttgaagggaaggtcttagttggggtaaagttgctcccaacatggtctattattggccgtttgcgcgtatgctttgttgaacctccatattttcaaatgactgtcaaacctatgtttgcttgtgggcttgatgtgattgaacttccatgcattgctgggtggctagttaagctgctatctattgcttttgagcagaccctagttgagattagcggatccttatgtgaaagatcaaatgggtgtatacagattcaggacaaaaataccaaggaaaacacttactccaaaatggtataa

SEQ ID NO: 65856 - DNA, 225 bp, Glycine max
  Peptide Sequence Number=SeqID_157541
atgatggctgatggggataagaaagcactattgcagaaggcacatagtgcaattatcctcagtctcggagacaaggtgctgaggcaagtctctaaggaaacaactgctgctggggtttggtcaaagcttgaagatcttgaaaatatcgatgtcactattgatgatgaggatcaagctttgctattgctgtgctctttgcctaagagttactctcatttcaaatag

SEQ ID NO: 65857 - DNA, 510 bp, Glycine max
  Peptide Sequence Number=SeqID_157542
atggttagaactaaaggtctcgaacatactttaggtcgaacaataggaaaagccctaaggagtagagaggctagtgacgatgataatgatgtgccccagcggcgaaggcctatcgcatattctcgtaagcagcgacaaaaggcgcgtgctattgaggatccttctacggccgcaatggaattaaacgaaaagcaacaacaaccacctgttgaagatgatgttattaatattaacgattttccaagcggaccccatgacacatcagttttgagagattttgaaaatcacgttgttgcgtttgtcgatcgcgtcaaagagcatgacgaggcagcttgcaggatcactctattacagatctacgagcatttcccatctgttggttccgccatagctaccaaggattatgatcagcagagaccgtgtgcatgccaatggacctctggcaaggcattatctgtgtcgatgtatcgtaggcgtctagacagactgacctctgatgttgtgtgctag

SEQ ID NO: 65858 - DNA, 774 bp, Glycine max
  Peptide Sequence Number=SeqID_157543
atgccctttcctctttctctctgcccctcttttcccctatgttccttcctcttcccctttggccctcccttcccctcttccttcgcccttaactaccacgaccccttccccttcctccatccccaaccaccacgagcccccattttcttttctcttctttgcacatctcaggaccactactgcacttcccttggtgatgtcgcacacagctcaatgctgggatacggtttaactgagtccgcggttacccgaatcactccggaggaggctaatcgggtgggagcaacaggtaaactgataccaagtatagaagccaaaattgtgaacccggaaacaggggaagccatgtttcctggtgaacaaggagaattatggatcaaaggaccttatgttatgaaaggttatgctggtgacccaaaagcaacttcagaaactttggtggatgggtggttaaggactggtgacctttgttatttcgataatgaagaaataattttatataaacgggctgttcaagacaaaaatcttttgctaaaacgcacaggaagtgggtcaagtcctcatcatccctcgtcacacctccttcctttatcgtgcaccaagtgcgattcgtgtattcttaagtccaatctgcaatttctcacatttgaggtcaacaaatttgtgttgatgtgttgctttgtccaatattctttgattttggaaattgctcatgagtgtgagataaatcaattgacacaacaggagagagttgtagaagttgaaaggaagtaa

SEQ ID NO: 65859 - DNA, 1071 bp, Glycine max
  Peptide Sequence Number=SeqID_157544
atgagggagtgcaagtgcacccctagagacaacttagatccaccccatggagacaattggcataaatatgtacttcatccttcccatatttttctatttttagtagcattgttggcagaacacgagagtagaacaagtacatgctcacccgtcgttacagatccaagaagcggtttctaccgcgattccagaaccttccacagcctcaagcccccgctccgcctccctcttcccaacgctgccgtctccgtcgcctccttcgccctctccctccgctgcaactcgctattcccggactcctccactaccattatcgactctgccaccagccaccgtctctcttgcggcgagctcctccaccgcgccaaaaccctagcctcaaacctcaccacaatcctcaaactcaccaaaggtgacactgcgcttgttctctacccaaacatcctccaagtttcgatcctctacttcgcgcttctttctctcggcgtggtcgtctcccccacgaaccctctctccacgcgctttgagctcacacacttcttcaacatcagcaaccccacaattgttttcacagtaacctcagtcgttgaaaaaacacgacagtttcaagtaaaaaccgtgctcctcgactcgcccgagttcgactcactcacgaaatctcagattcagagtaaaacaggattaaccaaagggccttattccgagaatgaacacgtttcaaacacgccagtgactcagtccgacgtggcagcgattctatactcctcgggaaccacggggatgataaagggcgtgatgctcacgcaccgtaacttgactgcaatagtcgcgggatatgacaccgttcgggagaagaggaaggagccagcggtggtgctcttcacggtgccgtttttccacgtgtacgggttctcgttcagccagggggcgataatgctgtcggagacgatggttgttagtaactcagcccaggtacggcccacacccaccagactcagaccagctcgagtcaagtcagcaccaatacacttgaaagactatcacgttgataacgtgcatggaccaccatga

SEQ ID NO: 65860 - DNA, 1044 bp, Glycine max
  Peptide Sequence Number=SeqID_157545
atggacgagagaaaaagaatagatccaaggagcggtttcaaccgcgcttccagaatcttccacagcctcaagccaccactccccctccctcctcccaacgccaccttctccgccacaacctacgccctctccctccgccgcaactcgctatttcccgactccaccaccgccctcatcgatgccaccaccggccaccgcctctcccactacgaggtcatcaaccgcatcgaaaccctagcaaataatttcacctctatcctcaaactctccaaaggcgacactgcgctcattctctccccaaacctcatccaagttccaatcctctgcttcgcacttctttcgcttggcgtggtcgtctctcccgcgaaccctatctccacgcgctccgatctcacgcgcttcttccacctcagcaaacctgcaattgtcttcacagtaacttcagtcgttgagaaaacacaagactttcatgttagaaccgtactcctcgactcgcccgagttcgactcgctcacgaagactcggattcagatacatcctccgagtccactcgtttcccccgtgactcaatctgacgtggcagcgattttatactcgtcggggaccacggggatgatgaagggtgtggtaatgacgcaccgtaacctaacggcgttagccgcgggatacgacgccgttagagtaaacagaaagtatcccgcggtgttcttctttacgatgccgtttttccacgtgtacgggttcacgctcagttttagggcaatggtgctgtcggagacggtggtgataatggagaggttcagtttgagggggatgctgagcgccgtggagaggttcggagtgacacacctggcggtggtgccgccgctgatggtagctttgacgaaggacagcgtcaccaacgggtacgatttgaagacgctggaaggggttacgtgcggttcgtctccactgggaaaggaaaccgctgaggctttcaaagcaaagttccccaacgtcatgatcctccaggtttgccttcgaaaatcatatataatgacataa

SEQ ID NO: 65861 - DNA, 156 bp, Glycine max
  Peptide Sequence Number=SeqID_157546
atgataacaaaagatgatgacaaaggtgatgacaaaaagctcaaaggtcaatcaaagaatgagttcaagatattcaagatagaatcaagaatcaagattcaagagatcaagatttcaagaatcaagataaggcttaatcaagataagtatgaaaag

SEQ ID NO: 65862 - DNA, 210 bp, Glycine max
  Peptide Sequence Number=SeqID_157547
atggtttttgaaagtgatagtgatctagcttcccctagatccactaagctaagggcttcattggctatgcaaatgcataagttgcaaaaaattgttgaaaagaggatgagagaaagatttgatgagatacaaagaagcactcaagagttaagtgggagaatgaaagacatagagaggaagaggcatcattggttaccttattcttcttga

SEQ ID NO: 65863 - DNA, 195 bp, Glycine max
  Peptide Sequence Number=SeqID_157548
atgtctagaggatctcaggtgagttctcttggtaggggcttgggatatcagccttggtgtacttcgtctttattccattgtcaaagccgctaccatggagccccacctcgccccctctcccgatttgtagtcccttttagggcttactcgaccacgacccaacaacaaaacccattcccccaaatctcctcctaa

SEQ ID NO: 65864 - DNA, 138 bp, Glycine max
  Peptide Sequence Number=SeqID_157549
atggcagaaaagaagaaaggtgaagtaaggagatcttttcagcaaggacaacccccaatgcgtaattggatgtatcgcacattagctcaaatggggatgtccaatcagggtctacctctatgcccttactggaaatga

SEQ ID NO: 65865 - DNA, 381 bp, Glycine max
  Peptide Sequence Number=SeqID_157550
atggcacgtgctcctgataacatcaagtctattaatggatcaaaagaggcacttaaacttgccataagaattactgatctttggttcgttgggactccaaacagatctgaacaagcagaaatggtcataattgattctcatgagggtgatattgatttgaatgtttctcctctagctcttgataagttgttgggttatgtccttgcatttaaaatcaaagttcaacctaagtttaacaatgttgttgttcttagatactcgaatgacttagatttgatcaatgttgtggtggacatgctgcctgatgctgaggcatgttccaacgttcatgctcctattcttgactccgatgatcctttccaactcgaatctataagttga

SEQ ID NO: 65866 - DNA, 549 bp, Glycine max
  Peptide Sequence Number=SeqID_157551
atggcaagcagaaatgagaacgtccctgccgaagtctactacgatgcttatgtagtcgactgtgacaagggcattcagtttaaaggtggaaacaagacacaattgcttggtggatcattaaactactatgagacgactccccaactaaatgagcactcccaactaaatgtcgacccaactactgatatccatgttgctcagtctgaaagcaacgaaatgtcacatgactatcatgctcaaaatgggttaccggatgaagtagttggtgacttcaatgacgacgaagacgaaattttggcggacaacaacaacaacaacaacaacgataatgacatacagttccttttcccgaaaacatcaactaaaaatgtctatcgtccatctccaaatagcgctgatgttagtgacaatcaagtgcctgacaaccctgactataggcattttttggaccaacaacaacaatctaacttgcacgataatgagttgtatgttggtcagcgattttgtcaattagaggacctgaaacgccgtaaagatgtggaacattaa

SEQ ID NO: 65867 - DNA, 414 bp, Glycine max
  Peptide Sequence Number=SeqID_157552
atgacattcttgggagaaacaagcagttggaccattgctaactcgagattagccttcatttttccaaatggatcaatcactcacaaccaaactggtgtttattttcaaagtcccactccaacaccaataacaccggatggtatacttaacctacttcaatcaaccattacttctactcatgatgcaatgttgtattacaatgagaagtggaacataccacaccaaggtgggtttttgggttactccttcactggaacaaacccaataagatttgacattcctttgagacgcaacatcaagaaactcaaggatgtcatcaagcaagttgcacctctaagggttctcccttatggaattcacgaatcacaggtggtcaaacgattgttctttcgacagctagaccatactaaatag

SEQ ID NO: 65868 - DNA, 642 bp, Glycine max
  Peptide Sequence Number=SeqID_157553
atggtcattgatactgctgtgtggaaggaagtagtcgatctggatatgggtggagtctgcaagttcgatgaagcgcctgatgggtacaacaagatgcagacttataggggaatacttcttgaccctgctaggaacttgaggaatcgcttaggagttggtggacaaactatagaggacagaatgttagtttacctcattacctacattttaattctgaggtcaagtaatcatgcccaggtaacggatgatgatctacatattgtttatggtctgaaatcaagtatcaagatgaactgggtattgctgattgaagacattatgttgaagagttgtcatctagtggattatgaatttccttgtgttgtacttgcctcaagattcattgactacttcaattttgatgtctctaataggattgtggactttaccaaagcatccagtgaaattatcaaaaggcatctcaagaagcttggaatgaggttttctaagaaaagtctctactctcaagtctctccaaatgcactcaaatggaaattcaagtttggcatcaaagccaaaaagggggagattgttagagatagggggagcaacatgaagaagcttgaaaaagttgtctttttgcatgtccaactctttgagtag

SEQ ID NO: 65869 - DNA, 603 bp, Glycine max
  Peptide Sequence Number=SeqID_157554
atggttaaggaaaagtgtaaggaggtaagtgtctcctccaagaggttagctaagaaggaaagtcattttgcaataaagataaaaattaaagaaactttccctcttagacaacctccacatcttctcttttgtaaaaagacacttgttagcactaccacaccttttgggcttgaggttattcctcaagtaaaggagttgttgaatgagggtttggttcgtattattaggcaccaaattcctaaaataggtgatatgatgaatgtgttgagtggtgcaaccctcatttttaaaatcactcatgcacccaacatcttcatgattcgtgtacatagggactcattagggatttccacggaccctaagagaataaaggtcattcctgagtggcccaccccaccaagtataaggaaaatttggggcttccatgacttaacaaacttttacaaaagggaagaaaccatgagtttcaagaaccttttcaaggggagagggaatgatgaaatcctacccccaagggaattggatagaagactccaagaagattgggctagagatgctaaagaaggccctagggttctcatgagccttagagtagatttctga

SEQ ID NO: 65870 - DNA, 363 bp, Glycine max
  Peptide Sequence Number=SeqID_157555
atgaagttgcaagctgagctttcttatcttaaagatatgtttggaaaaatgaacaaagaaaatagtgatcttagtcacttgctcagtgtgcaaaagcatactaccgataagactagtttggggtataacaagaaaactaccttttctaagaaaaccaagtttgcatcctccaaaaaggtgaacccaaacaaagtctccaaaaagaaaaacatagtgcattctaagcctaaagcaaagacttgtcattattgcatgaaaagaggacacacatcttataaatgctatgttaggagatttaatgttcctagaggtgtgcctaaaggcaagggactcgctatggtacttggaaaatggctgctctag

SEQ ID NO: 65871 - DNA, 580 bp, Glycine max
  Peptide Sequence Number=SeqID_157556
cagcattgggtggaataaaagcaaccgcaactggaaacgaaatatgccctctcacagttgtgcaatctcgcatgagctcgataaggggattggaacaattatttcatccccattaaaaatcccttttatcgccgaaggctatcctttgaacattaagttcggaccatttttagttataacgctgtgttccagcattcctagtgattggactattgtcaatggtttaccagaaggacccgctgttaaaattggtgcgcaaaaaaatacagaagatggttggtttaaaattgagaaagcttcacctttcggctataagcttgtgttctgtccactgcttgaggatagcacatgttgggatattgggattgatattgatgataatggaatcaggcatttggtagtgtctaaggtcaatctattattggttgtgtttcagaaatttgatgaagcaccactggccctcaataatcttgtgcttccttccacgcagattaagcttgaagatcgtccatccaccgggacaaagcactacccgggtcttattttagtaattatctatgctcagcaaaatggtccttga

SEQ ID NO: 65872 - DNA, 327 bp, Glycine max
  Peptide Sequence Number=SeqID_157557
atgcaaaagaacaaggcatctgttgcggctttgaatgcagaggttcgtcgaaccaaaggtagactcatggacgagcttcctaaactccgcaaattgatgcacaagaaggtggaccttgttctagcattgctagagagaatccaagcaataccaaatggtacttctggtgctgttgttcaaactacaggatggaccactacctcatctcagccgcatatcaactttgattcatcagagggacatcttgccagtgattatttcctgcaaagtgaagaatccagtcagtttcgacaagagtatgagatgcgtaggatgaaacggctttga

SEQ ID NO: 65873 - DNA, 2103 bp, Glycine max
  Peptide Sequence Number=SeqID_157558
atgtctgtgagaggtggtgatgccgatgtgttccaaaagaattgcttggagttcaacttgtacgagccgcggagagataagactgttaagggccagttgctggcaactggcgtcgtagatttggcagaatatggggcacttaaagagtccttgagcactagtgttcctatgaactgcaagaggagctacaggaacacagatcagccacttttgttcattaaaattcggcccgttgaaaggaatcgcgctagtgccttgttgaaggatagtaatggtggtgactcagtgtcaacactcatgaatgaagaatatgctgaggaagccgagattgcctcttttactgatgatgatgtctcgtcacattcatctgtggcagcagtttctacttcaattgagtccactggttttacccagccaaaatttggaacgaacgaaccaattagcaacaacactggtgtgaatgctaagaaacatcccttggcttcagaaagaaggcttgagaacatgaatatggtgcaagaagatacacacaagcttgagaggagttcttacgtgtcatcaacggatgtatctcctgttatcaggagtctggtaaatggtcatgcttctaattctcctaatcgcaattcattgtcaatccaaaagctagctgcttcacctagtgccgattcttcatcaccatcttcagtttgtgacaatttagacataaatcctaggagcatgacaagaagcagtggtcatgaaagtttgggtcagagttttcatgaaaagcttgctaattacagaaatatagttgctgatgtccaaagaaacagtaatgaaagtacttttggcatttattcaaaacatacatcatctcaagatagaggtcacttcactagcaaaaatccaggctatgaaaactttgatactactaaatgtgatgacaaattaaatgggagatgtaaggaagctgacaaatattttatgaaggagagatcaaatttggatggaaatgaaagatctaatttggatgggcaaaactacatagaagatgaacaattggtagcacaagaggccagagatcaagccttattgggtagcaatacacattcttatggggagtcaaatacgagtatgcaggaaaatattctcaaaagtgaaagattaaagaacacgaagtcggtgaggttaccgggagactcagttaggaatgctgaattaaatgaaaatggaattcttggagatgcacaaaacagttcagggaacagaagcaatgacagaagagattctaagattcttgcaaaggaaataagaagtggtactctagatggaaaaattgagcatttagaaaagaagataaagatgcttgaaggagagttaagagaagccgctgctattgaggctgctttatatacagtagttgctgagcatggaaactccacaagtaaagttcatgccccagctcggcgcctttccaggctctatcttcatgctagtaaagaaaatcttcaagaaagaagggctggggcagctaaaagttcagtttcaggattagtacttgttacaaaggcatgtggaaacgatgtcccaaggttgactttttggttgtctaatactatagtgttgagaacaattataagccaaacagtcaaagttccaccaaatcctgctggatctggtagaagaaagaaaactgagggagaggaggggtgtggcaagataacaacctcactaagggtgaaggggttataccccagaaaaactgaaaatacagctttaggatatgaaggttttggtaactgggatgatccccatatattcatattagcactcgaaaaggttgaagcttggatcttctctcgcattatagaatccatctggtggcagactctgactccacatatgcagcacaccatggtgaccaacaaggaagtgatgtctgccacaagaaaagactatagaaggacttcaagctcatgtgatcaaaagcagggtaacttgtctctatatatttggaagaatgcttttagggaagcctgtgaaagggtctgtcctattcgagcccgagggcatgagtgtggctgtctgtctatgctttctagattggtcagtctaatttaa

SEQ ID NO: 65874 - DNA, 276 bp, Glycine max
  Peptide Sequence Number=SeqID_157559
atggataaggctacaccttcaatccccagacttgcccctaccatagagcaaattaaacgggataattctgaattacctcccacaactcagtaccaactgccaaaggtcaaggacaacaataataaatctagcatgaccacaccttttaaactaaaggatgtcaacaaagaaataaccccgaaggatattgggagcctgatggaacatgctaattacaccaacaaataccttcaggtgttaggggaatctattagtaaagaaaaaggtctttactaa

SEQ ID NO: 65875 - DNA, 2031 bp, Glycine max
  Peptide Sequence Number=SeqID_157560
gttggtgtcaattggtccaatccatcatggtgcagagaaactgcagctgggagaaaaatataagcttatgtgggcagcaatgtaccttgaacgcaccaaacaagatgctcaaactctgtaccaaaagatcgcatcgaatatcgaacaactgaaggatctgtttgcggaggatgttattagagacttccctgatgacgaaaagctctcgtggtcgtggatgctatttgtggatggatgttctctgctacaaatcttggagaagggagaacttcaggatccaaaagaaatgaatgtaaaggttgatcaacttgttcttgtgtggcaggatgtgctcttgttagagaatcaacttccctatcatgtgcttaaactgttgtcagaccatgaggatgatgccaagctggtaaagagcatgaatgagtttcttaagtgtcatcatttgtcaccagagctaagatcaaagaaacaggacattggcaactctatgaccaaggatgaacacagagcgttggatgaagaagggtacacaagtgtttatgtaaagaacgaagacatcctgcatggagaacacaaaatagaaatatcccaggaatcacctattcatctgcttgatcagcttcgcagatatgtccttgatgatcctcataagaaacaaaaaaatgaaacaggaaacgtgaaaaaggaagatcagaacacaaatgaagacttggacatgacaacatacaggaacatacaagagctgagagcagcagggattaaactaaagagagataagtcgcgtaggcggctaagagatgtgtcattctcttatcgctggatgtgcctgtgtgcggaattgacgcttcctcagatcacagtcgacgacacaacaactcctacatttctcaacttgatagcgtatgagatgtgtcctgatttcaagaacaacttcgagatttgttcctttgtggtcttcatggactcacttatcgaccatcccgaggatgtgaaggagctgagagcagcaaaggttctgcacaatgctcttggaagtgatgaggatgtggcaaagcttttcaacaccataagcgctgacttggtgcctgacatggagagttatttgcatgttagacgccaaattgagaagcattataggagcaaatataggacatggatagctcttggttatcatacctactttagtaatccatgggcagtcattgctttccatgctgctcttgttgttctagttctcactttcatccaaacttggtctctttcaggttcagcccatcgtccctcgacctccgcacacaaagtccctctcaatctccctcacacgctcctcactaagcttcttcctgagaagcgagtacaagcgaatatcgcgcagatgagttcgttggagaaggtgagcctcaacattaacccgcacttcttgaagcaagacgatgccgtcggaggcggcgaagaaggcgaggacgtaggtgatgaagtggcacacgccgttgctgagggtggcccaatggcggaggtcctacgagaggtccacctcctccgccgtccagaaggaggcctcgactttcttatacatttcccaaatttcaaggttgagaaaaagatgcacgttgttcaaggacgaatggaagatttggagaaccaactgaatcagaatactggaagacattatggtggtaatagagtgggcaatgttggactcacgcaacacagaatggaggggcagaacagaattgagggagtaaaactcaatgtacctcctttcaagggggcgggagatagatacatagacagagatgagaagggtgatgcgaaagaggagtactacaaggagatggagaagacactagtgagggccaacattgaagaggaaactgaggacacgatagctcattttctgagtggcctaaattctaacattagagatgttgttgaattacaggagtatgtggaattggatgactttctgcataaagcagtctgggctacggagatttggatgacgccacttccggtgaaggaagataagtcagg

SEQ ID NO: 65876 - DNA, 210 bp, Glycine max
  Peptide Sequence Number=SeqID_157561
atgggggatgacagagggcgtggttggtggctggcgaaggacaggtcgcgagattttttggtggtggtggtggaagctggtagcgaagtcgatcgaaatgggagagaagggaaaggttgcagtggaacggatttggaagcttccaacgaagcaatggagcattcaatgaaggtgaatggatctagcagcttatactgtttctacctctaa

SEQ ID NO: 65877 - DNA, 317 bp, Glycine max
  Peptide Sequence Number=SeqID_157562
atggatagtagaagacttactagtcaagggagattgacttggtggctaggtgaagaggaggaagtatttaagatgtttggtactacaaagagctccttctctcccctttcttgcaatcttgtgcaatccaccaacaaggtgaaagtcactgtggctaagcctcactcaagtgtggggaagaaagaccctcccgggaacaaagctcatgacgttaaacaagcactatctaggagtggtattggcggtttgactggtctatcccgtcaagcagcagcagctgcagctgcagcaacagaagtgcaggctaggcagcctag

SEQ ID NO: 65878 - DNA, 387 bp, Glycine max
  Peptide Sequence Number=SeqID_157563
atgtcgaagatgttgatgaatgatggccacatatatggtaagcgtgtgtttgctgctgcagttcaactaccaaggtttactagaaagaagggaatgaacgggaataaattgaaagtaacgttgaaggagacaaattcccaacctttcttaaatgaacatgattacatgaatgccaaattaaaaagaatttcccaaactagggctgttctgaaggtatttcccagggggagtcctttttcacgtaactggccatgcatggcgccagttctgatggcgccacgtggccaaggaagcgccattcccagcagcgttttcgcttttgctgagctggctttggaagcgccagcagcagtggcgacttcagtgcaggaaaagctgcagccctag

SEQ ID NO: 65879 - DNA, 519 bp, Glycine max
  Peptide Sequence Number=SeqID_157564
atggtggtcacagttcgatcggagagggtgctacgccagcttgggtacattctgagcatcccttcgccgcctgttagcgcttcgttgtcatatgatgatatagatgacaggtggatgcatttctcagaccacgtagtagctgtgggtgacctttgtgtagtgcccgggcaggtatctgcggattacatggagtggtttttccagatatctcacccattcatgataccgatccaggcaagtgaccagcccagacatgcacctgccccagaccatgaggactacatgcagccggacatcccacaggttccagtggcatttgacccccctcaacatgcagtggatgattacgaaggctatgaggcgatcgcagaaaggttggagcgtgtgctcaaccttaggatggtcactgcagggacaaagttacatgatatcatgcaagattgcctaaggatcgtcagggggggtgctagcacagatggaagtgttagggctcgacaaagacggcacacaaagctttga

SEQ ID NO: 65880 - DNA, 225 bp, Glycine max
  Peptide Sequence Number=SeqID_157565
atgaccttgtcaccttgtgagggtgaggatcttgagagagagggaggccgtgaggggactgagggtgaggctcgaagtccaatcgaagacggtgagggtcttgagagagagggaggccgtgagcgtgaggctgacacggagccgctgccgtggagggaggctgtcgagggtaagggtcttgagagagatagctcgagagaagagattcaagagagtgagaaatga

SEQ ID NO: 65881 - DNA, 471 bp, Glycine max
  Peptide Sequence Number=SeqID_157566
atgcatctaaagtgtgacacatctgtagaagcaagcttcatgatgatgaaccaagcaattttgatgatgccaaaagcccaagtgattgattcaagattgattcaagacttcaagatcaagcatcaagaatccaatccaagattcaagattcaaaagaagaaatcaagaagcaacaaagggtacatctacttgggttgtaatactgagaacaagagagggtacatctcttgtggatcagttcaagtggagggtacatccacttggtttttcaaagagaacaaggaagggtacatcccttgtggatctatgcttgtaaaggattttacaaggatcaacattgaaggtgattcagacccgcaaaccaatcacttaaacaatgtggttgaacttcgttcaacacaacttacgcaggacacggcagtgagcgtgacggcaaacacaatggtaagcgcaacagcggacacggggtaa

SEQ ID NO: 65882 - DNA, 344 bp, Glycine max
  Peptide Sequence Number=SeqID_157567
ggaacgatcctgacacgggtgactcagacaaatgcaggttgtacatcaaagaaaatcctccccgcctggttgccctaggaagagtttatgagggatccacaacggttggtgttgaggaggttaaagatgcagaggctcccgttcctatacccactaacgaggttattttagtagggcagacaattaataccttccttgcttggccgacacatctcgtgaagcgtttatcagaacaagcagttgtgtctctagtaaaacctcctgataggccggatcatgaggtcgatgatcccctatatctgatgacattgatcatcccacaactttttttgaagccgatgtag

SEQ ID NO: 65883 - DNA, 147 bp, Glycine max
  Peptide Sequence Number=SeqID_157568
atggtcaaataccgcgccaaatccaagacagagatgaatcgaggtactcggggacgggtacgaatggatgctaggcccgtgaccaacagattgttgtcccgcattcgactccggacgatcgagaagcgctactgggaggtagcctag

SEQ ID NO: 65884 - DNA, 360 bp, Glycine max
  Peptide Sequence Number=SeqID_157569
atgcaccgcaggctgcagacgcaccaccaacacctcattaggctgatccagctaggtcatctggcatggagtggtatttacagcacttggttcgccagtaggcggcccaaccacagggggcaggtgcagacccatgagtgtctctaccagctcagcctcagtctgcagagccagggtttcgctccttttgcgtgccctacttcagatcagtttagggctgaggttgcatggcccggagattggcctgaggcccaggcaggggaggcgcccgtagaggctcccggcgacgcggaggaggtctgcatggatgaggagatgtcagatttactcggtttcttgggagggagtggagccacatga

SEQ ID NO: 65885 - DNA, 252 bp, Glycine max
  Peptide Sequence Number=SeqID_157570
atgttaggattgacaaacgattctcctcaaatttcagccagcccgcatcaattagactttgcaccttacgcttcagggccctacaatgctcaatggaacgccccggggctcctccatgatacgcacacgttgctttcgagtcgtatcctcagagaaatggaggttgaggaaccttggttgcggttaaggctaccattgaattatcaagtggatatgggagcaaatcatcataggacaccggaattagggtga

SEQ ID NO: 65886 - DNA, 780 bp, Glycine max
  Peptide Sequence Number=SeqID_157571
atgccctctagcccacgccgtgactttagctcctacttggccgaagccccaaaaaacccctcacaacacttaccaatatgcccaatatcaaccaagcttttcggcctgtgtcggaaacccctccagtccagcgcccatccagcaaagggcacccggtcaaacacaaagggcccccactcaaaacttggctcctacacaacctcgccccaccagcaactccattccgggcataagctccaatccaggaaggaattttctggtaaagaaacttgcgaaattcagtcccatcccgatgtcatacgcagacttgctaccatctttgatcgccaaccaaatggcagtggtgacccctgggaattttccagtttcctttcccttaatgaggatggtccaaacgtaaagacaaaccctcttaccagtcatgggggactagcggttattacggtggaggagtgcggacctcagaggttgaagcagatgaaagatgtggtaacctctaagaggtttatattgaaggcgttgcacaaggcaggcatcatttgctttgacggggacgagggggatacctacttgatacacacagggacggcgcatgatgtagaggtataccctgtggcagaggatttgctgcaaaggataatggatcaaggccggtttgaagttagtggtgcaagaaagtgggagcaacatgtgtgcatgcaatcggctgacaaaagcccgagcaagcctaaaccattggtgatccacttcaccgaagatgctgccacccaaaagccctga

SEQ ID NO: 65887 - DNA, 216 bp, Glycine max
  Peptide Sequence Number=SeqID_157572
atgggtagctgtaagaaaggtgttcagagacaggactggtgtagtttgatcctcaggagtggaagggtctgctgctgtcgcaacatgcccttttgcgggcgagcgaaggtgagggtcacgggtgcgctttccaaaggaggaaagatgcgcggagtcgccaccaacgtttatttgtggaaaacatcggaaaaaccgaaggaaaccgggtcgaaatga

SEQ ID NO: 65888 - DNA, 356 bp, Glycine max
  Peptide Sequence Number=SeqID_157573
gtcgactctagaggatcccacctacacgccctcgcctttagaggactacacgtcctcgccttcagagggctacatgccctcacctttagaggactgcacgccctcgccttcatagggctacaagccctcgccttcagaggactacacgtcctcaccttcagaggactacacgtcctcgccttcagagggctacacgccctcaccttcagaggactacacgtcctcaccatccgaggactacacgtcctcgccaaaatgtgcttggcatccatcattaggcaatttgtgaaattccaggacatgccgaaaaaccaatttgtgaaattcccgggttcatgggaacataaggagtggag

SEQ ID NO: 65889 - DNA, 324 bp, Glycine max
  Peptide Sequence Number=SeqID_157574
atgaaacctgcagataggccagatcatgatgttgattatcccttatatctgatgacattaaccattccacaactttttctgaagccgttgcaggttatgtgggatgctatcgtgtttggggactttaatgacaacttccccttgtacataaagcatgaaggcttgtttgaaatagcacacgatggtcaatgtctcagcatctctgttatacagttgtggattctgcatatgtctgagacaagtatgcaagcgggaaatgtcgatgtgtatggattcctcgagccacagtctatacaaagatctgggcaatcacaatttgaataa

SEQ ID NO: 65890 - DNA, 406 bp, Glycine max
  Peptide Sequence Number=SeqID_157575
atgcagcaacagcagcaacaacaaaaacaacaagcaactgaggccccttctcaaccttccttagaggagttagtgaggcaaatgaccatccaaaatatccaatttcagcaagagacaagagcctccattcagagtcggacaaatcagatggggcagatggctactcagttgaacaaggctcagtcccaaaattctgacaaattgccttcacaaactgtgcagaacccaaaaaatgtgagtgtcatcaccttgaggtctggcaagcaaattgaagtgcctccaccagtagcagcacctgcacctgaacctgtcaagcttcattctacacctgaaaaagaggatgagatagttgcacaaaaaagaaagcttcctgatcatgagagagctaacaaaaattttcatgcag

SEQ ID NO: 65891 - DNA, 191 bp, Glycine max
  Peptide Sequence Number=SeqID_157576
gaagggcagtagcttcatctgatgatgcatcagagatgataatcagaggtggagatggggtaactacttcaagctcaggagaaggaggtggattcaccactggagttcgtggctcagttggcattagttcaacctgtgccggtgcgagctccagaggagcagcctcattgggtctccccaatggaagttaa

SEQ ID NO: 65892 - DNA, 645 bp, Glycine max
  Peptide Sequence Number=SeqID_157577
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcgcggtgctgggttatggccccgattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttag

SEQ ID NO: 65893 - DNA, 249 bp, Glycine max
  Peptide Sequence Number=SeqID_157578
atgaatagaactaggaatttgggcatgatggtagtttgctttagaacctctgagcctatcatggttaggaccagaggattaggtcgtgccttaggtcaagttactggcagaggtgtgggcagaggagatcgtgatgattccgatgatgctccgcagcgtcgacggcctactgcatccgcacggaggcagcgagtcgctgtgactgcggatcacatcgatgagccagtcatccctgcgccagatgtttag

SEQ ID NO: 65894 - DNA, 234 bp, Glycine max
  Peptide Sequence Number=SeqID_157579
atgtataaatcatatttaaaccaaaaacaagcttcagatcaagaagtccacccgtaccttaaattcgaagccccacaatgtagaggtgtgcttcacgacttcgaaaatggcttctccttgcaatttggagtagaaatggagaagaattttggagcttcaatggaggcttcaatggtggagaagaagaaagaagaaaagcaacatggaagggaggaaaagcttatgaatttctga

SEQ ID NO: 65895 - DNA, 264 bp, Glycine max
  Peptide Sequence Number=SeqID_157580
atgcatttcattattttcttttcagattcatacagattgttcacattcatggtagcaacacgcctagaggaagcaagcttcatgatgatgaatcaagttgattcaagtagttttgatgatggcataaagccaaagagaatgatttcaagattgagtcaacaaggtcaagatcgagataagatcaagattaatttcaagattcaagagatgacatcaagaagaatcaagattcaagagaagatgatttcacaagagaagaattga

SEQ ID NO: 65896 - DNA, 186 bp, Glycine max
  Peptide Sequence Number=SeqID_157581
atgttttctgggttggacttgacggactcttcagagtgtaggccttggggagtgaccttgactagtctccctatgattttacctagtgagagtgactggacttacaagtgtatgatagttaggtggatggctatagagaacctcatgctagaggatgttggaacacaatgctctgataggatgtga

SEQ ID NO: 65897 - DNA, 558 bp, Glycine max
  Peptide Sequence Number=SeqID_157582
gattatactaagaatcaatatcaaccagaagcttccattgttgaaaggtatgttgctgaagaagctattgagttttgttctcagtacattgaaatagttcaatatgtttggcttcctgaccaagatccatgtgattcaagattgtcagtgcttctacaaggaagaccaattggtatcagtaaccagaatgatgattcaacacttgacatttgtgaaacgcttgctttttccacaaaagtgccttttataattgaagaaaacgaggttgatgacgatcatgggaacattgccaaggtcccttttgcattcaaattgtcatttagaggaggatcaggcccacaaaaacagaagttccacaactatctaggggtcatagctagagaaaaaattcctattgtacatagcaatgggaaagatgtaccagaatctcaaaaggacctagtatgggatgacatttgggcattggatagaaggctccaagaagattgggccagagatgcaagagaagaccttagggttctcatgagccttagggtagatttcaggtctatgggctaa

SEQ ID NO: 65898 - DNA, 300 bp, Glycine max
  Peptide Sequence Number=SeqID_157583
gtcagggggtgcgaacacgcgaccgatgcgggtcacgctgctcagccccatgatattggttaccttggccgacaacgggctgatgtcggtggcttcttccttcctttcgcttggaggtgcatacctccatggaactgcatggctgttttgtatggaaacgaaataggtttaactaccgaggggtatcagggcgtttggggagctgcgtctctggtgaaatatatcactaaaagcttaggctttccaagacctccctcatccgcggactgcatgcatatgtgctgctcttcacccccctga

SEQ ID NO: 65899 - DNA, 594 bp, Glycine max
  Peptide Sequence Number=SeqID_157584
atgcgtgccaaagctagagtgatgagtgaaataaaggaggtgcaagagcagatgaaggccgacatggagcccatgaaagagcaaatgcccacaatgatggaatccatgatgagtatgagaaaaatgatagaggtcaacacagttacagtcgttgccgcaagtactgccactgaggtggacccgactcacccatctagcatcaatcaagcaagtcatctagtcccagatatgataggtcagggaggcgaagcattgggaagtacaggcagcccccattttgtgcaagtccaaagtaagcattccttccgaccatatggcttgcctcccaactatacaccacccaatgttgcacacgctcccgatgagaatgttgataactccgctcccatacccattgagagccaacaacacaaatctggtcatgcacaggtccctcaacccatgggagagagacctgaagtaccccgagaccacactctagccaacttcgagcctcacctcggatatgccactaaggggcaagcatttggtggcatgccactgccaaaccctttggggggccctcagtatcgcccacaaccacatctacaatga

SEQ ID NO: 65900 - DNA, 597 bp, Glycine max
  Peptide Sequence Number=SeqID_157585
aacgtcatccgcgcgccacgccttctagctccgaagcaacagtgccgtccaagtatttgcataggggagatcggcaaccaagttgacaccgcacatggccatgactcacacatgtgccgcctgagcatgcttaaacacaacttcactctagacgaaactgaactggagttgcacaaggctagaccacgtggtcagatcagagaaggggctgatgagagagaaaatggtgttgctgcgcaaaatgatagtcagtcaccggtagcggcgagtttcccttgtgtcctttctgacttcaatttctccttctctttgttgcttgcatttgatgaaggttttattgttaatgggcttgtctgggttgcgacggttacagagggggcgatggtgtgcctgaagtggagattcgctgaggcagaaaatgaattccatcgagccaggaaccaagaactagtgaatatctgcaagaggaatcatcaatcagacaggagcaagctcgacgtgcaacagaagagaaaattcaagctcaaagaaggaaaactgaaagagagaaggctgagattgaacatgaaacaatcagataggctctggcagaagtag

SEQ ID NO: 65901 - DNA, 339 bp, Glycine max
  Peptide Sequence Number=SeqID_157586
atgcagaaaagattcacacatacagttaatcatcttgcatcattaggaagaatatttccaaacaaggatctcataaataaagtgtttagatgtctaagtagagattggcaaccaaaggaacatgagatggagttgcaaagactaaatcaacatgaagaaaacgacaaaaggaagaagggaatagcactcaaagcttcatcttctattcaagaagaaagtgacaacgaagacttggaagaagatgaagatctcaatatttttgtcaaaagatttaacaagtttcttaaaatgagaggaaatcaaagacgccagaacttcaaaccaaaaaggagaacttaa

SEQ ID NO: 65902 - DNA, 242 bp, Glycine max
  Peptide Sequence Number=SeqID_157587
atgcggggttaccttatggttacccgcacctttcgtcaaccaggggaaaacgagccgattgacgggcgaagactaacatcgtcttctgcaccttttgtcgtcctgaccatgaagtcaggtgacatgcggagttaccttatggttatccgcacctttcgtgaaccagcggaaaacaagcccgttgacgcgcgaagactaacattgtcttctgcaccttttgtcgtcctgacccttgaagtcag

SEQ ID NO: 65903 - DNA, 786 bp, Glycine max
  Peptide Sequence Number=SeqID_157588
atgacaagactgaagatttctaaaactctgctggctgtaacactgggtagcgttctggttagcggctccgcgctggcggaaagcagcaccatggataaagcacagtccacggcggataccgcagggcaaaaaatcgatagctctatgaataaagtcggcaatttcatggatgacagctctatcacagcaaaagtgaaagccgcactggtggatgatgaagccatcaagagcaccgatatttccgttaagaccgacaaaaaagtggtcacgctgagcggctttgttgaaagccaggctcaggcagaacaggcggtgaaagtggcgaaaggcgtcgaaggcgttgcctccgtcagcgataagctgcatgtccgtgacggcaaaaatgcctcggtgaaaggttatgccggtgatgcagccaccaccagcgaaatcaaagctaaacttttagcagatgacatcgtgccgtcccgtaaggtgaaagtggaaaccaccgatggtgtggttcagctttccggtacggtagattcgcaggcgcaaagtgaacgtgccgagtccattgcgaaagcgattgatggtacagcggcatgggcagctaaaattgtcttcgttgtcggtcaactcgcgctggtctgcgagggtggcggacagcgcggcattttcaccgctggcgtgctggacgaatttatgcgcgcgcagttcaacccgtttgacctgtacttcggcacgtctgccggggcacagaatctttctgcctatgtctgtaaccagcccggatacgcgcgaaag

SEQ ID NO: 65904 - DNA, 315 bp, Glycine max
  Peptide Sequence Number=SeqID_157589
atgggtgacttattaggtgttgatttgcgtcacgagttttctactgagactgagcaacaagggcggagacagcacgcaagaagaaatcctgatcgtcaagcccgaaggtttagggtttatggtgtagggcttagggaaaaaaggtttaaggcttatggtttagggtttagggtttatggtttagggcttagggtttatggtttagtgtttaaggctttggttttaggtttagggcttagggtttatggtttagggtttaaggctttggttttaggtttagggcttagggtttatggtttagggtttaaggcttag

SEQ ID NO: 65905 - DNA, 441 bp, Glycine max
  Peptide Sequence Number=SeqID_157590
atgggtttgaatatagaaaaattgaagaacatcgtcattagtcttgagatggcgacgacagtggaggtggaggttaggaaggtggtggtggtatcggagccaatggttgtggtggaggttcaagagaggatgacactcaggttagcaaattgcattgtaatggcattctacacagaaaggcaaaattattcattctcttatcgttggtgtcctacaaagggctctattgcttggccaatcatgtctggaacctcatcacgagtgacagtgctatctgaagcttgtagagttgagtctcgtatcagtttcatcgattaccgatatctcgtaatcgattgcactattgtttgtgatatgaatgacaatggaatggagaaggaagagagagaggagaccccacttcaaggagaagatgagtcaagaagaagctcaccatcatag

SEQ ID NO: 65906 - DNA, 464 bp, Glycine max
  Peptide Sequence Number=SeqID_157591
atgagccgcgtactggtcctgaaatcaagtattctgggtgaatattcccagtctggaaaattagtcgatttttttgttgaacaatggcgtgaaactcaccctgaagacaggttcaccgtgcgcgatttggccaacccgacgctgccggagctggatggtgaagtgatggccggttttaccgccggcgataaaccgctgacgccgcaccagcaaagcaccctggcgctgtccgatgagctgattgccgagctgaaatcgcacgacacgctgatcatcagcgccccgatgtacaacttcaacatcccgacgcagctgaagatctacttcgatctgattgcccgcgccggtcagacgttccgctatacttccgccggcgccgaagggctggtgacaagcaagaaagcgatcgtcatctccagccgcggcggcatctacgccgacacgccgacggatctgatcacgcc

SEQ ID NO: 65907 - DNA, 135 bp, Glycine max
  Peptide Sequence Number=SeqID_157592
atggcagacgagcagcaccagaggattacccttgaggattattcaagcagctcagtaccacaattctttactagcattgcacgtcctgaagagaggccaagaggtggcttcactcgtttaagggtaatagtctga

SEQ ID NO: 65908 - DNA, 174 bp, Glycine max
  Peptide Sequence Number=SeqID_157593
atggatcaggttcaacgtcagtcttttagcaagttagcaccaaccatagaggagttcgaggggatcttaggatgcccgataggaggaaggaagccatacctcttttctgggtactacccttctatggagagagtagtgggagtagtcaagatcttagaatgtgagttagattga

SEQ ID NO: 65909 - DNA, 213 bp, Glycine max
  Peptide Sequence Number=SeqID_157594
atggggtattatcagacatccgagtcaaaactttcgcccgtcggaatttgcccgggtcttccttgtttgtttcttagtgtctcagttggtttccgagatatgaaactggccaaatacagtctaaaggcccaagtggagaaggacgaaggcccaagtggagaaggacaaagcccccgagtggagaaggatgaaggcccaagtggagaaggatga

SEQ ID NO: 65910 - DNA, 753 bp, Glycine max
  Peptide Sequence Number=SeqID_157595
atggcggacggctactggaaccggcaacaggcgtttctgcctcactccggcatgctcaaacggccgcgttccgactacggtaatgagatgcataatcatgttgctcgtgatgatgaccgtactggtcaccgaatgctaaaggacacacaaacaattggatctgcttatgaccactaccttcagagtgggcaactttcttcatttacttctggggaagtcagtgcagttggtggtcttgggttggctaggggtggtggtggtggattatcaggccattcactagctgatcctgctgtcatggggcgtcatgggggtggtggttcagatctagcgccaaatggacggggtgttaattatggtggtcagctaccagtagatgcggtttccagacctggacctgagacaggatctctacctccagatgcttcaagtactttatatgttgaaggtctcccttctgatagcaccagaagggaattatttatattccttaacctcaccttagatattttccgcccttttgttgggtatagagaagttagacttgtgagcaaagaatcgaaacatcgtggtggagatcctcattacctttgttttgtggactttgcaaatccagcttgtgcagcaaccgctatgagtgccttgcaaggttataaagttgatgaactcaatcccgagtccagtcacttgcggcttcagttttctcggtatcctggtccaagaagtggacctgcttttcgcagtaaaagatga

SEQ ID NO: 65911 - DNA, 363 bp, Glycine max
  Peptide Sequence Number=SeqID_157596
atgcgtggaacgcgtcaagtcggaggtgagttccatggagaacggaatccatggaggcgaggctggccatggcggcttcgaggcggtccaggctggcagcggaaggtgcggcatctgccattgaagagcggagaggagggcagtcgacgcctttctttccatttgcaacaatctatattgttatcaccattgctccatgtagacagcatgcaagagtcatctcgaaggccttgtttgaagttgagcagtgcttgtctctccctctcaatgcatttcacatgtgatgaggagttgaatccaagaatggatgcttgggtatgcaaaaagcacactaacattgcaaacaagattttcagagagtaa

SEQ ID NO: 65912 - DNA, 174 bp, Glycine max
  Peptide Sequence Number=SeqID_157597
atggcgtttgggttgacaatcgacagtggtttcggtggaggcttggcttgcttgggagagacagggtatttgtgtccattcgggtcctttggaggtgcaaggagcaaaaaagggagggatctattgaaagatgggtactgggtagcctttaccggatgtgttaaccagatttga

SEQ ID NO: 65913 - DNA, 174 bp, Glycine max
  Peptide Sequence Number=SeqID_157598
atggtgtttgggttgacaatcgacagtggttttggtggaggcttggtttgcttgggagagacagggtatttgtgtccattcgggtcctttggaggtgcaaggagcaaaaaagggagggatctactgaaagatgggtactgggtagcctttaccggatgtgttaaccagatttga

SEQ ID NO: 65914 - DNA, 508 bp, Glycine max
  Peptide Sequence Number=SeqID_157599
aaacaacttaaatggagaaattcctgacgagattgggaatttaaatttgttagaatttctcgacttatcaagaaatcatttctcaggcaaaattccttctactctttccaaaattgatcgtctttctgtgttagacttatcaaacaacaatctgattggaagaatcccccggggaagacagttgcaaacctttgacgcctctacttttggaggaaatcttggtctttgtggggagcaacttaacaaaagttgtcctggagatgagacaatagcaaagcctcaaggactagcaattgatggtgaagatgacaattcaattttctatggagcattatacatgagcttggggtttggattcttcacaggcttttggtgcttattggggacaatactactttggcaaccatggagaattacttatatgagattcttgaacagactgacagactatatacttgtaacaatggaagtaaatatggggaagtgctataggtggctcacaggctag

SEQ ID NO: 65915 - DNA, 333 bp, Glycine max
  Peptide Sequence Number=SeqID_157600
atgcaggggagagtgaatatgatacggcttaccagtaggaagggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 65916 - DNA, 1761 bp, Glycine max
  Peptide Sequence Number=SeqID_157601
atgaataataacaaggctcctcaattcagcaagaaatggagtgttttgacagtcgaagttgacatttggttaatgtcaaaaggggaaatcctacaagatgctccttatcaccaacttctgagctcaagccaagaattccaggaccttgtcaatgctcacaaggagacttctaattctaatcagtttgtgaatgctacatcttcacagagacatttaacttctgctagagagattacacaagttttcatggagaggcagtgtaaagcaacaaatggaaatcaattaattaaacaagaagagagagagaaaggagacacagggttgaagccttacctacaatgtctagctacagttgctttgggtatgaaatcatcaaaaaaattattttcacagttaatggattcccttttttgtgcacccatgtcattttatgactctacaccattgggaaggatacttactagggtctcatcagatatgagcatcgtggatgtcgatatgcccttctaccttggttttgctgtgggaggacctataatttgttgttctaatattatagttttagcaattgtcacttggcaagtcttggttgtctctataccaatggtgtacatagcgattcacttgcagaaatgcttttttgcctctgctaaagaagtgatgcggatgaatggcacaacaaaatcctttgtagctaatcatgtttctgaaactgttgctggagttgtgacaataagggcttttgaggatgaaggtcgtttctttgagaagaatcttgatctaattgatatcaatgctagtgctttcttccatagtttttcttcaaatgaatggttgatcctacacttagaaatggtctctgcagtagttctttccttcgcagcactttgtatggttatgcttccacctggaactttcgcccctgaaaggataaatcaatatatgcatataccaagtgaggcagaagaagtaatagaaggaaatcgtcctcctttgaattggccagatgcaggcaaagtagaaataaatgatctgcagataagatataggcctgaagggccacttgtactccatggcatcacttgcacatttgaaggagggcacaagattggtattgttggcaggacaggcagtgggaagtctactctgatcagtgctttatttcgtctcatggagccagcaagcggaaaaatcgttgttgatggcataaacatttcttctattggccttcaagatttgaggtcacgtttatgtattatacctcaggatcctactcttttcaatgggactgttagatataatttggaccctttatctcaacattctgatcaagagatatgggaggttcttggcaagtgtcaattgcaagaagtggttcaagagaaagaagagggcttaaactcctcagttgttggagagggatcaaactggagcatgggacaaagacagctgttctgtttggggcgtgccatgttgcggagaagcaaaatattggtgttggatgaagcaactgcatcaatcgataatgcaactgacatgattctgcagaaaaccattagaactgagtttgcagattgtaccgtgatcacagtggctcacaggatacctactgtgatggattgtacaatggttctttcaatcagtgaagggaatttggcggaatatgatgaaccaatgagcttgatgaggaaagaaggatcactattcaggcagcttgtcaatgaatactactctcattttcagtgtgcagaatcacattga

SEQ ID NO: 65917 - DNA, 1212 bp, Glycine max
  Peptide Sequence Number=SeqID_157602
atggaggatttttggagcatgttttgtggggatcgtgattgtcctgggacccggggaaagactttttgccatgatttaaagtttttgaaagatccttctacatgcattaaccagttcttgatcatttgcgttgatgtgctactactggtcatgttgggattcattttgatccagaagtctttgttcagaccatttcgtggtcagttttgcgtggaaagatattcaaacttgcagctaatttctgccgttaccaatggctctctggggttgttgcatttgtgcttagccatttgggttttagagaacataaggaagagctacactctttttccacttaatgggtgggtgctagaactttttcatggattcagatggttcttagttggcttaagtgtaagtcttcagttgaaacaactttcaagatcgtcgttgtggttgttttcacttcttacagtatttgtttccactattttatgtgtttcatccatgtcttatgcaattagcagcagagaattgtccttcaaggcagctttacatgttctgtcttttacaggagcagttttactactcttgtgcacttataaagtgtataaatgtgaagacactgatagagatattgatgaaggcctttatgaccctttaaatgaccactttaatgaagttgatcctgataactatttaactccatttgccaatgcagggttccttagtaggatgtctttttggtggttgaatccattgatgaaaaggggtcaagagaaaacacttcaggatgaggatattccaaagttaagagaatcagatcgagcaggaagttgctatttatcgtttgtagaacaattgagcagacaaaaaggaaaagaaaaattttcacagtcgttagttttgtggactttaattttgtgccacaagagagagattttgatgtcaggattgtttgcattactcaaggtactcaccttatctactggccctgtacttctgaatgcttttatattggtttctgagggtaatggaagtttcaaatacgagggttatgtattggtggtatcacttttcgttataaagatcatagagtccctatcacaaaggcagtggtatttccgcactaggcttgttgggatgaaagttaggtcagtacttacagcagctatttataaaaaattattgaggttatcgagttcagctagattgaatcactctggtggtgag

SEQ ID NO: 65918 - DNA, 4446 bp, Glycine max
  Peptide Sequence Number=SeqID_157603
atggaggatttttggagcatgttttgcggagaatctgattgtcctggaaccggaggaaagccacctttctgttatgatttcaagtttttgaaagatccttctacatgcaccaaccagttcttgatcatttgctttgatttgctactactgatcatgctggcattcattttgatccagaattctttgttcagaccatttcggggtcatcagtttgggctggcaagattttcaaacttgcagctaatttctgccataatcaatggatctttggggttgttgcatttgtgcttaggcatttgggttttagaggagaagttaaggaagagtctcactcttattcctcttgatttgtggttgctcgaactttttcaaggattcagatggttgttagtaggcttgagtgtaagtcttcagtttaaacagcttccaaggtcatggttgtggttgttttctcttcttacattatttttttctactgttttctgtgttctatccatgtcctatgcaataagtagcagagaattgtcctttaaggaagctttaggtgttctgtcttttccagggtcagttttactactcttgtgcacttataaagcgtataaatgtgaagacactgacggggaaattgatgaaggcctttatgaccctttaaatggtcactttaatgaagttgatcctgataactacgtaactccttttgccaaagctggattctttagtaggatgtcgttttggtggttgaatccattgatgaaaaggggcaaagagaaaacacttcaggacaaggatatcccaaagttgcgtgaatcagatcgagcagaaagttgctatttgtcatttttagaacaattgaacagagaaaagggaaaagaaccattatcacaatcatcagttttgtggactattgttttctgccacaggagagagattttgatgactggattgtttgcattgctcaaggtactcaccttgtctactggtcctgtacttctgaatgcatttatattggtttctgagggtaatgaaagtttcaaatatgagggttatgtattggtcatatcacttttcattataaagatcatagagtctctgtcacaaaggcagtggtatttccgcagtaggcttgttgggatgaaagttaggtcactacttacagcagcaatttataaaaaactattgaggttatctagtgcagctagattgacacattctggtggtgagataatgaattatgtgactgtggatgcttatagaattggagaattcccatattggtttcaccagtcgtggacgacaagccttcaaatatgtattgcattgttgatactttttaatgctattggggtggcaacaattgcctcattggtggtgatagttctcacagtgctttgcaatgctccactggcaaagttgcagcataagtttcagagtgaactcatggtggcacaagatgagagattgaaggccagtactgaggctcttacgaatatgaaagtcctgaagctgtatgcatgggaaacccattttaaaaatgctatagaaagactaagaaatttggaactgaaattgctaagttccgtgcaattgagaaaggcatacaacatctttctattttggacctcacctattttggtctctgctgcttcttttggaacatgttacttcttgaacattcctttgcgtgcaaataaccttttcacatttgtggcaactatacgccttgtgcaggagccaattacagccatcccagatgttattggggtggtcattcaagcaaaagtggcatttgcccggatcgttaaattccttgaggcacctgaattgcaaagtgaaaatttccggaatagaagttttgatgaaagtaataaaagcccaatttcaatcaaatctgctgacttttcatgggaaggtaatgcatcaaagtccacactgaggaacataaacttggagattagacacgggcaaaagttggctatttgtggagaagttggctcaggaaaatcaaccctcttagctacaattcttggagaagttccaatgataaagggaactattgaagtttatggaaagtttgcgtatgtttctcaaacagcatggatacagactggtactatacaggaaaatattttgtttggatctgatttggatgctcatagatatcaagaaacacttcgtagatcttcgctactgaaggacctggagctgtttccccatggagatctcactgaaataggtgagaggggagttaacttgagtggaggtcagaagcagcgaattcaacttgctcgtgcactttatcagaatgctgatgtatatctcttggatgatccatttagtgctgttgatgcacatactgccactaatctgtttaatgaatacatcatggatggtcttaaagagaaaactgttttactcgtaactcatcaagttgactttcttccagcgtttgattctgttttgttgatgtcaaatgggaaaatcctagaagctgctccttatcatcatttgttgtcctcaagccaagaattccaagatcttgttaatgctcacaagaaaactgccggttctgacaagcctatgaatgttacttcttccaagagacgttcgacatctgttagagagattacacaagctttcaaggagaaacatttaaaagaagcaaatggagatcagttaataaaggaagaagagagagagataggagacacagggttgaagccttacatgcagtatttgaatcagacgaaaggctacatatacttctttgtggcttctctttgtcatctcttgtttgtcatttgccagatattgcaaaactcatggatggctgctaatgttgacaattcccaagtcagcacattgaggttgattgtagtttacttcttgatcggggctatttctacaatattcttgttgatcagaactctacttattgttgccttgggtattcaatcatcaacaaatttatttttactgttaatgaactccctttttcgtgctccgatgtccttttatgactctacaccattgggaaggatacttagtagagtctcatcagatctaagcattatggatcttgatgtcccatttatcatcgcttatactgtgggaggtactacaaacttctattctaatctcgcagttttagcaattatcacttggcaaatcttgcttgtctgtgtaccaatggtttacattacaatacgcttgcagaggtactatttttccactgcaaaagaagtgatgcgcatgaatggcacaacaaaatccatcgtagctaatcatgtagctgaaactactgctggagttgtgacaataagagcctttgaagaagaagatcgtttctttgagaagaatcttgatctaattgacatcaatgctagtcctttcttccatagttttgcctcaaatgagtggctgatccaaagattagaaataattagtgcaatacttctttcttccacagcactatgcatggttatgcttccacccgggactttcagctctggattcattggcatggctctctcttatggtctttcactaaatgctcagctagtattttcaattcaaagtcaatgcaatcttgcaaattacataatctctgtagagaggctaaatcaatatatgcatataccaagtgaggccaaagaagtaattgaaggaaatcgtcctccttcaaattggccagttgctggtaaagtagagctaaatgacttgaagatacgatacaggctcgatggaccacttatactccatggaatcacatgcacattcaaagcaggacacaagattggaattgttggaaggacaggcagtggaaagtccactcttatcagtgctttatttcgtctagtggagccggcaggtggaaaaattgtagtcgatggcgtagacatatcttctatcggccttcatgatttgaggtcacgttttggtgttatacctcaggatcctaccctttttaatgggactgttaggtataatttggaccctttagctcaacactctgatcacgagatatgggaggttcttgggaagtgtcagttgcgagaagccgtccaagagaaacaagagggcctgaactcctcagttgttgaagatggatcaaactggagcatgggacaaaggcaattgttttgtttggggcgtgctcttttaaggagaagtaggatattggtgctggatgaagcaactgcatcaattgacaatgcaactgatttgattctgcagaaaaccattaggactgagtttgcagattgcacagtgatcacagtagcacacaggataccaaccgtgatggattgcactatggttctctcaatcagcgatggaaagttggtggagtatgatgaaccaacgagcttgatgaagaaagaaggatcgctattcaagcagcttgtcaaggagtactggtctcattttcaatctgcagaatcacattga

SEQ ID NO: 65919 - DNA, 777 bp, Glycine max
  Peptide Sequence Number=SeqID_157604
atggaaacttctcatcctctttctattgaaagcttctcttatagttggttagtgaacctgaagccatcactagaaagcctagatggctccctcagaacttcccttgatgcttctgatgaaacttcttccttcattgaaatggatccaagaatgacaccttctaaaagattcttcagaaactcccaagatttcaaatttgacttcccaatctcgcagtcccctcgcactcttgttgatgctgatgagctcttctccaatggctacctcatgcccctttttgttgaatcattgaagatggaagcatttgaggcctctgatgtcattccaagcctaccttcctcttcacatgtgccaaagagtgtggttcctaatagtcattctagatgcccttcgttgaaaaggtgcaaaacattatcaaggagaatatttctcaagtatctcaacttcttaaggcccttgtatagaagattgaggggtggcaaatcaggctcaaaacctgaatctgttgttaagagaaccgtgtcagcaaagaataggggatactattctgaaacttccccacggattagtgtagcttattctgctgatgactggcgcaagtcctgtgattctgaaagctcaatttatgaagcagttctccattgcaaaagatccattgcatatgttgtgttcaaggttttaaattgcagtcacggtcacaatttcatcgtgatcttggatattgctggcaattgtggctgcaattgcgatcgcaagagtccgaaaactttgacatag

SEQ ID NO: 65920 - DNA, 1794 bp, Glycine max
  Peptide Sequence Number=SeqID_157605
atggaaaacaacataaacattgaaattgcagaacaaggctctcctgaagttccatcactcataaggtatatatcatcaagtgatgttgcgggctttgacactgctgactctcaacctcccagcccatatgcccaaggaagtgaagaaacctcaccaagaagacaacatgatgaacctgtagtcatcaatcatcaaaggaagtattctatcagcatgccactttcttctgaacaagttcagcttcaaccactggacaacaaaacagatggtattcccatttcctcttctcaatcaggaactgctaactccaaccatccacaggcatcaaaatgttactctcaaccaatgccaaaaggctatgtgccccaagaggcagataatggagtcaaaatagataaccatcctggcatcaaagcattcaaggacaagaggtttgattcttttaaaacatggtctggaagacttgagagacaattaacaattctacgtggaaagtcacccagagcaactgcacaagatggtaacaacaactccagtagtactgataggccattacctgtggatcggtattttgatgcattggaaggtccagagttagaaactctcagggcttcagaagagacagtgcttcctcaggacaagcaatggccatttcttcttcggtttcctatttcatcctttggtatatgccttggagttagcagccaagcaattctctggaaagcactggccacatctccttccactcaatttcttcacataagcctcaaagtcaacttaatcttatggttcatatcaattgctcttgttaccacagttttcaccatctatcttctaaaaatcattctctactttgaagcagttcgtcgtgagtactaccatccaatccgtgtcaacttcttctttgcaccatggatagctctcttgttcttggctcttggagttccaccatcagttaccaaagacttgctccatgttctttggtacattctaatgacaccaatattgtgtcttgaacttaagatctatggacagtggatgtctgggggccagaggaggctctctaaggtggccaatccaacaaaccatttatcaattgttggaaactttgtaggggcattacttggggcttcaatgggcctaaaagaagggcccattttcttctttgccattggcctggcccactacactgtcatgtttgtaactctctaccagagacttccaacaaatgagaccctcccaaaagagctccatcctgtgttctttctgtttgttgcagcacctagtgttgcttctatggcatgggccaatattcagggttcttttgattatggatctcgaattgcctatttcattgccctcttcctttatttttcattggctgtccggatcaattttttcagaggattcacattctctcttgcatggtgggcctatacttttccaatgactggtgcagcaattgcaaccgttagatactcaaatcgggtcacaaatccagttaccaagacactgtgtgtcatactgagtctcatctccacactcatagtaatagctttgcttgtatcaactatattgcatggctttgtcttcagaaacctcttccccaatgaccttgccattgccataagttacagaaagagaaggccacaaaagaagtggctaggtcttagatacaggagccatgattccaaagagattgaaaattacttgaagtttgtgaactcggataaaattgatttagaagcttctgccccactaccaaatggcacagaagatactccatctatctga

SEQ ID NO: 65921 - DNA, 243 bp, Glycine max
  Peptide Sequence Number=SeqID_157606
atgtccaatgagcgcaaagcacatgcattcccaaatgattttggaattccaccttctaaaatgtttgatcggattgacaaagactccaacagagatggcaatttgttactctctggaatttttccatctgttgaaggaaagatcaaggacggaaagggaactagaaaaattgaatttcgagggcctccatggaaggataaaatgatcggaaaggctacaattagcgcaaagcacatgttgtga

SEQ ID NO: 65922 - DNA, 777 bp, Glycine max
  Peptide Sequence Number=SeqID_157607
atggcttcctatggtgcttttctccttctccatttcgctgccattgatcttcaagaagcaaaggactccattgatgaagaagatccaaggcctacaagctccacatggagctacatcaaagtccctgtggagaggaactcttttataaatgtgaagcctacaatgacaattggtatgtttggcaaaagtcttaacacaaagctttcccaagacttctttcaggtctgcctcgtgttgggctattctctgagacttgacgaccatgttgtcgccataaacctcaatgtttcatctgatatgctgcttgaaaattcagtccatcaatctcttagggtatgcatctttggggcacgtcatgttcagatcagtataatcgatgcatattcaccatttggcgttggccttttttaccatgacgatgttggcgagctaggtaaaatatttgacttctccgatgaagttggcattgaggagtttgtccacttcttctctgatagctttgcagttgtcgcaacctaccctttggtgcgagggcgacgtggggatcacgggtgcgtcttccaagaaaggaaaatgggcggagtcgccaccaacgtttattcgaggaaaacgtcggaaaaactggaaaggtgtggtctacgaactttaatcgtgaaaggttcgggagttgtttttatgcacggagaagggtgtttccctctctcctacgtatcctcaattgcgatgaggaaatcagacctatgtagttctctcaaaagtggtaaagttacatgttga

SEQ ID NO: 65923 - DNA, 867 bp, Glycine max
  Peptide Sequence Number=SeqID_157608
gattccttggaggagcaagcctcacagggttcctttgtcgcccatggacgtcaagatgtactgactgctggcattgggcgaccaaaacaccctggtcatgtgcgtgttgctggagccagtgtcgcgatcaaacaatactttggactggctccaaggacctcccactcatcttcgtccatggctctcgaagacctggagcaactaacacaaaaaatcagggatcagttggaggagtcgatcaaagaaaaaatgcaatcagagggactcacactgcctcttaagcctgaggttggtcctttagctgctagtgtcagcacaaaggagagttatgttgatccctcagtgaacgatccaaacatgggtgactcagagaaatgcgggttgtacgtcgaagaaaatcctccctgcctggttaccctaggaagactttatgaggggtcgaaaaccgttcacaacatccctttgcgacatgatcaagtcaaggttggtgttgaggaagttagagatgcagatgctcccattcctgtacccactaaagaggttatgtgggatgctaccatgtttggggtgtttaatggcaacttccccttgtacataaagcatgaagatctgtctaaactagcacatggtggtcaatgtctcaacatctctgttatacagttgtggattctgacagacaactacctcaaaggaataattaataggttagttttatttttcaatacatttgcattagcattagtcgggaacatcaatattataattgtaaaatacgcatccatgtttgtattgaacaatgctttgaaaggacttgatgatactccacaaagtaagtccaaggctgctgctaggtggattgttgttaaa

SEQ ID NO: 65924 - DNA, 75 bp, Glycine max
  Peptide Sequence Number=SeqID_157609
atggtcaaatgtcgggccggatccaaaggcagagaccaatcaaggtacttagggacagatgcaagtagagactag

SEQ ID NO: 65925 - DNA, 470 bp, Glycine max
  Peptide Sequence Number=SeqID_157610
ggctactctctggcaagaattgttcactgagttgcgagacaagttacattgtggttcttcgtatttgattcagaacctgaggattgttgacaaccagtctgaatacagagtcagcccagttccacttttggtttatttcctgaaaacttcatttgtcaaggaaatccagcatccagaaattccttctaatatttacctgattactccttttgctgatataatctctggggtggcaccctgccatactttagtggacattgttggcgtggttgctgatctcattgatgttaaaatagttaatccccctcacaggatgacagtcaggctcagggataacagtaactgcgaaattctaatggctatttgggaggactatgctattcagcttcatgatgctattgacaaaaaccttttgcttcaggaaccattggttgttatgttgaccctgggtaaaatcaaggatgctacag

SEQ ID NO: 65926 - DNA, 359 bp, Glycine max
  Peptide Sequence Number=SeqID_157611
atgaagaagcttccagagtttgccctgattccgatttcatacggggacttgttaccattcgtaatcgccaaccagttggcagtgtgcgtggcccttaagcataaagtgcaaagctggattgacgcagggtggctaacattccaagaagatggcccgaatgtgaagacaaatccgttcaccaatcataggggaccgatggtgagcatggtttccttttataggcacaaaggggactcttgtttgatgcatccgggtgcatcacatgacatagaagcatgttcgacgacggaggagctattacagcaactcatggaccaaggccgatttgagatcagtgaaggaacaagggagaatagcac

SEQ ID NO: 65927 - DNA, 178 bp, Glycine max
  Peptide Sequence Number=SeqID_157612
atggcaattctgatcgtcaatacttcaacaacatttcatagggatgaaagacttgggaatacgtatgctatacatggaaaatctgagaagtctgtggatctcctcgggggcggagtaggtgtccgccattgctttggccttggccagcaaccaggaaagttcttgactcccgttcaaa

SEQ ID NO: 65928 - DNA, 534 bp, Glycine max
  Peptide Sequence Number=SeqID_157613
atggaaagaaaagataaggagcttaggggaagcaacaacagtatcatcggcgactatcataaatggttgaaggctcggacgcaagggataacttggctcctgaagttaagtagttcaagtgaggaagaagttgaagtccctgaggagagtgaaaaagtgcaagccttgaaagcaaagcttgaaagaacgagagtggttaaggaaaagctaaaccagggtcaggaaaaatataaagagaaggtaaacctagctgctagtcatgggctgagactagaggacgagcatgcgaaggtatcggctttggaaatggaaggggaagcaagagagagagtgatagaatcattgcatggggaggcgatgaaatggatgaatagattcgctctcactctgaatgggagtcaagagcttccaaggttgttagccagagccaaggcaatggcgaatgtatacccggctcccgatgaagttcattggctttttgattattgtcaacatatgatcaagttgatgtcccacataattaggaaccgctaa

SEQ ID NO: 65929 - DNA, 165 bp, Glycine max
  Peptide Sequence Number=SeqID_157614
ggagaccaattagggtcacgctgctttgtgagaatgctccaaccatgtgggattggcacaggcttaaaggagcactcaaatcgggtgacccccaaggcctacactccgaagagtccgtcatggccactccctcttgattcaggtccaacccagaaaacattttag

SEQ ID NO: 65930 - DNA, 258 bp, Glycine max
  Peptide Sequence Number=SeqID_157615
atgggtgctgatccagaaaggagagataagttaattgagctgcttcctcaggatggagtttatggtccccttgtattagctttttctgtggtttcaaattcatttggtggaagtggaaaggctttttcagagggaaattgcgaaggacagatcaaagtcgctactgatgacttatcttctgctaataagattggggaagccggttttggtcctgtatacaagggtcaattgctagatggtacttttatagcggtctag

SEQ ID NO: 65931 - DNA, 393 bp, Glycine max
  Peptide Sequence Number=SeqID_157616
atggcgcctgatgcggtattttctccttacgcatctgtgcggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcacagtcacagaaaagcatcttacggatggcatga

SEQ ID NO: 65932 - DNA, 345 bp, Glycine max
  Peptide Sequence Number=SeqID_157617
atgggaataaatcaaaccggaaaaagattctatcaagtcaagattaagggcctagatgtcaccaaccttaaggagttggggcggttggtgggacctctccaaatgcaagccttctgcaaggcgtacggaaagattttagatttgaccatagcggagatattcacggaagtcgttgtatcactcacccaatactatgaccagcctttgagatgcttcacatttggggacttccaattagtaccgactgttgaagaatttgaggagattctaggatgtcctcttggaggaagaaaaccgtatctttcctccgggtttcttccctccttgagcaagattgcagttgtg

SEQ ID NO: 65933 - DNA, 1416 bp, Glycine max
  Peptide Sequence Number=SeqID_157618
gtgaaagagctgatcgcctcccacgcgcgtcaggccgactcggatttcgaaacctattacaaaacgccgaataagcagattaacgcgccgaagctcaacctggtgtatatctacggcgaaagccttgagcgcacctacttcgatcaacaggcttttcctggcctggcaccggagctgagtcgcgaaaaagatcacagcattgacttcagcaacaccgagcaactgcccggcaccgattacaccatcgccggcatggtggcgtcgcagtgcggaattccgctgtttgcgccgttcgacggcaacgcctcggcttcgctttccagcttctatccgcaaaatatctgcctcggcgatatcctcaaacactccggctatgagaactggtttattcagggtgcagacctgcgctttgccggcaaagacacctttttgctgtcacacggttttgatgccgccaatatgtacggctcgcaggagctgaagagccgcgtcgctgaccccagctaccgtaacaactggggcttttacgacgatacggtgatggatgaagtgtttgaaaagtatgaggagctgtcgcgtcagcagaaacgctttgcgctgtttacgctcaccgtggacacccatcatccggacggctttatttcgcgcagctgtcagcgcaaaagttacagctatgacggcaaacccaatcagtcgtttagcgcggtggcctgttcccaggagcacgtggcgcgcctgattgcccgcatcaaagcctcgccgtggtttaaaaacaccgtgattgtggtgagttccgatcatctggcgatgaataacacggcgcatcagtatctgatcaagcagccgcgccgcgatctgtttatggtgatccgtggcgatcagccgcaggccgaggtgctggacggcaagcgcagcacgctggataacggcgccacggtgctggatattctcggcggtgataacgcgattggccttggccgcagcgggctgtcttcggcctcgctctccagccagttcgatgacatggcgaagaaggtcacggcgtggaaagccgatatcattcagctgtggaatttccccagccagatgaagacgttcaccatcgaccagcccaaaaatacctttagcttctcgggcgcgacgttcaggctgccgatcctgttccgcgtatccgatcatcaggtagagccgctgccggaaggcgaatacgccgcgccgctacgcttccagctggccgattttgccgccagcgataagtttgtctgggtcgatcgctgcttcaaaatgggccggctgtggcagccggcgctggcgctgtcgaccgatctctgtctggcgatgggccagaccggcggacaacccacggtgacgcgcatcgaccagccggtgtggcagggcaaagcgcagttcccgcag

SEQ ID NO: 65934 - DNA, 801 bp, Glycine max
  Peptide Sequence Number=SeqID_157619
atggccctattcagcagcgtggcgtccgccgcggcactgcgcgtggccgccgatccggtgccgcacagtgagattctcaactacatcaaacaaaccgacaaacagctcgacctgaaggtgatcgagcttaacggcaatttaaacgcaaacgagctgctggcgcgtggcgatgtcgatgccaactatttccagcatgtgccttatctgcgcgatcaggaaaaagcgctgggcgaaaaatttgccgtggtggcgaccgtgcatattgagccactcgggatttattcgcacaaagtgaaatccctgaaagatctgccggatggtgcgcaggtggcggtgcccaacaacgtcactaacctgagccgcgcgctctatctgctgcaggccaacggcctgattacgctgaaaagccgcagcgccagtacgctggtgaccacggcggacattagcgacaacccgcaccatctgaagatcattgaagttgaagcgccgcagctgccgcgcgcgctggatgatgcgcagctggcgattattaacggtaactatgccctgcaggccgggctggtgccgtcaaaagacgcgctggcgctggaacaggcaaaggataatccgtatgccaacgtgctggtcaccacgccaaagctggctaatgacccgcgcatactcgcgttagcgaaagatctcgaatcaaagcaaactgctgaatttatcaaccagcactataaaggatcggttattcccggtggcgcacccgctgttctgtggtatatttcgccaccaacaccagtggcacctgctgcataa

SEQ ID NO: 65935 - DNA, 327 bp, Glycine max
  Peptide Sequence Number=SeqID_157620
atgctgatctgcccttgtggaaggatcgtgcctacaagacacccagtggacttgaaggagtccaacaaggccctggggtttccagctttggttacgggcctttgtcagtcctaccgggtgcccgtccccccagcaaggtcatgtcgtcatgacatagggatcgcacccgcaagacccccagtggacccagagaagtccaacagggtcctggggtttctagctctgattacgggcctttgtcagttctatggagtgcccgtcgcccctaccaaggtcatcaggccccctattaactggactttcatcaagaagtacagcgccccctag

SEQ ID NO: 65936 - DNA, 78 bp, Glycine max
  Peptide Sequence Number=SeqID_157621
acccccaagtccattgacaagcaagaggccaatgtggtcatctgccaccctttcgaagatgtcagcatctcccgatag

SEQ ID NO: 65937 - DNA, 599 bp, Glycine max
  Peptide Sequence Number=SeqID_157622
atgcccactaggaagaataaagctgtatctattttttggatgccacccttccatggcaagagtagcaaaagtgatcaagatctgagcacaagagttagaccgagtgaagcaaaacaggaatggggtgcattgttggtgtttgggattgtactctttccaaatgtagacgggctagtggatttagcagcgatcaatgcttttcttgcttatcaccacagcagggaaagcccgatcattgctgttttggccgatgcatatgacacattcgacctgagatgcaaaaagagcaggaaaagcaaattgggaggaactcttggcaggattcccaaacatccccttgatgggaacaagggcaacgatatcatcggcggctatcttaagtggttgaaggctcagacgcaagggataacttggctcccaaagctaaagagtccaagtggggaagaagctaaagtccctaaggaaagcgaagaagtgcaagccttgaaagcagagcttgaaaggacaagagtggtcaaggaaaaactaaagacgacagtcaccagggtcaggaaagagtgtgacgagctaagggatgttaacatgaccacgatcgaagc

SEQ ID NO: 65938 - DNA, 426 bp, Glycine max
  Peptide Sequence Number=SeqID_157623
atgcataaggcattacgggccaatgcacctcttccatatcctcaattggtcaccctctttctccgtcattttcaaattcctcttgatgatgaaccttttgttcaagtcaagcgttcctttgctataggtgctggtgcagtcacttcatttggttaccataaggatcataatggtcaatggctgaagaaagatgcactccttccacaagacgagcgtactccttctcctcctcctcagcgagatgattcaactcttatgactgaagttcttacagagttacggggtcttcgcacttatgttggtgaacgatttgattctttggatggtcgctttgcaggaatggatatccgtctcacgcaacttgaagaggatgtgggttatattcgtcagagcttcgatcttccaccaccaccaccaccttcttag

SEQ ID NO: 65939 - DNA, 597 bp, Glycine max
  Peptide Sequence Number=SeqID_157624
cctcgcactaagccgagtctacctgggctaagtgcatttcgtcatgacaactattgggctaagcgagcttggctccagctaagccgatatgttttgtttctgaggatggaatcgagaaaaagagctagaacggaggacatcccttcatcatccactccagctcctccgtcaataaccataggacaggatgtccaaggctcacaaactttagtccctatgctgcaaagctcattccgaggacagtttattagcatgcacagcctgcaagagttggctcataacaggccaatcataactatgaagcattttcttaagcaagtagcctggcctgaagctcaacttccattggttgatctagagccagctgacccacaatctccaatggtgaatccattgtcttctcctaagcgtgaagtagttcccccatctccacctctgattatcatctccgatgcatcatcagatgaagtggctgcctctcctgattcaccagcaggagaaatagttgaccttcctacttccctagttggaggaatttccgatctttccgatttgtcatctggagaagatgttgctctcactgattccccagtttag

SEQ ID NO: 65940 - DNA, 590 bp, Glycine max
  Peptide Sequence Number=SeqID_157625
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 65941 - DNA, 396 bp, Glycine max
  Peptide Sequence Number=SeqID_157626
atgccctcgccttcagaggacttcaggttctcgccttcagaggactacacgtcctcaccttcagagggctacatgccctcaccttcagaggactacatgtcctcgcctttagagggctacacgccctcgcctttagaggactacacgtcctcgacttcagagggctacacgcccttccctgcagaggactacacgccctctccatactacgcatccttgccattagaaggctacacgccctcgccttcagaggactacacgtcttcgcctctagaggactacatgtcctcaccttcagagggctacacgccctcccattcagaggactacacgttctacccttcagagggctacaacccttcccttcagaggactacacgccctcgcctgcactag

SEQ ID NO: 65942 - DNA, 440 bp, Glycine max
  Peptide Sequence Number=SeqID_157627
cctgtatctctctatccattgaaggttctagttcttggatactcgactcaggtgcctctgatcatatttctgggaacaaatcctccttttcatccttctcttttccaaaaattcctcaccacgttactgtagccaatggttccaaggttgtgtctcaaggaagtggtcaagaacatgggacggggcgactgattggagaaggacatgaatcacaaggactttactacttggaatccagtccacctggggcttgttttgcaatctcaaagcccaaacttttgcatgatcgtctaggtcacccaagtttaccaaaattgaagatgatggttcctagtctcaagaatcttcgagtcttagattggtattctacatcagtctacatgtcctcacacaccacaacaaaatggcatagcagaaaggaagaatcgtcatcttcttga

SEQ ID NO: 65943 - DNA, 198 bp, Glycine max
  Peptide Sequence Number=SeqID_157628
atggaatcgtgtaatgggtggcgcaagccgaattcgttgcatggaacattgccctctgtcgtaatgcaaatgaaagtagctagaaagcgaacgtgtgtggcattgagaatgatgatgatgaatcttcattcaataatcttacaaatcacgaccgaaatggaagtgaatgagatgagtgaaataggagatggagactag

SEQ ID NO: 65944 - DNA, 429 bp, Glycine max
  Peptide Sequence Number=SeqID_157629
atggtcttaaaagagcacgctctcaggttcgtggattgtggtggtgttggaagtactgtaagctctgtttctggtggggtttgtttgggagaaagtgtggttgagttttcatatggtcttaaaagagcacgctctcaggttcgtggattgtggtggtgttggaagtacttgagctccttcaccactgcatcgatatcattgtttatgcatttgggtttcaaacctgtaaggcatccagatgcaacaaatgttgatgatcatgaagaaaaatgtgatactgtgagcaatttacagaactgcagctatggggcttcaaccaggagttatttctttgctggttttgctgctcaaaggaattctacaaagaggcttggcacaggagttgtttctttgttggttttgctgctcaaaggaattatgcagaagtga

SEQ ID NO: 65945 - DNA, 1497 bp, Glycine max
  Peptide Sequence Number=SeqID_157630
atgtccggaagcagaagcaggttccatggcttccgtggtgcttcgctatcagcaagcttctatcaagtgcctccgtctgcggttcctgcaatgctggattgcattctggtctccaccggtttgtctccgccctcgctcttcgcttcactcctccacgatttccctcgaattcttctcaaggatattaccaatgaaggtgatgatgatttggatgctgataaacgcctccaccttgtgtcaatggtgggcgcgttttgtcacctcctgaagaaaatgggggctgattgtgacgctgtaaggtcgtttgtgtggaggtgttttcttcctttagttaaggtgctacagccattgcagcatgacttgcttaatcagatcacagaattgttcatgggtgtagtgattgaaacttgcgcctgggaagttcttgaagcaacttcggtgccaattttcttaagatcagttggtctttccatgggtatgcttcataacgatgatttggatttttatgaatggagtagtaattcatctcaccaagactcgtatgacgtcatgattgatccactaatggacaaggagctattgctgtctctgtcaaatagtttcaaattgctaacttcatgtaatcttctgtctgtaattctggaagctgcccttcagtatatgcaaacagatacactacctaaatcagcagaaagaaaagggtgcattgtggataaatttgttaacattttgatttgggaattaagtaatatgattgagcggatgcttttacatagtccagagcacaggtcttgcgcagttggccttcttcttcctatcattctcaaagcattacctgccaatggctcattcgaaatctcaattcgtgggcagaaacatgggttttctcgggagtatttctttatcaaactctggaactgctgcagaacactgttttcaattggacctttagagagaagggcagcatatactatactatctctgtatttcgccttttcctggtcctcagaagaatgtgaagatgctgatattgatacaatcattaaaactgaagaatttgacataagagcagaaaaagagttctgggatgaaataaagatagcgctgaaccaaactgaatctggtcaggttgacaaggagagtttggtgaggaagcagagtttacatatattgaagatggttctaaatatacaaggaggcaccaattccatctctagcatttcaaaagggaatacgaatgaaaagtgttcagtacctcatggcgtgacaaagagggaaaaatgggcttacaaggaagccaaatcacttggtgttgggaaccttccgatgatagatgaactggttattaacagccagcagtattggggtgcgtttgtgcttttatatgagatgcttgaagaatatggtacccatttagttgaagcagcctggaatcatcagagattaagggtagatgagggagaactgagagaacaaactccacattatagaatataa

SEQ ID NO: 65946 - DNA, 2388 bp, Glycine max
  Peptide Sequence Number=SeqID_157631
atggtgagagagatggagagagagagagagagtagagagagaaacagtgggtgggagagagttaggactaggaaagagaggagagctagagtcagattccgagagtcagagggttcccatctgaccattgaagggttagccacaggacagcatcaatcctacacgcgagcgaactggagagaccataaggacgttatatctttttactttacgaggttcccggaagacgcaacagcaaaggatttgtggttccactttaaacagcaaggagacgtgagagaggttttcatacccaggaaaagaaacaaccaaggaaggagatatggttttgtgaggtataagggggtgagagatgtgcatcaacttcagcagcatttggacaataggttcttcggaggaatgaagatgaatgttaacatccctaaatatgggagaccaaagaagggagaaccacaaacagtcgagagggggacagcagagacaggacaaacacaaaagggaagaacagaagtgtacctgagcaggttaccagaagcgaatatgggaatccaaggacggtcgtttgcggaggtggtcaacacgaatatcccgaaaccagcacagaggagaacaacagccaaactccaatacataagttccaatgccacatcggaagtgaacctggacattccgatgacgggtaaacaatggctcaaggaggcctgggtgggtagactgaaaaacttggctagctttgatagcatagaagaagccatatggtgggatagcggacaaaacatatcaccaaagtacatcggtgatgacatggttttgctactggggctcacagaagagaacgcagagaaaatgatgaatgaagaagatgaaggatggggagacctgttctactccatagagaagtggaatccaagtctacgccctggttttagactaacttggatccaatgttggggaatacctttggttgcatgggacatgaactgtatcaagcagatagtcgcgggaataggtgagatggtggaggctgaggagagcttagaagatcaaaggaggtacgacgtcgcgaggatactggtcaagacgccatggaaaccgctgattcagcacacggtaaatattcatatacagggggagatttttccggtgcacatagcggaggagattgggttgtttggagctaggtggcagccaagaagggaacgtgatttcagctcatcagaggaaatcctttctgacgattgtaacgatgacgcgtggtctggtagtgagctgcaggggtggcggtacaaagcgcgaacagagagcgtggcggaggaaatacgaacagtagcgaagggagggaccatggaggcagaagccatggaggatatggcgacggagggagtggtggggggcgaggaagataaccgcagagggataagtgaaatcgtgccatggaaaacccaaaggggagcttcagcccagtcggagacggtggatgacacagaggataggggtggtgatgaggagaggtcgccgcgtggtgtggaagaagggcgactcaggcaggtctctcggtcagaaggaccggcgacagtcgcggccggtgcggaccaaaacggaaacgcgatcgggacgaagagcggacatgacccaaaggacaaagctattgtccgatgggtcgtgaagcaagcggataaagcactgacaggtgataaatgcgtgcagaccagggaccgtgagctaccagtgtcgcaggaagaagggaagaccgatttaggtaaagaagataacctcgggggggatgtcggctctgacggtttgggcaatttgtatgaaaatagtatgaggaggcagacaagatacgttggaggcatggtgtacgaggaagacaaacataattttgaatccccctcacccaagtcacgtgacaaggagatgatggggctgctggatttgggccaagctattaacaccccccctaaattatgtccttctcccaaaaatggcccagttttaaaaacaacacctctcccaacccctttgttaacgtactcccgtaaagggaaaatgaagagagttaaagcccaaataggtgaggttgtttcgaaccaggtgctttcaagcccagagcatgttcaaaatggaccattccagcgagacaacgagggacgtggatcagccaacccccaaatacaaacagaaacatcatcaactcacaataggcaggaaaatcagcttcaggaggaaacttttgactcgcacgaagaaagtctatggacaatgatcaaggagttgggactgacaacaggaaaaactcaaagagattatgttcaacagttgacagaaatggaagatagagatggaaaagaggcagatagcttgggaggaaggggaagggactcatga

SEQ ID NO: 65947 - DNA, 283 bp, Glycine max
  Peptide Sequence Number=SeqID_157632
atggacatagactatgctataagaaaagacaaactacctgcaatcgctgatgaaagtagtttagttgatgttgcgttatataagtggtgtgagcggcccaaccaactccgcatgatgttctttaagacaaaaatcttggctgggatacatggttttgttgaccaacatgaaaaggttttagacttgcttaaggccattgatgaccagtttatcacttcagataaagctttagcaaggaccctgatcatgaatttatcctctcttcggctcaccagtgtgaaag

SEQ ID NO: 65948 - DNA, 327 bp, Glycine max
  Peptide Sequence Number=SeqID_157633
atggcagacaaggcagtcaccatccgaaccagaatgtttatgacaaccaggcttctctccggaaagcagttcgtcattgatgtccttcatccagggagcgctaatgattccaaggctgaactgaaggagaagctaaggagaatgtatgacgagaaagacaccaaccctttgagaatgctaagaagtgtgagcctaagtacaggcttatcaggaaaggaagagaaatcaaggaagcaaatgaaggagagaaagaatagagctaagaagattcgtggagttcagaagaccaaggcttctgatgctgccaagactggaaaaaagaaatga

SEQ ID NO: 65949 - DNA, 741 bp, Glycine max
  Peptide Sequence Number=SeqID_157634
atggacactttcttcaagtccccatcgtcttcttcttctagaagcagctggagttacgatactctcaagaatttccgcgagatctctccgctcgttcagaatcacatcaaactggtttattttacgttatgttgcgctgtggtggctgctgctgttggagccttccttcatgttctgtggaacattggcggttttctcaccacggtggcttccattgggagcatgttttggttgctatctacacccccttttgaagagcaaaagaggttgtctctgttgatggcttcggccctgtttcagggtgcttccattggacctctgattggtttggcttttgccattgatcctggccttatcattggcgcatttgtggcaacttctttggcttttgcttgcttttctgcagtagccttagttgcaaggcgaagggagtacctctaccttggtggtttgctttcttcttggctttccattcttatgtggttgcactctgattcctctctctttgggggctctatagctctattcaaatttgagttgtactttgggcttttggtgtttgtgggctacgttatagtagacactcaagtaatcattgagagggctcactttggtgacctggattatgttaagcatgcattgacactgttcactgatttggctgcaatctttgtgcgaattcttaatataatgttgaataattcatctaagagaaatgagaagaagaggaggagagattaa

SEQ ID NO: 65950 - DNA, 1941 bp, Glycine max
  Peptide Sequence Number=SeqID_157635
atgacgggattagcctgtatcgccattgccactgacaagtcatgctttaccgccaaacctaaagccgccaaactgaacggtggtgacggcaacgtgattccacaccgcccgtcccaaactccacgtgtcactctctcaattcagcaaccccctccattctcgctccccccaaaagcttttcccttttcaccgctccaacatcggaagaagaagggaaaaacaaaaaaagaacaagacggattaatgtctcggcactgcgattgttgttgtggcggaatcccaccggggcttctactaatccgaggaaaacaatggaacctccaaacatatcgctacatggttctcctcaccaccttcatcgcttacgcctgctaccacgcgtcgagaaaacccaccggaatagtgaaaagcgtgttatgccccgaacacaaaggaacaaaccagggttggagcccattcaacggccacgatggaacgtcgaagctaggtgaaatcgacgtggcgttcttagcgtgctactcgatgggtatgtacgtggcaggtcacttaggagactccctcgaccttcgcttgttcctgacaaccggaatggtcggtagcgggatattcgtatcactcttcggaatggggtacttctggaacatgcactcttttttgttctacctttcaatgcaaatgattgctggcatgtttcaggctaccgggtggccttcggttgtggcggttatcggtaactggttcgggaagagaaagagagggctcataatgggggtttggaacgcgcatacctcggtgggtaacattagtggatcccttcttgcggcgagtgttttggagtatggttggggttggtcttttgttgtgcctggtgtggtgattgttcttggtggggttcttgtgtatttgtttctggctccttatcccgaggatgttgggttctcttgtgttcatgggggtggtggtggtggtgatgaagaggctcaggtgaatggtgtgaaaaaaggtggcggtggcggtggtgttgctcctcctactagagaaggctctgtgaatagaaaaagcgttgggcttgttgaggcgtgcatgattcctggtgttataccttttgcgctgtgtcttttcttcgccaagcttgttgcctacacgttcttgtattggttgcccttttacttgactcagacagcagaaattggtgggaagtatatctctgttaagtctgctgggaacctttcagccttgttcgatgtagggggcatttttgggggtattcttgctggctacgtatctgataaactcaatgcccgtgctataactgcggccagcttcatgtatgcagcgattccttctatgcttttataccggcattacggaagtgtttctatgaatgccaacattggacttatgatggtgtctggattatttgtaaatggaccttatgcacttatcaccactgctgtctctgctgacttgggtacacatagttctctcaaaggagattctcgtgctctagctacagtcactgctattatagatggtactggatctgttggtgcagctcttggccctcttctcactgggttcatttcatcgaggggatgggatgaagttttcatgatgttagttcttggtgcttttattgcggggcttcttttgtcgcgtttgatcatagcagaaattgcagagagaagtggcaaacctttatcaagtggacagcaaaacccagaagccactgcatctcaaccgcttctggaggaaagactctggaaggttccaaaggggatcacaactcacaactggggatggaacttgatctcttttcatcgtgaattgattttctcaagggacaattgtggagatttactgctcgcactgaatcatcttgacaccagatattccaaagtgacatttgttcccttaatccttgtgtcacactcattttga

SEQ ID NO: 65951 - DNA, 1587 bp, Glycine max
  Peptide Sequence Number=SeqID_157636
atgatgcagatcagctccaccataccagcacccaacctccacatgttccaaacgagacgcaccagtttccgatgccgtgcttctccgttgaacccaacaacctcgtcttctcctcaatccataaaatcggtctcagattccacccgcctgcacctctctaaccttgacaatctcctccagaagcaatcaccaacgacacagcccaaacaacaagaagaattgaccttagccgctacaattcaaaacaacaaaacaacgacaacggagaagaaaggaaagaacgttcttgaaggcctgaacctggcccgtctctggccggacatgaaagcaacggaggaaatgtcgccgcgccacctcaaccgcctccagcgcctcctctccaagaccgacgagtactcgccgcgaaacaccctcggcagcctgtggcgggagtaccacggcagccacgactggaaaggcatgctcgaccccctcgacgagaatctccgccgggaggtcgtccgctacggcgagttcgtgcaggccgcctaccactccttccactccaaccccgccatgtcagcggaggagccgccactcccccgccacatggtcttacccgacagatcttacaggatcacaaagtctctatatgccacgtcatcgatcgggttacccaaatgggttgatgacgtggcaccggatctggggtggatgagccagcgctccagctgggttgggtacgtggcagtctgcgacgacagaagagagattgtgcgtttggggaggagggacattgtgatctctcttcgtggaaccgccacgtgtctggaatgggtcgaaaacatgcgggctcagttgataaacatagatagtagtagtagtagtagaggaaagcccaaagtggagtgtgggtttttgagcctgtacaaaacccgagggagccacgtgcctagtttgaaagaatcggtaattgaagaagtgaagagactcatgaaactctaccaaggggaaacactaagcattacaatcacgggacatagcttaggtgcggcactcgccctactagtggcggatgatgtcagcatgtgcagcactgacgtcccgcccgtggctgttttttcgtttggtgggcccagagtaggtaaccgggccttcggagacaagcttgcggcccaaaatgtgaaagtgctgagaatcgtgaactcgcaggacgtgataactaaggttcctggaatgttggtgagtgaggaggtagagaagaaacttagaaactccaagcttggtgctggtgtacttgacattttcgatgagtactcccacactggaacggagctccgcgtggacacgaagatgtcgccatttttgaaacctgatgctgacatggcatgttgtcatgacttggaggcttacttgcaccttgtggatgggtttttggcttcaaattgtcccttcagggccaacgccaaacgaagcttggctaggttaatgcaggaccagggtgccaatgttaagaagttgtatactagcaaggcaaaggctttgagtctcaatcttcaaagacaggcttccttctctatctctggttgtttgcctagtccttcctaa

SEQ ID NO: 65952 - DNA, 282 bp, Glycine max
  Peptide Sequence Number=SeqID_157637
atggagtatcaaaaccaaagggccaaggagggtagattctgtgagaaactcaagatcaagaataaaccaaagtttgtaggagtgagacaaagggcttcagggaaatgggcagcagacatcaaagacacatcaaagaagattaggctttggcttggaacttatcaaactgttgaggaagctgcgcgagcttatgatgaagatgtatgcctccttcgagatataaaaactggaggtgtaacaagcaaaaaggctagaaaaattgaagaaaagaagaaaatctga

SEQ ID NO: 65953 - DNA, 81 bp, Glycine max
  Peptide Sequence Number=SeqID_157638
atggcgagaaggatgggtgccgccattgaagatggcgataagcttgcttacctggagcgtgacgtgatattcaaatgttag

SEQ ID NO: 65954 - DNA, 1462 bp, Glycine max
  Peptide Sequence Number=SeqID_157639
atgactttccctctgttccaaacaccctttggcgcaaagtttccaacttccaagcttctcccgcgtttccgcttcctcctcttcctcccccttccttccctctacctcctcttctcaaaccctagccccttagatttcttctcagttatcgctttctcagcagcactcttcgtttccctcaatttggcactgtctttcttcactcgattgttccccaccaaattctcatcatcatcatcatcctcttctcctcagcctgttgtatggtctattgggtcgaaccctaagcaagtaaagaacacaaattgggggtgttgggtccaagtttacagcaatggggatgtttatgagggtgaatttcaaaaagggaagtgttgggggagtggggtttatcactatcacatgcatgggaggtatgagggaggatgggttgatggaaagtatgatgggtatggtgttgagacatgggctagagggagcaggtatagagggcaatatagagaaggtttgaggcatggaatggggatatataagttttactgtggggatgtgtatggtggtgagtggtctaatggacagtgtcatgggtttggagtccacacttgcattgatggcagccgctatgttggggagttcaaatggggagtcaaacatggacttggacagtaccatttcagttgtgccttggtgacttgttggtcatgggttcgaatccggaaacagcctctttgcatatgcaagggtaaggctgcgtacaacatccctccctcataccttcgcatagcgaagagcctctgggcaatgagaattactaaagttattgatgatcttcctgaagatgataaatttgcttctgttcctggtagtatcaaaaatggggacatatatgctggtgaatattttgcagacaagatgcatggttttggagtgtatcaatttcagaatggtcatcggtatgagggggcatggcatgaaggaagaagacaaggactgggaatgtacactttcagaaacggggaaacacaatgtggtcattggcagaatgggattcttgatgatcctaaaagacataatagtcctactgggtctccatgtgctgtggaccatgccaaggttttcaatgcagtacaggacgcacattctgctgctgagaaagcttacaatatggcaaaggtggatgacggggtgaataaagtagtggctgcagctaataaagcagcaaacacagccagagatgcagctgtgtttccatttcttgtatctttgtatagctacgaggtgcctgcttggaaccactttctgtcattgaactcaatggcagattgtggagcaaagttaaagatttgggaagctcaatttcgttatcatttgtacgatcagacttacacatcaaacaacgataatggaggtgacatcgcaacaatttctacaggaactcatgccaaaggtgtcaaacaggctg

SEQ ID NO: 65955 - DNA, 231 bp, Glycine max
  Peptide Sequence Number=SeqID_157640
atggaggcgcttgcaggaacaagaaggagaagacacagaatggcagaagatgtatttttttggctcttaatgggccacgacgcgcgtgtctacgtggtgggccgagtccaaccagaggtgtcttcctgttcaaccgcgtccggtgacggcggaggcgacagacaccacgtcgcaccggagtcatacgcgcatgcgtgtccggtgcgagtccgacgcgggacacgccggtga

SEQ ID NO: 65956 - DNA, 594 bp, Glycine max
  Peptide Sequence Number=SeqID_157641
atggcatctaacaagaggaaagcaccctctacacctacccaagccagatttgatagatccaggttcacatcccaagaggcttgggagagatacactgacgttgtggtacctagaaagatcttgcctgaaaggaatgtcattcttcatcacactgagtttgatgaattcactgaagaacttgagtgtagaaactggcacaaggagttgacaaacttcatggacagcagtagagccatctccattgtgaaggagttttatgccaacctctatgaccccgatgataagccacctaaacaggtgaatgtgagaggttgtttggtgaaatttgatgcaaacaccttgaactcattcctgaagaccccagaaatacttgaggaggggaagaactttcccgtatactccaggttttgttgctcaaagccagaaccacaggaatcggcagctcgattatgcatccctggaagggaattcgagttaaatgctgatggactaccactaaagatcttacggaagaatctgactacgctcgctcagacatggagctttctttctttctctaacctggtccctacgtctcacacatctgttagatag

SEQ ID NO: 65957 - DNA, 168 bp, Glycine max
  Peptide Sequence Number=SeqID_157642
gtcacagattgtaccatttgttgtgaagctcatgagacaagccaatgcaatctcactaactataacactcaagaaattcatttcatggggaatcagcagaggcaagggtacactcaaggagggtttttaggcttccaacaaggtccttataatcagcaaggacagtga

SEQ ID NO: 65958 - DNA, 300 bp, Glycine max
  Peptide Sequence Number=SeqID_157643
atgtcactacttgttgatgggttaaccaaggtgactatggataagtggatggatataaccaacatgagatatgtcattgcatcaagatataatgtaatccttgtatccttgtctcaacaacaaagcatgacgttttttcctctaagaagtcaacaaccggtagattcttcgatgcatcgcataatttgtatcggtcatgtctatgacaatcattttgttcaggtttatttaaaagaccattgtcctttacctcatgtagcattgttatgctctagcaattgttatcctcaggcgaagtag

SEQ ID NO: 65959 - DNA, 657 bp, Glycine max
  Peptide Sequence Number=SeqID_157644
atgggtccctttgatgaagatgccattaatcaatttttggggcatccattggtcctcgaagaagggcaacattatgagttcagcctgaggaggagccaggcctcgggatttgataaggaggccataggccaactgttgtacattccaggagaggacttcgcacagagtgtgatggggagacgggtgcggatcatgcgcactagcatgaccaccctgacacagatctgcatgacactgcttctcaacaacatcctccccagcgatcataattttttatcttcccttgccgaagtgctagttgatctatgccatcttgacccaggtgagtgttcatgtggcctagttgatctcatacaccatttatcaatttacagggatcacgcctcccagacacccagtggacccagaaaagtccaacagagcactggggtttccggccttgatcacgggcctctgccagttctatggggtgtcggcataatagtagggccaagcacaacggcaacaggaagaggactagtagcatccaaccacagatgcactaccgccacctctacggtagccaccatctctagagtccatctctgctcacatgtgaaggatggagctccagatgcacatatctatgcagcatgtgaccgaccatcaagcagctaa

SEQ ID NO: 65960 - DNA, 402 bp, Glycine max
  Peptide Sequence Number=SeqID_157645
atgcaacttgtaggaaaagaaaagcagaaagaaacacaaattgttttgcaagacatagaagcaacaacaactctagaagaagaacctctatcttctgaggcatcatctagttttccaactcaagggcaatctcatacaattttagctgaagcaaatatcatggctgaggagccaagaagagttactctggaagactactcaagctcaagtgtgccgcaattctttactagtatagcacgaccggaagttcaagcacaaaatatcacctatccacattcattaatccagttgatacagaacaatttgtttcatggtctgcccaacgaggacccgtacacatatctagtcacttatattgaaatttgcaacactgttagattggctggtgtgcctgaggacgca

SEQ ID NO: 65961 - DNA, 669 bp, Glycine max
  Peptide Sequence Number=SeqID_157646
atggttaggaccagaggattaggtcgtgccttaggtcacgttactggcagaggtgtgggcagaggagatcatgatgattctgatgatgcttcgcagtgtcgacggcctactgcatccgcaagaaggcagcaagtacttgtgactgcggtgcacgatgagccagtggtccctgtgccagatgtagagactgacgtattctcgaatgacccgatggcaccatctgatgtaaaggacattggggcagacattcctgcagacacaggcgcgcaggctactaaggatgagcatgagggatttccaggtggtccaagcgacccatccgtgctgacccagtatgcgggtcacgttgcttgcagcgtatggacgggagaggagcgtcctgagttgaagttatcctctcacaagaggaagatccatagtttaggcaggcctgtccctgccattgagagactagttgctgggacaggactaagtcctctgatcacatgttcagtagacactagcgatcggggacttttgtcctcgtttgtcgagcggtggcaccaggagacgtctagtttccatctccctgtgggagagctgacgatcaccctggatgacgtctcttcacttctacatctgtctgtggttggcgacttgcaatacctttcagcccttacacatggatga

SEQ ID NO: 65962 - DNA, 198 bp, Glycine max
  Peptide Sequence Number=SeqID_157647
atgggtagtaaatggctagaggttgaaaatgtaccatgtcctttcgctaagcgcaagccttgcgctaagcgcatctttggtcatgaactaagccaagagtctctagcgcttagcgctcaacccttgcatctcatgttgatttggtctgctaagctggccaaggctgagctaagcccatttcaattcaatctgaattag

SEQ ID NO: 65963 - DNA, 106 bp, Glycine max
  Peptide Sequence Number=SeqID_157648
atggcccttcgctcagcgaacatgcacaactcatccttcttccagattcttcctcacgttcagccgaggagtgttgcgctcaacggatggctcgctaagctgacag

SEQ ID NO: 65964 - DNA, 225 bp, Glycine max
  Peptide Sequence Number=SeqID_157649
atgggacccacatacagtgatatggggtgcaaactagcccttgaagacaaaaaaagagtcgcatttaggaggaggcagaggcatgaacatgttgatgcagcaaggcatgccaaaccttgcaattgttcaagtttggcctctcagcaacaaaaagctaccatgcagaatctgtcttcaagcactgaggtgtgcccggaaatgggcatgttatggatcaaagaataa

SEQ ID NO: 65965 - DNA, 69 bp, Glycine max
  Peptide Sequence Number=SeqID_157650
atggatcctattcgaaggatacagaagaaagggttctctattgattcaaacgctctacctacgagatag

SEQ ID NO: 65966 - DNA, 588 bp, Glycine max
  Peptide Sequence Number=SeqID_157651
atgccaaaattgcccctaccacctttcttccttaaaaatgccattttttttccggaaaagcttcttacctccattttcagaaaactttgcttctcgttttctctttttcgtggggcattgcctctggttcgtgggggtagcagcgttgagcacagcggagaaggtgaaggtttcggcatcgagctttgcagtggtcggtggcgacaaacgaggtacgcagatggtggtttgttcgtcgcggacatggatgaatatgagtggatgtatgaaataatgtctgaacgaggggatatggattatgaaaatgtagaatcatgtggtgcgaatgaaccacatgttgattgttcggatgcgttcaagacttctcaggtgtttgagtgccgagaggatgttttgcggtgggctcgatccgtggctcacgaaaacggatttgtggcggtgattttaaggtcggacacaaacacaggagtggcgagtataagtgtaggaaaaaagaatttatcagaagagacactgggattaggaaatgtgggtgtcccttcaagcttcgttgcaagccagtggttggaggagaaggctggatggtga

SEQ ID NO: 65967 - DNA, 774 bp, Glycine max
  Peptide Sequence Number=SeqID_157652
atgagttcgctttactggcacaccacaggcacaggcgatcgcgatcttgtgttgctgcacggctggggattgaacgccgaagtgtggcaacacattgttccgcgactcagcccgcattttcgtctgcacctggtggacctgccgggatttggccgcagccagggatttgggccgctgagcctggcgcagatggcgcagcagctattaccgcagttgccagcgcgcgccgtgctgctcggctggtcgctgggcggcttagtggccagccagctggcgctgagccagcccgatcgcgtggcggcattgattagcgtggcgtcgtcgccgtgctttaccgcccgggatgaatggcccggcattcagcctgagacgctggcgacgttccagcagcaattgagcagcgatttccagcgcacggtggagcgttttctcgcgctgcaaaccatggggacggaaaatgcgcgtcaggatgcgcgccagctgaaagaggtagtgctgtcgcagccgatgccgtcagtggcggtactggaagggggattgaacattctgcgccacgatgatttgcgcagcgcactggatgggctgacgctgccgttcctgcgtatctatggcgcgctggatggcctggtgccgcgccgcattgcgccgcagttggatgcacgctggccgcattcgcagtcggttgtcatcgcgaaggccgcgcacgcgccgtttatttcgcacccggaggcgttctgccagcaggtgcagcagttcatccacgcagccacataa

SEQ ID NO: 65968 - DNA, 910 bp, Glycine max
  Peptide Sequence Number=SeqID_157653
aggactgcatgtcctcgccttcaaaggactacatgtcctcacctttaaaggactacacgtactcaccttcaaagggctacacgccctcaccttcagcagactacacgtcctcccctacagaggactacacgtcctcaccttcaaagggctacacgccctcgccttcataggggtaaatgccctcaccttcagaggactacacgtcctcgccttcagagggctacacgccttcactttcagaggactacacgtcctcaccttcaaaggactacatgtcctcgccttcagaggactacatgtcctcacctttaaaggactacacgtactcaccttcaaagggctacacgccctcaccttcagcggactacacgtcctcgctttcagaggactacacgtcctcaccttcaaagggctacacgccctcgccttcatagggctaaatgccctcaccttcggaggactacacgtcctctccttcagagggctacacaccctcacctttagaggactacgtgtcctcaactatagagggctacacaccatcgccttcagaggactacacacgccctcgccttcagagggctacacgccctcgcctttagaagggctgcacgccctcaccttcagaggactacatgtcctcagcttcagaggactacatgtcctcaccttcagagggccacacgccctcactttcagaggactacacgtccccgtagtcctcaccttcagagggctacacgccctcaccttcagaggactacatgtccttgccttcagaggactacacgtcctcaccttcagagggctacacgccctagccttcgtagggctacacgccttcaccttcagaggactacacgtcctcgccttcagagggctgcacgccctctccttcagaggactacat

SEQ ID NO: 65969 - DNA, 207 bp, Glycine max
  Peptide Sequence Number=SeqID_157654
atggcgttgccccggttgacgtgtgcactgaagtccgggcgtggaattgtgatgttggattttaaactcatcgcacatttcccccatcatcttattattcaagttggtgccattgtccgtgataatcttcctcggcaaaccgtatcggcagatgatctccttcttaatgaacctgaccaccacactcctggtgacgctagcgtatga

SEQ ID NO: 65970 - DNA, 579 bp, Glycine max
  Peptide Sequence Number=SeqID_157655
atgacccaagagctggtagcccgcggagacaccttatggttatctgcacctcgtcattcagtgaccccaagtgtgattgatgagcagaggccaatgtggtcatctccgccctttccggagatgtcagcatcttccggtggagactttttcaagtctcacaagttatctagaactacaggcggcgggcccgatgacatgcggagacaaaatttggtcattccgcacccctttgccattcgacacagtcgtgtccgatggcacacagagacaaattatggtcattctgcactcttttgtcatccagaggcggcgggcccgatgacatgtggagacaaaatttggtcattccgcacccctttgccattcagacacagtcatgttcgatggcacgcagagacaaattatggtcattctgcacccttttgtcatctagaggcggcgggcccgatgacatgcggagacaaaatttggtcattccgcacccctttgccattcagacacagtcgtgtccgatggcacgcagagacaaattatggtcattctgcacccttcgtcaatcgcggccgacaagcccgttga

SEQ ID NO: 65971 - DNA, 127 bp, Glycine max
  Peptide Sequence Number=SeqID_157656
atggcggatgcgcttgccactttagcgtccatgttccagctgacaccgcatggagacctaccgtacattgagttcaggtgtcgtggcagacccgcacattgttgtctggtggaagaagagcgggacg

SEQ ID NO: 65972 - DNA, 189 bp, Glycine max
  Peptide Sequence Number=SeqID_157657
atggagaatattgacgagaggattatgaagatggagatgaattgtgaagctggatttatgtgcgcacaagtctcacgtacagtgcatcaaacgggtggttcatgcacaggaaccaatacccaggctgcaaacaaaaaacaaattatgctggctatgaaaattttgaaaatgaagatatcttatttgtaa

SEQ ID NO: 65973 - DNA, 651 bp, Glycine max
  Peptide Sequence Number=SeqID_157658
atgccctcgcctttagagggctacacgtcctcaccttcagaggactacacgcttcacgtccttgtcatccgagggctgcatcccctcgcctttagagggctacacatcctcaccttcagagggctacacgccctcactttcggaggactacacgtcttcaccttgagagggctacacacccttgccttcagagggctacacgccctcacctttagaggactgcttgccctcaccttcagaggacttcacgtcctcgccttcagaggactgcacgccctcagctttagaggactacacgtcctcgccttcagagagctacacgccctcaccttcagaggactacacatcctcaccttcagaggactacacatcctcaccttcagaggactacatatcctcacctttagaggactgcatgttctcaccttcagaggacttcacgtcgtcactttcagaggaatgcatgtcctcgcctttagagggctagacgtcctcacctcaccttcagagggttgcacgccctcgccttcagaaggttgcacacccttacctttgaggactacacgtgctcggcatcagagggctgcacgccctaaccttcagaggactacacgtcctcgccaacagagggctgcacgccctcacctttag

SEQ ID NO: 65974 - DNA, 478 bp, Glycine max
  Peptide Sequence Number=SeqID_157659
atggtcattgaccaatccctattctatgatttaacccaattatctagtgaaggtgtaccatttgaaggtacactgattgatgattggaagtttgaattctttgtgcatgatgcccgccggttggtttgcaccaaccaagcggatatgaccggaaggcttcttgccggttcattggcttttgagagacgcatccttcattatctcataggtcgtatcttacttccaaaatcttcaaaccttgcacaggtttctgaagaagatcttattgttatgtgggcttttcataaaggcctaaaaattgattgggcacacctaattcgatatcgcatgcataagtcattgcgattaaatgctccattgccatatccacacctagtcaccttcttccttcaacactttaacatccctcttgattctgaaccctatgttccaatcaagagatcctttctaataggcactgctgtcattgcatcctttg

SEQ ID NO: 65975 - DNA, 651 bp, Glycine max
  Peptide Sequence Number=SeqID_157660
atgggagaaatagaggagatgcaagaacggatgaaggctgacatggaggccatgaaagagaaaatggccacaatgatggaggccatgatgagcatgaagaagataatggaggtcaatgcggctgcagttgccgctaccagcgccattgctgaggtggacctgactcctctatctggcctcaatcaaataaatcatccaacctcggatagggtaggtcaaggaagcaaagagttgggaagtatgggcggcccccattgtgtgcaaattcaaaaaaagtatgccttcccgccatatggcttgcctctcaactatacaccacccaatgttgcacgcgctcccgatgggaatgttgacaaatccgctcccatactcattgagagccaacaacctcaatctgatcatgcacctgtctctcaacccatgggggaaacacatgaagtaccccaccacaatctagccgacctcgagcctcgcctcggatactccattgaggggcaagcagttggtgatgtacccctgccaaacactttggagggcccctcagtttcacccacaaccacaacccttgtatcttactgcagagagagtccctcctgctatggtggaaagggagaaattggatcatatagaggaaaggctaagggccattga

SEQ ID NO: 65976 - DNA, 291 bp, Glycine max
  Peptide Sequence Number=SeqID_157661
atggggaagaagatgctgcagatgggcatagaagatcaaaagatcagctttgatttgttccatgaggacagagatcaccctagtcaaaatgtctgtcttaaagtgcatgtgatggaggaaaggagacatgagaagaaggtccttgaagtaggaactctggcaggaagtgctaagtgccaatctcttacgggttttgaattcttggaaaaagtgctaagcgcagcctgctacgctaagcccgagatgctcactggacctgatgcaatcctaccccccaagggcattggatag

SEQ ID NO: 65977 - DNA, 332 bp, Glycine max
  Peptide Sequence Number=SeqID_157662
ggatcgcgcccgcaagacacccagtggacccggagaagttcaatagggtcttggggtttccagctctgattacggacctttgtcaattctacggagtgcccgtcgcccccaacaaggtcatcaggccccctactaatcgagctttcatcaagaagtactgtgtccccaggcaggcgcagggcaagacaccacagcagcctggggatggccgacagcgggcaacagacgcactgccgccacctccagagcccctcagctcatctacaaaggttggagtgttgcctacgacctgtggtcaaccagcaggcgaccaagtccaaagccaaaggtaa

SEQ ID NO: 65978 - DNA, 462 bp, Glycine max
  Peptide Sequence Number=SeqID_157663
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgaccccgcgaacttgtttattcatctaccgtcgggaggggaggggatgaccacggcgccccgtgcgcccggcctcctcgtcctcgcgacaaacacaaaccccggcgcttcgtgcgccaaggaactcaaatctgttaagtgcgactcccgggggcccggagacggtaatcccgtgaaccatcgagtctttgaacgcaagttgcgcccgaagccattaggccgagggcacgcctgcctgggtgtcacacatcgtttccccaacgcaaacatgtaa

SEQ ID NO: 65979 - DNA, 315 bp, Glycine max
  Peptide Sequence Number=SeqID_157664
atgcagggcataggggagtttgaggttcaagaaattgcaaataagcgacttgatcgacgagcaatggcatgcactgtcaaattgaatgaatggtcgggtgattgtggacaatttcaagcacttcgactaccttgcttgcatgcaattgcagcgcgtgttttttgcaatttaaattatgataactttgttgaccctgtatacaagttgaaaaacattttcaaagtttatcaacatcattttcattcccttggaagtgaagacacatggccacaatatttaggttcgtattttatgtctgatccttcgaaacggtga

SEQ ID NO: 65980 - DNA, 183 bp, Glycine max
  Peptide Sequence Number=SeqID_157665
atgccaaaagatagggggacttgtcttgattttagggattgtcatcatgaaaaagggggagattgtagacaaaggatcaagctgaatgttttgatgatgccaaaggatcacatgcttctcaaagctttattcaagacaaagaaattaaagatattcaagatggatgatcaagacagtctctag

SEQ ID NO: 65981 - DNA, 180 bp, Glycine max
  Peptide Sequence Number=SeqID_157666
atgattaaagcacgccaaaagggggggaaaaagggaggtggttgccgcccagctcgcccaggagagctcagatcgcccaagcgagctgggttgcttccaccagaaggcaccgccttctgttggaacatcctggaagtcccaagtgggcctgattgctatttgcacacccatgtttactaa

SEQ ID NO: 65982 - DNA, 1262 bp, Glycine max
  Peptide Sequence Number=SeqID_157667
atgattagaactagaggtcttggtctcactttaggccgcacaataggaaaagaccctcctacggccgaggaggaattggtcgacgtccaggcagaagcacctattcatgaaggtgctactgatgttgaaggttttccaggcggatcccatgacacatttgttctgagtgattttgaaaatcacattgctttgagagaacgtcctgagttgaagttatcttcccatggaaggaaggtgactaagattgggaggcctgccccagagattgaaggccttgaaaccagcagtttccattttcctgtcggagaggtgagtatcaccttggatgacgttgcggcattgttacatttacctattgtcggagctttccacagcttcgagcaacttaatgtcgacgtcgttgtggacttgttggtggagttactcgagattgaggcatgtgagtggattgtagcagcgcaagcgtatttgttgcatctccttggttgcacactttttgctaacaagagtgccacacatggtgttgttgcacttgtgcacatgtacgatcatttaaatgacgtgtccaagagcacggcgaagcaacttgcaggatatatcactctgttacagtgttggatctacgagcattttctgtccgttgctgccagtgttcctgccgaggattacgaccagaggagaccacgtgcatgttgttggacctctggcaaggcacttcaaattttgaggtattggaggcgcctagatagactgacccttgacgcagtgtgttggattgcgtacggtgaccatagagcatttagagaatttgaggtcacttcattattttccggccatatcagatggggtccatacatggtcattcatcggtcggagaagtacgttgcacatgtaggtcaattatgtacagtgcctagccactatttggcagattacctggattggttttacaggatctcccacccattcatgactcctgcacagtcaggggatccttcgagagtattgctagttcaggaagaagaacaatttgttgaaccacatatgtatgatcaactgatggcggcaacagcacctaatgaggcagacattgatcagcatgatcttcgacatgcagtggatgactttgcagtaattgctgataggttggacatgctactgaacctgagaattttgaccgaaggaataggagcctacgttgttgttgacgaatgtgttggcatcgcaagacgctacactggcgatccacctgtagcctacag

SEQ ID NO: 65983 - DNA, 109 bp, Glycine max
  Peptide Sequence Number=SeqID_157668
atggagaagagagcgcgaaagggtacacggagaagaagagagtgtgagagggtaaacggagaagaagagagcgcgagcgaaataggtcgcgtcaaatataatttaaaat

SEQ ID NO: 65984 - DNA, 372 bp, Glycine max
  Peptide Sequence Number=SeqID_157669
atggcttctccacctgcctcctctcctccttctcctcctcttcctcctcctccttctgctccttcggacgtatcggcttcgccgtctgccgtgaagcggacacacaaagcctcacgtctacgatcgttatctactagaccacctggtgttgagagaccagtggtccatgtaaatcctgttatcggtaaggccgacggtccccacaggaagaaattaagaacatatttggggattgtggcacgtgataaggtggacgtcacctacgagaactggaaggaggtccctactgctcagaaggacctgatttggaaggatattcaggcagaatttgaaatcccagaggcttctgatagtaggacgaaaaggaagtaa

SEQ ID NO: 65985 - DNA, 612 bp, Glycine max
  Peptide Sequence Number=SeqID_157670
atggaggaggcataccaacgacacttgactgtgacagcaacggtggtgcttaacctgggcttcgcttactttgatttaactcaatctacaaacctgatgagccaagatacattattggagcctcctctctctctctcatttcttcctctactcaaactgggtgtcggaacctcatcgttgggtgctaccacgagtgcgggagttttcagtgcgagaacaggtggagagctcaccggaataggaccaagtggagaactcatcggaactggcgctggcggcaaactcactagagtcacgataggaggtgtggctgtcggtggtctagccgcaggaggagtggttgcgggaggtgtagccaccggagctggagcggcagctttagacggaggagatgctaccgtgggagatgaagcgggtggggttgcagttgcaacactgggaaacgctaacaaaaaaacctacctaacaagaaaaataaatagagggcgaggaggacgacggggtaaaggtcgacgaggaggaggacaaaggaaaggacttccaggcagcggtgggagtcagaggaaagaaagatggttagggttttcaaaaacattgttaggtaaaccctaa

SEQ ID NO: 65986 - DNA, 682 bp, Glycine max
  Peptide Sequence Number=SeqID_157671
tgtcctgtcctattctaaccttgccctcacctctcacacgtccgatctgaatatggactgggcgaggttagtttatggactggttatgaagatggacatgggcgtgggcttgctaatctctggacagatatcacagatggcccagtccaactcctctaggctcggcctaccagcactgatcacaaccatatgcttcgcccgaggagttgtcccagactctcttaccttcgagtctctcagccctgccattaatttgggcccgtcttcttctgctccccttgctcttgcttctacaccaacaccatcagtagctctagctctagttccaacacctgccggcacctccactcagagctcagatctcataagcattcataatttggctcagcaccggtcaatcattagtatggaggagtttatagcccaggtggcctggctaggagtccagccttctcctttgggaggaggtggggcttctatagcccaggagcctcagccacaaccggaggttactcttgaggtcagaccagagaccactccacgaacttcaccggtcactacaccacttgtggaggtctctgatgaagaggatgtcactatagacacagatcatgcaactaacatggcaacagcgcagagcacctgggatccctggcccgctacagctcaagagacatcttag

SEQ ID NO: 65987 - DNA, 213 bp, Glycine max
  Peptide Sequence Number=SeqID_157672
atggtgagaattggtggaggagaatatcgtgtagataaaggagcagctccaaagatgttgaactgtcttatagagagagggttgattagaatgcagtttgatgtagctgagttatgcttttggcagcaatcggattccagaggctgctttaatggcttgatcctatctcccaagcaaggtctcagtgacaatttggagaaaagatctcactaa

SEQ ID NO: 65988 - DNA, 324 bp, Glycine max
  Peptide Sequence Number=SeqID_157673
atgactccgtcccaaattcaaaattcaccaaacaactatcaagtgacaaatgacatcagcaaatgggcaggcttttctgctttcctcatttcccataaaggaaactattgtttgcagtgttttcatggccttggtggtgttcagcacatgatgttagcgttgggttacaacaccaccgacgcaaacatcaccacgctggagattttagtttgggattccccgatggagaatttcctcgatgacgttttcttcgaccttttcgatgttctaataggagatccttcgaaaggtctcataactcgtgactcaaaagtggaattataa

SEQ ID NO: 65989 - DNA, 758 bp, Glycine max
  Peptide Sequence Number=SeqID_157674
atgcaatcacagggacttgcactgcctccagagcctgaggatggtccctcagctgctcgtgtcagcacaaaggggagttgtgttgatccctcagtgaacgatccagatacgagtgacttagacaaatacgggttgtacatcgaagataatcctccccacctagtcgccctaggaagagtttatgaggtcaatgttgaggaggttaaagatgcagatgctcccgttcctatacctattgacgaggttaacttagtgggacatacacttaacaccttccttgcttgggcaacacatctcctgaagcgtttatcagaacaaggggctgtgggacccacaaaacctgcaaataggtcggatcatgaggtggatgatcccctatatttgatgacattgaccatcccacaactttttttgaagtcgttgctagttatgtgggatgctaccatgtttggggtgtttaatcaagacttccccttgtacataaagcatgaagatttgtttgaaatagcacatggtggtcaatgtctcaacatctctgttatacagttgtggattatgcatctgattgaaacaagtatgcgagcggggaatttcgatgtgtatggattcctcgagccacagtccacccagagatctggccaatcgcaatttgaatcagaaagttatatgaagaattggatgcagaattcaaaacacgatgtctacctaggagcctacctgaatgggccagacaactaccttaaaggaataattagcag

SEQ ID NO: 65990 - DNA, 480 bp, Glycine max
  Peptide Sequence Number=SeqID_157675
atggaagaacccttcttccggaattcttccggaaagtttttggaagaggtgttccgggagacttccggaagaagtgttcttccggtagacgtttggtttcttccggaagaacacttcttccggaatgtttccggaacagcttcttccagaagtttcggaagaacccctaacgggtcttccggaagcctccgccgtgagcccccttttcccattttttccggtgtcttctaccctaaggttactatcctaaggttccactgctacaacaatgctggatattacaagcaaatgggagttagggagactaacctcgttcgcggagaagaagaagacgagcttcacgcttggcttgcggagaagaagaagcagttcgcggagaagaagcagttcgtggagagggagaagaagcttcacgaaaggaatagcaggagcaggaagagtttcttccgaagaggggggctttttataattttttgttaa

SEQ ID NO: 65991 - DNA, 870 bp, Glycine max
  Peptide Sequence Number=SeqID_157676
atggagaacaatgagcctccaaggcgtcttgagggaaaacatgctgcaatggcagtttgctggcttcttggcactgggtgccttttcgcgtggaacagtatgctgactatagaagattactatgtttacttgtttccgaaataccacccgtctagggtgcttactcttgtatatcagccatttgcagttggaacactagcaatactggcttacaaagaggacagaatcaatacaaggataagaaacttatttggatatactcttttcttcataagcactttgtcgatcttaattttggatttagcaacatctggtaaaggaggccttggaacttttattggtatatgcgtaattagtggtgcatttggaatagcagatgctcatacgcaaggtggaatggtgggagacctgtcctacatgcttccagaattcattcagtctttccttgctggcttggcagcatcaggtgcactaacatctgctttgaggttgattacaaaagcagcctttgaaaattctaagaatggtcttcgcaaaggagccattatgttctttgccatatcaacattctttgagcttctttgtgttcttctctatgcgtttgtattccctaaattaccaattgtgaagtactaccgttcaaaagcagcatctgaaggatccaaaacagtatcagctgaccttgctgcagtatggcacacagggctggatgataatgttgacatcttttttggggttatccaatggctacttcactgtttgtgttctcacttcagcacccaaaggttacaagggaccggaacaaaatgccttgggaaatttgttggtgttgtttcttcttggaggtatctttgcaggggtaacacttga

SEQ ID NO: 65992 - DNA, 759 bp, Glycine max
  Peptide Sequence Number=SeqID_157677
atggctcaacctccaatgttgaggacttatcaaatgaatacgagagttgttgggtcaaaaaccatgatagtgatactgactcctctttcgggctcgaaggaattagcaattttcagtttacccacttctactgcagtagatggaatggtcttaactctagggaacatagcacaactagcaaaagtaaaattcatgaaaagacatggtgaatggcaagacctagaaatacctcccagcattcagtcaattgtatgtctcaacttgcccagcttttctggtggattcaatccatggggtacaccaaataggaggaagcagagtgacagagatttgacaccactatttgtagatgatggccttctagaagttgttggttttagaaatgcatggcatggacttgttttgcttgctccaaaaggacatggaactcgtcttgctcaggcacacagaatccggtttgagtttcgcaaaggtgcagcagatcatacattcatgaggattgatggggaaccttggaagcaacctcttccaattgatgatgatactgttgttgttgagatttctcaccttggccaggtcaacatgctatccactcataattgcaagtctaaaagtgtgtatgatccttcatcaccacaccatgaggatgaggaagatgacactgatgaagaagactctgtagcagaggaatttcggaagttcggtgcagccgatacatttagaatcccagatgaggttgatgcttctcagcatagttag

SEQ ID NO: 65993 - DNA, 225 bp, Glycine max
  Peptide Sequence Number=SeqID_157678
atgttaccacaaaggtcatcacctctaataattgcggttcaagagccagctatagttcaagagcaggttaatgaaccaatcttagaaccaattcaacaacctatgaacccaatgcatgagccttctagaaaatctacccgagtgcaccatgcacctgatagattaaacttgatggtcctagatgacacatcaaatgaggtttatcatgatgatgatgatccatga

SEQ ID NO: 65994 - DNA, 1929 bp, Glycine max
  Peptide Sequence Number=SeqID_157679
atggcacaggccaccatagatttaaaccgcgatggaaaggatatgagcggtcgcattcatcaactcgcctgcacgacggtcctacctccgtttcccactatttcaaatccaaacaaaaaggtgttggggaagaggagggtttattgttacaagagacacactttagaggcaagtttggattcagatatccacttaagattaatcagtagtggaggtctagtggcatattgcgatgccaaaccagaatatgttaatcatgaaagtaaaaaaaagaaggtggtggtgcttggaactggttgggctggaaccagttttttgaaaaatatgaaaagcaactcctatgatattcatgttgtttcaccacgtaactattttgcattcactccattgttaccaagtgtcacgtgtggcacagtggaagcaaggagcgtcgttgaaccgattcgcagcatcaccaggaagtatatacacttacttacaaggagaaactctgttgaacagagcggtgtaaatattcatttcagtgaagctgaatgctataagatcgataacaagaacaacaaagtttattgccgtgctagtaaagacaaaaagttgggtggccaagaagacttttccattgattatgattacctggtaatagctatgggaggccgttctaataccttcaacacacctggtgttcaagagcatgcccatttcttgaaggaagtggatgaagctctaaaaattcgtcattcagtggttgacctttttgaaagagctagccttccttctttaccagtggaagagaagaaaaaacttctgagttttgtagtagttggtggtggtccaactggggtagagtttgctgctgagcttcatgactttgtacttgaggatatggcgaagctatatccttcccttaaagactatgtgaagattactctcctggaggcaggcgatcatatcttaaacatgtttgacaagagaattacagagtttgctgaacaaaagtttgctagagatggcattgatgtgaggttgggatctatggttgtcaaagttggtgaaaacgaaattactgccaaagaaagggcaagtggtcaagttgtttctatacctcatggaatggtagtttggtcaactggtattggtgctcgccctgaagtagttgaatttatgaagcagcttggccaggttaacaggcgtgcattggtcactgatgaatggctaagggtggaaggatctgacaacatctatgctctaggtgattgtgctactataaatcaacgtagagttatggaagatatagccgtgatatttagcaaggctgacaagaacaattctggaaaattagatcttaaagaatttaaagacgttgttggcgacattattgagagataccctcaagtagacatttatttaaagaagaaccaaatgagagacatggccagcttgctaaagaaatctcaagagagcaatattatagtggacattgaatactttaaagaagccctttccaaagtagactctcagatgaaaaatcttcctgcaacagctcaggtagctgcacaacaaggagtctatcttgcagactgtttcaaccgcatggaggagtgtgagaagtatccagaaggccctctcaggttcaggggagttggacgccatcggttccgtcccttcaggcatttgggacaatttgctcctctaggaggagagcaaactgcagctcagcttccaggagattggatttcaattggtcagagcacccaatggctctggtattcggtgtatacaagcaaacaagtgagctggaggacaaggtttttggtggttggtgactggggaaggcgattcatatttggcagggactcaaacacatgttgcatactccctacaggctatggccaaccttgggatctcagtgagctggtggaggggtcttaa

SEQ ID NO: 65995 - DNA, 1231 bp, Glycine max
  Peptide Sequence Number=SeqID_157680
atgagggcttgccagctcatgattttgttagatgtaatccaccaaatgtcagggtgggtggctcttgcatttgggacgttggtgaccaccttccatggtgcgttgcaggataaggacttgtttcctaacactaagcgtgaagtttctatcttgaaaccaccccttcctaggtgggttaagttgaattgtgatggaactctaataaattatttttggaaagttggccacaaaggcttagttagaggtgattcaggaagatttatcttaggtttctctattaaactaggaataggaggtggaggaggctcagaagaagacgaagccatggggttccgcggtttagaaatttttgtcctcagacgatctctttgtaaacttactctggaagggttcttgtactggcggaacgaaaaaacggttaccaatcaaaagatttcgctgctggcgggatacacatgccctagttgcactgattctgccagtgggcctgacgtttttgctctggcgtgttccagaggagagggcagagggagcatggatttagcgcagtgtagcagggggttccgcggtttagaaatttttgtcctcagacgatctctttgtaaacttactctggaggggttcttgtactggcggaacagaaaagaggttaccaaccaaaagatttcgctgcaggagggatacacatgccctggttgcactgattctgccagtgggcctggcatttttgctctggcgtgttccggaggagaggtccccaaccaaccaccagttcttgagatttccaataaccttgtaaaatcctttacaagcaaagatccacaagggatgtaccctcccttgttctctttgaacaacctagtggatgtaccctccactagaactgattcacaagagatataccctctcttgttctcagtcaataacccaaatagatgtaccctctacttgtaccacaaaggatgtaccctccaatgtgttaagacaaagttctcaggcgggtttcgcggtttagaaatttttgtcctcagacgatctctttgtaaacttactctagaagggttcttgtacaggcggaatggaaaagcggttaccaaccaaaagatttcgctattggcaggatacacatgcccaggttgcactgattctgccagtaggcctagcgtttttactctggcgtgttctagaggaaagggcagagggggaatggattcagcacattgtagcaggg

SEQ ID NO: 65996 - DNA, 267 bp, Glycine max
  Peptide Sequence Number=SeqID_157681
atggatcaccatggccctcccaaagttgcctgctggaaagatccaatgagcccatctaaatggaaggaggagcactttgtgattgtctctttaactggttggggactactcatctatgggggatacaagttggccacaggaggcaagggcaagaaagaagagctaagggtattcaaatatccaacattggctgtttgcctattgataagcaatattgtaaggcaagaaactaatcagatcagttcagagggtgcaaaggatcagtga

SEQ ID NO: 65997 - DNA, 1318 bp, Glycine max
  Peptide Sequence Number=SeqID_157682
ggttcttgcagatttgggtttaaactcatctgcaggaactgagaacagtgaaggggctctgaagtttgatcttggtttagctgtgccacaagagtatgaggaaaaatccattcttggattacttagttctgatggcgggggagagcagtcaccatttgaaatcatttccttcaagagatcagaggattcaagtggatattttgtggaatcagatatagagaagtccttaaatgttagtgtggtgaaaagggaggcaccaaggtttgcatatcttatttcaggcaccaagggtgatagtcataggatgatgaggacattagaggcagtgtaccacccgaggaatcaatatatcttgcacttagatcttgaggcgccaccccgggaaaggttggaattggcaaatgcagtgaaagctgatccaatatttcgtggggtggagaatgtgcgtgttatgtctcaatccaatttggtaacttataagggtcctacgatgattgcttgtaccctccaagctattgcaatattgttgaaggaaagttcagagtgggactggtttattaacctcagtgcctcagattatccccttatgacacaggatgatttgcttcatgttttctcaaatctgtcaagaaatctcaatttcattgaacatacacgcattgctggttggaaactgaaccaaagagcaagacccatcattattgaccctgctctttacttatcaaagaaatctgatttagcattgactactcaaagaagaacacttccaacatcttttaaactgtttactggttcagcttgggttgtactgactcggtcctttgtggagtactgcatatggggatgggataattttccacggactatgctaatgtattatacaaattttatctcctcgccagagggatattttcacactgtcatttgtaacactgaggaattccatcacacggcgataaaccacgatcttcactacattgcttgggacactcctccaaagcagcatcccatctctttaactgtgaaggactttgacaaaatggttaaaagcaaggcactctttgcgcgcaaatttgcaaaggaggatccagtgttagacaagattgacaaagaacttctggggcgcacacatagattttcacctggtgcatggtgtgttgggaacacagatggtggggctgacccttgttctgttcgtggcaatgatacaatgtttaggccaggacctggtgctgagaggctacgtgagctgcttcaggttcatattaacaatcaacaagcactcacatcagcagttttggtgcttgtttcggtctag

SEQ ID NO: 65998 - DNA, 351 bp, Glycine max
  Peptide Sequence Number=SeqID_157683
atggttaaaatttaccttaaactgtctatagaaaattctcaagaagagatgttgggttacaagtgtgaggtctccttatgtggtggctcgtggtccacaggtgtatccctcgaatctccccaacaattggtatcagagccgaaggttcaagatggtgaccggctcagacgagtatgcaagtaccgtaggtggccagaatggctagcggcacagcgtgccccgcaggggaagcgggcagggcaagtaccgcaggtctccttatgtggtggctcgtggtccacaggtgtacccctcgaatctccccaacaccagacacctaatgctttagagcacttgttgaatggatattag

SEQ ID NO: 65999 - DNA, 249 bp, Glycine max
  Peptide Sequence Number=SeqID_157684
aaagaatgggatattatttctaccaagtgtttgtggcaagaggagcaaccatttttggaaagagagtttcttgtagaaggaaaccatggtaaagaaattgaacctgatgagactcaagtcaccagtgataacataactcaagaacatgagatggaaactgagaggcctttctttgatgttttgaaattaggacaaagctctttaactcaaacgattatggctcaagaaccagctactattcaagaataa

SEQ ID NO: 66000 - DNA, 219 bp, Glycine max
  Peptide Sequence Number=SeqID_157685
atgccagacctcaataaaactttcaaggaagctaccaaggctataggggtggctcaagtccttctaacaacttgcatggaggttcttcaaataaagaggtttaggtgggacaattggcaaaacaaatgtctgagcatgaaagtggatccttctcagcaaccacaaaagtcaacccaagagaacaatgtaaggcagctacaactaggaggggggcagtag

SEQ ID NO: 66001 - DNA, 492 bp, Glycine max
  Peptide Sequence Number=SeqID_157686
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccgggaactatcgtcttgagtccaacccggaaagacatgcaaaagcaccactggcagcagccactg

SEQ ID NO: 66002 - DNA, 450 bp, Glycine max
  Peptide Sequence Number=SeqID_157687
atggagcaagttagcataggacaccgaaatttggggatggcctttgtggataactgggtggtggataaggagaatggttgttattggttgagtaatgacattgttggattggtgggaaacttggccatatccgcttcgaccctttccccggcgaagaccaaatccgcaaagcttgaaggaaggcaaccattaggtccttacatgaatggactcaggaagatggttcttggggcaagtagtccccttgtacttgtcaaagtccagcaccttaaacatgggaatgaccatgttcgggtactaggaaaaactcttctaggaggggctctcccatcgcaaatgcaagggttttggttgtgggcgaaactaagggccctccaaagtgttggcatgggtaccaccaactgcttgccctccagtggcatatccgaggcaaggctcgaagtcggctag

SEQ ID NO: 66003 - DNA, 369 bp, Glycine max
  Peptide Sequence Number=SeqID_157688
atgaaggcccaagtggagaaagatgaaggcccagaggcagaggcactatcaagaccattaatgttgctgaaggcccaaactaatttgaaggcccaaacttatcaaggtaatccttgtggcgtctacccagacttatcttccttcattggaagtggcgtctacccagacttatcttccttcattggaagtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaaccttcgtagcctgtatcaaatga

SEQ ID NO: 66004 - DNA, 480 bp, Glycine max
  Peptide Sequence Number=SeqID_157689
atggttgcgtctgtgcggcgctctgaaggcgttctgtgcggtctgcgccgtggcctgcgtggcacactgtccgattgcggcactgttggttggctgcccggtagacgggtgcgtgaggccgctaatagcacggcacggctttgggcattcggcatgctgatcggcaataccgacatgcacgccggtaacctgtcattcatcagtcgccatggccgtccttatcacctcgccccggcttatgacattctgccgatgggcttcgcgcccagagcgggcggtgccatcgtgaatacgctgcggcctgcgtcactgccagaagtggttagcagcgatacatggcgggaagcgctggctttggcggaggaatttttgtctctggcgaacagttgcgatggcttctccgatcgttttgcgccctgcctcgccgcgttacaacagcatctggatgaggcccgagcgcgcatcgcccgactgggctaa

SEQ ID NO: 66005 - DNA, 495 bp, Glycine max
  Peptide Sequence Number=SeqID_157690
atggatatgatggtcgtcatattatcagcacaccaatatgacgaccatcatacagagggcttttccatgtcacaccaactggctttaatcaccggcgcttccagcggtatcggcgcaacttacgcaaaacagctggctgcacgcggcaacgacctgattctggtggcgcgcgatgctgcacgtctgagtgcactggcgcagtcgctgcgtgaggcgcacggcgtggaagtcagcgtgctggccgcggacctgacgcgccatgaggatctggtgcgtattgatagcgagctgcggaacaatacgcgtattaccacgctgatcaacaatgcgggcatgacggtggaaggcgagtttatcgacgctagcatcgaccagacgcaaaccatgctggcactgaacgtggtggcgctgacgcagctctctcacacggccgcgcaggttttccgcagccgcaatgcgggcaccatcgtgaacgtggcgtcggtactggcgctg

SEQ ID NO: 66006 - DNA, 132 bp, Glycine max
  Peptide Sequence Number=SeqID_157691
atgtcagggaaaaggcacaatgtgagggtggtaaagagggacacagtcgatgggagcttttggtttcgtcagacaatacctttctggaggttttattcgctcgggagagggtatttcctaataaggatttaa

SEQ ID NO: 66007 - DNA, 486 bp, Glycine max
  Peptide Sequence Number=SeqID_157692
atggcgcctaccaggcaccctctggacccggataagtccaacagggccctgggttttcccgccttgatcacaggactctgccagtcgttcggagtccctgtcgcacctagcaaggtgattcggccgcccatcacccgagcttttattgagaagtattgcacacagagacaagcccagggggatgctgcgcaggccacggatgcgccgcaacctcatcaggctggtccagccgaagtgtttgatatgaagcagtatttgcggcatttggttcgccaacaggcggccaaccaccgggcacatggctttacttcttttccatgccctactccggaccagttcagggcagaggtcgcattgcctggagattggcctgaggcccaggcaggagaggcaccagcagaggctcccgacgaggcagatgaggcccgcgaggacgaggagatgaccgatttactggatttcttaggaggaagcagggccacgtga

SEQ ID NO: 66008 - DNA, 150 bp, Glycine max
  Peptide Sequence Number=SeqID_157693
atggaggtgaccttagctattagagaggtatgtgtagctagcttctccaggaatcttctcaaggagctaagctctagcttctcaaggaagcttcttaaagaagcttctcaaggaagtttctcaagaaagattgtcaaggaagcttcttaa

SEQ ID NO: 66009 - DNA, 465 bp, Glycine max
  Peptide Sequence Number=SeqID_157694
atggaacttcgacgccttaatcgaaatgaagaaaatgacaaaaagaagagaagtatagcccttaaagcctcgtcatcaatacaagaagaaaacgaagaagaagattcaaatgatgaagaagatttttctttctttgttaagaaatttcaaaaattcatcaagaaaagaagaattgacagacgtcagaatttcaataatggaagaaaatcacaagatgattctcaagtccttaggtgttacaaatgcaaccaaattggtcacatcaagttcaattgtccttcaaatgaagaatggtcggagaaaagtgaaaagaaaagatttgatgaaagaagaactaagaaagcctacattgcatgggatgacaatgattcatccaatggtttagaaaaggagattaatcttctaaccaaagattatgaaagtgatgagaacatctctcatcaaaaacaaggagaaaaagcatga

SEQ ID NO: 66010 - DNA, 216 bp, Glycine max
  Peptide Sequence Number=SeqID_157695
atggtgaatccaccgtcttcttctgagcgtgaagtagttcccccatctccacctctgattgtcatctccgatgcatcatcagatgaagcgactgcccctcctgattcaccagctagagaaacagctgaccctcctgcttccccagttggaggaattgccgatctttctgattcgtcatctggagaagctgttgctctcactgattccccagtttag

SEQ ID NO: 66011 - DNA, 270 bp, Glycine max
  Peptide Sequence Number=SeqID_157696
atgccgatgcgaggacgcaacaacaccatcgtcaacacccatagaagacgaacgaagcacgcgattggaaggttaggaagaagaccaacgaaggtcacaaagaagacgcagaataagacgcacaaaaagacgcagccaagctttttcaagaggaagaagaaggattcgaagaaggatgtgaaggtcaccaatgaaggtcacgaagaagtagcaatggcgaggaagaagaggaatggcgaggaaggaggaaggaagcaacaaaaatcgtga

SEQ ID NO: 66012 - DNA, 507 bp, Glycine max
  Peptide Sequence Number=SeqID_157697
gaaggaggggctggagttttgtgctcatgtgaagggttcccaaatgtccccttgatgggaacaaggggttgcatcaattataatcctatgctggccataagacaactaggctaccctgtgagaagggcgccatcagaagagattatcgtgcttctcatcgcacgggataaggagcttagaggaagcaacaacggtgttatcagggactaccatacatggttgaaggctcggacggaagaagctgaagtccctgaagagagcgaagaagtgcaatccttgaaagcaaaacttgaaagagcgagaggggtcaaggaaaagttcaagatgacagccaccagggtcaggaaagagtgtgacgagttgagggatgtcaacatggccatggccgaagggactcaagctttgaagggccgaaagggacgagtcaaggatggaaagtatgatattagaggacaagttgaaggcttgtcaaaggtcgaagaggagtttaaccgaacaactgagtag

SEQ ID NO: 66013 - DNA, 306 bp, Glycine max
  Peptide Sequence Number=SeqID_157698
atggcagattcatcaaagaaacgtaagggttcatccgcctccgcttcggcttcaagagctcatcgttccggagcctccagcgcattcacagcaccaattccaccctccttatcctcttccacattgttttcttccgaagaacagcagaaatggtattcaaatcttttctcatctcgttccattatcgaccctaagttcattgatatggaattcttttttgccgaaacctttgattgcattcaagcatttcagaatttaggtctcatacctttcatgtcattacaattgcctatctatcctgaattg

SEQ ID NO: 66014 - DNA, 347 bp, Glycine max
  Peptide Sequence Number=SeqID_157699
ggcatccgttggtcctagaagaggggcaacgctatgaattcagtcaaagaaggagccaggccttgggatttgatgaggaggccataggccaactactatgtgttccagggcaggacttcgctcgaagtgtgacaaggagatgggtgcaaatcatgtgtactagcatgaccaccctgacagagatctggatggcattgctactcagcaacatcctccccaatgatcataattccgacctttctctgccaaagtgccagctggtctatgccatcttgacccaggtgagtgttcatgtggcccagttgatctcagatgccatttataaatttgtagggatcacgccttga

SEQ ID NO: 66015 - DNA, 423 bp, Glycine max
  Peptide Sequence Number=SeqID_157700
atgcgtctaccggggaaggagagtctgctgatgaaatctcccataaccataaatgagattttggatgttagcattttgtttctaaatgaccatttagaggaaacactgggttcgacaaaaatagaagaaatccactcaaagtgtatcaatcttgcacagctttctcttcaattggaaattttccttcttttcctttttgcttccgagggtaaggattacggcgagtcaggattttggctcaaggtttgtagaatggctagacatgatacatgtcggggtttggtttggctcaaggataaaagggatgccccacattatttccatgacacaaatgcaaaaatgatgatttggaaactttatgcaaaactggtcatgcatgcatctacgcggacactcaaatgtcaaccttttatggtcatgtga

SEQ ID NO: 66016 - DNA, 438 bp, Glycine max
  Peptide Sequence Number=SeqID_157701
atgacccaaaagttaagattggaaagtgctgtgacaaagggcatagatggattgtgttcaaaaaccatagctgattgtgttgaagccctcataggcgcttattatgttgggggtgggcttactgctgcacttcatgtaatgcagtggctgggaatgaatgttgggcatgattcaccattggtacatgaagccatcaccaggacattattaaggtccaatgtcccaaaagcttattatatcaattccttggaactaaagtttgggtatgaattttccactaagggtttgttattggaggccatgacacatccatctcagcaagagctggaaccgggaatttgttattgttaccaggaatcttcaacctcatcttcagtattgttccagaattcttcaaagtcgagtaacaaagttcatgagttcaatggcggaaagtaa

SEQ ID NO: 66017 - DNA, 917 bp, Glycine max
  Peptide Sequence Number=SeqID_157702
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgaccatcggtcgcccactcgacataatctgtcgctttatcttcatttgctgtcgcgcccctgtaatttcacggttttgatcggtagaatcgtcgcctttccgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 66018 - DNA, 352 bp, Glycine max
  Peptide Sequence Number=SeqID_157703
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgcttccaagctggactgtatgcacgaaccccccgttcagtccgaccgctgcgccttatccggaaactatcgtcttgagtccaacccggaaagacatgcaaaagcaccactggcagcagccactggtaattgatttagagaagttagtcttgaagtcatgcgccg

SEQ ID NO: 66019 - DNA, 129 bp, Glycine max
  Peptide Sequence Number=SeqID_157704
atggataagagttggaaggtaggagaagatgagtggagggaaagggagagaaggagcacggaattttgtgcctcaaatgagtccactaatccaagatcaagaccaagattctctactaagtgtgcttag

SEQ ID NO: 66020 - DNA, 306 bp, Glycine max
  Peptide Sequence Number=SeqID_157705
atgggtcaacttcaacggcaagccttccgcaaagcctatggtaagatttgggacctagctacgatagaagtctccgtggatgtgaatgcatcccttacccagtattatgaccatcccctgaggtgcttcacatttgaggatttccagctagtgctgactgtggaagagtttgaagaaatcctgggatgcctactaggaggaaggaagccatatcttttctcggggttctatccctccatggctagagttgccaagagttgtcctctttccaaatgtggaagggttagtggaccttgcagaaattaa

SEQ ID NO: 66021 - DNA, 552 bp, Glycine max
  Peptide Sequence Number=SeqID_157706
atgagaagaggtagtggaaaagttcctgaagaactcctcgatgccttagctggtgggaagatcaagttgaagactccagaagaagccatggaacggataaaaaatatggtagccaatgatcatgccatcctccgtgatcgagcctacacacccaaaaagaaaagtcttcttgagctcacttctcaagatgttgtgttggctcaaaacaagctccttaccaagaccttggagactcttatagccactctaagtaatcttccccaacaactacatgcagtgcaacctccttcaaccatgcacagtggaggatgcaacatttgttggggtgctcatgagtcaggctcatgcatgcttagaatcaccacggattccaaggctacaaccaaggaggaccgccgggattcaaccaagggagaaatttcacattgggctcaagctggaggaatcatccggagaaccagttcaacaaggagtaaaaaagtcaacctatctagaattccaaccaaaaggtcgatctttatgagaagaccaacaagcttaaggagacattga

SEQ ID NO: 66022 - DNA, 267 bp, Glycine max
  Peptide Sequence Number=SeqID_157707
atgcctcagcccaatactgcggaagctcctcaacactgcccactgcaacctctgcacttcttagtggggagactgcctccgatcaaggagaaaagggagaagttggatctcatcaaggagagattaagggtcgttgaagggtttggtgatttctcatttgttgacatggcagagttgtgtttggtgcctgacgttgtcatccctcgaatttcaaggtgccagatttcgataagtgcaaggggactacttgccccaagaaccacctga

SEQ ID NO: 66023 - DNA, 379 bp, Glycine max
  Peptide Sequence Number=SeqID_157708
catcttcttcaagcttattatccaaggcaattcttggcggtgaagctccttcttccttggcttattccctagtggatgcctccataaaagctccacaatcaagcttccatcaaggcctcagccagtcctacggagttcctgtcactcccagcaagggtgacgcacatcaggacgcgggtgcaccaccgccacctcggcaggccaatttggctgggccactgggcgcggccaaccaccgtggacaggtcacatggcctggagactggcccgatgcccaggcaggggaggagcctacaggatcccccgatgaggcggatgaatcccagatggatgaggatatgattgacttgctcggtttcttaggagggagcggaccaag

SEQ ID NO: 66024 - DNA, 495 bp, Glycine max
  Peptide Sequence Number=SeqID_157709
atgtcgatctccccctgtggaagtatcagttggtctgtgccgtcacgacatagggtttgcgccccctacgaggggttccttggactcggagaagtccaacagggccctagggttcctggctctgatcaccaggccctcattaaccgggctttcaacgagaagttttgtgcccctaggcaggcgcagggtgaggcaccacagcagcctggggacgaccagcagggggcaacagacgcatcaccaccaccttcagggtccacctcagctcatctacaaaagctggagtgttgcctacgacacgtggccgaccagtactgggcccatgatcgacaaatcgtcatcacgcgtccggctcaagacgttaaagaagcgctactaggaggcaacctagaattggctgcgaagaagctccctgcgacaaggtccaggaagggcaccattgaagagggttccaatgcgaccccgcaatccgacacaggcttcgacaaacactga

SEQ ID NO: 66025 - DNA, 923 bp, Glycine max
  Peptide Sequence Number=SeqID_157710
ctggagtaatggctgaagtaaatgaggtgcaagagcggatgaaggccgacatggaggccatgaaagaacaaatggtcacaatgctggaggccatgatgagcatgaagaagataatggaggtcaatgcggctgcacggttgcacaccctcgacttcagaggacttcacgcccttaccttcagaggactgcacatcctcaccttcagagggctacacgccttcgcctttagaggactacacgtcctcgccttcagaggactacacgtccttaccttcagagggctacacatcctcgccttgagaggactacagtcctcgtcttcagaggatatcaaaggactgcacgtcctcgtctacagagggctacacgccctcgccttcagaaggctccacgccctcgacttcaaaggactacacgtcctcgccttcagagtgctgcacgcccttgccttcagagggatacatgtcctgaccttcagaggtttgcaggccctcgcctttggagggctacaaacccttgctcttagaggactgcgccttcagaggactacacgtcctcgccttcagagggctacaggtcctgaccttcagaggactacaagtcctcgccgtcagagggctccatgtcctcgccttcagaggactacacgtcctcgccttcagaggactgcatgtccttatcttgggaggacaacatgtcctcaccttcagaggactacacgtcctaaccttcagaggactacacgaatgcacgtccttgccttcagaggactacacatcctcgccttcataggactacacgtcctcgccttcagagggcgacacacccacacctttagaggaccacacatcctcaccttcagaggactacacgctcaccaacatgaccattcatacacagatatggatgacattgctacttag

SEQ ID NO: 66026 - DNA, 340 bp, Glycine max
  Peptide Sequence Number=SeqID_157711
atgatcgttcgaagctttgggttcgatggcccctatgacgtctatcccccacatggaaaaaggccaaggggcgggcatgacattcaggggatgtggcggagcattgacattgtccgcgaacgcttgacatttatggcatttccttacatgggtacaacaatcactttccatattgagccagtaataacctgctctcaggatcttcctggccatagcatgcccattggcatgcgttcaacacgaaccctcatggacttcctcgatcatgtggcttaccgtcccattcctcttccacctgacaacaatgcgggtctgccacgacaccagaactcaacgtatg

SEQ ID NO: 66027 - DNA, 650 bp, Glycine max
  Peptide Sequence Number=SeqID_157712
atgttggtgagcatgattcgcactcgtctctttgtagcggcccgagtgaaatcttgccccggtatgcagagtagctacgcgatagcctccccctctagttgtgctcgcacagttggccctcctccaatatcagggggtggcccaggaactgataaaagaaaactactagcccctcacccgggagcgcaagcccctctgaaggcgaggacgtgcagccctcttaaggcgaggacgtgtagtactctgaaggcaaggacatgtactcctctaaaggcaatgacatgtagtcctcagaaggtgaggacgcgaagtcctcggaaggcaagggcgtgtagtcctcggaaggcgatggcgtgtagtcctttgaaggtgaggatgtgtggtcctctaaaggtgagggcgtgtcgccctctgaaggcgaggacgtgtagtccactgaaggcgaggacgtgtagtccactgaaggcgaggacgtgtagtcctctgaagtcctctgaaggcgaggacatggagccctctgaaggcgaggacttaaagtcctctgaaggcgagggtgtgttgccctccgacggcgagggcctgcagacctctgaaggtgaggacatgtatcctgttggatcaagtggcctcagaataattaagaaggggag

SEQ ID NO: 66028 - DNA, 402 bp, Glycine max
  Peptide Sequence Number=SeqID_157713
atgttttcagaatggccactccgtaaccaaaaaaagcttttggattggacattccataaccaaaaaacctttcagaacgagcattccataagaaaaaaagtttcagcaatgagattctggaaatggggttctagaaagtattattgggcttatgaaaagccctctctagaagaaacaagttttctagaagtaacaaaggcattctggaacagttttccttccagaaaatgtgttctagaatggtcattctggaagcaaaaaaactattttggaaagcctattccggaaacatgtccacaacatgagtgggaaacattgaaacgtacctggcgtggagagttggagaaggagagggacttctgtgctggaacctctagcatggacagttggaagaagacttga

SEQ ID NO: 66029 - DNA, 570 bp, Glycine max
  Peptide Sequence Number=SeqID_157714
atgtctcacacaaattccattatgatttctagcagaatcaaggaatcaaggttagagcaattggatgaaattcaagtgaaagctatcaatacttctaatgggaagaatttacggcctcggccggaagacgctgacatctcctggaagggtgcagatgaccacgttggtgcggataaccataaggtgtgtttgcgtgctaccggacccttaggtcacgatagcagaattgagacttttttgcggtctcggccggaagacgctgacctcttcaggaagggtgcagatgaccacattggtgcggataaccataaggtgtgtctgcgtgctactgaacccttgggtcataatagcagaattgagacttttttgcggtctcggccggaagatgctgaactctccaggaagggtgtggataaccataaggtgtgtctgcgtgctaccggatccttgggtcacgatagcagaaatgagacttttttgcggtctcagccggaagacgctgacatctccgggaagggtgcaaatgaccacattggtctctgttggatcaagtggcctcgaaataattaa

SEQ ID NO: 66030 - DNA, 507 bp, Glycine max
  Peptide Sequence Number=SeqID_157715
atggcctttgttaggaggacaagaggggagacttgcaaaacaaatgactccgacgctcaaggtcgcaagtttgtcgagcccccaagcatggacaattattgttcagtgttgagagtggcaaccttgacaagtggtggacatgcttttggctttacaggcgaaactagacgtgtcagacatgtgcagtgcacgaacaatattcttgcatacatgtcccttgtggagtgggcacatactgaagacgtggtcatctccatcggtgtttcctcctcgaaggagactcatgatggggcttctgataatgaatcctcttccttagagaggttgagggttcgcaccgtgctggtggaggcacttctcacctccatgggagggcgtaacctttcgctacttctttgtgctgagttgccatcgtccccacctgttactgctagctttgaatgggtgtttgttcgaggtcttgggtctgattctccctttgaccgcattctagtgtgctctgcttga

SEQ ID NO: 66031 - DNA, 480 bp, Glycine max
  Peptide Sequence Number=SeqID_157716
atggaagggagcattgaccctgcaacctcaagccttctgtgtctggaaaacaatgacatgtgctttgatgattttgatttcaaaattcattttgatggcctttttctcttgaacctaagtttgcatttgaagctaaagacattcaaagaatggaactactggccctctgaaattgctgcagcagtggcaatttctgtatcaagggaaatgcaagcagaagagattgacaagaccttaacatgttttttcattgtagggaaggaaagaattttgaagtgtcttgaattgatcaaagatttgtccttgatccaagattctgctaacttaggcaccaacttagcatcatttgtaccccaaagccctattggggtgctggatgctgcatgcttgagctctataagtgatgaattaacagttggatcatatacagattcatcccttaatactccaaattctaagaggaggaggaaatctgactaa

SEQ ID NO: 66032 - DNA, 396 bp, Glycine max
  Peptide Sequence Number=SeqID_157717
atgaggcataatcttttctcaagcttcaatgtggggaagaaggaggtgaaaataaatctattgcaatatgtcgatgataccattttcatatgtgatgtttccttgaggaatgtgatcactatgaaaatcatcatgagaagctttgaattggcatcaagacttaagtcaatttcaataaaagttgctttggaggtgccaatcctagaagggtggaaacttggaaaaccaattgcagacaaagtgaagaaaaaagtggtggctctggtttggttggatggttggttagagggagagtgtttggctatgaaatatcatagactattcctcatctcttcacaacaacaagatgaagtggggaaaatgggagtttggtgtgatcatctaaggtcttggtag

SEQ ID NO: 66033 - DNA, 132 bp, Glycine max
  Peptide Sequence Number=SeqID_157718
gtgttgagggagcggtttccggcagaattcaggcgggaggagaaagagaagagcgatttcaggcaggaggagaaagagaagagcgagtgcaaggttttcgagcgcgcgggttgtgaagtgtcaatgttttaa

SEQ ID NO: 66034 - DNA, 273 bp, Glycine max
  Peptide Sequence Number=SeqID_157719
atggaacaaaaaaattatgaaccagcgacggtggcgtgtacaataacggtgtgggctcaacaacaacaacatgatgatgtgggtgagaggatacgtgctaacgtcacttcaatgaggtcctttaatggtgattttccaccatggagatgcagcggaagacaaaggagaagaggtgagaggaggcgccatctactagggaataagccatggaagaaggagcttcaccaccaagatgagccttggataagaagcttggagaggatgcttcaatga

SEQ ID NO: 66035 - DNA, 252 bp, Glycine max
  Peptide Sequence Number=SeqID_157720
atggtagtctttaaagtcttcattgtactggtgtcgcaacctacccttttgcgggcgagtgaggcgaggctcacgggtgcgtcttccaaaggaggaaaatgcgcggagtcgccaccaatgtttatttgtggaaaacgtcagaaaaaccgaaggaaaccggtcatgaagaatattctagattcaggagttgaatttacgtttgaggaaggtattagcacctctcacgtttgtctcaaaggactacagccttaa

SEQ ID NO: 66036 - DNA, 261 bp, Glycine max
  Peptide Sequence Number=SeqID_157721
atggagcggtatctacagcacttggttcgccaacaggcggccaaccaccaggggcaggtgcagatacatgagtgtctctaccagctcagcctcagtcagcagggccagggtttcgctccttttgcgtgccctactccagatcagtttagggctgaggtcgcatggctcggagattggcctgaggcccagatggaggaggcatctgtaggagttcccgacgatgcagaggaggcccgcatggatgaggagatgacagactag

SEQ ID NO: 66037 - DNA, 654 bp, Glycine max
  Peptide Sequence Number=SeqID_157722
atggaggtcaacgcgactacagtcattgtcgcaagtaccgccactgaggtggacccgactcacccatctgatctcaaccaaataaatcatccagccttgaatatggtaggtcagggaggcaaagagttgggaagtgtgtgcggccctcattttgtgcaatttcagaacaagcattccttcccaccatatggcttgcctcctaattatacaccacccaatgttgcacacgctcccgataagaatgtcaataactccactcccatactcattaagagacaacaaccccaatctgatcatgcacattatcacccacaaccacaatccttgcattttgcagtgggaagagtccctcctgctatggtggaaaaggagaaattggatcatataaaggaaaggctaagggccattgaagaaggcggagattatgcctttgctgacatggaagagttgtgcctagtacccgacgtggtcattcctctgaagttcaaggaaagtcttactggggcaaccgtcacttggtatactaatctggaaccctctcgagtccattctaggaaggacctaatgggatctggcagctcaagtagcgcccccaataatggaaagggagatgataacaatgatagtagacacattactggtgttctactatga

SEQ ID NO: 66038 - DNA, 114 bp, Glycine max
  Peptide Sequence Number=SeqID_157723
atggcccttggaaccatgggagctcgcccaggcgagctgatgcttcatcctgaaaaaccggtgtcgaacaacatctttcggttagcgagaatcaaaaacatcaatggatggtag

SEQ ID NO: 66039 - DNA, 183 bp, Glycine max
  Peptide Sequence Number=SeqID_157724
atggtttggattggaaacaagctattattctcatctggtcaggtctgcgaggcgcagttgccttggcactttccttatcagttaaggcaagtgtcaagggcacaattttctgtgtggtgtaggcgggcaggtgcaagagaacctgctgaagaacaggggggaaatgacaacatggaaggataa

SEQ ID NO: 66040 - DNA, 708 bp, Glycine max
  Peptide Sequence Number=SeqID_157725
atgacattttggccaaatttgatatcctataagcctcaaatgccaagaagaagtgaacaaaaacaagatccttctataaaatatggtatagatcaacaaacttgggatgaatttgctgcaagtcgcaagacccttgcttggcaggaaataagaaaaaaggcacagcaaattcaaaaaaacaatggctgcctccacgtactatctcgtgggggttatgatttgcttgagaaaaaactaatatacaagaaaagaaggaaaaggcaagaggagaaaatgctaactgagaatacaccattgcttgaggaccctccatctcccattgaaagacatgtcaagtggaaaatggctcgcacaaagcaatatgggcagatgacatctcaggcggcacaagaaaaatctgatagaattacgacacaaggtagttttgttcctcatggtcgtgacgacatactcaacactgtcattgggcgaccagagcatacaggtcgtgttcgtgtagcggggtcaggtatgacaatcagtcaatactatggaagggcatcacgtggctccagcagttcctctacatcaatcacccaacaacaattggctgacataattggatgccttaaggaaaagtggaggaatgagattattagaaaccttaaggaagaagtcaggcatgagattgaagaagaaaacaggtggagtctagagaaactaaaatag

SEQ ID NO: 66041 - DNA, 369 bp, Glycine max
  Peptide Sequence Number=SeqID_157726
atgggatttcgggaactttcaggtggaagagaggatcaaggtatggcttctacaagtggagatgctactccaccatctccaaaaaccgcaaggctcatggtggagataattaaacttggtgatcaaatgagaataatgagttatgacaatgaagaaaggatggagagaatgagaaaggagaataataagagtttgggaagaatacacaggagtaataaagctttaagtgtgaggattgaaaatatagagcgaagaagagaggaaagatcatctaattcttctcatggaaaagatgagggaggatggaggaatgagaggtatagggagagaagaaatcataaaagatatggaggtaggcaaagagagtaa

SEQ ID NO: 66042 - DNA, 1980 bp, Glycine max
  Peptide Sequence Number=SeqID_157727
atgccttactttcagttgtcaagtccattagcccatggatcagcaaatgttcagcctcgggatattggaaggaatggcaccaacaacaatacaagttctcgttctatggatgttcttccttcacctttggccactgataaaaatgatggcacggttgctctagttaaaactggctctgaaatagttaagactacccctgccggtgaatatctgactgctgccctgaatgatttcgatccagatcaatatgaagggcatgctgctatatctgatggtgcaaacaagcttttgatgctgggaaattacactaatcccaaggttagagcacattacactcgtgagactcctgttgtatgggacacaacaccagtctttgttgattgtaaggttctggctgctgtcatcaaagctggtgcctctagagaacatgagatactcgctgaaattagggattctgttttctcttttattagaaagatggaaccaaaacaagtaatggacaccatgcttgtttcccgtgttagaattctgtatataagatctttgcttgctagatccccagagttgcaatcaattaaggtaataacagtagaggctgttggatttctctttgaaaagaaaataagttctaataaggttttcgctgtgtacttttgggatgctttattgagtctagtggttttgccagttgagtgctttctcgaaaagactaatactgggcgcagtagaagttccagccgagggagtagtcctggtaggtctcctgtgttatatgttgatgagcagatccagggatttaaagtgaatctaaagccagaaaagaaatccaaattttcatctgttgtgctgaagatacgtggtattgatgagcaagtaactggtggaaagcttagggaaattactgaggaggccaaaagttttgcaattgggaacagggctcttgctgcactatttgtacatacaccagcgggtgagctgcagcgtcaaattagatcctggcttgcagagagttttgagtttctatctttaacgggagaagatgcatcaggggggtcaactggtcagttggaacttctttcaactgcaattatggatggttggatggcgggacttggtgctgctcttcctccccacactgatgcccttggccagctattatttgaatattcaaaacgtgtctatacttctcaattacaacacttgaaggatattgctggtaccttggcaacagaggaggctgaagatgcagcccaagtagcgaagctacgttcagctctagagtcggttgatcataaaagaagaaaggctatgttgtcaatcacgggtgtcgcggcggagcggcccccatccgcgatggggatggacgtagcggcgcggttcaacgttgcggttggcacggccgctatcgcggcggagcggcacgggatctggatcggatttttgcgccgctacactgaagccgtggaaattccaaaaatgccctcacttaatgcgggaaagctgcgacaccccggcgaggctgcgaccccggcgacgctgcaacaccggcaagcgccgccacctcctccatgcccaggagcacgctgcgagtctgcgacactgacatgtccacgcaacactgacacagatcatggcactccgccactggcagccatgacagcgatgggctctcactggagtcgcagttctctacgggatgtgagggagattatggttgtcaaaacgcacaccaccactgcatgctatgcctggtttgaacgtcaacaggaggggttgttctcttggggtggtggagcaatgacgctactaccattgggagttgggggtggagtttctgtggtctctgctgcatatgtaaggaataatagaatgagagcgaagagaaggaaggttagggtgaagaaagaaggtgcagtagcagccatgagcatcagcatggacagagagtggttagttgaggatggtgaagctgagcattaa

SEQ ID NO: 66043 - DNA, 417 bp, Glycine max
  Peptide Sequence Number=SeqID_157728
atggcttcgtctggtccagttctctccttctccggaactccaaccatcacaacagctaaactcaactggaaaaattatctatcttggtccgcttcagtggagctgtggtttctcggccaaggtcaccatgaccacttggagaaagctgctgaggaggttccaatcgataaaagatctgaatgggagaagctggattatcagctttgtgcagttttatggcaatcagttgagccagacgttttggagatccttagatcattcaaaacatgttgttctttctggaagaaggctcgagaaatctttgccaatgatattcagagtctgtttgatgcaaccatgaaggttacagctctcaagcaaaccaaccacgatatgattgcacacataggtaaagctcgggctgtagtggaagagtga

SEQ ID NO: 66044 - DNA, 322 bp, Glycine max
  Peptide Sequence Number=SeqID_157729
gttaggtgtcaaggaatcaaggttagagaaattggatgaaattcaagtgaaagctatcaatacttctactgggaagaatttgtggtcttggccggaagacgctgacatctccgggaagggtgcagatgaccacattggtctctgcgtgtcaacaggtgcggataaccataaggtgtgtctgcgtgctactggacccttgggtcacaatagcagaattgagacttttttgtggtctcgggcagaagacgctgaactctccgggaagggtgcaaatgaccaaattggcctctacgtgtcaacaggctcacttgcctctggttga

SEQ ID NO: 66045 - DNA, 480 bp, Glycine max
  Peptide Sequence Number=SeqID_157730
atgggtcatggagagggggacgaaccactcgatgttggtgatctctatgttgacgtaatcacggtggcgaaggagaaatcgaagatgaaggttgagttagtagaggtctttgttgcattggccttgctccgcaacagcgaaggagacaaagataagggattgagtcagagcccaaagaggacaacggagaaatcaaagatgaggaggtgtcaagttctgtattttgttctcaagacattgaacgaatcgggtcatcaatatgtttacaatgcagcagaaaagcctttgctttatgctcaaaccgctgctgtgttagagctttttctaacttttttcactttctggtgcggcgttgtattgaattgtgtggtagattcttcatggcttggtaggattggtgaggtctccagtaacagcaacattgccacagataagttcaaggcttttcctggtttggggcatcttatggagttttcctga

SEQ ID NO: 66046 - DNA, 174 bp, Glycine max
  Peptide Sequence Number=SeqID_157731
atgaggtgtgaatacccacaaaacctgtctcagaaaaatgatgatctcggactcattcaccgttggatcatcgtgaaatttgagtaccacgttcgcaaccaaatttcgagcattttcaccgttgggaattgtaaaaacatgtcagagctaagagaaatacccttcgcaccgtag

SEQ ID NO: 66047 - DNA, 219 bp, Glycine max
  Peptide Sequence Number=SeqID_157732
atggaagagggcgaaagggtgaacttaaccattcatggaaagaacaaagtggatcaacccaaaaacaagggcaagatacttgctcagccagtcataaagaaagagtccaagtgtttcttttgcaagaagaaagggaacatgaagaaagactacttaaagtttaagagctggatggacaagaaagggtatggaaaacctaaggaggccagtgggaagtga

SEQ ID NO: 66048 - DNA, 174 bp, Glycine max
  Peptide Sequence Number=SeqID_157733
atggcggaaaatcttcacggaatcacccacggaaacgaaaatgagggaggagcttgccacctagcttgcctagacgagctaggttgcttcctccagaaggcaccgccttctagaggaacatcctggaaggcccaagtgggcctggttgctatttgcaccgcccctgtttactaa

SEQ ID NO: 66049 - DNA, 554 bp, Glycine max
  Peptide Sequence Number=SeqID_157734
gtgcggataaccataaggtgtgtccgcatgctaccgggcccttgggtcacgatagcagaaatgagacttttttgcggtctcggtcggttgtcgctgacatcttcgggaagggtgcagatgaccacattggtgcggataaccataaggtgtgtccacgtgctaccggatccttggatcacgatagcagaaatgatgcttttttgcggtctcggccggaagacactgacatctccgagaaggtgcagatgacctcattggtctatgtgtgccaacgggctcgcttacctctggttgacaaaaggctcgcttgcctctggttgacaaaaggtgcaaataaccataaggtgtgtccgcgtgctaccgaacccttgggtcacgatagcagaattgagacttttttgcattcttggccggaagacgctcacatcttcgggaagggtgcaaatgaccacattggtctctacgtggcgaggatggacattctcaccctgggtcaaggtttatgggataaaggaatgtctcacactatttacatgacacacatgcaacaatga

SEQ ID NO: 66050 - DNA, 1080 bp, Glycine max
  Peptide Sequence Number=SeqID_157735
atggatgacatatcacagatacaaatccaaaatcagatcactgattgctggatatggaaaccagaaactataggacagtactctactaaaagtgcatattacctgttgcaagaagccacagtaggggacaccctggatgaggcattagaggatctatggaagctaaaaatctcagcaaaagctcaaatttttgcatggagaatgatcaaagacagactaccaaccaaagctaatctgggaagaagacaaatccagatgaatgacacaatctgtcctttttgcagaaacaacatttcatgcagcaaacaattggcacaaatggtggaaagcagtattctagatggaagtgctggaaggacaatatgggttctgtggggttcgagcaacgacaataagggttttccggcagtggagcggtttccagcagatttcaagcgggaggagaaagagaagagcgatttcaggcagaaagagaagagggagggcaaggttttcgagcgcgcggaagggcaaggcttaatgctccaaccatgtggaatcggcacaggcttaaaggagcactcaaaccggatgacccccaaggcctacactccgaaaagtccgttaggacctctccctcctgattcagcaattgtgacatttctggtgctctctagggctcctcctccggttgctttgttaggattcttgtgtggccaaaccaatcataacatcagaagctgcaaaaatattggagttcctattaggccaaagaaatatgttgcaccaccaacttcaaatcaggatgaggacctactagctcaagatgggcaagctttgaatgaggctgaagaagttgctgctcatgttcaagaaggtccgttggagattaatttatctcaacctaatttgtcacaagatagtgacatggagttcatggtccctgcatctgttgttgatgttccaccagtagcaaggaataagctaaacataacaagacccacacaaaagaacatttcagacacaccaacaacaccattacttttcatgccaacaccgaggctcactagaaggaaggctactaataaagatccagtataa

SEQ ID NO: 66051 - DNA, 123 bp, Glycine max
  Peptide Sequence Number=SeqID_157736
atgaccacaatgatggaagtcatgatgagtatgagaaggatgatggaggtcaatgcggctacagttgttgccgcaagtactgccatagaagtggacctgactcacccatctggcttcaatcaa

SEQ ID NO: 66052 - DNA, 525 bp, Glycine max
  Peptide Sequence Number=SeqID_157737
atgaagatcgaatcgcgttcgaaagaggaaacaaagacgtatcaggaatggtttaatttggtagattcagatggagatggtcgaatctctgggaatgacaccacaaagttcttcgctctctccaacttgtcgcgctctcaactgaagcgactctgggctctcgccgatgtcaaaagacaagggtttttgggcttcacggagtttgttactgcaatgcagttggtttcactagcacaagtagggcaagaacttaactcagatatcctcaaaacgcaaagcaagtgtactttcataattttcccctcttcattagaaattgctaaaatgagtttatttataacttggatgctatatgaatgtgatacatgcgatgttgacaaggaaaatattaaacctcccgtattggaaggactcgatgctttagtagcacaaatgagtttaacaattaatgccccgccggaggtaaatgggactcctcagcctcaagtgttccaaactaaccggtggtttggttcaaaatcttaa

SEQ ID NO: 66053 - DNA, 300 bp, Glycine max
  Peptide Sequence Number=SeqID_157738
atggtgctattgaaacccgtcttaaaattacttgttcaacaacggctccgccggtgccatctccactcctgtgttgaccccagctccggccatcgtgccatctctatagctcccgtcgtatctcgagtcaccgaagctcagatcgctagctgtacccagttttgggagttctttgttcctgagcgaggtcgcaagtggtggatatgtttgttaatttcgcagttctctacgcgtgttgcattagaagttgggctgcgatatcttcctggtgctattgtagctgcgatatcttcaatttag

SEQ ID NO: 66054 - DNA, 339 bp, Glycine max
  Peptide Sequence Number=SeqID_157739
atgagtttctatttatgtgggttaggtgtcaaggaatcaaggttagagaaattggatgaaattcaagtgaaagctatcaatacttctaatgggaagaatttgtggtcttggccggaagacgctgacatctccgggaagggtgcagatgaccacattggtctctgcgtgtcaacaggtgcggataaccataaggtgtctccacgtgctaccggatccttgggtcacgatagcagaaatgagactgttttgcggtctcgatcggaagatgctgacatctccgggaagggtgcagatgaccacattggtctctgttggatcaagtggcctcgaaataattaa

SEQ ID NO: 66055 - DNA, 147 bp, Glycine max
  Peptide Sequence Number=SeqID_157740
atggggagagttaacttagggttaaatgtgagaatggtagtgttgaaagcttgggtagagcaaatgacaaaaatgagtgacaaatgtgaaagaaaagagccatttctaagaaaaatgcttgtgcattgctggttatgggaaaggtag

SEQ ID NO: 66056 - DNA, 597 bp, Glycine max
  Peptide Sequence Number=SeqID_157741
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagactacgagtataataggagcatccgtcacaaaaggatcaccctagatgatcatctcgtggctattgagaacgaatcaaatcagatggaacaagtcatagagattgagaaaaatagatcattcacaaccactgatgaaggattcctcgaaaagttaaggattagtaatccttttgaaaattaa

SEQ ID NO: 66057 - DNA, 228 bp, Glycine max
  Peptide Sequence Number=SeqID_157742
atgactgtcagtgatggcagcgattgtgatgatgataacgatcatgataacggtggtagcagtagcgacggtgtcgccaatcataccgacaaaggtggtgacgatcgtgatgatggtgatggtgatgatgatagcttagaagtaatttgtcaggataggaggagattgacgtgccaaatcacacctacttcaatactatgctacggaaacaatgtttacaagcagtaa

SEQ ID NO: 66058 - DNA, 210 bp, Glycine max
  Peptide Sequence Number=SeqID_157743
atgtggcttgaaggcattgatgaggagctaaagatacaagatgaagtgatcacagtacactgtgatagccaaagtgccattgatttatccaaaaattttgtgcatcatgagaggacaaagcacatgatattaagttgcattttgtcagagaagttattgtctagatcagtagatagattgtacccagaggagggattattcagagtttaa

SEQ ID NO: 66059 - DNA, 815 bp, Glycine max
  Peptide Sequence Number=SeqID_157744
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagaattcgatcatcccctggtatcacagggattggccccaggtcccctgcggatattaaaatctgtaaatgctcaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 66060 - DNA, 51 bp, Glycine max
  Peptide Sequence Number=SeqID_157745
atggaggtggtcttcgtcattggaagtgcggtagacaggctttgtggttga

SEQ ID NO: 66061 - DNA, 960 bp, Glycine max
  Peptide Sequence Number=SeqID_157746
atgtctcacctcagaggactacacgtcctcgccatcagagggctgcacgccctcaccttcagaggactacacgtcctggcctttagagagtcatgtaccttcatcttcagaggactacacgtcctcgccttcaaagggctgcatgccctcacctttagagggctgcacgccctcgccttcagaggactagacgtcttcgccttcagagggcgacacgccttcgctttcagaggactacacatccacgccttcagagggtcatgtaccttcaccttcagaggactacacgtcctcgccatcagagggctgcacgccctcaccttcagaggactagacgtcctcggcttcagagggctacacgccttcgctttcagaggactacacgtccttgcttttcgagggctacatgccctcattggactacacatcctcgtctttagaggactacacgttctcacctttagagggctgcactccctcgcctttagaggactatacgtcctcgcctttagaggactatacgtcctcactttcagagaactacacgtcctcaccttcagagggctgcactccctcgccttcagaggattgcacgtcctcgtctttagaggactacacgtcctcatctttagaggactacacgtcttcgccttccgagggcgacacgtcttcaacttcagagtgttgcactctccctcaccttttgagggctacgcatcctcactttcagagaattcaaggtcctccgcccttaatgcctattcgagacttgcactcccggttaaggggccagtagtttccttttatcagtttctgggccaccccctgatattggagggcgaccaactgtgcaaccaaaaccagagatggaggctatcacgcagctactatgcataccggggcaagatttcacccgtgccgctgcaaagagacgagtgcggatcatgcgcaccaacatga

SEQ ID NO: 66062 - DNA, 793 bp, Glycine max
  Peptide Sequence Number=SeqID_157747
gctaagacaagaaagagggcttcgaaccattgggcgaatcgagctggcgtatggtcgaatcgaagtcaaggcaacaagatttctggacttagcgcaatttctgacaaaacttcacaaaattagttcgacttcgagcgatatggataaccgttctaaggagcagttatgtgcatgcaagctagaagcctccattatcactaagctaactactatattccccaaggtatacaccattggtcctctccacactctcaccaagacccaattcatcacaaacaatagttcatcatcccttcatttgagaaaagaagacaaaagttgcataacttggcttgaccaacaaaaggcaaagtcagttttatatgttagttttggcaccttggcaaaggtgtcacatgagcaactattagagatttggcatggtttggtgggtagtttgaagcctttcttgtgggttattagacaagggcttatcattggagaaggtggtttgggacataatgtgcctatggagcttgaattgaagaccaaagaaagagggctcatggtgaattgggcccctcaagaagaggttctggcccaccctttagtgggtggattttttactcatagtggttggaattccacattggaatgtattactaaaggcgtgcctatgctttgttggccactgatagctgatcaaacggttaatagtaggctaattgtggagaagatggtgaagaatttgatggagaatcaaatagaaagactcacaagctctacaaatgagattgcaagaaaaagctcatga

SEQ ID NO: 66063 - DNA, 195 bp, Glycine max
  Peptide Sequence Number=SeqID_157748
gacttagaagcagcagcaactccaggagaagaacctcgatcttttgaggcatcttctagttttcctactcaagggcaatcacatatagaggttagaggagacactatcatggatgagcagccaaggagagtgacccttgaagactattcaagttcaagtgtaccacaacgtttcactagcattgcacaaccggag

SEQ ID NO: 66064 - DNA, 228 bp, Glycine max
  Peptide Sequence Number=SeqID_157749
atgcatagatctcccacaggcaatttagttcctctggacttagaaattgaagctacattgagaaggaacagggccgagaggagaaggaagcttctgcaagatagaacattcgcatccattcttgaggaagaaactcatttttctgattcattaccccctaattcaccatcatcaaggaaatctgctactcaattgcctgaagccactatcatggctgttagtgcttag

SEQ ID NO: 66065 - DNA, 237 bp, Glycine max
  Peptide Sequence Number=SeqID_157750
atgtcaggacttacacgcgattctcctcaaatttcagccagcccgcatcaattagactttgcaccttacgcttcgaggtcatacaatgctcaaaggaatgccccggggcttctccatgacaagcccacgttgcattcgagtcgtatcctcggaaaaatggaggtggtgttcgtcattggaagtgcggtagacaggcttgtggttgatttagggatgacctttgtggataactgggtg

SEQ ID NO: 66066 - DNA, 933 bp, Glycine max
  Peptide Sequence Number=SeqID_157751
atgacgattgccgtcgctgccgccccatatcccgcgttccacgctctacccggcgctggtgcatttttacgatgcggaatacctcggccggccgatccgcgtggcggcgctgtttcaaccggtcaacgagtcgggggtgagcggcatggcgaccattttggtggcggaaaccctggagtcgcgccgttacctggcgcggcagatgatgatcgcggcgcttttgagccagggtacggtggtggtgttgaccctgatcctggcgttcgcgctgctcaagcggggctgttgaaccgatgcgtgaaggacatcaccgcctatcacggcacccgcccggagcgagctgagctcctgccgcgctgggcggctgttgcctgttcaatttacatcgacgttggccgccggggctttggctttacgcgtcagcggcgtgcgcagccgctgcgacaggataacgcccagcagggtgatgccgccgccgatcaggtggtaaccgtgcagctgctcatgcaggaacagcacggcaatagcggcggtaaacaccggcgccaggttcatgaagatcgaggcggtgttggcgcccaggcgcatcacgccctggatccacaggaacggggcgatgatcgaagccggaatgccggcgaacagcaccagcggcaggttatggccgttcaagccgacatcctgcgccatcaggaaattaggcagcagcagcagcacgccgaacaggatctgcacgtacagcgattgccagttcggcagcgcgatggcccagcgtttggtcaacacgccatacagcgcgtaagaggcggtggcgagcagcatcatcaattcccccttgccgataccgtgttgcagcagcacgccgggctggccgccgctgaggggagccgcccgcctcctctaggaggcggcgggggaaggcgtggagattga

SEQ ID NO: 66067 - DNA, 543 bp, Glycine max
  Peptide Sequence Number=SeqID_157752
atgccaatctccccctgcagatgtatcggttgggatcgtgcccatatgatgcccagtggacccgaagaagtccaacagggccctggggtttccagctctggttgcgggcctatgtcagtcctacagggtgcccgttcccccagcgaggaatcgctcccacaaagacacccagtggacccggagaagtccaacagggccctggggtttccagctctggttacgggcccctgtcagtcctacaggatgcctgtttcccctggcaaggaatcgtgcccgcaagacaccctgtggacccgaagaagtccaacagggtcttggagttgccaagctctgattatgggcctctgtcagttctacggagtgcctgttgcccccagcaagatcatcaggccccctactaatcgagatttcatcaagaagtactgcgtctccaggcaggcgcagggcgaaacaccacagcagcctggggatggccagcagcgggcaacagacgcaccgccatcacctctagagttcacctcagctcatccacaaaaaggttag

SEQ ID NO: 66068 - DNA, 212 bp, Glycine max
  Peptide Sequence Number=SeqID_157753
atggaaatatttattcagtcaattgatcctggtgcatgtaatgctattgctaaaggtctatttataccaactaaagaagtaaatagtgaatcggtacctaaagaatgggatgatataaaagatgatgagaaaagaaaaatgcaagatgatcaaaaagctaaaaacattttaacttcaggtttatcttctgatgaattctttcgtactgcaag

SEQ ID NO: 66069 - DNA, 624 bp, Glycine max
  Peptide Sequence Number=SeqID_157754
atgcatgtttatagtttgtttgatggtatctactactcggataaccgtagtaattctagagctaatacgtgcaacaaaccccgacttctggaagggatgcatttattagataaaaggtcaacacaggctctgcctgttgctttgatgattcatgataactcgtcggatcgcacggcctttgtgccggcgacgcatcattcaaatttctgccctatcactttcgatggtaggatagtggcctaccatcgatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 66070 - DNA, 351 bp, Glycine max
  Peptide Sequence Number=SeqID_157755
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggtacgcgcagcgtga

SEQ ID NO: 66071 - DNA, 943 bp, Glycine max
  Peptide Sequence Number=SeqID_157756
tttagaggtctacacgccctcacctttagaggactgcccgccctcaccttcagaggactacccgccctcgccttcaaagggcgacatgtcctcaagtttagtgggctacacgccctacccattagagcactacacgtcctcggcactagaggactacacgtcctcaccttaagaggactacatgtcctcaactttagagggctacacgccctagcctttagagggatacacgttgtcatctccagagggctgcatgcccttaccttcagaggactgcacctcctcaccttcagaggactgcccgtcctcacctttagagggctgcacgccctcgccttcgaaggaggactacacgtcctcgccaccagaggacttcacgtcctcaccttcagagggctacacgccttcgcctttagagggctgcacaccctcgccttcagagggctgcacgcccgcaccttcaaaaggcaacacgtcctcaacattagtgggctacacgcccacgcctttagaggactacacgtcctcgccttcacaagacttcacgtcctcaccatcagagggctgcacgccctcaccttcagaggactgcacgtcctcaccttcagaggattgcacgtcctcacctttagagggctgcacgccctcgcctttagagggctacacgtcctcacctccaaagggctgcatgccctcgcctgtagaggactacacgtcctcacctccaaagggctgcatgccctcgcctgtagaggactacacgtcctcgccttcagaggattgcacaccctcgccttcagagggcgacacgtcctcaactttagtgggctacacgcccacgcctttaaaggactacacgtcctcgccatcagaaggactacatgtcctcgccttcagaggacttcacgtcctcaccttcagagggctacacgccttcgccttc

SEQ ID NO: 66072 - DNA, 1341 bp, Glycine max
  Peptide Sequence Number=SeqID_157757
atgattaatttgaaagcagtcattccggtagcaggcctgggcatgcatatgttgccagccacaaaagccattcctaaagaaatgctgccgatcgtcgacaaaccgatgattcaatacatcgtcgacgagattgttgctgcagggatcaaagaaatcgtcctggttacgcactcgtccaagaatgcggtagaaaaccatttcgacacctcttacgaactcgaagcgttgcttgagcagcgcgtcaaacgccagctgctggcggaagtgcaatctatttgtcctccaggcgtgaccatcatgaacgtgcgccaggcacagccgctgggtctgggtcactctattctctgtgcccgtccggttgtgggtgataacccgttcattgtggtgctgccggatatcattattgataccgcttctgcggatccgctgcgttacaacctggcggccatggtggcacgtttcaatgaaacgggtcgtagccaggtgctggcgaaacgcatgaaaggtgatctctccgagtactctgttatccagaccaaagaagcgctggagacggaagggcaggtgagccgcattgtggaattcatcgaaaaaccggatcagccacagacgctggactcagacctgatggcggttggccgttatgttctgaacgcggatatctgggccgagctggagaaaaccgagccaggtgcctgggaccgtattcagctcaccgacgcgattgccgagctggcgaaaaagcagtctgttgacgcgatgctgatgaccggtgagagctacgactgcggtaagaagttgggctatatgcaggcgtttgtgaactacgggctgcgtaacctgaaggaaggggcgaaacggtttcagagcgccagtatctcgacatatttaatagacggaacagataacgtgaaaattcttgtgacgggcggggccggctttatcggctcagcggttgtgcgacatattattaaaaatacccaggacgaagtcgtcaacgtggataaactgacgtatgcgggaaaccttgagtcgcttaccgaagtcagcgatagcgatcgatatgcctttgagcatgcggatatctgtgacaagacggctatggatcgtatttttgctgagcacaaacccgatgcggtaatgcacctggcagcggaaagccatgttgatcgttccattacaggccctgctgcgtttattgaaaccaatatcgtgggcacctatgtgcttctggaatcggctcgcgcgtactggtcaactctggatgataacgcgaagaaagcattccgtttccatcatatctcgaccgatgaagtttacggtgatttgcctcatcactga

SEQ ID NO: 66073 - DNA, 363 bp, Glycine max
  Peptide Sequence Number=SeqID_157758
atggctgaatcaatgaaaaagagaaagggttcttcctccaccaccgtcgttgttggccatcgccgccatagaccatctgaagcacccatagcactggttcctccttctgtgtcatccccacgatcatctactttattttcttcagatgatcaacgtctaagtcaaggtgttccttttgagggcactattgttgatgactggaagttcgattactcaagtcatgatgctcgtcgtatggtctatgatgaccaggctaatatgactggtgaacgatttgatgcgatggatactcgccttgatgcaatggatgcacactttaattggatggatacacgaggatcactagtctcaaagatgatatga

SEQ ID NO: 66074 - DNA, 303 bp, Glycine max
  Peptide Sequence Number=SeqID_157759
atggcggccgccatagccatggcggtcgtggcggttatggcggggtggcggaaaatggcgtccctcccgcaccccacacgcgcacccagccgcgacacccgtagccgcacgcgcacgcagccgcgacgacctccggcagcgacgcaccggcacaaacggcggcgacgagctccggtggcgacgagctctggcagcgacgcacctgtcacgaacggcggcctacagcgagaagttctcgcggagaagacgaagctgtcgcgaagaagaagaaggcgtagctttttttttccttttgctatttga

SEQ ID NO: 66075 - DNA, 144 bp, Glycine max
  Peptide Sequence Number=SeqID_157760
atgtgtacgaaggagcatgaatcttttaaagaatacgcccaaggatggagggatctagcagctcaagtagcgccccaaaggatggagaaggagatgataacaatgatagtagacacgttaccggtattctactatgagaagatg

SEQ ID NO: 66076 - DNA, 360 bp, Glycine max
  Peptide Sequence Number=SeqID_157761
atgatcttttcattgagtttcctagaccctcgctcacccaggctagcctctagctcgtctgggcccccaaattacttcaggatgaaggaaccagctcacctgggcgagccagttacttcaggagtaagcatcatctcgcctgggcgagcaaccattgccctaagtgcccattttcctataaataggtgtgctagggaggctgaggagaggttccaaggttcagtacttgagggaattgagaaaattaagagagaagaatcagaaagaagaggaaacgaagttgaggcgctgctgaattgcgactgtgatcaatctctacatcgttcctccttcgatgttctttgtgctaccgtcggttag

SEQ ID NO: 66077 - DNA, 93 bp, Glycine max
  Peptide Sequence Number=SeqID_157762
atgaattcgcagggcttcagactcgttggtggaggacacatgaacagcgttagactcgatggtggaggacacatgaacagcgctaagcaataa

SEQ ID NO: 66078 - DNA, 354 bp, Glycine max
  Peptide Sequence Number=SeqID_157763
gtcaacaaaagcggggctcttgctcctatgtaccctccatcaaagaggaaatcagacctacgtagttcttcctttaaaggtgaatcaagcgattccttttacttgaaaggtgatcattttaaggcgttggaccttaagaatgatccatttacttgcaaaataggggaggagcttgccacccagctcgcccaggcgagcaaggttgcttcctccagaagcaaccgccttctggaggaattttctggaaggccccagtggaagttacagaaacttacggattgcgcaaaaacatctcctttcgatttccgtcacattacggaatttcacggattgcgtaagcctgcttccttttga

SEQ ID NO: 66079 - DNA, 717 bp, Glycine max
  Peptide Sequence Number=SeqID_157764
atgagtcttcattcttcatctagtgttaatggtgagggttctactcctaaggacctcttgtataagatattagatgagttgagatcccttaagttgtggaaagaaaaacaagagagaaaagaaaaaggaaggcataggtcacatcttagaccttactcccataggagagaaaaggaaagaaatcctcaagaggctaacattaacctcccatacttccatgggaaggataatgtagaggctaactcagattgggaaataagggtagagcaacaacttaaaaggaagtcgacttcaaaatcttatgactctcactcttatccaaagaaagaccaaggtcaaggcatcttaggggtgacaccttctaagctcaaagatgataaggggaagacaatagaaaagcaaccccttaaggttagtatgcaagagaagactagctccatgaagttctttaaatgtcttggaagaggacacattacttctcaatgccccaccaagaaaaccatgattatgaggggccaagacatttatagtagccaagatgaggctactacttcaccttcctctagtgaaagtgaagaagcaaaaggggaagaatctagtgaagagatctaccccccagaagaaggacaaccttttatagttaaggagaagtgtaaggaggtattattaggcaccaaatccctaaaatatggactcgtgcacccaacatcttcatga

SEQ ID NO: 66080 - DNA, 324 bp, Glycine max
  Peptide Sequence Number=SeqID_157765
atggccacttcacctgtctcgcctcctcctcctcttcctcctcctcttgcagacgcatcagcatctccatctacgttgaagcggacacgcaaggcgacacgattacaatcattggccactagaccacctggggcagaaagacctgtggtcaacgtcgatcatgctactggcaaggccgacggtccccacaaaaagaaattaagaacatatttggggattgtcgctcgtgataagaaggatttggggattgtcgctcgacgatcctgctactggcaaggccgacggacacctggaaggaagtccctactacttagaaggatttga

SEQ ID NO: 66081 - DNA, 315 bp, Glycine max
  Peptide Sequence Number=SeqID_157766
atggctttgctgtacatttactttcattggcagaatttcttagagactgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgaggcatgggacacggcagcacgaaagctagataacagtggggatgagggagctaggttgggacgaaagaaaatgagggaggtagctaggttcgcatga

SEQ ID NO: 66082 - DNA, 870 bp, Glycine max
  Peptide Sequence Number=SeqID_157767
atgggaaacgagaaagcaaattgtttctgggaagcagaattacctccaaattatgatagagttggaattgagaatttcattcgtgcaaagtatgatgaaaagagatgggttccaagagatgggaattcaaaaacaccttctggatttcgggaagagaaaagtccttcacattggcagaggcctgtggagagaagtggttatgccgctgtttctgaaaataaatttgaggaaaggaagaaaatccaaccatcaactgcaattcctgccgcaagaattaatgttcctgctcctcccagagcatctgagcagcatgtagagaaagtggaatcagtagcaccacaaccacaagctccccaaccactagctgaaacatcaaagcaggctacagacacagttaaaaatacccctcctaaagttgactatgccacataccttttcaacatgttgtctatggatggccccaatgaaaatggctctgaggcagctggtacaactactgatgataatcactgggcagctgctgcagaggtgtcaacagctgagaagactagtcccctaaaagcagctgatagtactccagcttctgcatctggaattgaggatcttttcaaagatttacatcctgtgacaccaagcttgactccagaaaaaccacagagagatgtgaaaaatgatatcatgagcctctttgagaaggttgccacaattgcttggttggaagctgattctgtttgtggtagccactctgttgcaatccctttggttcttgtcttgccttatcttttccgtttaaaccaatgtctccggcagtacaaagatactggagagaaaactactcttctgaatggtaagaactttgtcttgttctaa

SEQ ID NO: 66083 - DNA, 531 bp, Glycine max
  Peptide Sequence Number=SeqID_157768
atgttggataaacatgtagttgtgtctccagcaaaacctgcagataagccgaatcttgaggtatatgatctcctatatctaatgacattggccatcccacagttttttttgaagccgttgcaggttatgtgggatgctaccgtgttcggggtgtttaatgaagacttccccttgtacataaagcatgaagatctgtctgaaatagcacatggtggtcaatgtctcaacatctttgttatacagttgtggattctgcatctgactgagacaagtatgcgtacagggaattccgatgtgtatggattcctcgagccacagtctattcagagatctgggcaatcgcaatttgaatcaaaaagatacatgaagagttggatgcagaattcaaaacgtgatgtctaccttggagcctacctgaatggcaagcctcatgatgatgaatcaactatgaatcaagtagttttgatgatgacaaaaaagcccaaaagaatgatttcaagattgagtcaacaagttcaagatcaagattaa

SEQ ID NO: 66084 - DNA, 57 bp, Glycine max
  Peptide Sequence Number=SeqID_157769
atggtgatgttcaatggtggtttgggtcgcgggttggcacacaaggttttgggatag

SEQ ID NO: 66085 - DNA, 405 bp, Glycine max
  Peptide Sequence Number=SeqID_157770
ccttatgcatccacattgacactctccaccctctttgctttatgcttctgtgctgctgcaacctctaataaatatgagatttatgcagcacagaagcataaaccaaagagggtggagagtgtcaatgctgatgcagaaacctttggtgatcactgggaaacttcagattgctctatgtattctgaagctgaagcattagaacatatgaagaaaagagatagaggccatcaaagtgtgtcattggagaataagacagaagattcaactatggtcaagataagtgagaaaaataataatgttgatgccggcgactgcatgattcttgatgaccatgaaggacaagagcattgttgtggcaaaggaacaaatgcgaggagtgtttgccaagaagccaagagaagatag

SEQ ID NO: 66086 - DNA, 337 bp, Glycine max
  Peptide Sequence Number=SeqID_157771
gtgttttgaaaatccggttttggagttctccccttccgatgtttcttcaggtatgggagcggtgtacggaatcgcgaagagcggcgtcggggttgcgtcgatgggtcatgccagagctggattgattttgtgcttgttgcactttgttcctaagtcgaacgacgtccgccgcccattgcttaccacgcggaggacagttatgttcagtggacatgggagggtgttgtttgcagccaaggaagctggtgggaaattattcaagcatgtgggagtagatggaaatggagagagctttgcattgacttatctggtggagttagttaagttactgagttga

SEQ ID NO: 66087 - DNA, 201 bp, Glycine max
  Peptide Sequence Number=SeqID_157772
atggaaaattgtcagtgggagcaagagttacaaccctacaatttggataatttgttgatgcaagtcaaggaaacatatgaatctactcaacatgcatttaaaaatctaaaaattcaagttggggaagaaaactttgtagaggttgaagctcatgaggaaagtcttgtagaagagaatgattcaagagaaaaagatgaataa

SEQ ID NO: 66088 - DNA, 447 bp, Glycine max
  Peptide Sequence Number=SeqID_157773
atggatatctgtgaagataatggcattcctataatattgggaaggccattcatgttaactgcgagctacatagttgatatggggagaaagaagctggagttgggctttgaagatcagaaaattgattttgatttatttgttgaagacaagcctgctccaaaacaaaatgtttgcttacagggactgaaaaatgactttaaaattttttttcttctaaaaatcagtcctctcgctaagtgcaagcctcacgctaagcacatctttggtcatacgctaagtcaagagtcacaagcgcttagcgctcaacacttgctgatgaagagagagaggagacgtcacttcaaagagaagataagtctagaagaagttcaccaccataggaggccatggataagagcttggagaaagaaggagatgaatgaagggagaggaagagaagagcattaa

SEQ ID NO: 66089 - DNA, 426 bp, Glycine max
  Peptide Sequence Number=SeqID_157774
atggttcatacaaaaaggagaaaccatttgcatcaaaagaaaatgaatgacttagtttatgtcatgtacaacttgaagctcaaaagtagacaaacaagaaaaacaattgctcttccatttgaagatatggaatctgatgatgagtggatgacagaagagggagatgatatttttgatgaagacaatctccaagttgagcaagaacaacctttaggggaaagtggtagcgaaagtaatattgacttggttggaggaagtttaactgatcaaactttggatgcatttgatattgacaattttgtattgaatgacaatgtggaagatcacttctcaactgaggaagagcttgaagatgatggagataaagatgatggcggtggtggtgatattggagatgattttatcagaggattgatgtacatttga

SEQ ID NO: 66090 - DNA, 273 bp, Glycine max
  Peptide Sequence Number=SeqID_157775
atgcttattagcatgctcaagaagtacacaaatggtaaggacttggttagatcagcttgtctccatgaaatgaaagcatctttgatgaggttgttcagttatgaggagtggaaaaaaaatgtatccatatgcctcaaagttgctgcccctcttatggtagtccttcgattgatggattctgatcaacaacccaccatgggtttcatatatattgagatggatcgtgcaaaggaaaggattaaaagtaacttcaataatgtgaagaaaaattaa

SEQ ID NO: 66091 - DNA, 693 bp, Glycine max
  Peptide Sequence Number=SeqID_157776
atggaaggtctcatatgctcaagtaagtcattgctacggagttggactactacttcagacatgactggccgcattgcagacaatggtggagtgcacaacaaagaaatgcctatcacattcttcatttcttctgaatcatacttattagggtttaagctttggtccactaactctaagtgcttgccactctcatacaatgtccatgcctgttgtagtcaaaaccaagggggacagatgtcgtacaggatgtcacgacatcacgcttcagaacatgcagattatatgtgtctgtatgaacagattaaacaagtggctcacaaaagactcaagtcccaaaactcacaaaataactcttcaatcccggacttggtacagaactcgtgcagcctccatgattatatagccgtgtacgattctgggctgcaactccttgatgctggaggagatctatcttcttctgaaaaatctgcagacatcgtgtccgacatcgtggatcctgcagcttcacttctgcacttgacttttatcttgcattgtacagcaactccagtattctcgggcaggatgtcaggacattgtatccgacatcgtggatcctgcaacttcacttctgcacttgacttttatcttgcattgtacagcaactccagtattctcgggcaggatgtcaggacattgtatccgacatcgtga

SEQ ID NO: 66092 - DNA, 348 bp, Glycine max
  Peptide Sequence Number=SeqID_157777
atgagtcttcattcttcatctagtgttaatggtgagggttctactcctaaggaccccttgtataagatattagatgagttgagatcccttaagttatggaaagaaaaacaagagagaaaagaaaaaggtaaaaaaagagtggaagaaataagtcaagatgaaagagggaaaataagagaggaagaaagaagaaaaataatgaaagaaatgaaaagagaaaaacatgtctcctatagtagtcataactcttgcaagagcctaagtgaagaacttcgtgactattatgaagaagatcctaggcctacaagctccaatggagcttgcatcactaagcattgtcagaaataa

SEQ ID NO: 66093 - DNA, 372 bp, Glycine max
  Peptide Sequence Number=SeqID_157778
atggcattcaagaaaaggaaagccacaacatcccaaccccaggagccctatgatactaccagattcacttttgagggggcctgggaacgtcattctcagaacattcactcccggaacatccttctagagaggaatgttaatctttttgtcacagaatatgacgaattccgccgggagatgatcaggcggaactggcacaaggtcttgacccagttcatggacgggcacattgatgtggccctggtcaaggagttttactcgaacctgagaaccctggaagctcctgaggaaggatcagatgacactggcccagacttagagtgtgctctcatactccaaccttgccctcacttctcacacgttcaatcttaa

SEQ ID NO: 66094 - DNA, 390 bp, Glycine max
  Peptide Sequence Number=SeqID_157779
atgtacgattttgaagttgaatgcttcgtttggcagcaggttgagaagaatttgaaacagcttgagaagttgtggaaagaaatgaagacaaaaagggtagcaccggataaggtgacttatactaccatcattggtgcttatagtaaagaaggtataatggttggtatgttctctaaagttggtctggttgatgaattggtgaaactcttacaagacatgaaagtagaaagaacaagactagatcagaggctgtaccaatctgctttaaatgcttttaaagatgtctggttgcaaattcaggcaaggtggatcaaagagagctttttttggccaaatgtgaagctgaaatattcgaaaccggtaaaaccacaagctaggtgcaaatactaa

SEQ ID NO: 66095 - DNA, 123 bp, Glycine max
  Peptide Sequence Number=SeqID_157780
atggataagcctcctatccaaactgtccaagtcctcgacgattctactgatcctgccattaagtatcagctaggagcaatgatggacagtttcaagcacatgggaatcaacttgttgtcatag

SEQ ID NO: 66096 - DNA, 114 bp, Glycine max
  Peptide Sequence Number=SeqID_157781
gtacttatggatggacgcaaggagaggctagggtcacaaccaataggtcgtcatcccttgcctagcccgggacaaacggaaagtgccgctgcaaagcagcctagtatcctttaa

SEQ ID NO: 66097 - DNA, 204 bp, Glycine max
  Peptide Sequence Number=SeqID_157782
atgaccgccagcaaaggaaaacccatttttgaagtagttctttctttgggatttccgttcaaagtcgctctcgactggcgatatcccgccccacataaacaaagaggaaaagaccaaaacacccagcttcctctccaaaaagtcactaccttcgagaagatcctattggtccgtgatcctgcgtgtgatcttttggttcgatag

SEQ ID NO: 66098 - DNA, 576 bp, Glycine max
  Peptide Sequence Number=SeqID_157783
atgttggtatttgatgcctattcgttggagaaggtgacaaaggtcatggagatgaccaccaagttggccttgaacaactccgacactggagaaagtccccttagcgttccgattaccactaaaaagttggttgtgtccaagatgcctcaaacaaacacatcctcaaaaacccctaagcccagaaaccaaggggttggttcagggtacatcctttgtggtacaagtaaagcgtacatctacttgggttgtaatactgagaacaagagagggtacatctcttgtggatcagctcaagtggagcgtacatccacttggttgttcaaagagaacaagggagggtacatcccttgtggatctttgcttgtaaaggattttataaggttattggaaatctcaagaactgtgggttgcttggggactggacccagtggagtagaaatacttgctctagttatactcatcctatcaaatgtggcttcaaatgtaccaactgaagtaagcttcatgatgatgaatcaagttgattcaagaagttttgataatgacaaagatgttgacaaaaagcccaaagaatga

SEQ ID NO: 66099 - DNA, 1236 bp, Glycine max
  Peptide Sequence Number=SeqID_157784
atggctgaaaagacaaagaaaaaactggaggaagctgctcagtccggaagcactgagggcgtcattgacccttcatcttccatcagacgacacgtgaagtggaagatggcctgcaccaagaaaactaggcagatgacgtttgaggcaacaaaggaaattgctgagaagattgattctttggaggagaaggcttcacagggttcgtttgtcccctatggatgtcagtatatcctgactgctgccattgggcgacaagaacaccctggtcgtgtgcgtgatgctagagccggtgtgaccataaagcaatactttggatcagctccacgaacctcccacagttctttctccatagctcctgaagaactcgaacagctgactcaacaaatcagggaccagctggaggagtcgatcacagaaaaaggacttgcactgcctctggagcctgaggttggtccctcagctgctcgtgtcagcacaaaggagagttgtgttgatccctcaaggaacgatctagagacggatgactcagacaaatgtgggttgtacatcgaagaaaatccttctcgcctagttgccctaggaagagtttatgagggatccacagtggttcacaacatccctttgttgcatggccaagtgaaggttagtgttgaggaggttaaagatgcagaggctctcattcctgtacccattgacgaggttagtttagtggggcagacacttaacaccttccttgcttggccgacacatcttgtgaagcgtttatcaaaacagcctctccaggttatgtgggatgctaccgtgttcggggtgtttaatcaaaacttctcgttgtacataaagcacgaagatctctctaaaattgcacatggtgaaagttacatgaagagttggatgcagagttcaaaatgtgatgtctaccttggagcctacctgaatgggccagacagctaccttaaaggaataattaacagtgctttgaaaggacttgatgatactccacaacctaaatccaaggctggtgctaggtggattgttgttaagtgtaatagacaaaaaggaagcactgagtgtggctattacgtcatgcacttgatgtccacaataatcttaggaactttcaagaataattgggaaacgtattttaatgatgttagaccattggaagcagaaagattgaaggtgtttcgcatccagtgggcacaatattatctcaaagttagaaatcaaacttag

SEQ ID NO: 66100 - DNA, 1839 bp, Glycine max
  Peptide Sequence Number=SeqID_157785
atggcagtagcgaatgtgacagtttccaatataaagggtagactgaagttaggggggatcaacatcggtgcttcagtcatggctcttttcaaagtatcaaaggcgagttgggcatcatcggaccaattgagctggtccttcctcaagagcaaagatggtacaggccaatcgcacatggcactgattttgcttggtttcagagctacgacgacagctgagatgatatgccctaaagatagtgatgaactatacataaggatgtcatccaagaacatgacaacgaacaagcgtaagaatatcttcaacaactcgttcatgcatttttgggaatatctgcttcaaccatgtgattctggtggaatctctgttagagagctttgtaatccatgcagaagtgccaatgccatccttatatttgacaagcaaaacgggggaggaaaaagggctatggctcaattggatgaatttgaaggtggatacagtgggcaatggtacgtggaggtggtagtgcattgggttcctgaaacaattggtcgaaatggagaagaagggtggctcgagcgattgggccggttaggaatccgagataagtggaacatagctgagatgctctgggtttgcgccaaccttttaattcgatgggttgaggtgttggaaagtcgaaggggaacatgtgggaaggttcaagaagctggctactcgtggttggacgaaattgtgagtgcttcctctgtctacgagtatcgtcatcttgtgttgatggatagtcccaaagatgcaaaaggtctcgacggcttgcatcccagggttctccaagtcttcgtccgtgatgagaagatgaagtcgcgacttacagcgatgactaatgacccacttgacccttgggaaggtggcgtgacagaaggggcaagggaaatgagtggcagagggtggtgcgaactgcgagttgagaaacgacgatcctatagtttatcctcttgtaacttggacagtgctatagtttgcggcaaagacaagggtggcaaggcttggacctctcgacgaaggtcaggagtaagaccaaagatgaagaagctaagaaggaaaggagcagcagcgtggcgcgagaccaaacgagacgtgacggttggccgtgaaaccagacgagacgtggcagcatggtgcattggttctgttgcgagacgagaccgacggtgtgagaccattcagattggaagccgcaagtcccacgacgagcgagagaagcttgctgcttgtgtcaatgaggtaccaggtccaggtgcagcaagaagaagcaaaaaggctctagaaaataggactgatattgggtggaaacatgtgacagatgttttagggaatgataaaaaagttaagtgcaactattgctcaaagatcaacaatgggggaatttttagattcaaacatcatcttgataggactagatggaattctgaaccttgtgcttcagtgcctgaagaagttaagatgcttatgatgaaagttgttgcagaggggagtcaaataccactcaaagtggaatataagggatacggtttcttgctttcaaaggaagaggaaaagcaaaatttgttcaagctagtgcagcttttgaaaagagcagtggagaaaactaatgtaatgcttcaagaattcagggatgagtggaagaaaactgaatgcacaattatgtctgatggatggacagataaaaaaagaccaagctcaagcttagcgcgaagaagaccctcgaagaagcctaaaggtgcgcctagcgcaaaatcccacgctaagcgtgtgaatgcctcgctaagcccagacattatcgcgctcagtgcatga

SEQ ID NO: 66101 - DNA, 552 bp, Glycine max
  Peptide Sequence Number=SeqID_157786
atgggttacgggcccttccattgtcaagaattcggatggggaattgtaaggtcaacttggttggtttgggaagtggcaaatgtgctatacttggaatcaccagctggtgttggattttcatactcaagcaatacatctttctataccttagtgacagatgaaattacagctggagataatcttatttttctaccgcgatggttcactgaattccctgagtactcaaaaaacgacttcttcattacaggggagagctatgcaggtcactatgctccacaacttgcacaacttattgttcaaacaaagaccaacttcaatcttaagggggtagcaataggcaatcctctaatggaatttgatactgatttgaactccaaagctgaattcttttggtcccacggactgatttcagattcaacttataatcttttcaccagagtctgcaactatttcacaattaggagacaaacgatacaaggtaatcttagtgacgtttgtgcaaaaataaatggactggtgtttactgagcaaatcaacaggcttatgtgctga

SEQ ID NO: 66102 - DNA, 435 bp, Glycine max
  Peptide Sequence Number=SeqID_157787
atggtgaaactcttcaaggtcgtagccttaactttgttggtgttatggtcatggtggagctttgagggtgcagtaggagaccctcaactctttttactcacaaatgagtgcagcggatttaccaccgcaaatttcgacttgtccactttcttccaaaatctaaacgcaagtttcgcagacctgagagagcaggtgaccaaccaaagcaagcaatttgccattgctcaatcaaccagcggaacaagtcctgtctatgccatgtttcaatgcatgaactacctctccatcgctgactgcgctgcctgcttagcagccgccgacaccgaaatccgcaactgctccaccggaaccaccgacggtgctcgtgtcgtttatgacggctgcttcctcaggatatgctgttacgctgcagatatgttgttaggctgtttttaa

SEQ ID NO: 66103 - DNA, 552 bp, Glycine max
  Peptide Sequence Number=SeqID_157788
atggagcaatcagagccagcaaacaaatcagctagctacacttctcgagggctatccccttctccactgagcactactgatcaagaagatttggccctaacacccacctacagttccttagtgtttcttgtgctcaatcacccgtatggatattggtgtgaggtagaaaattgctatgcaaagggggtgtttggactgatttggggatgtaccggaagtagtgctcttgctattggtattggtggggttctaggtagtgaagggagggttgttgctatagatttaagccttctagttgttgttgcagtttacaatgataagatgacacaagatatgagtcaaagtgacaactttatagaaatttcagctaatgatggtgtgggactaggaggtcttcacagtgttgcatttcagtccaccacaagctttagtggttcagggtctagtttttcaaattctaattcagctgagtactgtagattgaaagaggaggaagggcatattccttttgagacgagtgctatgtttggtcataatactagtaacggagtt

SEQ ID NO: 66104 - DNA, 510 bp, Glycine max
  Peptide Sequence Number=SeqID_157789
atgaaaactgaggaggacgagctggaagaggaggtcgccctcaatgttcttactgctgactatcaagagtatctccagctaaaagctgccaaggaatctcaaacatcatctgctataagtggtcataactccactacttgcacttcccaatttggtaataatcaaagtccatggataattgattcaagtgcttctgatcacattgctggtaatagttctttattttcatccctctctcctcctaaaattcctcatttcattactttagccgatggttctagagttgcagcaacaagaatcagccatgaatgtggtacgagtcggacgattggcataggacatgaatctcacggtctttactatctcaagcctaatctttcttggcgcaaggcattctccatcagtcctcttgtcctcatactcctcaacagaatggcattgccgaaaggaagaataggtacacttgccaacgagttaacacagaccttcttcgaatgtgacacattctaa

SEQ ID NO: 66105 - DNA, 84 bp, Glycine max
  Peptide Sequence Number=SeqID_157790
atgcagtatttcactgatcgtagaccattggaactagaaagattgaaggcgcttcgcaaccaatgggcaaagtactatttgaaa

SEQ ID NO: 66106 - DNA, 216 bp, Glycine max
  Peptide Sequence Number=SeqID_157791
atgtatgcaagagcacgacacacgtgtgtcgcaacctacccttcggcgggagggcgacgcgtgactcgcgggatgcgtgttccacgaaaggaatatgcgtggagtcgccaccaacgtttatttgaggaaaacgtcggaaaaaccggaaaagacgcgatctacgaacttttaagtgaaaggctcgggagttgtatttacgcgcggggaaggtattag

SEQ ID NO: 66107 - DNA, 330 bp, Glycine max
  Peptide Sequence Number=SeqID_157792
atgggtgaagattcttggtccttggtgcgcaaccatttgcttaaagaacttggcaaatggtcagatgactatatcaggctcttcggtggcacaggcagattcgaggaattaaggaggtccctacttgttgatgggttatccatgtggatggatataaccgagatgagatatgtcattgcatcaaggtataatgtaatccttgtatcgttgtcgctacaacaaagcatgacgttctttccacttagaagtcaaccaccaacagattcttctgtgcatcgcataatatgtatcggttacgtttatgacaatcattttgttcatgtacattga

SEQ ID NO: 66108 - DNA, 860 bp, Glycine max
  Peptide Sequence Number=SeqID_157793
caaaagctttggtggatcaaggaaagtgggcttcgttcattgatgtttcagcgctattggtgttcggggaaagttcggtcgttgctgttttggctgatgcctatgacacattcgatcggatatgcaagaagagcaacgtgaggattgtctgttgtacacccgctctctatgtatggctggtctctcacatttttcatcatgaaagtagacctgtctgtcctcttcaaggtcaccgcatgtgtgccgaaaaagggaaagcaaattgggagcaactcttggctgggttccaaaatatccccttgatgggaatgaggggtttcagtgatcccaatgcaagaatgcttcaaagagttcgaaaagcatggattgtggtgcaaagaaaggataaggatcttagaggaagcaacaacagtgttattggaggatatcatcaatggttgaaggctcaaacgcaagggataacttggctcccaaagctaaagagttcaagtggggaagaggctgaagtccctaaggagagcgaagaagtgcaagccttgaaagcggaacttgaaagaatgcgagtagtcaaggaaaagttcaagacgaaagccatcagggttaggaaagagtgtgacaagctgagggacgtcaacggtagtaacagcgaactcaagcttcggagagatgaaagggacgagtcgagggtggaaattatgatattagaggacaagttgaaggcttgtcaaaggtcgaagaggagcttgaccgaacagttgagtaggatggaagagaacatgtgggcaatcattgaccaatataaagagaagctaaatctagctgccaaccatgatcaaagactagagggcgagcatgcaaaa

SEQ ID NO: 66109 - DNA, 420 bp, Glycine max
  Peptide Sequence Number=SeqID_157794
atgttcaagcgactctggttcgacggccgggcccgggccgtcctggcgcaactgctgatcgccggtgccttcgtcggcgcggtgggctggctggcctggaacgcccacgccaacctgacccagcgcggcatcgccatggggcttcgactaccttggcgaggcggcccgttttcccatcgccgaaagcctgctggcgtaccagcctaccgacagctacggccgcgccttcctggtggggctggtcaacacgctgtacatctcggcgctggtgatcgcggcctcgacgctgctgggcttcggcctggcgctggcgcgccgcagccgccatccgctggtgacgggcgtggccacggtctatctggaagccgtgcgcaacacgccgctggtggtgcaactgctgttctggtacagccctggtga

SEQ ID NO: 66110 - DNA, 177 bp, Glycine max
  Peptide Sequence Number=SeqID_157795
atgcacacacatgataatgcaatcctccctaggaagggaccagtcactagagccatgagcaagaggctccaaaaggattgggctagagttgctaaagaagcccctagggttctcatgaacctcagggtagggtaccttagaaatataggatttttcagcccttgtgagggcacctag

SEQ ID NO: 66111 - DNA, 309 bp, Glycine max
  Peptide Sequence Number=SeqID_157796
atgccatatgtggaggccacaaaggagtcattagaaaccgctttccagtctttcgaggtggtaagaatttcctccgtggactccttctttgggcaaccttgcctgtcagatatggcagtaatggtggcccgggtaatgttggggaatggctacgagcccgaaatgggtttaggcaaggacaacggcagcataactagcctgataagcgccaaaggaaatcgtgggaagtttgggttaggctacaaacccacacaggcagatataaggaaaagcattgcgggaaggaaaaacggaagtcaaggctcgtga

SEQ ID NO: 66112 - DNA, 175 bp, Glycine max
  Peptide Sequence Number=SeqID_157797
atgcagaagaagacgttagtctttgcatgctaccggactctgagtctgacggatagcgaaagagtgtttatacggataaccacttgggtcacgatagcaacaggtggggtggtcgacaaaagcggggcttttgctcctatgtatcctcaatttgtgatgaggaactcagacctac

SEQ ID NO: 66113 - DNA, 450 bp, Glycine max
  Peptide Sequence Number=SeqID_157798
atggatgctgtgcaaaggaaagataaagagcgtaggggaagcagtgatgggattgtcgacggctatcataagtggctgagagtccggacgcaaaagttggattggctcccaaggctaaaggctgcaagaaaggaagaggttcaaactctagagaagagtgaggaagtgcaaaccctaaaggcagaacttgaaagagcccaagcagtcaaagagaagttcaagtcaacgaccatcaaagttcggaaagagtacgatgaattaagggacgtcaatatggccaccaccgaagccttggaacgagaaactaagagggcccgaaaggaagaacatggccagaacaagttccgaggagctttatggggcagcaacagtgagcttaagctccgaagagccgaaagggatcagtcgtgggtcgaaggcatgatcttgaaagacgagttaaaggcttga

SEQ ID NO: 66114 - DNA, 501 bp, Glycine max
  Peptide Sequence Number=SeqID_157799
atgtctgcttttgtggaacgttggcataaggaaactagcagtttccatttgcccatcgaagaggtgactatcaccttggatgacgtcgtgtcgttgctacatctatctgttgtaggggcgtgccacagcttcaagctacttcatgtcgatgacgctatcgaaatgttggtggaattactcgagttcagtgctgtagagtgttggatctacgagcatttctcgtccgttggttccgctgttcctgccgaggattatgatgagaggagaccgagtgcatgccgatggacctctggcaaggcactgcccatttccacgtattggaggcgtccggataaactgatccttgacgcgatgtgctggattccgtacagtgaccaccgtttatttagagaatttgatgtcatctcattattttccggccacatcctgttgcgtcttcattctctgttgaagaaattgatgatagatggatgcagtttggtgaatacattgaacctgtag

SEQ ID NO: 66115 - DNA, 222 bp, Glycine max
  Peptide Sequence Number=SeqID_157800
atggaagatgcacccttagcccgtccaagaggctctttttgcacccccactgaagggcaggttgcgacaaagggtgtggagctaaagccaatattgctcagtttgattggttcacacccttttgctggaatggatcatgacaatccatacacacatttgtctaccttcatagagctatgcagtaccatgggagcttccgacgaagacgttaaagctgtctag

SEQ ID NO: 66116 - DNA, 1083 bp, Glycine max
  Peptide Sequence Number=SeqID_157801
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccagctgacaatgtcttccgcccggatcgaccggccgaagccgaccttgggtccaaaaagaggggcagtgccccgcttccgattcacggaataagtaaaataacgtttaaagtactg

SEQ ID NO: 66117 - DNA, 432 bp, Glycine max
  Peptide Sequence Number=SeqID_157802
atggtcattctgcaccttttgtcatccagaggcggcgagcccgatgacatgtggagacaaattatggttatccgcacaccttttcgccatccagagacgatcgagtccaatggcacgcagagacaaattatggtcattctgcaccttttgtcatccagaggcggcgagcccgatgacatgcggagacaaattatggtaatctgctccccttttcgctatccagatacgatcgagtccaatggcacgcagacacaaattatggttattctgcaccttttgtcatccagaggcggcgagcccgatgacatgcggagacaacttatggtaatccgcacactttttgcatccagagacgatcgagtccgatggcacgcagagacaaattatggtcattctgcaccttttgtcatccagaggcggcgagcccgatga

SEQ ID NO: 66118 - DNA, 204 bp, Glycine max
  Peptide Sequence Number=SeqID_157803
atggtgatgttcgtggtggaggcagggacaacaaaggtgagatgttgtggtggtggtggtggaggaggcagtggtgggggcaatggtgtggcggcgatgacggggccatggtggtggtatatggcaatgatggattcagactcattagagggttgtttttatcctaaagacgacaaggttgctaattggtacacatttaggtag

SEQ ID NO: 66119 - DNA, 385 bp, Glycine max
  Peptide Sequence Number=SeqID_157804
atggttaagaaggagtgtagggaggtaagtgtctcctccaagaggttaggtaagaaggaaagtcattttgcaataaagacaaacattaaagaaacttcccatctgagacaacctccatatcttctcctttgtaaaaagacacctgttagcactgccacacctattgggcttgaggttattcctcaagtaaaggagttgttggatgagggtttgattcgtaagagcttaaatccttgtgctttgttggtgcccaaaataggtatccttaggcaccaaatccctaaaataggtgatatgatgaatgtgtccagtggtggaaccctcttttgtaaaatcactcatgcacccaacatcttcatgattcatgtgcatagggactcattag

SEQ ID NO: 66120 - DNA, 801 bp, Glycine max
  misc_feature (46)..(46): n is a, c, g, or t
  Peptide Sequence Number=SeqID_157805
atgcgtaaggagaaaataccgcatcaggcgccattcgccattcagnctgcgcaactgttgggaagggcgatcggtgcgggcctcttcgctattacgccagctggcgaaagggggatgtgctgcaaggcgattaagttgggtaacgccagggttttcccagtcacgacgttgtttcgccattttgaggagctacatcgacgcctgaaagagttcgccgagtataatcttcatttgccaccaaagcattttctgtcaactggtttagatgtaccagtcattcaagagcgtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 66121 - DNA, 131 bp, Glycine max
  Peptide Sequence Number=SeqID_157806
atggcggaaccatcaaagaagcgaaagggttcttcgagtcagagtcaacagcatttcgagactcaggaaacgtcgattccttcctttattccctctgcctcattgttttcatccgaagaacagcggatacg

SEQ ID NO: 66122 - DNA, 468 bp, Glycine max
  Peptide Sequence Number=SeqID_157807
atggctccgaagaaactctccacgaagaggtctagaagagacgccgcagcaaaagggtccagtgccgcccccgagtttgatagtcatcgtttccggagcgctgagcaccaacagcgattcgaggccatcaaaggatggtcgttccacagagaaaggcatgtccagctcagggaggatgagtatacatactttcaggaggagatagctcgcagacattggacattgctggtgactcccatggctaagtttgaccctgagatagtcctagagttctatgctcatgcttggcccacagaggagggagtgcgagacatgcgttcgtgggtgaggggtcagtggattcccattgacgcagatgccctcagccagttcttgggtgacccgctagttttggaggaaggccagcaatgtgagttcaaccagaggaggaatagggccgacgggttcgacgaggaggaaattacctag

SEQ ID NO: 66123 - DNA, 1261 bp, Glycine max
  Peptide Sequence Number=SeqID_157808
atggatacccgtcacccacccgttcgtttctcgcagcgtctgatcagctggattgtgtgcggcctgatggtctggcagccgatggcacctgccgtcgcggcggcgcttacgccgaccgggcagaccacggtcgatcgggcggggaacggggtgccggtcgtcaacatcgccacgcccaacggggcgggtatctcgcataaccagttcggtgagtataacgtcggcaaagaggggcttatcctcaacaacggcacggaccgtttaacccagacccagctgggcgggcttatccagaacaaccccaacctgcaggccgggcgggaagcgaaaggcattatcaacgaagtcacgggcgccagccgctcgcagctgcagggctatacggaagtcgccggtaaagcagcaaacgtcatggtggccaacccgtacggcattacctgtaacgggtgcggatttatcaacaccccgaacgtcaccctgaccacggggaaaccgcagttcgacgccagcggtaacctgcaggcgctggaggtgacgaaaggcgccatcacggttgaaggccaggggctggatgccagcaagagcgacgcgctgtcgattattgcgcgcgcaacggaagtgaacgccgcgattcatgcgaacgacctgacggtgacggcaggagcgaaccgcgtgggcgcagacggcagcgtcaggccgattgccggtgagggtgccgcgcccgtggtggccgtggataccggcgcgctcggcgggatgtatgccaaccgtatccgcctggtctccagcgagacgggcgtgggggtgaacctcggcaacctcaccgcgcgccagggcgacattcagctggacgtgggcgggaaactgacggtcacgaacagcctggccagcggatcgattaccgcgaacggcgcgggagtggccctcaacggcagccatcagtccggtggcgcgctgaatgtggccagctcgcaggatgtggaactcaataacagcacgctcgccagccagggcgatatgcgcctttccgctgcggggaaagtgcagacgacgggcggcgggacaaacagcgcgggggcgctgtcggtgagcagcgggcaggggatgacgctcagcaataccgccctggtctcccgcggcgcggcgacgctggacagtaaagctaccctgaccgtcaacggcggcggcgtgtcggctcagggcggggcgctaaccgtcacgagcaaacagggaatggcgcttgcggatgcgacgctgacgg

SEQ ID NO: 66124 - DNA, 231 bp, Glycine max
  Peptide Sequence Number=SeqID_157809
atggcagcggaatggagaaggaagagagagaggagacgccacttcaaggagaagatgagtctagaagaagttcactaccataggaggccatggataagagcttggaggaagaaggagatgaatgaaaggagagggagagaagagcatgaaattttgtgctctaaaagagctctgaaatctgaacccactaatccaagatcaattccaagattctccactaagtgtgtttag

SEQ ID NO: 66125 - DNA, 141 bp, Glycine max
  Peptide Sequence Number=SeqID_157810
atggcacaatgtcggctgaaaaatatcagtcgcggatttacaaccgccgatgtcggctatggaaatgtccgatcggcgtcatccggtgatgcttcttttttaaaccttgatcggacacttttcctggccgacgtcggctaa

SEQ ID NO: 66126 - DNA, 643 bp, Glycine max
  Peptide Sequence Number=SeqID_157811
atggccccaaggaagcttgcctcaaagagatccaggaaggataaagtggctgaaggaactacttccgctcccgaatatgatagtcattgttttaggagcactgagcaccaacagcgcttcgaggccatcaagggatggtcatttctccgggagcgacgcgtccagctcagggacgacgagtataccgacttccaggaggagatagttcgccggcggtgggcatcactggttacccccatggccaagttcgacccagacatagtcctcgagttttatgccaatgcttggcctacagaggagggtgtacgagatatgcgatcctgggtgagggagggccaggagtgcgagtatggccagaggaggaaccgggccgatgggtttgatgaggaggccatcgcccaattgatgtgtataccggggcaggattttgcccggactactgctggaagacgggtgcggatcatgcgcaccaacatgaccaccctgacccagatctggatgactttgctgctcagtaacatccagcccatcgatcataattccgacctccccctgccgaagtgtcagctggtgtacgccatcctgacacggatgagcattcacgtggctcagttaatcactgatgccatctatctatttgcag

SEQ ID NO: 66127 - DNA, 945 bp, Glycine max
  Peptide Sequence Number=SeqID_157812
atggataatagcaattcagctgcaacgaccggtgtctggaatgattttcggtcaattgatataataataacaatacttatgagcctcaatgttgtggaccttgcagttgcctcgctggtctgcaaaatgtggaacaaagcttgtcgtgacccgtctctttggcgcaaaattgatctgtccgaactcaataactcataccttttcaacatacaaaataataagccgggagcttacaagcattcgagggggaaaattactcaattcttaaagtatgttttgagtctgagtaatggaaatacaaattgcttaatatttaactacaatgttgacttaacggatgagcagttcatcatagctgctgaaaggaccccaaatctgaaacgactagttctaccaaatacatgtgtcttttcaagaaaagcagtgcatacggcaatgaagtcatgggggggcctagagtccattaccatttccttcgatgaccccaataaatacatattttctgcaattgccgaatactgcaagaacataacagagatgaaatttagtcacggttgcctcctctttgaagaaaattatgttgaagcgctgcttaaatgtgcccctaacttgaaggctttgagcattcggtgcataatgacaagcatgggtgctttgtgcggtgtgttcacttccttccaacatttggaggcggtgaatatatgccatagctccattatagatgcaccatattctgatttcggtgttgtggatattacttatgtacaaaagcatttgccgccatcgaattacggaaagcttatatattgtaaagaaggatcatgccttaggtgcaagaatgacaggagcattattcctgccggaattttccaaattacaagctttcttatccatgcctcagaggatttgtggcgggaggacgagataacttctcttgcacattaa

SEQ ID NO: 66128 - DNA, 1695 bp, Glycine max
  Peptide Sequence Number=SeqID_157813
atgtggcgaagaagcttcagtagcagcaccgccgctctgaagggcaagaaatgggacgcgctggtaatcggcggcggccacaacggcctgacggcggcggcatacctcgcgcgcggaggcctctcggtggcgatactggagcggcgccacgtgatcggcggcgccgccgtgacggaggagctggttccggggttcaagttttcgaggtgcagctacctccagagcctgctgagaccgtcggtcataaaggagctggagttggggaagcacggcttgaagcttctgaaaagcaatccgtcgtcgtttacgccctgcctcgacggacgctaccttctcttaggtcccgataaggatctcaatcactctgagatctccaaattctcactcaaagatgctcaggcttatccaagatatcagactcagcttgagagtttctgtaagttcatggatctagtgctggattcgccgccacctgaatctgtgcaccataaatcgtctattaatgaaaaattgaagaataaattacagaattctgtattttgggcaagttgtctgcgacaggtgtcttccttggggcaaaaggatatggtggactttatggaccttctgttgtccccagcttctaaggttttgaacaactggtttgaggcagatgttctgaaggcaacccttgcaactgatgctgtgataggcagtacattttgtactgttcatacaaagagtgtgaatatcatgctatttattccatgtagatatgttgaaggtggaatgggctcaatatccaaggctattggtaatgctgctattgaagctggagcacatgttgtaaccaatgctgaggtgtctcggttgttgattgaaaactctagcactgtctgtggggtggctttggctgatggtactgaagtgcattcttcaattgttttgtctaatgcaactccatataaaactttcatggaattagtgtccaacgatgtccttcctgatgattttgttcgtgccattaagcacactgactacagttctgctactacaaaaataaatgtagcagttgataaattgcccgaatttcattgttgcaagttagaacaccctcatgctggcccacagcatgtcgccacaattcatataggttcagaaagcatggaggagattcactctgcatgtcaagatgcagtaaatggagtaccgtcgagaagaccggttattgagatgtcaattccctccatactggacaaaactatttctccacctggtaagcatgtgatcaacctgtttgtgcagtatacaccctacaaaccattggatggtgactggcaagatcatgactacagagttagtgcttcattatatcttatctatcctcctattcaggaatcgtttgcacaaaaatgtttcacattgattgatgaatatgctcctggcttcagcacatcagtcattggttatgatatgctgactccaccagatcttgaaagggaaatcggtttgacgggagggaatatattccatggtgctatggggttggattcccttttcctcatgcgacctgcaaagggatggtcaaactacaagactccgcttaaagggttatacttatgcggaagtggggcacatcctggtggtggtgttatgggagcacctggacgtaatgctgctcgtttagttcttcaagaggttggagaaagaacttaa

SEQ ID NO: 66129 - DNA, 618 bp, Glycine max
  Peptide Sequence Number=SeqID_157814
atggcggtttctttagcttaccaagacttgtttgagtggatgatcggtcgtggctcgaattgggatcaggggattctctctttctccgatgatctccaaaattggaaccgggagataacaagagttgtggcgggaataggagcaagtgctgatacaggaggaactattatggccagcttggtcttcaagcagtcttcaggcagctctccatgcaccactgccaccatcgaacaacaaaccacagattgtgatgctagcacaccaccacgaggtgaagacggtgcacaaacaccaccatcatgccctcgttcatatggtgatggtgaaccagatctgaagaaggatggagatggtggctgtgagttgcaatgtgagcatggcctccctcgactcctcgatgcaggcaacgacggaggactcggaggagaagtgggtggtgaagagatcggtgcatttggtgccactggagacaaagctactacgattcgtggtgttgaagcggaaggagtcaacatcgctactggcagagatggcgacgatggaagaggcggtggacccaacacgacagataataatcttgtcagaatcacaaaagttaacgatgagggtaaatgctag

SEQ ID NO: 66130 - DNA, 1227 bp, Glycine max
  Peptide Sequence Number=SeqID_157815
atgtcattgagaagcatagtccgtgaactcaaggagatgagagatggaataggaagcacatcaaagcggggtgcagaaagcaagcatcggctcagtcggacaaagtcacatgtagctccagatgttcttgcaactccatttgaacctattcaacagggacaatgggcaaatctaccatcagaattgcttttggacataatccagagggtcgaagagagtgagacatcttggcctgcccgtgctgttgttgtcttttgtgcttcagtatgtaaatcatggaggtccattacaagagagattgtcaagactcctgaacaatgtggaaggatcacatttcccatttcattgaagcagccgggtccgcgtgattctccaatacagtgctttatcaggaggaacaaagaaacttctacatatctattgtactttggtctggttccatcagagaatgacagtaataagttgttattagctgccaaaaggataagaagggcaacaggcaccggttttgtcatatccttggctgctgatgatttttctcgagccagcaacaaatatgttggtaaactaaggcaattcaccgtatatgacagtcaagctccacatgattctgcaattcaatcaaattgtcaatctagtaggagatttcattctaagcaggtgtcaccaagagttccagcatgtagctatcttgtcagcactgtttcctacgagctgaatgtcctttgcactagagggccaagaagaatgcattgtgtcatgaactctatacctgtctcagctattcaggaaggaggcaacgccccaactccaacatctttccctcaaatatttgatgaacctttttctccatcaccagcactgaaagaaaaagctcaagtcacagatttaaactctgcaagcttatcagagccaccagtattgagccaaggctcaaccgagcaattagcactgaaaaacaaggctcccagatggcatgagcagctacagtgctggtgtctaaacttcaagggtcgcgtttcagtggcttctgttaagaactttcaacttgtagctgctgttgatccatctcataatatttctgccgaggagcaagaaaaggtaatcttgcagtttggaaagattggaaaagacatatttaccatggattactgttatccactctctactttccaagccttcgccatctgcttgagcagctttgacactaaacctgcctgtgaatga

SEQ ID NO: 66131 - DNA, 513 bp, Glycine max
  Peptide Sequence Number=SeqID_157816
atgaagcaaggagcttcaatttaccatgaagatctcaacagcatgcgttatggtttgaaggtatttaaggaaacattgagaatgtccaatgtcctgttgtggtttcctcgtgttgcacttgaagactgcacgatcgaagctaattataggagggctttcatcattagcctttctggcctcatgactatgttactaactatacaagtggcaataacagggtatgatataaagaaagggtggcacgttaacatcgatgcaacttacatacaaagatttgatgaaatgcaaaagccatacagtttcataccttttggatcagggcctaggacatgccttgggatcaatatggcgaaagtgacaatgttggtctttttacacagactcactggtggttacacggggacccttgatgattcagatacttgcttagaaaagaaggcacacatacctaggataaggagtggctgcccaataactttgaagtccttaagcaaaagcatgccagaggcataa

SEQ ID NO: 66132 - DNA, 294 bp, Glycine max
  Peptide Sequence Number=SeqID_157817
atggattccgttgacgatgatggagtttctgctactggatgtcgacaaggtgctaagaggcgaaggtacatttgggtggaccatttttccaacaaaggggtggaccttgagaaggtgcatgtgacattgattgggaaattagggtacaagaagacaaaaattacacatgacaacatatgtcacatgcctatgtgtctggttaacagtcatgtaacagaaacaaaagaagtaaagcttcgtcaccgcagcaacactgtagaaaccttaaagctttccgccatcgacacctactga

SEQ ID NO: 66133 - DNA, 1374 bp, Glycine max
  Peptide Sequence Number=SeqID_157818
atgagactggatcatcgacgtctggttctactcgtcggagttccaggacatgatctctggcggcttcctctcgccgacagcgaaggcactctgcgtggagatgacgtcaggatctcgaagatggcgtcacccccgctggtgaagtccgcccaggctcgttggatttcgttcccggacggcacgttcgacttcgattttgccgacgacaacacactggaggaagaagaagctgtgaaattagaagttcttaaagaaggatcatttgccattaattgtctagagggctgtgtggcagaatctatgctggttagccactttggtgaagctatcattgacgagctttttagcccttaccaagaaaccttggctgatccaatgtccaacgagaaaactaagtttgcatccgagcaaaaggcgatttgtttgtcaaagcccataagagaggaagccataacaggtctctattgcaacacagtcccgagaagcttggcaattgcagatttaggttgctcttatggaccaaacactttgtctgttgtgtctgaattcatcaaaactgtggagaaactttgccggaagctaaaccataaatctccagaatacaaggtctttctgaatgatctccctgggaatgacttcaacaacatctttatgtcccttgacaacttcaaagagaaattgtgtgatgaaattgaaactggggttggtccatgctacttctttggggttcccggttccttctatagcagggttttcccaaatcaaagtctgaattttgtccattcctcttatagtcttcaatggctttctaagtgtcgtgcagaggaattagttgaaggaggtcgcatggttctcacaattttgggaagaagaagtgatgctgagaatccagctatcaaggagggcggttatattatctgggagcttatggctacagctcttaatgatatggtcatgcagggaatcataaaggaagagcaattggatacttttaacattcctcaatacactccatctccatctgaagtggaattggaagttcttaaagaaggatcatttgccatcaaccgtctagagcttgctgaagtgaattggaaccctcttgatgatctgaacgctcttgactttgaatctgagaggtctgaatcactccgtgacaatggatatagtttggcacagtgcatgagatctgtggcagaacctatgctagttaaccaatttggcgaagatattattgaagagggagtaaggaagaaagagaagaggaaaaacgatggtggtacctcgcatgcgacaaaggaggttttccgtgaggaaatgaatgctacagagggttctgtttggggttgtggggtcactagtttggagttatag

SEQ ID NO: 66134 - DNA, 1038 bp, Glycine max
  Peptide Sequence Number=SeqID_157819
atgggagggcaatcaagcaagatggttagtgttgaatccccgacacccattaaaatgggtacccattctctgtatgctgctgatttgagctcctatgaagctgcttgtgttaaagatccaaacttgcaatcctttgacgtgagcattcaggagcataccaatagggtgattagttcccttgctcatggggttgaggtcagatccttatcttttgattcactgagagaaatgactgatagtcttcttgagatgaaccaggaagtagtcaaagttattttggattgcaagaaagatatatggggaaactcagaattgttctccttggtgaatgattactttgataatagcctccacacattggagttctgtaactcacttgagaaatgcttgaggcaagcacgcgaaaaccagatgatagtcaagtcagtggttacctactttgaggaagaggtgcaaaatggggccgaaggggtgacttatgtgaagacattgcaagagcttaagaagtttaaggatgccggggacccctttactgaagagttttatttgttgtttcaatcgggtgtcaaatgccattttgttgctgcttttgtttctgtcttgattttctcggttgtggcggcttctattgctgcgccaccggttgtgacagccttggctgctgcattggctgttccaatagggtcagtaggaaagtggtgcaactctctcttcaagcgctatgagaaagctctaaagggacaacgggaagtgatcagctcaatgcagattggtacttacatttcactgaaggacctggacaacattcgagtgcttatcaacaaattggaattagttcttgaatcattattgcagaatgctgattttgctattaaaaatgaggatgttatgaagtttgcaattgacgagattaagaagaaaatagaaacattttcagaaactatggagagtttaagtgctcatgctgataaatgcagtcgccagatacggagagcgaggactgtggttgtacaaaatataatcaagaaaccagattga

SEQ ID NO: 66135 - DNA, 693 bp, Glycine max
  Peptide Sequence Number=SeqID_157820
atgccactcgaagcaccagtgaggagagtagattgtattttttctagtcctatgaaaagggggaaagggaaaccaataaggacattggattggaagttgacacattacttgaggctgtggtttctgccatattattctgttatacaagtttttggttacattggagtgtcacttcttgcagatataagtgagttgaatctgccaaaatcttgtagcatgcagtttcccaatggcaaagatgacctgatgaactttaaagtttcaatccgacctgataaaggatattacaaaggtggcacatttttgtttaccttccaagtgtcccccatctatccacatgaggcgccgaaggttaaagtgcaagacaaagcgaatcaagatgacgtcagattgagagtcacgggtgtggaggtcggaccaagagaggacctaaaggaggacgtgatagcgaaggacgttagcgagggcagtggggaagaggtgatcgtcgacaacgaggtaagcattggggacaacaagaatggaaaaggaagagtggttcgagagatccacgacgaggtgggtgatagaggcgaggagggagatgaattgggagagcttcgacatggtggagaggagggcggtgagattgttaatgtttggagaggaaggtttagagaaagaagtccatatggaaaaagaaaaaaagtgtga

SEQ ID NO: 66136 - DNA, 531 bp, Glycine max
  Peptide Sequence Number=SeqID_157821
atgagtgcccaggcttcagcttcacgtggctctggcgttccactttgtgtaacagcttcccgtatgtcaacggaagcgcccaagcgcgaccaatggcagtgggagaacgccaccgccggcgccgccgctggattcgccaccgtcgccgtcatgcatcccctcgatgttgtccgaactaggttccaagttaacgatggtcgagtctctaattttcccagttacaagaacaccgctcacgccgttttcactatcgctcgttccgagggattaagagggttatatgcaggcttccttcctggggttcttgggtcaactatttcatggagtttatatttcttcttctatgacagagccaaacagagatatgcaaggaacagggaggggaagttgagcccaggtctgcatcttgcctcagcagctgaagcaggagctatatggttccatggccaccatggtggaatggcatggcagattttttgccaaccgccatggggaaaatgtgaagggatgcctgctatggcagcgccatag

SEQ ID NO: 66137 - DNA, 810 bp, Glycine max
  Peptide Sequence Number=SeqID_157822
atgtgtgaaaaagatttgaggtatgagttcaagaaatggggggatgtaagagagttcttcattgcgaaaaatacaaataggagtggcaagaggtatggcttcgtgagattcaagggagtgggtgatgtagggaggcttgaaagacagttggataatcttataattgggggtctgaaactacatgtcaacataccaaagcatggaagggagaggacgctaaatggtgaacctaattcagaagagaagtacaagctgaatatatctatggaggaaagaacatggctcaataatgcttgggtaggaagactgaggaacctggtgatgtttgatagagtggaagatgaactcatgtgggacagaggagaatatatcacgtcaaagtatctaggggatgacatggtgttgttattgggactcactgattccaaagctgaacaactgtgtaaggaagcaactgacaatgaactgtccctgttccataagagcattaagaagattgcatcggcagtaggggaagtggtggaggtggatgacgatgtggaagaactccaacagctggatagggcacgggaatacatggttcatatggctgaagaaacatgctataactctagcagatgtaaatgttggacagggagtttgatagggtcgtcagaagaaataagctctaaagagagtgaaatcgggactccattactggccgatgatgtctcaccaaaaaatgagtgttcgctgataatgaccaaagtgattgcagacaaaggagagccgttaggggaagttggagagttacggttgactaatggacaa

SEQ ID NO: 66138 - DNA, 123 bp, Glycine max
  Peptide Sequence Number=SeqID_157823
atggttcaagttgggcaaacactgctcttaaacgaatcaagtaaaaattgttgggaattggtatcatcatcaagtttaaccagcgagcatgttttcatatccctgttgaattactattactaa

SEQ ID NO: 66139 - DNA, 208 bp, Glycine max
  Peptide Sequence Number=SeqID_157824
atggggaacgtgaaatggttcgactcagcttacaatggaaggaaaaccggtgtgaacttgcgaacagagaagggaagaggagtttgtttagtaaggattatcgttggtggcattattggagctggtgaagcagccagtgtctcttcctccggcaatcagacaaaacccgccgctccaaagaaaaaacgaaacctcccgggcatgccag

SEQ ID NO: 66140 - DNA, 234 bp, Glycine max
  Peptide Sequence Number=SeqID_157825
atggcttcctcgaatggaaattttccaacatctatgccgattctcataggcaagaactatgatgattggtgtgctcaaatgaagataatctttcgatttcaagatgtgacaaaagtggtgcaagaagagatgcaaatgacctttagcacatccttcttcatcaccatgacggtcctccctcctccaaccatagttgtgcccacacccaccacaagccagggtcaaatgccatag

SEQ ID NO: 66141 - DNA, 1048 bp, Glycine max
  Peptide Sequence Number=SeqID_157826
atggaagagcacgatctcgacgccggtgtgcgccgcgtgctgctgggcgataacaaggtgtgcggcctgacccgcccggaagacgcgcaggccgcgcatcaggctggtgcgctgtatggcggcgtgatttttgccgccggttcgccgcgccaggttaacgaggcgcaggcacaggcggtgatcgccgccgcaccgctgaagtatgtcggcgtgttccgcaatcagcctatcagtgacgttgtcacgtcagcctcgcgtttatcgcttgcggccgtccagctgcacggcgacgaagacaaagcctacgttgcggaactgcgccaggcgctgccagccagcgtgcgcatctggaaggcactgagcattaaagataggttgccgccacgcgactggccgcacgttgatcgctacgtgctggataatggccagggtggcagcggtcagcgctttgactggtcgctgctgcagggtgaagacctggctgatgtgctgctggccggtggcctgagcgccgataactgcgtcgaagccgctcagctcggctgtgccggcctcgacttcaactccggcgtggagtccgcgccgggcatcaaagatgccagcaaagtcgcggcggaagaggacacgatgacgacattacttaatccctactttggcgagttcggcggccagtatgtgccgcagattttgatgccagcactgcgtcagctggaaacggcctttgttgaagcacagcgcgatccggcgtttcaggcagaatttactgacctgctgaaaaactacgccggtcgcccgacggccctgacgctgtgcagcaacctgaccaaaggcagcaaaacccgcctatacctgaagcgcgaagatctgctgcacggcggcgctcacaaaactaaccaggtgctgggccaggcgctgctggcaaaacgcatgggcaaaaacgagatcatcgcggaaaccggcgccggtcagcacggcgtggcatcggcactggcgtgtgccctgctcggcatgaaatgccgtatttacctgggcgcgaaagacgttgagc

SEQ ID NO: 66142 - DNA, 312 bp, Glycine max
  Peptide Sequence Number=SeqID_157827
atggctcagctcgcgcacctgggcgtaattatggatgccggactcgctgattacggtgacgccatggctgagacgcggggccagctgacgcgtgcgattcaggtcaatcgacaaatcacgcagatcgcggttgttgatgccgaccactttagcttccagcgcgatagcccgctccagctcttcttcgttactgacttcggtcagcacgcccattttcaggctgtgcgccaccgcagccagctgacgatactgctcatcatccaatacggacagcatcagcagaatggcatcggcctggtaatggcgcgccag

SEQ ID NO: 66143 - DNA, 522 bp, Glycine max
  Peptide Sequence Number=SeqID_157828
atggagaatagcgtggccacagcttccgctgttagtttggctgccgaagcatacctaactctcccagctaacgtgcaccatcctctcccaaacgtggtaggacgagaaagaagcacactggggcacatcagcaacccccatttgggatacaatcgagtggcttacccttatggattaccacctaattacacaccaccagtcatgcgtgatgacgtgggtcatgttcacgaggatcgtagagagtatgcccaaggagacatcgatttctaccctccagtccctgtcgaggggtcagcacccaacacactgcctcatcccaacctcacgggagaacctcgaaacctcccatcacaaccaatattcttgtcctcagaaggaccgccctcggcagcgatagaaaaaaggaaacttgatctcttcgaagagagattgagagttgttgaaggctttggcgactatccgttcacagacatggcggatctttgcttagtaccggacgtcgtcatccccccaaaattcaag

SEQ ID NO: 66144 - DNA, 345 bp, Glycine max
  Peptide Sequence Number=SeqID_157829
atggtgtggcatcttcaatcaccgtttctccttttctattccgctgccattgatcttcaagaagcaaaagacttcattgatgaagaagatccaaggcctacaagctctacatggagccacattaatggtattatattgatggacaaaacttttggcttcgatactacgattgaggaagcacaaagagaaataaattctgcatacgttgaggcacatagtgcatatcatggaattggtattatggaattgatgggtcgtgatagaggattcatagcaatgcatgcttccttagctagtggacagattgacatatgtctgattcctaagagagaggttgacaaatga

SEQ ID NO: 66145 - DNA, 281 bp, Glycine max
  Peptide Sequence Number=SeqID_157830
atgtcattgagacgagatgatgtctatgttgagaatgatatgtgtcgcaacctacccttttacgggcgagcgaggcgaggctcacggaaaaaccgaaggaaaccggtcatgaagaatattccagattcaggagttgtatttacatttgaggaaggtattagcacctctcagaacttccgtgtggggatcgcggacgagtatgcccaagtatacgtggaaaaagaggctagaggaagggtgatcgactctttacaccaagaggcaaccatgtggatggatcg

SEQ ID NO: 66146 - DNA, 207 bp, Glycine max
  Peptide Sequence Number=SeqID_157831
atgttacgaaaccttacggattacgtaatcatcccatttttaccttccggaacgttacggaactttatggattgcgcactaacacttccttttaattttcggcatgtcacggaacttcacgaattgcctaacgatgggtgccaagtacctcgaagtggtcaaacgagggtcgcaccccaacaacggatgatccccggacgaaattag

SEQ ID NO: 66147 - DNA, 683 bp, Glycine max
  Peptide Sequence Number=SeqID_157832
tgaacgatctggtctcgtacaacgacaagcacaacgatgccaacggggaagataacaacgacggccataacgataaccgttcatacaactacggtgccgaaggccccaccgacgacgaaggcatcaacgcggtgcgcgagcggcagaagcgtaacttcctcgccacgctgtttttctctcacggcacaccgatgctgctggcgggcgatgagtttggccgcagccagatgggcaacaacaacggctattgtcaggacagcgagatttcctggctgcactgggaagatctgccggcttccgctgatgcgttacgcgatttcacccgtcaaatcattgcactgcgcgcacagcagccgctgctgcgacgtgaaagctggcgcgacggcatggagattaaatggtttaacgctggcggcggtttccagcaggcggaacagtgggacgagggctcgacgctcggcgtgtacatcgggcgtccggatctgcaaaccgaagagggtatctggcacgatgtgctgatgctgttcaatccgtttgaaggcaatgtgccgttccgcatcccgcagtgccggtttccaggtgcgcatgaatgcgcaccctacggaaataacggaacatgccctcccggtttccaggtgcgcatgaatacgcacccgacggaaatcacgggacatgcactgtag

SEQ ID NO: 66148 - DNA, 200 bp, Glycine max
  Peptide Sequence Number=SeqID_157833
ttgaaaggaaagatattgagctggtagacgagggagaaccacgaattggtgctgattgttcgagtgtaacctctaataaatttgagatttataaggaggaagcagggaatgcagcacaaaagcataaaccaaaaagggcggggagtgtcaatgctgatgcagaagcctttggtctatgcattctgaagctgaagcactag

SEQ ID NO: 66149 - DNA, 126 bp, Glycine max
  Peptide Sequence Number=SeqID_157834
atggcaaaaattgacggcaagatgagcaatttttatgcggggatgtgcgaaggagtggttttgggatttaacctgcggcaactgaacgagtcttggaactgtgaagcatttgcagacaacgtgtga

SEQ ID NO: 66150 - DNA, 123 bp, Glycine max
  Peptide Sequence Number=SeqID_157835
atgaaggaagtaggtttgaagttgatagggacagagtttgaaaagaatataatggaagtgaagatggaagagacataccacaaaaatgaagaagaaagaaagcaaatggaggaagcaaaatga

SEQ ID NO: 66151 - DNA, 247 bp, Glycine max
  Peptide Sequence Number=SeqID_157836
atttcaaagctcatttggagcacaaaatttcgtgctcttctctccctctcctttcattcatctccttcttcctccaagctcttatccatggcctcttatggtgggagcaaaggaatccattgatgaagaagatcctaggcctacaagctccaatggagcttacatcagaatcattggtggaggatgcatgaacgacaatcaattcatggggctccgaataaaagtggagaatggagaattgcactag

SEQ ID NO: 66152 - DNA, 297 bp, Glycine max
  Peptide Sequence Number=SeqID_157837
atgtggcccaaagcaagtgccaaagcccctggaaggtcagtgcactttgccccccacgaacatacacaacatccaacgtctgaacgtggcccaaagcaagtgcaaagacccagaaagaaaatcagcatgcaacagggacaagcagatattctcatagctaggttccctgaccctaactatggtgtcaaaacggtaaattttataataactcccctcacctatcgtgagctctccgtcagttcttctttgcgtcacttagaggtctctctctcgttcgctcttgtcggtccaacgtaa

SEQ ID NO: 66153 - DNA, 435 bp, Glycine max
  Peptide Sequence Number=SeqID_157838
atggattacgcgatgatgggtgttaagtgtctcaaagtgatcaaccaaggtccacacaccgacaacaattgtccccgaacgaaattacgagaagagtctttgcacgtcatcggacttgatcgtctctgggtgacaaagacttgtttgtctctggatggtaaaagggacttcgatagtctttggataggaagggtgcagacgaccatatgttgtctccacgtgtcatcggacttgctgtctctggatgacgaaggtgcgaataaccatgaggtatctccgtatgctattggaccctcgagtcacgatagcagaattgtgtgtacggataaccataaggtttgcatgctatcggaccctcgattcacgatagcaaaggtgagacttttcgcggtctcgaccggaagacgccgacatctccgggaaggatgcagatga

SEQ ID NO: 66154 - DNA, 414 bp, Glycine max
  Peptide Sequence Number=SeqID_157839
atggaaatcatatcgaagtggtttgaagaacttgatgtatgtggcaaagttactctaaagagtaaacttcgggaaattgtctaccctaaccaaaactctatgtgtgctcctccagaaaaggtcaaaacaaaagtatttcttcagtcaaatgtagtgcataatcatctgagcaagaaaaaccatgaaggactatgccgatcttggatcaatttcatccatgcattcatgattccattgaaaacattgttgatgtcaaaactaatgattcatggtctttggtgcgcaaccatttggttaaagaacttgcaaaatggtctaatgagtatatcaaccagcttgatggcaaacaaatttaaggaattaaagcggtctctacttgttgatggattatccatggttaccatggataagtga

SEQ ID NO: 66155 - DNA, 894 bp, Glycine max
  Peptide Sequence Number=SeqID_157840
atggctccgaaaaagctttccacgaagaggtctagaaaggaggccgcaggagaaggctccagtaccgctttggaatttgatagtcaccggtttcagggcgtcgagcaccagcagcgcttcgagaccatcaaaggatggtcgttccatagagagaggcgcatccaactcagggaggatgagtatacagactttcaagaggagatagctcgtagacgttggacgtcgctggtgactcccatggctaagtttgaccctgagatagtctcaaagttctacgttaatgcttggcccacagaggagggagtgcgagacatgcgttcatgggtgaggggtcagtggattccctttgacgcagatgccctcagccagttcctgggtgacccgctagttttggaggaaggccagcaatgtgagttcagccagaggaggaacagagctgacgggttcgacgaggaggccattgcccagctgttatgcacaccggggcaggatttcgcccggaccgctgcagggaggtctctgccaatccttcagagttcaagtcaccccagcaaagtgatccgaccaccgatcacccaagtcttcattaagaagtactgcacgcctaggcaggcacagggtgacgcacctcagggtgtgggcgcaccgccaccacctcgacaggctgatccggctaagccactgggcgtggagcggtatctacagcatttggttcgccagcaggcggccaaccaccgcggacagtttgcggctgaggtcgcattgccgggagactggcccgatgcccaggcaggggaggagcctgcaggatcgcccggtaagatggatgaaccctgcatggacgaggatatgactgacctgttcgatttcttgggagggagcggagccacatga

SEQ ID NO: 66156 - DNA, 309 bp, Glycine max
  Peptide Sequence Number=SeqID_157841
atggatgactggagtattccagaaatccctcgggacatattagatattaggcacaacaaattcaaagattccttaataggaacggtagaaacaagcttagaacaaggtccagtctatttcaattgttacccaaacaaaacaatgagtctgatggatagaaaccttcttgactctctgttcctaaacatccactttcatgggcttgacatgaaggaaggatcaatcccagctgcattaatatataggattcagtacaaggtcatgaacacttgtgcatcacgagtccttctaaaaccacaaagaggatag

SEQ ID NO: 66157 - DNA, 618 bp, Glycine max
  Peptide Sequence Number=SeqID_157842
atggtccatgacatcttcgtcaaggtgaaattggaagtaacaaggacattaatagtcctaaatgtgtttggtagtagacgaagcaatgatgtaacacaatcaatcttttgccccaacttttgcaaggtggttacttccatacttcaacttgactcgatgaatcttttcgtaaaagcacgagcttggttcaaccccataacccagggaatggcaattttgatcgccaatacttcaacaacatttcatagggatgaaagattcgggaatacgcatgctatttttgtagaggaaggcacaaggatcatgtatgagcaaacatgtagaacaaaaagacacgagagcccgaaaatcatctctccttacttgcgcatttgggggcgtagtgccccatgtgtgcagttaagaagacgatatggatcttccgacttcccacgacaaaaggcgagacccacatacaacgcatgtgcgatggtatcatcactcaagataataatattgtggcggtatggaataccagcaacaacacatttgtcataccctaatttcgtccggggacctttgcttgatgacatgcgacctttctttggtccttgtgaggtgcttggcacccatcattag

SEQ ID NO: 66158 - DNA, 378 bp, Glycine max
  Peptide Sequence Number=SeqID_157843
atggggttcaagtggaccctgagaaaatcaaggccatccaagattggctcaccccaaaaagtgtgggagatattaggagcttctacagaagtaacctcctttgggtatcgtaaagatcggaatggacaatggctgaagaaggatgcactccctcctcaagatgaacgtactccttcacctccccctcaacgtgaagattccgcactcatgaatgaagtcctctccgaattacggggtcttcgttcttatgttggtgaccgcttcgactcgttagattcacgctttgccggtatggacattcgccttacacagcttgaagaggatgtcggatacattcgtcagagttttgatcttcctccaccacctccatcttcttag

SEQ ID NO: 66159 - DNA, 315 bp, Glycine max
  Peptide Sequence Number=SeqID_157844
atgtcttgcccagcgatcataactccgacctccctctgtcgaagtgtcagctggtgtatgccacctaccaggcaccctctagaccccgataagtctaacagggccctggggtttctagcgttgatcacgggtctctgtcagtcattcaaggttcccgtcacacctagtaaggtgattcgaccgccgatcacccgggccttcattgagaagtattgcacgtgtagagtttttgtttggattgttgcattagtgcttacttcgttattgtcgataatgtttgttgaaattccggaaccgtgtagagttttcatttag

SEQ ID NO: 66160 - DNA, 417 bp, Glycine max
  Peptide Sequence Number=SeqID_157845
atgctgggagaccttaaggtggcaacacaagggagtgacccagatgcctatgttgactgggagatgaagattcagcatgcattctcatacaatgattatcctgaagagcagaagggttatgcgaaagaggacaaggagatggagatggctctagtgagagccaacattgaagaggacaccaaagcagtgcatgatggcttcaccaacaagatttctttccagcaccatgaccagaaaattattcttaaacctcaatccctgaaagaagtgtgtgatgaccaaatcagaatgagagaaaagagagaacaagagaaagacaatagtgaggcaccacagaggaatagaaaaaggaagagtgatacacttgagagatggagtgatacacaagggagagaaagtgatacacaagacatttga

SEQ ID NO: 66161 - DNA, 1893 bp, Glycine max
  Peptide Sequence Number=SeqID_157846
atgattcagcacggccaggtcggggcgattttcaatacggtaacgcgtccggatatccgcgccatgcaggatcaggtcatgcagctcagccgcctgaaggtgccgctgttctttgcctatgacgtggtgcacggccagcgcacaatttttccgattccgctcggcctcgccgccagctgggatctgcaagccgttagcgaagtgggacgcatctccgcctatgaagcggcagacgacggtctcaacatgacctgggcgccgatggtggatgtgtcgcgcgaaccgcgctggggccgcggctctgaagggtttggcgaggatacctatctcacctcgcagatgggcagtgcgatggtcaaagccatgcagggcaagagcgccgccgaccgctacgccatcatgaccagcgttaagcactttgcagcttacggcgcagtagaaggcggtcgtgattacaataccgtcgacatgagtccgcagcgcctgttccaggattatctgccgccgtataaagcttcgctggatgccggcagcggcggcgtgatggtggcgctcaattcgctgaacggcacgccggccaccgccgacagctggctgctgaaagatattctgcgcaacgactggaaattcaaaggcatcaccatcagcgatcacggtgccatcaaagagttaatcaaacacggcgtcgccagcgatccgcaggatgccgtgcgcattgcgctgaaatccggcatcgacatgagtatgagcgacgagtattacagcaaatacctgccgggactggtgaaaagcggcgcggtgagcatggcggaaatcgacgatgcggcccgtcacgtgctcaacgttaaatatgacatgggcctgttcaacgatccgtacagccatctcggaccgaaaggcagcgatccgcaggacaccaatgcggaaagccgcctgcaccgggcggaagcgcgcgacgtggcgcgccgcagtatggtgctgctgaaaaactggcatgaaaccctgccgctgaagaaagaggccaccgtggcgctggtgggaccgctggccgatagccagcgcgatatcatgggcagctggtcggctgcgggcgtggcgaagcaatctgtctcgctgctgcagggcatgcgcagcgccatggccggcaaaggcaccgtgctgtatgccaaaggggccaatatttctgataacaaaggtatccagaacttcctcaacctgtatgagcaggcggtcagcgtcgatgcccgttcgccgcagcagctgattgacgaagcggtcgcgcaggcgaaaaaagcggacgtggtagtggcggccgtgggcgaggcgcagggcatggcgcatgaagcgtcgagccgcagcgacctggtgatcccgccgagccagcagaagctgctggcggccctgaaagccaccgggaaaccgctggtgattgtgctgatgaatggccgtccgctggcgctggtgaatgaggaccgcatggcggatgcgatgctggagacctggttcagcggtaccgaaggcggtaacgccatcgccgatgtgctgttcggtgattacaacccatcgggcaaactgccggtgtcattcccgcgctcggttgggcagattccgatttactacaatcatttgccaaccggccgtccgtacaatttcgagaagccgaacaagtacacctcgcactactacgacgcggtcaacggtccgctctatccgtttggttacggtttgagctatacccagttcagcgtgtcgccggtgaagatgtctgcccagaccatgccgcgtaacggcacggtggaagccagcgtgacggtgacgaataccggcaaacgcgatggtgccacggtggtgcagctgtacctgaacgatccggttgccagtatcagccgtccg

SEQ ID NO: 66162 - DNA, 1740 bp, Glycine max
  Peptide Sequence Number=SeqID_157847
atgaatcccttttccgttacccgcatccacgatcgggtaaatttcatggtgtcgttaaacttcaataacggaaaaacggcgcaacaatggcggtcgattgattgcaaacagggcaaagcacagctcctgtataaggatctgttaaatgataagggcttaaccattgctcgttattacggtaacagctatctccggtacgcgcctgcacaggatgatcagcaaattaccgcagacgatattcataaggtgtgcaaactccccataaaagaggctcagtgggaaaagttatcagccacgtctgaaatcggcaccaccaaactggtcgatgtgaatagcattcaacacactggcgatattttatcggttcgtctgggatatgattacgcagatatcatctgggaaccgccttacgatgcgccgctgggattaaaaacagaacactacctgtacaactgtaaaacccatcagggtgctgtaattgctgccatgaatttcgacagcgaggggcgcgttacagattcactcatcactgctgaccttgttcgccgcaagagtagcttcaaaattgatactcagatgacacaacgtttcgatcagctctgccagttacccgcaggaaaaaagtttaccgctgaagggcattttgtgtccgctgcgaataagccagcatccacgttgatggggccattaatgcctgacctgagtaaaaataattcgcagtggctggataagtattctctttctgctgaaattgaacggcagggacaagcactgattaaccccagggcgctgccacgcttcaaacaaatccgttataccgaagtaagcacgctcggtaaggttgaagtgcagttggatgcacagccaaatggttatgtacgtaagctggaagattacggtatctggaaggtgcaacgtttgacgctggctaatcagttgcagcttaagttcaccatgtccatcagcacaggcgcatcactccttaataagttgcagacggatctgcgttttccgctagtaacgggtcaacaatatcaggcgcaatgggaaagtattgactccgacaagaaaattacgtcttcagggttacgctgcaaggtcacctcgatgggagacgcaaagagcattgcagatgaatttagcggcaaatatctcttagtcgagtgtcagcaaactgattcaggacaagcgggtagccgtgtcagactcgcctggctgcaggatctcaatgtgttcgtcaccgttgctatgcaggtaggtgataagccggaaagcctggtgaaactggaaaatgaagtgaaagccagatttgctcatgtcgtggccaatgagtacaacgactgggaaaaatggtttcaaattgagtttgaatatttccttttgaatgagaagggttttcacaccagaagggagttgaaggcgaaatctgatcaaagaagcaaactcaatcgtttttacatgtttgtcgatttgatttttagaaaacctaatactgcaaaggatcagtacatctaccttgaatttaagcgggcgatgaaagcgacaacgttagtcaaaggaatgttgcacgacatatccaaagtgaattcaatcgttaaatcacactacattgagactgaaattaagcagcgttcattttggaagagatcaagcaatactccaaaagctttcacgaaccggtgtatctatgctcgtgccggggcgcatcacattatgatgaatgcccaaaaatcggcgtag

SEQ ID NO: 66163 - DNA, 393 bp, Glycine max
  Peptide Sequence Number=SeqID_157848
atgattaagcagggtttattggggatgatcgcattcgcgatgagtgtcggggccgtgcaggcagcggacccggtcaaggtaggttccaagattgatactgaaggttcgctgctcggcaacatcattctgcaggtgctgaaccagcatggggtaaaaaccgtgaataaaatccagctcggtaccacgcaggtggtgcgcggcgcaattaccgccggtgagctggatatctatccggaatataccggcaacggggcgttcttcttcaatgatgagaaggacgcggcgtggaaaaacgcgcagcagggctatgagaaggtgaaaaagctcgatgcagagaaaaatcatctggtgtggctgacgccagcaccggccaacaacacctggaccattgca

SEQ ID NO: 66164 - DNA, 405 bp, Glycine max
  Peptide Sequence Number=SeqID_157849
atggccccgaggaaacttgcctcaaagagatccaggaaggataaagcggccgaaggaactagttccgctcccgagtatgacagtcactgctttaggagcgctgaacaccagcagcgcttcgaggccatcaagggatggtcatttctccaggagcgacgcgtccagctgagggacgatgagtataccgatttccaggaagagatagctcgccggcggtgggcatcactggttacccccatggccaagttcgatccagacatagtcctcgaattttatgccaatgcttggcctacagaggagggcgtgcgagatatgaggtcctgggtgaggggtcagtggatcccgtttaatgtagatgctatcggccagctcctgggatatcctttagtgctggaagagggttag

SEQ ID NO: 66165 - DNA, 767 bp, Glycine max
  Peptide Sequence Number=SeqID_157850
atgctgccgggcaaagatggcatgacgctgtgccgcgatttacgtgcgcactggcagggcccgattgtgctgctgacctcgctcgacagcgacatgaaccacatcctggcgctggagatgggcgccaatgactatattctgaaaaccacgccgccggcggtgctgctggcgcggctgcgcctgcatctgcgccaggcgcacgtggccaaaccggaagccgcacctgccgtgcagagctcacaaaaggtgctgcggttcggttcgctcaccattgatgcgctcaaccgtcaggtgatcctgttcgacgaacccattaccctttcgaccgccgattttgacctgctgtgggagctggcgagccacgcaggagaaattctcgaccgtgacgcgttgctgaaaaccctgcgcggcgtgagctatgacggcatggatcgcagcatcgacgtcgccatttcacgcctgcgcaagaaactgcctgggatacccgctcctgatgagaaagctcttcattcagttctatctgctgctgttcgtctgcttcctggtgatgacgctgctggtggcgaactgcgtgagatcccgccgcgcgactggaataaaactatccgcaacctcgatctcgatttatccttcgagctgcacatcgaaccgatgagcaaatatcagctggacgaagccgacatgaagcggctgcgcgccggtgagatcgtcgcccttgacgatcagtacaccttcctgcagcacatcccgcgcagccactatgtgct

SEQ ID NO: 66166 - DNA, 264 bp, Glycine max
  Peptide Sequence Number=SeqID_157851
atgagagaaagaaagagtgagacacttgagaggaaaaagagtgaaacacttgagaaggaaaagaggggaaagaaaaagagtgaaacacttgagagggaaaagagagaaaacaaaaagagtgaaacacttgagggcaaacaactttgtttagcaacaaaaagggagttaatgagggattttgatgatgtgatcctgattaggagcggatcgcttgatacaggctacggagatttggatgacgccacttccagtgaaggaagataa

SEQ ID NO: 66167 - DNA, 552 bp, Glycine max
  Peptide Sequence Number=SeqID_157852
atgtcacggaacttcacggattatgcaacaatgcttccttttgacttccggcatgtcacggaacttcacggattgcctaacgatgggtgtcaagtacctcgaagtggtcaaatgagggtcgcatcccaacaaacagatggtccccggacgaaattagggccgaaagtcatccttctatgggcaaaagtgccgaaaggccaggtgaatgtggcgttcaagcatctgttcaatgaatggcaggggaaaatggtcctttttggtaacttggttcagcctcctatagtcaatgcagactctccaactgttctgcacccgagtaggaatcagctcctccttctcatttttgatcacggtgaggccgattttcttcggaactacctagatgggactcaccttcttactagtttagcctcatcctctaaatttattcgatgcatacatgtggatgggctaataccaggaatgtccgccagggtccagcctatagccttcttatgcttcttgataactgataacaacttctcctcttgctcatcagcaagggaggcagat

SEQ ID NO: 66168 - DNA, 1311 bp, Glycine max
  Peptide Sequence Number=SeqID_157853
atggactgtttcgatgaggcgaatggggagcttgaaaatgttgtgagtgttgggtgtagtgaagagggttctgagaaagaggcaaagacagatattggtgcaattgaggatgctgtgaaggttcttttgcttgcgcttggggaagatatcaacagggaaggtcttaggaagacaccacttcgtgttgccaaggcccttcgtgaaggaaccagagggtacagacaaaaagtgaaggacattgttgaaggtgctttattccctgaagccggtctagaaaacaatagaattggtcatgcaggcggcacaggtggacttgtggttgtccgagatcttgacctttattcctattgtgagtcttgcttgctaccattccaattcaagtgtcatgtgggctatgtcccttctggccaaagagttgtgggtttaagcaaactctctcgagtggttgatgtatttgctaaacgactccaggagcctcagcgtcttgcagatgaggtttgttcagcattgcatcaagaaatattgccagcaggttctgggatttttgaaaacaaaagtgaagatgcatggtctgatttcttttgccttctaagatttagaggtatcaaaatagaaaacattcatttgagaggatcatctgaccaatgctggtgtccatctttgactgctctttctgctaaagtttcctccaaaattgtaccagtcaatcccgcaatggtgactgcagtatcttcaatccttgattctctgggagaagattcattaaggaaggagcttgcagggacgcctagtcgatttgtgaaatggctattgaacttccaaagcattgacatggatgtgaagctgaatcgttccctttgtgatggaatagatactttaaacctcgatagggaggttaacttcaatgacagacaaatacattctgagttgaacttgccattttggtcacaatgtgagcatcatatacttccatttcatggtgttgttcacataggatacttcctttcagaaggatctaatcccattggaaaatcccttttacagtctgtagtacatttttatggtttcaaactccaggttcaggaaaggcttacaaggcaaatagcagaaaccattgcaccactattattaggtggacatgtaatagtagttgtagaggcaagtcacacatgtatgatttctagaggaattgagaagtttggaagtagtacagctaccattgctgtattaggtcgcttttccactgacctcgctgcaagggatgcattcttgcagtgtgttgcaagtgctacaacttctggggggcaatag

SEQ ID NO: 66169 - DNA, 177 bp, Glycine max
  Peptide Sequence Number=SeqID_157854
atggccataactgaggtccatgaagctaagcgccagtcatggcagctaagcgagattcattgcgacaatgcattctcgaaagaactcgctaagcgcgcttaccatgctaagcgagttcatcctttgaggatgaacactcatcctcttgttgagctacctgtggctaaactaggctga

SEQ ID NO: 66170 - DNA, 303 bp, Glycine max
  Peptide Sequence Number=SeqID_157855
atggaggaaacttctgtggtagatgcaaggcacaaggaagaggatggggaggaagaacaagaagaaaataagcaagaagagcaacacaaactagatgttaatggtgtgcaagatgaggattcggtagaccaagaaactgaagaaaattctgaaaatgtaacgacacaagtggaaggcgaacaacataatgagaaatttggtgaagagaatgacaatatagacaacaaagagaatgaggagaataaaagtgaaggggaggacaaggaaattggagagaataaagaagaaaagattctatcctaa

SEQ ID NO: 66171 - DNA, 585 bp, Glycine max
  Peptide Sequence Number=SeqID_157856
atgaaggttagggttcagaacagtcaagaggctaggggcgcttcaaatgcgaaagggagcgagaaggttagggttcaaaacacagtcaagaggctaggtgcttcaaatgcgaaagtagtgagaaggtggatgagaatggatgtgccattttgcactctctctccctccatgagaattgagaatagttacatatttcagattccagcactttctatcatagaccccccacatgcagaggcttcccaatcccgagttcaaccctctcaagacccagcctcgaccactacgacagaatcaacacccccagcgagtcaagacttggacaccaactcaaccaccctctgcacatgctcgctgtccaccttctccttcgcacactacaccagacccaacctgtaccagatccctctctcccccaactcccacgcacttgtctgcatgcatcccaacacctcgaatgatgtgtacgatgacattccgcacacgcccttcagagtgttgatccgcctcttgtcaaacacaatgcaagttggtctcaactctctcgtgacaaagtgcaagtttcctactaggttactgttgtaa

SEQ ID NO: 66172 - DNA, 180 bp, Glycine max
  Peptide Sequence Number=SeqID_157857
atgactggccatatgacaatgattgacatatggactgagcttctagaatatccacaatgtgataatagtgagaagatgtttgacataaagggacaacttcaacttaggaataagtgggaaattgtcttcattgataatgaaggggatatcatgcttgttggtgatgatccatggctgtga

SEQ ID NO: 66173 - DNA, 219 bp, Glycine max
  Peptide Sequence Number=SeqID_157858
atgattcgaacagatgtaatggattgccccaacacccaacaaaaattttcaataatagtgtcaagagcgctaacaaaccctacatcgttttgtacaaacggtgcagtgctgctgtgttttctactgcaattggtgctctatgcttgtgatgcatgtcaagtaatccctaagccactaacgttttacatagaaggcgtaacatggatcaaagttggatga

SEQ ID NO: 66174 - DNA, 114 bp, Glycine max
  Peptide Sequence Number=SeqID_157859
atggttagtggaccagttactgtggaacttaatgtaaacatgcattgtgaggcctgtgttgagcaactcaagaggaagatactacaaatgagaggtaccatttttctctattga

SEQ ID NO: 66175 - DNA, 288 bp, Glycine max
  Peptide Sequence Number=SeqID_157860
atggcgcctaccagacaccctttggacccggataagtccaacagggccctgagatttcccgcattgatcataggactctgccagtcattcggagtcctcgtcgcacctagcaagttcagggcagaggtcgcatggcccggagattggcctgaggcccaggcaggggaggcaccagtagaggcacccgcagaggcacccgcagaggctcccggcgaggcagatgaggcccgcgaggatgaggagatgaccgatttgcttgatttcttgggagggagcggagccacatga

SEQ ID NO: 66176 - DNA, 2838 bp, Glycine max
  Peptide Sequence Number=SeqID_157861
atggcgtcttcatcttccaacagctactccaaggtcaacgacgtgttcttgaacttcagaggagaagacacgcgcaagactttcgtgtctcatctgtatgctgccctctctaatgcaggaatcaacactttcatcgatcacaagcttcgcaagggaacggagttgggagaggaactgttagcagtcataaaagggtctcggatatccatcgtcgttttctcggctaactatgcttcatcaacttggtgtcttcatgagctggtcgaaataatttaccaccgtagagcttatggccaggtggttgtgcctgtattttacgatgttgatccatctgatgtacgtcatcaaacgggtgcttttggacaacgcttgaaagcacttatgcaaaaaagtaagcccatcgactttatgtttacgagttggaagagtgcactcaaggaggcttcagatttggtcggttgggatgccagaaattggaggagtgaaggtgacctagtgaagcaaattgttgaggacatttctagaaaactagacacccggctgttgtctattcccgaattcccagttggattagaatcccgagtgcaagaagtaattgagtttattaatgctcaatcagacacaggttgtgttgtagggatttggggaatgggtggcttgggtaaaacaaccatggccaaagttatctacaataagattcaccggagattcaggcatagcagtttcattgaaaatattagagaagtttgtgaaaatgatagtagagggtgtttttttttgcaacaacaacttgtttctgatatcctaaatattagagtcgggatggggataattgggatcgagaaaaaactttttggaagaaggccccttattgtacttgatgatgtgactgatgttaagcaattgaaagccctatctttaaatcgtgaatggactggtacaggatgtgtgttcatcattacaaccagagatgtacgcctacttaatgtacttaaaccttatcacagagtccatgtttgtagaataaaggaaatggacgaaaatgagtcccttgagcttttcagttggcatgcttttagacaagcacatccaagagaagacttgattaaactctcaatggacatagttgcttactgtggaggactaccactagctcttgaagtccttggatcttacttatgtgagaggacaaaagaagaatgggaaagtgtgttggcaaaactaaggaaaattcccaatgaccaagtacaagagaaacttagaataagctatgatgatttagattgtgaggaaaagaatatattccttgacatatgttttttctttattggcaaggatagagtcaatgttacagagatattaaaaggttgtgatctgcatgctgaaattggaataacaatcctggttgaaaggagcctcataaagcttgaaaagaataacaagatcaaaatgcacaatttgctacgtgacatgggaagagaaattgttcgtcaaagttctctagaggaacctgagaagcgtagtcgattgtgggttcaccaagaagtgcttgatttgttgttagaacatactggaacaaaagcaattgagggcttggctttgaagttacaaagaactagtggacttcacttcaatactaaagcatttgagaaaatgaagaaattgagacttttgcaacttgatcatgtacaacttgttggagattatgagtatcttaacaaaaacctaagatggctttgtttgcaaggatttcctctacaacacataccagaaaacttgtaccaggaaaatctaatttctattgaattaaaatatagtaatattagactagtatggaaggagccacagttgctgcagaggctaaagatcctcaatcttagccattcaaggaacttgatgcacacccctgatttttcaaaactaccaaatcttgcaaaactcaatctcaaagattgtccaagattgtctgaggtgcaccaatccattggagacctaaataatcttcttgtgataaatttgatggactgtacaagtctaagcaatcttccgaggaggatctatcagttgaaatctttgcaaactctcatcttttctggttgttcaaagattgacatgttggaagaagatatagtgcagatggaatccttgactacactgattgcaaaagatacagccgtaaaagaaatgcctcaatcaattgtaaggttaaaaaacattgtttatatatccctctgtggacttgaaggattagcacgtgatgtttttccttctctcatatggtcttggatgtcaccaacagcaaatctcagatcttgtactcactcatttgggagcatgtcaacttctctaacctccatggatattcatcataataatttgggtgacatgttgccaatgcttgttagactttcaaaacttcgaagtattttagtgcagtgcgactctaagtttcaattaacccaaaaattaagtaaagttatggatgacttatgtcaagtaaaatttacagaattggaaagaacatcatatgaatcacaaatttcagagaatgccatggaatcttatttgattggaatgggacgctatgaccaagtcatcaatatgcttagcaagagcatatcagagcttaagtatgtgttgtttctgattatatcgtacgcgattcttgccatgaatgagaaaattaatttccaacttcgtaatatgatagaaaataatagaacctgtgctagagagatggatgtctggacaaccacccagacagcattagagaatgaaaaattaagaataaatccattaggattggctcaaaaaggccagactcaattcacagcataa

SEQ ID NO: 66177 - DNA, 1085 bp, Glycine max
  Peptide Sequence Number=SeqID_157862
atggatccttttgatgatgttcttgtagtggctcttacttcacgtactcggtccgattccaagtttattccaaaggccaaatcaaaacagccttctccaaaggaaataccagttgttcaccttgctaatgtcatgcattcaaaggatgtagttcataatggaactagaggtgattggaaaaattgtgtgggaaaaccagcccttcattctttcattgagatgggtgttgaggaatattttgttacaccttattctagttctattaactcttttgggaaatgcgatactactcagaacatccaaatctcaagatctgttataggaactgccttctggaataggatatcacacaactgtgagcttagctgtagctgctctcaggcacaggccatccagaagcaaaacactgcccctcacgtgttgtctcgtgggggttatgaatatttagaaaagaagttgatggatgagaagagaaagaaaaaactggaggaaactgctcaatccggaagcactgacaccgtcattgatcctccatctcctatcaaacgacacgtgaagtggaagctggcccgcaccaagaaaactggtcacatgacatctgaggcagcaaaggaaattgttgacaagattgcctcacaaggtttctttgtcacccatggatgtgatgatgtactgactgttgtcattgggcgatcagaacaccctggtcgtgtgcgtgttgcaggagtcggtgtaaccatcaagcagtactttggatcagcttcaagtacctcctgcacgtcttcctccatggctcccaaagacctgcaactgttgacgcaacaaatcaaggaccagctggaggactcaatcacagaaaaatcacagatgcaatcacagggactcgcactacctcctgaacctgaggttggtccttcagctgctcgtgttaacacaaaggagaattgtgttgatccctcagggaacggtccagacacagttgacaacattcctttgctgcatgatcaagtcaaggttggtgttgaggaggttagagatgcatatgctcccattcctgtacccactaaagaggttaaggtcatagg

SEQ ID NO: 66178 - DNA, 180 bp, Glycine max
  Peptide Sequence Number=SeqID_157863
atggaccaattaaagcgcctaagcatcccctcagaaatgcttagattctctaaccatgctagttacccacgtttgggccatccgacaaggtttttcaaaggaagcataagacatgcaatgacggttccaaagtcagaaaagatgcaaagacaagatgaaactaacaagaaacaagcgtag

SEQ ID NO: 66179 - DNA, 264 bp, Glycine max
  Peptide Sequence Number=SeqID_157864
atggatccttttgatgatgttcttgtagtggctcttgcttcacgtactcggtccgattccaagtttattccaaaggccaaatcaaaacagccttctccaaaggaaataccagttgttcaccttgctaatgccatgcattcagaggatgcagttcataatggaactagaggtaaatcatccagagaggaaacaattagagatgccatcaaagtctctataacttggccagttaatcgagattcattatccaatgggatgcagtaa

SEQ ID NO: 66180 - DNA, 336 bp, Glycine max
  Peptide Sequence Number=SeqID_157865
atggagaggagtatgattgatgctaccagtggtggagctcttggtgatatgactcctgctgagaccaggaatttgattgagaagatggcttccaactcccaacaattcagtgcaagaaatgatgttattgtccttagaggagtccatgagcaacaacaacagcaacaacaaagacaacaagcaactaaggctcctcctcaaccttccttagaagagttagtgaggcaaatgaccatccagaatatgcaatttcagcaagagacaagagcctccattcagagtctgacaaatcagatggggcagatagctactcagttgaaccaagctcagtcttaa

SEQ ID NO: 66181 - DNA, 522 bp, Glycine max
  Peptide Sequence Number=SeqID_157866
atggctccgaaaaagctttccgcaaagagatctaggaggcgggtgtggatcatgcgcaccagcatgaccaccttgacccagatgtggatgatgttgcttctcagcaatgtcctgcctagtgatcataactccgaccttcctctaccgaagtgtcagctgttgtatgccatcctgacacagatgagcgtctgtgtggctcagttgattgctgacgccctctatttatttgcaggtatgccacccaccaggcaccctctaaacctggataagtctaacagggccctgggtcagtcggggttccaagcacagggtgatgcaccgcaggccgcacatgcaccgccaccacctcatcaggctgatcctgctgggtcattaggcatggagtggtatctacagcacttggttcgccagcaggcggccaaccaccgagggcaggtgcagatacacgagtgtctctaccagctcagcctcagtcagcagggccagggttttgttccttttgtgtgccctactccagattag

SEQ ID NO: 66182 - DNA, 3129 bp, Glycine max
  Peptide Sequence Number=SeqID_157867
atggaattcgtggcttcttcttcttccttctcacagtcgaaaccttcatcatccttctcaaaatcgaaacccaaacggctgtacgatgtgttcataaattttaggggagaagacactcgagggaagttcgtttctcatcttcattatgccctctcaaaagctggagtcaacactttcattgacgacgagaacctacttaagggaatgacactgaaagatgaactgatgcgagcaatagaagggtctcagatatctttggttgttttctccaaaagctatactgaatctacttggtgtcttgatgagcttgaaaaaattcttgaatgccgcaaacttcatgaccaaatagttatgcccatattttacgatattgaaccatccgttgttcgacatcagaagggtgcttttggaaaagctttaaaatcagctgtagaaaaaacatattcaggagagcatgcggaacaagtgttgtggaggtggagcagcgcactcaacagagctgcagatttatccggtttccatgtagtagatcgcaggaatgaagctatactagtgaaggaaattgttgaggatgttctccgcaaactagtctacgaagacttgtacgttactgaatttcctgttggattagaatcccgtgtacaaaaagtaattggattaattaataatcaattcaccaaagtttgtatgatagggatatggggaatgggaggattaggtaaaactagcacagccaaaggaatctacaatcaaattcatcgtaaattcattgataaaagtttcattgaagatattagagaaatttgtcaaacagaaggaagagggcatatccttttacaaaaaaaacttctttcagatgtcctaaaaacagaggtcgatatacttagtgttgggatgggcaaaactactatcaaggaaagactttctggaaaaaggatgctcgttgtacttgatgatgtgaatgagcttggccaagtagaacacttatgtggaaatcgtgaatggtttggtcaaggaactgtaataatcattacaacaagagatgtacgcctactgaagcaacttaaagttgattctatttataaattggaggaaatggacaaaaacgagtcccttgagctttttagttggcatgcttttggaaatgcagaaccaagagaagacttcaaggaacttgcaagaagtgtagttgcttattgtggaggactaccactagctcttcgagtccttggtgcttatttaattgagaggccaaagcaactgtgggaaagtgtattgtcaaaactagaaaaaattcccaatgatcaagtacagaagaaattaagaataagctttgatggtttaagtgaccccttggaaaaggatatattccttgatgtatgttgtttctttattggtaaagacagaggctatgttactgaaatactaaatggctgtggactacatgctgatattggaataacagttctcttagagcgtagcctcatcaaagttgagaagaacaacaaacttggaatgcatcctttgttacgagacatgggaagagagataatttgtgaaagttcacgaaacaaacctggaaagcgcagtcgattgtggtttcaaaaggatgtacttgatgtattgacaaagaatactgggacagaaactattgtgggtttggcgctgaaattgcattatagcagtagagattgcttcaatgcttatgcttttaaggaaatgaagagtttgagacttttgcaacttgatcatgtacatatcactggagattatcagtatctttctaagcaactgagatgggtctgttggcaagggtttccttcaaaatacatacctaacaatttcaatctggaaggtgtaattgcaattgatttaaaacacagtaatcttagacttgtctggaagaaaccccaggttttgcagtggctaaaaatcctcaatcttagtcactccaagtacttgacagcaacccctaacttttcaggactaccaagtcttgaaaagctgattctcaaagattgtccaagtttgagcaaggactgtacaagcctaagcaatctccccagagagatgtatcagttgaaatctgtgaaaactctcaacctatctggttgttcaaagattgacaaattggaagaagatatagtgcagatggaatccttaacaactctaattgctgaaaatactgctgttaaacaagtgcccttttcaattgtaagcttaaaaagcattggatatatatccctatgtggatatgaaggattgtcacgtaatgtttttccatctatcatttggtcttggatgtcaccaacaatgaatcctctatcttgtattcattcattttctggcacttcatcatctctagtttccatcgatatgcagaataatgatttgggtgatctggtaccagtgcttaccaacctttcaaaccttcgaagtgttttggtgcaatgtgacacagaagctgaactatctaaacaattaggaacaattttggatgatgcatatggtgtaaattttacagaattggaaataacatcagatacatctcaaatttcaaagcattacttgaagtcttatttgattggaattggaagttaccaagaatacttcaatactctcagtgatagcatatcagagagattggaaaccagtgagtcttgtgatgtttctctcccaggtgacaacgatccttattggttggcccatatcggcatgggacattcagtgtatttcactgtacctgagaattgtcacatgaagggaatggctttgtgtgttgtttatttatcaacccctgaaaagacagcaactgaatgtcttattagtgtcttaatggttaattacactaagtgcagcatcctgatatgcaagcgagacacagtaatttcctttaatgatgaagattgggagggcataatgtcacatttgggatctggagacaaggtggagatttttgtggcttttgggcatggattagagatcaagaagacagctgtctatctaatgtgtgatgaatcaattgacatgaaaatggtgccttctcctgagccaaagaaagtgtcaaagaaaaatgcctttgtaagaatcataaagaaaattgtaacgagcaagattcaagagcagtag

SEQ ID NO: 66183 - DNA, 145 bp, Glycine max
  Peptide Sequence Number=SeqID_157868
atgaaggcccagaggcagaggcactaccaagactacttgatgagaatcatgaaacaggccaaatacagtctaaaggcccaagtggagaaagatgaaggcctagaggcagaggcactatgcggatcgcttgatacaggctatggag

SEQ ID NO: 66184 - DNA, 270 bp, Glycine max
  Peptide Sequence Number=SeqID_157869
atgtccaagagggagagaaacacctccaatcgatgctccaccgtgcccagattctccgctctagggttttgcgagaaacacggacatttcgccattgatgacaatgacatcattgaggtgagaacaaaggaatgggaatccatggacttcattctctacataccttgcgtatcaccgatgccgtctgcgaaagagaggctatggttccaatcaactccaagaattcacacaagtaaccacacgttgttgagttcctcggtcttcccatag

SEQ ID NO: 66185 - DNA, 267 bp, Glycine max
  Peptide Sequence Number=SeqID_157870
atggagaccaaaaggtggtcatcatgtcgcaacatgaccttttgcgggcgagcgaggcgaggctcacgggtgtgctttccaaaggaggaaagatgcgcggagtcgccaccaatgtttatttgtggaaaacgtcggaaaaaccgaaggaaactagtcaaaatgaaaattctaagttcgggagttgtatttacgtttgaggaaggtcgacaaaagcggggcttttgctcctacgtaccctccatcgaagaggaaatcagacctacgtag

SEQ ID NO: 66186 - DNA, 309 bp, Glycine max
  Peptide Sequence Number=SeqID_157871
atgatgcaatacagacataaatgtgcagatagcacgaaagaggaacgtgtagaagcaaagcttcatgatgaatcaagattgattcaaagatgttttgatgataacaaaggtgatgacaaaaagctcaaaggtcaatcaaagaatgagttgaagatgttcaagatagaatcaagaacacttcaagattcaagaggaaagttgatttcaagaatcaaggatcaagcttccaagaatcaagatcaagattcaagaatcaagagaagacttaatcaagataagtatgaaaaggttttttcaaaaactaaatag

SEQ ID NO: 66187 - DNA, 552 bp, Glycine max
  Peptide Sequence Number=SeqID_157872
atgtccaagttgagccaatctcttgatgaaaatggtagtggaagcaatattgatttggttggaggaagtttaactgatttgactttgaatgcatttgatattgataatttggttttgaatcacaatgttgaagatcacattttgaggaagagcttgaaagatgatggaaatgaagatgatggtagtggttgtgagaagaatcgcgaccccaccaacgcggaaaaggcaattgggtatgagcatggccttgttgttcccgaagtaccaattctaggctatgttcttggtactaacgacgacggcgtaggtgttggggtgaacctgaagcatgtcttttgcgaggtcaatggcgatgacgccgacgctgcagcccatgccgccaaggttgaagcttttggcattaccgcagagcttgtacttgttgacgatcatggaggagagagaaggggtggggttgaagaggttgcagttgacgacaaggatgccaatgtctttggggttgacaagggagaagctcggatgagagagatggtgtcgaagaaggagggggtg

SEQ ID NO: 66188 - DNA, 195 bp, Glycine max
  Peptide Sequence Number=SeqID_157873
atggaggctggatctttgagcttcaatgtgcggaaggcaaaagagaagaggagaggggggcaccatccactagggaataagccatggaagaaggagctttaccaccaagaatgtgccttggataagaagcttgaagatgatgctttaatggaggaaaagaaagagagaggggggagcacgaaattgaaggaataa

SEQ ID NO: 66189 - DNA, 1215 bp, Glycine max
  Peptide Sequence Number=SeqID_157874
atgaagaagatccaaggcctacaagctccacatggagctacatcagtaaggggttccttcgcactttggcaaggcttttgggtccttttgcatcacactttgccatgccatgtaactgttactcacttgcaagtagcaattgctgaatctccaattgtaaaagctctgcgagtgttcacttccgccacctgttcgaccattggcctcacccaaacccaggttgaatttgaagatgataaaaacaagtgtagtgatgctgctgagcttttgagcaaatggggttgtagtgatgatgatttggtgagaatattctcacgttgcccctccttgcgcaatgctgatcccatgcaggttcagtctaaactgtgcctgctgagtgatttgggcttgtgtgcatctgaacttgtaaagattgtcaattgtaggccacggtttttccggtctcggattaatagttgcttagaagagaggatggcgcatcttacatcattgtttgagacgaaagaagtgcttcagaaggcaattgtgaggaacccttcgttgctgctatctgcgggtcgctataatgtgaaggcaacagttgagctctatgagaagttgggtgttaagaaagaggacttgattcagatgctccttttgcggcccacggttatttcgaggacttcctttgatgctgagaagctggaatatttaagcaagactgggcttactaaggattccaagatgtataaatatgtggtgacattaataggagtctctcgcgtggaaacgattcgggataaggtggcaaatttcgtgaaatttgggttttccgaagaggagatatttggtcttgtggggaagtctcctaatgtgttgacattgtcaacggaaaaggttcagaggaacatgactttcattttgggaacgatgaagcttgatgctaagatggttctaaagctgccgtatctcttatatgccaatgtggatactgttttgaagccaagagtgcttctagcattgaagatgcaagatatggatgcagagttgcaaatcatgggaccaacgatcgtaagctcactgaggatgccagagcagagatttttaaagttgtttatccaatgccatgacgaggatgttgcaaatcaattgatggaattctataaaaggacaaaagaggtgaagagattaggagagtcatcaaagaagtacagtaagagtggattccctttctga

SEQ ID NO: 66190 - DNA, 288 bp, Glycine max
  Peptide Sequence Number=SeqID_157875
atggggagtctttgggaaaatattgataaaaaaaaggaaaagggaggtatacaattaaatatggaagctgggttagtaaaaaagaacccaaagcaacctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 66191 - DNA, 342 bp, Glycine max
  Peptide Sequence Number=SeqID_157876
atggcgtcttccaaaaaaggagaacgcgggggagtcaccaccaacatttatttgaggaaaacattagaaaaaccaaaaagaaggtctgccaatttcaaaaagaagggttcagaaaaagaggtcgttaaggcgttggaccttgaacaatctcaagtgactttaatgaagatagtggaagcaatgccttccaagattattttgatgatgccaaagaatcaagagttaagcaaattccaaagattcaagaatcaagtttcaagtttcaagaatcaagattcaagaatcaagtttcaagaatcaagattcaagaatcaagtttcaagaatcaagattcaagaataa

SEQ ID NO: 66192 - DNA, 903 bp, Glycine max
  Peptide Sequence Number=SeqID_157877
atgtctaccgtcatggagctatgcagtaccatgggagcttttgatgaagatgttgaagttgtctacctcagagctttctcattctccttgacagggttcgatgaacctttatgtgaaacatgggagagattcagatctttactgtggaggtgcccaaaccatagttttgatgatgctgcacaactacaaattttctacaatgttttgagacctcagacaaagatgattcttgatgccttagctggagaggccttaacaaaacagatagaccaagttcctcaacaattttcgcaaggtcgatcacagaaaacgcaccaagcttatcaagttcaacaagttctaagatgtgatttctgtggtggtgaccatcggaatgggcactactcaacacctgatgattgccaacaggaagatgaggcccattatttgcataatcaaactagacctcaacataactttcaaggaaattaccaaggctacaaaggtggcttaggttcaaatcagccttatggctggaggcagcaaaataataatgcatattttggtcctactaactcttcttatgttaacccaaaggaacaatgcaaaggaattataacaaggaggggggctgtggatggtttgaaggatgatggtgagaaaaagaaaaatgaaggagttgtggaaaaaaatgatgaaaaggaaggagttgaaaaagaaaaagagaaaaatgatgaagtggtgactaatgaagaagtggaagagaaagtgattaacattcctttttctgaggaattggagcatatgccaacatatgctaaattcatgaaggattttcttacaaagaagagaagaattatggatgatgaaacagtggagctggaggcaggttgtactgcaattattcagaaatctattccatag

SEQ ID NO: 66193 - DNA, 135 bp, Glycine max
  Peptide Sequence Number=SeqID_157878
atggataagaccttgaagataagagaagatgaatggagggagagggagagaaggagcacgaaatttggtgcctcaaaagagcccactaatccaaaatcaagtccaagattctccactaagtcaagaggtatgtga

SEQ ID NO: 66194 - DNA, 138 bp, Glycine max
  Peptide Sequence Number=SeqID_157879
atggagcccactacatgttggggcttgcattgctacagagacaagaatctgccaagggaatcaaagaattggagaagtgaatttaagaacttcatacagttgagaaatgtcacagcacaacccaaaaataagcaataa

SEQ ID NO: 66195 - DNA, 3057 bp, Glycine max
  Peptide Sequence Number=SeqID_157880
atgtcgtcttcatcctcccagatcatgcagtacgacgtgttcttgagctttagaggaacagacattcgtagtggtgtcctctcacaccttatagccgctctctcaaatgcgggagtcaacactttcgaggatgaaaagtttgaaaggggagaaaggataatgccctcactattgcgagccatagcagggtctaagatacacatcatccttttttccaataactatgcttcatctaaatggtgtcttgatgagctggtcaaaatcatggaatgccatagaacttacggcaatgaggttttacccgtattttacaatgttgatccatcggatgtacgtaatcaaaggggtgattttggacaaggcttggaagcacttgcacaaagatatttattgcaaggggagaacgatgtgttgaagagttggaagagtgcactcaatgaggcagcaaatttggctggttgggtttcaaggaattacaggactgatgctgacctagtggaagatattgttgaggacatcattgaaaaacttgacatgcacttattgccaattaccgattttccagttggattagaatcccgtgtgccaaaactgattaagtttgttgatgatcaatcaggcagaggttgtgttatagggatctggggaatgggtggattgggtaaaacaaccattgccaaatccatctacaatgaatttcgtcgtcagagattcaggcgaagtttcattgaaacaaataataaagggcatactgatttgcaagaaaaacttctttcagatgtcctaaaaacaaaggttaagatacatagcgttgccatggggatatctatgattgagaaaaaactttttgcagaaagagctctcattatacttgatgatgtgactgagtttgaacaattgaaagccctatgtggaaattgtaaatggattgatcgtgaaagtgtactcatcatcacaaccagagatttgcgcctgcttgaagaacttaaagatcaccatgcagtccatatatggaaaataatggaaatggacgagaatgagtcccttgagctttttagtaagcatgcttttagagaagcaagtccaacagaaaactggaataaactctcaatcgatgtagttgcttattgtgcaggactaccactagctcttgaaatccttggatcttacttacgttggaggacgaaagaagaatgggaaagtgtattgtcaaaactgaagaaaattcccaattataaagttcaagaaaaattaagaataagctttgatggtttacgtgatcccatggaaaaggatatattccttgatgtatgttgtttctttattggtaaagacagaacctatgttacagagatactagatggctgtggactacatgccagtattggaataaaagttctcatagagcatagcctcataaaagttgaaaagaacaaacttggaatgcaccctttgctacgagatatgggaagagagatagtttgtgaaagttcaaaaaatgaacctgggaagcgcaatcgattatggtttcaaaaggatgtacttgatgtattgacaaacaatactgggacagaaactattcagggattggctgtgaaattacatttcaccagcagagattccttcgaagcttattcttttgagaaaatgaagggattgagactgttgcaacttgatcatgtacaactctctggaaattatgggtatctttctaagcaactgaaatggatctgttggcgagggtttcctttaaaatacatacctaacaactttcatctggaaggtgtaattgcgattgattttaaatacagtaaacttagactactctggaaaacaccccaggttttgccgtggctgaaattcctcaatcttagtcactccaagaacttgacagaaacccctgacttttctaaactgacaagtcttgaaaagctcattctcaaaaattgtccaagtttgtgcaagggctgtacaagcttaagaaatctcccaagagaggtatataagttgaaatctgtgaaaattctgatcctatctggttgttcaaaaattgacaagttggaagaagatatagtgcagatggaatccttgacaactctaattgctgacaatactgctgtgaaacaagtgcccttttcaatagtaagctcaaaaagcattggatatatatccctttgtggatttgaaggattatctcgtaatgtttttccttctatcatttggtcttggatgtcaccaacaatgaatccgctatcttatattggtcatttctatggcacatcatcatctctagtttccatggatatacataataataattttggtgatctagcaccaacgtttagaagcctctcaaatcttcgcagtgttttggtgcaatgtgacacacaaattgaactatctaaactatgcagaacaattctggatgatataaatggttcagattttactgaattacgaatgacaccatatatatcacaattttcaaagcattccttgaggtcatattcatatttgattggaattggaactggaactggaacttaccaagaagtcttcactactctcaacaatagcatatctaaggaattggcaaccaacgtggcttgtgatgtttctctcccagccgacaattatcccttttggttggcccatacaagtgagggacattccgtgtatttcactgtgcctgaggattgtcgcttgaagggaatgattctatgtgttgtatatttatcaacccctgaaatcatggcatccgaatgtctaattagtgtcttgatagttaattacacaaagtgcaccatccagatacacaagcgagacacagtaatttcctttaatgatgaagattggcagggcataatatcacatttgggacctggagacgaagtggagatttttgtgacttttgggcatagattggtggtgaagaagacagctgtctatttgacgtacggtgaatcaattgacatggaaatagagccttcgcccgagcaaaaggaaaatgccctcattagattcataaagaaaattgtaacgtgtgacttctggtaa

SEQ ID NO: 66196 - DNA, 753 bp, Glycine max
  Peptide Sequence Number=SeqID_157881
atgggtccaaacgcggcggcggcgaaacaagcggagaaactccgaattgacggcaacacttacttcaaaaaagaccgtttcggtgccgccatcgacgcttacaccgaggcgattacgctgtgccctaatgttccggtttattggacgaatcgcgcgctgtgccatctcaagcgcaatgattgggagagagtagaggaagattctcggaaggcaattcagttggacagcaattcagttaaggctcattgtgaccaatctccttgtgatattgtagttccttttgttgtatacgcattggctaataattcttcgcctgaaaatgaacggcaagtaggaggcggcggcaaaccattggctaaaactctcacaggaactcaaagcagccatgagagtgcagcaaaaaggacaaacaaacagtatctgcaacaaaagaaagaagctggaaaaatgaatggggacgtcgagggaggtggaagtatgccgacaaaggtactgtcaggcattggagaacaattggtggatggtgatgctgatggtggggtcaccgaccgaagtggtgatcggagcagcggtgggtccactggaatgcggaaaaaggaaaaaggtcgcgggtatagagaagctgggagaaatgtgaaagaagttgctagaaaaggagatagggtttatcggaagagggtagcgagcaaaagggctcatcaaggacccactgtccttggtgagggatggtttttccttattccttcaacctag

SEQ ID NO: 66197 - DNA, 270 bp, Glycine max
  Peptide Sequence Number=SeqID_157882
atggatggattggtgagttacggagggagaaggggcattgttcgagaattttcccagggtttgaagggagaagggtggcgcgcggttgacacaaatgatgcaaaagcagtgcgagaaggcgcggttgacacaaatgatgcaaaagcagcgcgagaaggcgcggaggaagaagccggttgttgcggtgagaagaaaggatttcgggagcacaagggagatgaagaggttacacccaaagttaaagacgaagacttactagttgatttgtga

SEQ ID NO: 66198 - DNA, 339 bp, Glycine max
  Peptide Sequence Number=SeqID_157883
atgaaatatttttccccagagtttttgaaggcaaagtgcttaatgaactgtgaagtttcattgattcttgagcacaagtatgagcagcttcaacagacatctgatgatcccatgaatcaaatttctcaggtatttgaaaagtcactgcagtatgtgaaacgtttcagtcgctataaaaatcctgatgctgtcagacaagttcgagaaattctcgcaagatatcaattggctgagtttgagttgtgtgtccttggcaacctttgcccagaaactgtggaggaagctattgctatggttccatctatcaaggaaggaaatagaggatttaataaaaagtaa

SEQ ID NO: 66199 - DNA, 360 bp, Glycine max
  Peptide Sequence Number=SeqID_157884
atgtcattaattgacgtacttatgtatgcttttttgtcattgttccaaacacttacaggaaagcgaccacggtataaggtagatggtggatctaatgttgagaatttaagcttgcagaacattgaagctcgaatcagaatggtgctagctttcatgttaccatcactcttaccttgggttcacagcaaacctgggttttatcttgttttggggagctccaatgtggatgaagggttacgtggttacttgaccaaggcgagaaacgatgttgaaagaacaagttactacatcgatgttggtgtaggaaacgatgtagaaagtgcaggttactacatctgtgcctccaccaaaacgatttaa

SEQ ID NO: 66200 - DNA, 279 bp, Glycine max
  Peptide Sequence Number=SeqID_157885
atgacctatatcttgcacttgattgctagtatgatatttttcaataaaagctcctcgacttatgtccatgtcgcctaccttttatacctcagcaacctaactgttttccacaagtacgcatggggagtagctacaatagtgtacctctatgaccatcgctctgttggctacaatgaggcgaaggcttacaatgttgatggtccactagccactagatggaagccattgagaggttttgggcttgctttgccggtcagggatagactagatgacctatag

SEQ ID NO: 66201 - DNA, 402 bp, Glycine max
  Peptide Sequence Number=SeqID_157886
atggaaattccaagagaagctagagatgaggaagtagcaaaccactatggaattgcaagggagaaattgaacaacttgctagctcaagaaaatgcctattggaaacaaaaggctaaggacaacttgggaaatgtcgattctaagagtgataatggaatattacttgggtactttgaaacatcaaaggcatatagagtatataaatatagaaccttagtagttgaaaaagctatccaagtgaagttcaatgacaccaagcctaataaggaattatcaaaactgaatgagttctttgcaaatttaaggctggaatatggaatcaaaaactttgtgtcatctaggcacaacatagaaactgcagcatctaatccaccactagactgtcctcaagaaaagatatag

SEQ ID NO: 66202 - DNA, 423 bp, Glycine max
  Peptide Sequence Number=SeqID_157887
atggatgatacaaaagagattaaggctctaatgcatccaaccacatatcttggattggatgaagaatcaaagaatatggacagaacccaatatgcaatgattggccctttcctatatctcactgcatccatacctgacatcatgttcagtgcaatcaattcgtggggctccgaactcgatggtggaggatgcatgaatgacaatcaattcatgaggctccggataagattcgttggtggaggatgcacgaactccggacttgatggtggaggacgcacgaacaacgctaggcaatcaattcgtggggctccggactcgatggcaatcaattcgtgggtctccggactcgatgctggaggacgcacgaacagtgctaggcaatcaattcgtgcggctccggactcgatggtggaggatgcatga

SEQ ID NO: 66203 - DNA, 1617 bp, Glycine max
  Peptide Sequence Number=SeqID_157888
atggcttctccacctacctgccctcctcctcctcctcttgttccttccgacgcatcagcttcgccgtctgccgtgaagcgacacgcaaagccttatgcctacgatcattgtctactagaccacctggtgctgagagaccaatggtgcatgttgatcctgctaccggcaaggctgacggacttgatttgggaggatattcaggcggaatttgaaatcccagaggcttctgacaccgatcaagacggtgtggaggacactgtctgtgagaaatacgacatcaacaaggaaaaatggctccagttttgccagactcgcaaagacccttcttgggaggatgtgtgcaaaaaggcacaggccatccagaaacaaaacactaccccccacgttttgtctcgtgaaggttatgaatatttggagcaaaggctcctgattgagaagacgaagaagaagctggaggaagctgcacagtcaagaagcgttgatggcgtcatcgaccctacatccccagtcagacgccacatgaagtggaagatggcccgcacgaagaaaataggggagatgacgactgaggccgcaaaggaaatcactgagaagatcgatgttctcaccgctactattggacatccagagcaccctagacgtgtccatgctgctggagccggtgtcaccatcaagcaatactttggatcggctccacggacgtcctgcagctcttcctcactgcctcctgaagaattacagcagctgacccagcaaatcagggaccagctagaggagtccatcacagaaaaagtgacgtggcagctcatggcatccttcaaccagatgcagtcccagattcaatcccagatgcaatctcagggatttacactgcctcccgagcctctagtgcggcttgtacatcaagtagatcctgcttgcctggttgccctggggagagtttgtgagggatccactgttgttcataacactcctttgttgcctgaccaagtaaaggtggacacttcacacattccttgcttggccgacacatctggtcaagtctttatcacagcagttgtgtctccggaaaaaccacctccaaagcccgatccggaggtcgatgattcgctttatcttatgacattgaccatcccagagcttttcttgaggccttatcaggttacatgggatgccactgtgttcaggatctttaatccatatttcccactctatataaagcacgaagacctctccgaaatcgcacatggtggtcaatgtctcagcatatcagtgttacagttgtggattcttatgcgagcggggaattctgatatctatcgattcctcgagccacagtccattcagaggtctgggcaatcgcagtttgagtctaaaagttacataaagacttggatgcaaagttcaaaacacgatgtctatcttggagcctacctaaatggcggacactggcagatggtggtcatcctgcccaaggaacacctagttgtctggttttgttcattgcataacaggccagacaactaccttaaggggattattaacagtgatttaaaaggtcttgatgatgctccacaacctaaatcaaaggctcctgataggtggattgtcatcaag

SEQ ID NO: 66204 - DNA, 249 bp, Glycine max
  Peptide Sequence Number=SeqID_157889
atggttaatctgagcttgttggctaaatggagatggcaattcttgcaagatacatcagtgttatggtgcgatttgctcaagcataagtatagggcttttcaagatgaattgtatgctgaatacatgaatggatggttggttgatgtagttgatagttggagttggattgttgatggctctaacaacttctcagtagcctcaactttcaaggtgttagagcaacaaccacctcaactttcaaggtgttag

SEQ ID NO: 66205 - DNA, 579 bp, Glycine max
  Peptide Sequence Number=SeqID_157890
atggagaacttatctctggtagacgaggaggaaggggagctagttttccatgtagagaaagagcaagaaaggagggtagttttcctcacaagcaagagtgtacgagtccagatgatgaaagaacacatggccagtgtgtggcaactgaaaaagggagtcacaatcaaggaactggagaacgaaagtcaaggttggataagtcttagagaacatccttctctttcacgtgcctttttggatatagttagacaaccattggctcaaaacaagaagattaaaaagcctggcgaagagtggaacatggtgcattttaagtatgagaaactagggcaatattgctatctatgcaggatgttagtgcatggggagaaactttgtgatattctcttcacgactaatggcatgagtgtggttaagggggaggaaggcggtggctacatgaggagtgcccaatttgggatgaaagagaaaatcacagtgggagcaataaatgtggatcttatgtgcgagaagaagcacatacgggtcaggacgggtcaaggacatatggattgcaatgtggtcgacgatggcgtgtag

SEQ ID NO: 66206 - DNA, 198 bp, Glycine max
  Peptide Sequence Number=SeqID_157891
atggctacttttaaagaagagcaggaagctgttttggatgaccttgaaaccgaaagtgcccacttactggtccaaggtgatgctaaggttaatgattctgatgataatgtggattttattgctgggaatgtgaaacttattaccaccaaagaagtgtgggaccaatatttggaagaagcaaggagggatagcaaaatt

SEQ ID NO: 66207 - DNA, 414 bp, Glycine max
  Peptide Sequence Number=SeqID_157892
atgggaggtcaacatagttataggaacatatgcaaagacgaatcagtagaatacaactgtaaagagtgtgatctcaggaaaaggaggttgaaaaacacgaataagaaagaagatagagaggatgtaagatggggatatgatataaggatggaagaaaacaatacaaaccagttagcaagaagtctcattgcaacagttctggttgtcaagcttatccagaatgccaaagaactctccttttttggaagggatgcaatcgattcaaatgagactttagaggttttctccaataatagatcggtctggattaggattgagggtctaccgttgaacttatggaaaagaaaatgttttgaactcatcacagcaacaatcaaggatttagtgttggtggatgaggatacaactgactaa

SEQ ID NO: 66208 - DNA, 291 bp, Glycine max
  Peptide Sequence Number=SeqID_157893
ttgtttagttttgtagaagcaaagcttcatgatgaatcacgattgattcaaagatgttttgatgataacaaaggtgatgacaaaaagctcaaaggtcaatcaaagaatgagttcaagatgttcaagatagaatcaagaacacttcaaaattcaagaggaaagttgatttcaagaatcaagattcaaggatcaagcttccaagaatcaagatcaatattcaagactcaagattcaagaatcaagagaagacttaatcaagataagtatgaaaaggtttttttcaaaaactga

SEQ ID NO: 66209 - DNA, 1161 bp, Glycine max
  Peptide Sequence Number=SeqID_157894
atggtagatgttgccgcacagaaaatcagtgcagagactgacgcacgggataccagtgcaaagactgacggggacgagcctgagggatttcctggtggacccagggacccatcagtgcttacaaaatatgttgaccatgttgcgggcaacgtatggtctggaaagaaacgtcctaagttgaagttatgctcccatgggaggaaggtgcataacttgggcaggcctgttcctgcaattgaggacatggttgctgggataagattatgtcctttgattgcgtgttcaatagacaccggtgattggggacttatatcctcctttgtcgagaggtggcaccgggtgatttctagtttccatcttcctgtgggggaggtttcgatcacgctggacgacgtcgtgtctcttctccatctgcctatcatcagcgcattccatgacttccagcctctgcgcaccgacgaggcggtgctactattggttgagttactaatggtcaatgtggtggaccatacgtacgcctgcagtggctgcgagatgtataccagcgcagatgtcagacgcaacactagacagttgccgctcgtgcttatcttctacatcttttgggttgcactctttttgctaataagagtacaacccatgttcatgtcgcacacatacaggccctacgtgacctcactcttgctgggcggtatgcatgaggagctgttggcctcgtccatatgtacgatcagcttaatgatgccagtctcagcaccagccgatagcttgctgtgttggatttacgagcacttttcatcagttgtaaagtgcaatgctgatttagactacgacgaggtgtcaccacgcgcatgtcggtggattgcaacaaagaagactgtgaagaaggtatctacagcgacgtacaggcagtgcctggatcgtctgagaatcccagatgtctgctggatgccatatgcggagcaccgacctgtgcagaactttcatttgattttgtgcttctcgggacagctccgttgggggcctattgttgtcagatacaggccggagagggttatacgccagttcggctatgtccagtgcattcctgcacaccctgtccattcatgggtgtcatatgatgacgtggacgatacatggacgcactactcagccatctag

SEQ ID NO: 66210 - DNA, 300 bp, Glycine max
  Peptide Sequence Number=SeqID_157895
atgtacaaagataattggacccaaccttggcacatgggctcagaaatctaccctaagggaggattgcatcaacaaggaaccaccacgaacatgaacggtgacaggaaaaagaagcaccgtaggaagaggaagacgaacaagaagcatcgtaggaagaagacgaaccatcgtaggaagaggaagatgaagggttgtaagaagaggaagaggaagaggaagaggaagaggaagaggaagaagaaggatgcgcacgatggccgtaggaagagaaagaagaaggatggcgcgacgactatatag

SEQ ID NO: 66211 - DNA, 510 bp, Glycine max
  Peptide Sequence Number=SeqID_157896
atgattgatatctcaaagccctacactgaggaaatgaggggcaccgtgcatgagcctcaagcaaacctagagacaggtcaaaagttctcacccgttgatgttctctccttcagagggctacatgtcctcaccttcagagggctagacgtcctcactttcagagggctcaagatcctcgccttcagagaactcaagggccaattgtgcgagcacagccagaggaggagggaggtctttggctttgagaaggaggctattgcacagctactacgcataccggggcaagatttcacccagacaagtgtggatcgtgcgcaccaacatgaccactcttacccagatgtggatgatggtgaggcaccacagcagcttggggacaaccagcagtgggccacagacgcatcgccatcacctccagagtccacctcagctcctctacaaaggctgaagcgttgcctacgacacatggctgaccagcaagcggccaaccaccggggcaggtacgagtag

SEQ ID NO: 66212 - DNA, 282 bp, Glycine max
  Peptide Sequence Number=SeqID_157897
atgagagagaaaatacttcaagaaaagagagaaaaagaaaaagagagccaaacacttgagagttcaaaaagtgaggacaaaaagagggaaacacaagagaggaaaaagttgagtgaaaaacatgaagtgagggagaattttctagctacaaaaacagaggtgttgggtcctcttactaagcaaattgatgcaattaaggatgtttctctaattaaagatgtttctgtgttccatgctgaaggctcaagtactaaacaccgatgtctcatgagtttagcctaa

SEQ ID NO: 66213 - DNA, 221 bp, Glycine max
  Peptide Sequence Number=SeqID_157898
atggtagttgctcttggtggtggtggaggcttatgttacatgggggaccaaggcacaagaaattttgaaagaggtgtcaaaaatgggggagttgaagagattatgcatattttcagtgttgaacaaggaatccttcatagacccaacaaagggttgctatcatctgaccatggtcatgctaattaccatgactatggtgaatggaccacgaccattatcaa

SEQ ID NO: 66214 - DNA, 375 bp, Glycine max
  Peptide Sequence Number=SeqID_157899
atgggcgaagtagaggaggtgcaagagcagatgaaggtcgacatggaggccatgaaagagcaaatgaccacaatgatggaggccatgatgagcatgaagaagataatggaagctaatgcggttgcagttgccgctatcagcgctattgctaaggtgaacccgatgcccccatctggcctaaaccaaatgaatcatccaacctcaaatatggtaggcaaagatttgggaagtacgggcgacccccattatgtgcaaattcaaaacaagcacgccttcccgccatatggcttgcctcctaactataacccacccaatgtggcatacactcccagtgagaatgtcaataactccactcccatactcattgagagctaa

SEQ ID NO: 66215 - DNA, 609 bp, Glycine max
  Peptide Sequence Number=SeqID_157900
atgccctcgccttcagaggactacatgccctcgccttcagaggactacatctcctcgccttcagaggactacacgtcctcgcgttcagagggttgcatgccctcgccttcagaggactacacgccctcgcctttagatggctacacgccctcgccttcagatgactacatgtcctcgtctttagaggactccacatcctcgccttcacaagactccacgtcctcgcctttagagggctgcaagcccttgccttcaaagaactacacgtcctcacctttagagggctccacaccctcgccttcacaggactacacgtcctcacctttagagggttgcacacccttgcctttagaggactacatgtccttgccttcagagggctgcacgccctcgccttcagaggactacacgccctcgccttcagaggactacacgtcctcgctttcagagggctactcgcctttagagggctacacgtcctcaccttcagagggctacatgccctcacctttagaggactatattcctcactttcagaggactacacgccctcaccttcagagggttgcacgtgctcgctttcagagggctccacatctgcgcctttag

SEQ ID NO: 66216 - DNA, 255 bp, Glycine max
  Peptide Sequence Number=SeqID_157901
atggggtcggaccaaacaccatcttttaaaaaaaggttttatcatctagagctagatctggtgatgatagaagaggccgttgaagtcatcacatctctcgctcaatactatgaccaatcactcagatgtttcacttttggggactttcagttagcgccaaccatagaggagtttgaaggggtcttaggatgcccactgggggtaaggaagccataccttttttctggattctatcattctatggcaagaatataa

SEQ ID NO: 66217 - DNA, 1776 bp, Glycine max
  Peptide Sequence Number=SeqID_157902
atggtggaaagggaaaaatttgatcacatagaagaaaggctgagggcctttgaaggaggtggagactacccttctgttgacatggcaaaactttgcctagtaccaggcgtcatcattcctccaaagttcaaggtgccagactttgacaaatacaaggggactacttgccccaagaaggggcgaaaggatcgaaaggatagtccaaatgtaaggaataacccattttccaatcatgaaagctcggcagtgaatgcggtggaagaatggaagtctcaagagctaaagcagataggggatgtgtcgacttttaggcgattcatattggaggcattgcgcgaggccgatgtaattgaacttgacgataacaaaggagatctgtgcttgatgcatccagagtgcaaagaaggaggaatgagaggtatgcatgcaatcgggggcattaccactcagataccccaaggtttccagccccctatagcaaagacgcaagatgcatctggcatatgtgtcgggaatggcatgctggctgctaagatcataaatacttccagtacaagtggcatgactcgtagtagacgcatttttgctcctcctgaactaccgacaaggtcaaaagacaagggaaaggcaaaggcggatataggtgagagggagaagacgaccccgaccgcgaataatgagacccctattggaaaaattgtggaggaaggggacaactttagcaaaagagagatatcagctgaggaggggacacaacaaggctttgcacgtgtccgtcaaatgcatggaccacaatggccaaagtactcattggcaatgggtcttccctcaatggtggtcctgccaacgttgcaccagaaattgaagtttgtggtggaaggtcagctgattatcgtatcgggggaagacgatatactagtgagttgtgcatcttctacaccctatgtggaagctgcggaagagtcattggaaacatcttttcaagcactagaaattgtgaacaatgcttatgtggaggctcctccagtgcaaccatgtttatccggtgccttcttgatggtggcccgagttatgttaagggatgggtatgagcccataatgggtttaggttggaatggtgatggcacgacaagcttggtgaagttcgttgaaaatcatggaagaccacaaatggagagggtccctatctgtcacattagcaagagctttgtcagtgcggggtggatgcatgaggatcaagttgttgtactgggcaaagaaacctatcaaggccagtcaaactgggaagaccatgaggatcagggacttccccccagatttgaggagaatggtggagcaagaagaaagagaggtgaagctgcactgagaggagacaaaggttgtgaatttaggcattggtgtaaagaaaaaggaattcaaggttggcacttgtatctcctcgaacatccgagatgggttagtgactctgttgcgagactaccaagacatcttcgcttggtcttactaggatatgtttggtttgagctaagatattatgcaacacatgctatctttgaatcccaagtgctccctggtaaagcaaaaattgaggacaatgaaacccgagatgtccctaaagataaaggaggagatgaagaagcagttcaacgttggtttcttggccgttgctcggtacccagaatgggtcgccaataccgtgccagtcccggaaaagaatgggaaggtgcaaatgttcgtggactattaggatctaaactgagccaatccaaaggataa

SEQ ID NO: 66218 - DNA, 1503 bp, Glycine max
  Peptide Sequence Number=SeqID_157903
atgtttgttgcatcccttgcttgctcttgcacttatccctcccttttgttgcgatctttgtgtcccacatttacttcgtggtcttatcagctcaagcaactcaacagaaagaagaatcgcattttggcatccatcaatggtaacagtgcctacgatgtgggcggaggatatccggaattggagcagaatcagaatggaaagttgcattcagacatgtcttctcaacgcgaagccctccttaaaggaggggaccaagtcatctctgttttggaggaaatgattacccttttggaagacatgaatatggacgaggaatctgagaaagtggcagtggagttggctgcgcaaggagttattggaaagagagttgatgagatggagtctgatttcatgatggcccttgactacatgatccagcttgccgagaatgaccaggatgataagcgcaagtcactgttggaagttatcaaagagacagtattatcacatctaaccaaaaaatgtccaccccaggttcaagtaattggtcttctatgtagaactccaaaaaaggaaagccgacatgaattgttgcgccgagttgcagctggtggcggtgtatttaaaggcgaaaatgagttgaagattcatatcccatcagcaaatctaaatgacatagctaaccaagcggatgatttgttggaggcaatggaaactcgtcctgttatcccagatcgaaaactacttgcaaggcttgttttgatcagagaagaagctcgtgatatgatgggagggggaattatggacgaaagaaaccatcgtggattctatactcttcctcagcctgaggtggacttcttagccaaattggtagctctaaaacctgggaaaaacgtgcttgatatgataagaaatgtaatgcaaggaaaagatgaaggtgcagacaaatctggcaatgacaatgaggatgacactaccaatggggagccagctgaatttcttggaaggccactagtaacgggagagaagacacttccagtgcgccctggcatgtttcttgagactgtctccaaggtcttgtctggtttatatgctggaacagattctggcatcactgcacaacatttggagtgggaagaggaattaagagaaattgtttgcttacaaaggagtggggatgtctcctccgcctctaggaacctcacaattgctcaaaaactcacaaatctccctaaaagctcaaaacttggctcctttactctattctgcgcttctgtgttcgcactcttcaagctctctttcaattatgttattccagacattaaaaagggctttctgatcttgatgtcatgcttagtgcgagtaagtgaactttggctcagcgccaatcttgcgctaagcctggaaggtgacaaacgaatcgctgagcgagctgataacgcgctgagcgcatgcttgcatggaagattgcctttcagattcctcttactcgctaagcgcgttgatgcctcacttagcggatga

SEQ ID NO: 66219 - DNA, 543 bp, Glycine max
  Peptide Sequence Number=SeqID_157904
atggcttctgcttgtgtgatcctgaaagttaatacccatttagcaaactctgagaaaggctttcttggagaaagaataaaaggtggcttcaacaacagtgtcttggtcatgaatcagttggttatacgttctacaagccacaagagggtgaaacatgtgccttccattctgagaagagatgatccaaaaaatgttgtttccatcatattgggaggaggacctgggacacaactctttcctctcaccaaatgtgctgctacacctaccgttcctgtggataagcaatactgtgggctatggcatgtggagaagaaacctataagacccttgtccccttggattactgatatattacgagctgcacctttaggcattacaacagactattttcggtggtgtagtggtgttatgggtaaatatgctacaggagaactcaagccacctactattggtacgttctccaaggagttactattgctaacattaccaaacaatttttgttcattcagagctttactcactccgttgcacgtctcaatctga

SEQ ID NO: 66220 - DNA, 2097 bp, Glycine max
  Peptide Sequence Number=SeqID_157905
atggtgatagcggcaatgagaatgacaatgaagacaacaatgatagagtgtggtggtggcggaggtgacagcaacgatggcgtggtggtgacaacgatgcaaaacgtcaatcagaataaagtcaaatataaatccaaaaactatcgtctagttgtccaaaatttagtggaaaaagacgctgaagacatgtctggtcactgggggattcttgtttcagatccatggcttcagaatcagttcacacaagtggagcttcgtagcttaaagtcccatttcatgagcatgaggagggaaagtgggaggcttgtgattgcggatttggcttcgaagatgtcaaggttgaaggtggtgggagagaatctgagtgaggaagagagagcttcttgcgtgaaggatgtgtatcagaacactgaagaggaggttgattttgaattgtttctcaaggtctacttgaaactccaaacatttgtgaattctagaaccggaagtagtccaaagaactcgtcagcgttcctcaaggcagctacaaccacattgcttcacacaataagtgaatcagagaaagcatcatatgtagcacatataaatcactatctagcacaagatgagttcctcaagaaatatcttcctattgacccttcaaccaatgagctctttgaaattgcaaaagatggtgttcttctttgcaagcttatcaatgtagcagttccagggaccatcgacgaacgggcgatcaatacaaaaagaatactcaatccatgggaaaggaatgaaaatcacacactttgcctcaactctgctaaagcaattggatgtacagtggtcaacattggcactcaggacttcattgaaggaaggcgtcatctggtgcttggggtgatttctcagattattaagatacaattattggcggacctcgatttgaagaaaactccacagctgcttgagctgcttgatgacagtaaggatatggaagagttcatgaatctacccccagaaaaaatcttgttgaggtggatgaatttccatttgaaaaaagcagggtacaagaagattgtcactaatttctcctctgatgtgaaggatgctgaggcttatgcacaccttctaaatgttcttgcacctgaacacactaatctctccacgttggcagttaaaaatccctttgaaagagcaaagttagttcttgaacatgctgataagatgggttgcaagcgatacttaactgcgagagacatagtggaaggatccccaaatcttaatcttgcctttgttgctcatattttccagcacagatatatacgcctactaactcaacttccctcttgtaggaatggactttcagcccagacaaaacaacagatgtctctccttgagacatttccagatgacaccctagactctagagaagaaagagcatttcgcctttggatgaatagctttggaaattcaacatatatcaacaatgtcttcgaggatctccgaaatgggtgggttcttctagagactcttgacaaggtgtcgccagggattgtcaattggaagattgctaataagcctccgattaagatgccatttagaaaagtggagaactgcaaccaagttgtgaaaatagggaaacagcttaaattttcgctggaaataaatgatgctgatattttagagtgggccaacagcaaggttagcagctccagaagccaaagccgcatggacagttttaaggataaaagtttatcagatggaatatttttccttgagcttctaagttcagtgacacccagagctgtaaattggggtcttgtaacaaagggagtaacctaccaagagaaaaagatgaacgccacctacattatcagtattgcaagaaagcttggatgttctatattcctgcttcctgaagacatcactgaggtgaatccaaaaatgatccttacactaacagctagtataatgtcttggtgcctaaaacaccctcatgaagaaaggacagtgggaacttccgataacgagagtgggggtcaattggagactacatcaaactcaacactagatgactctgcctctgattcatcactagatgagaatgggaacatataa

SEQ ID NO: 66221 - DNA, 75 bp, Glycine max
  Peptide Sequence Number=SeqID_157906
atggtggtcaatgactcagcatctcttttatacaattgtggattttggggagaatgtgaatgtatgaatacatga

SEQ ID NO: 66222 - DNA, 603 bp, Glycine max
  Peptide Sequence Number=SeqID_157907
atggactctctcattactagacttcttcgtgtgccccatgtgttgaaagatgaaaacttagctaaagtcgtggaaacgtcagccatggttgcacctcgtggaagaggaggaggtcgtaacaatagaggaggccgcagtggaaggagtggatgtcctcaatacacctattgcaagaggatgagtcacactcaagaaaactgttactccttacatgacttttctgacaaagtagcacatgtatctaaatcagataaatcagagtctaagttctttgatgatttggatagaagtatgttctttgatgaggagtaccaagaatatttgtggctcaaatttgaaaaattcagcaaccaagcacaatcctcctctgtaccatgtgtttcaacaacatgtatctctcaatctatggaaggtcctggtccttggatacttgattcaggtgtctctgatcatatctttggtaacaaatcatctttttcatccatctcttttccaaaaattcctcactttgttactatagctaatggttccaaagttgcttctcaaggaattgttcaagaacacggtacgggtcgtttgattggagaaggacgtgaatcatga

SEQ ID NO: 66223 - DNA, 931 bp, Glycine max
  Peptide Sequence Number=SeqID_157908
atgaagttcaacattgcaaatccaaccactggctgccagaagaagctcgagatcgatgatgatcagaagctacgggcattttgggacaagaggatttcacaagaggtcaacatagatgctctgggtgaggaatttaaaggatatgtcttcaaaatcactggtggttgtgacaaacaaggatttccaatgaagcagggagtgctaacacctggctgtgttcatcttttgctccacagaggaactccttgcttccgtggatacggaaggcgcaacggagagcgaaggaggaaatttgttcgcgggtgcattgtcagcccagatctctctgttctgaacctggtaattgtgaagaagggcgaaagtgatttaccaagactgactgatgttgaaaagccaagaatgaggggtccaaagagagcatccaaaatccgtaagttgttcaacctgtctaaggaagatgatgtgaggaagtatgtcaacacataccgtcgaaccttcacaacaaaagttgggaaaaaggtaagcaaagctccaaagattcagcgactcgtcactccactgacactgcaaaggaagcgggcaagaattgctgataagaagaagagaatcgcaaaggcaaaatctgaggcagcggagtatcagaaacttcttgcctccagattgaaggagcagagggaacgccgtagtgagactggcgagttcggtgtggataccgccaatggagctggcgagtttggtgtggcaagttcttgccactctcactggcgacttggcttgagcaacatgcttgacgggacaggtgaggcaggctatgcttcagactgcttcagagtagcagtgcagggagtagcggtgcaggtaggagtaggatggtctcgccaacactgcttgcgagacgagcttatatccgccaatggtattggcgatatag

SEQ ID NO: 66224 - DNA, 459 bp, Glycine max
  Peptide Sequence Number=SeqID_157909
atggcttatggactgcctagaaaactgaaaataaaagcaagcttcatgatgatgaatcaagttgattcaagtagttttgataataacaaagatgatgacaaaaagcccaagagaatgatttccaagattgagtcgacaagattcaagaatcaagagaagtttaatttcaagattcaagagaagatgaattcaagatccaagagaagaaatcaagaagacttcacaagggaaggtacatcctttgtggtacaagtagagggtacatctacttgggttgttgtaactgagaacaagaaaaggtacatctcttgtggatcagttcaagtggagggtacatccacttggttgttcaaagagaacaagggagggtacatcccttgtgggtctttgcttgtaaaggattttacaaggttgaaaagaaatctcaaggaccacaggtcccttggggactgggtgtag

SEQ ID NO: 66225 - DNA, 702 bp, Glycine max
  Peptide Sequence Number=SeqID_157910
atggacaacactctcaatgaaggcaccaaagttgttatggccgaaatccctaatctgcaatttcctagaattcgagagctaggactctccagaagcaagatagagaagatgagttttattcattctgccctctttcattacatgttggccaccatttgggcaatttcctttggaacggaaccaccttattcttcgcggagtgcttcacggagtcctgaaccagcgctgataacggattcgtgtcacttctctgaccccacgcaacaaccacctcttttccgccgagacttcgaaaaggcgaggaaggtcaaagtcgctgaagttccgaggaaatgcaaggaactgtcgaagttcatattgaaaagcgctttgactgcggcggcggaaggaggagcacacgatggtgagacagcaatggcgacaacatggggatggtggagggaactgggagggaaaggaagaaatggcattttatatgtggagatgatggccttgttccgagggatggagctttgctgggagaaaggcctaggtggatttcgtgtgaagcattttcttcacgaagggaatgcctatgctgatgttttagctaagctgggagctacttcttcaagcgattgggatcttctgcaggtgcctcctttggagttaacaatgcacctcctagctaatatgggaggggtgatgtttagtaggatttag

SEQ ID NO: 66226 - DNA, 606 bp, Glycine max
  Peptide Sequence Number=SeqID_157911
atggctaaggtactcatcgaaaactgctcaagcatgaatgtgatgcccaagagcacgttggagaagtttccgttcaacgccacccacatgaggccgagttccatggtggtctgggccttcgatggcagccgccgagaggatgttctggtgagtttttcttcctctacgccgtatgtggaagctgcaaaagagtctttggaaacgactttccaatcctttgaggtgcccagaatgggtttgggcaagaataatgacggtatggccggcctagtagacgtcaaaggaaatcgcgggaaatttgggttaggctataagcctacacaggctgacaagcttcgtgagtgtgggtttaaggcacgaagggcaagtcgccgcgataggcggcgaagactccccgaggcggtcaaacttggtgcaaccatgccctcccgattcgacgacgagtcccgtgaaggtactaataccggggacccggccattgattttgagcaagaaacgagccaaatggaggatgaagaagacgaagatatagagcttcccctagagctagagaggataattgctcaggaaaaccgagagatgaaaccgcaccaagaagagacatag

SEQ ID NO: 66227 - DNA, 441 bp, Glycine max
  Peptide Sequence Number=SeqID_157912
atggcgcctactaggcaccctttggacccgaagaagttcaatagggccctggggtttcaggctttgatcacgggcctctaccagctctacggagtgcatgtcacccccaacaaggtgcaaggtgacgcacagcaggccacgggtgcaccgccaccacctcggcaggccgattcggctggaccactgagcgtggagcagtatctacaacatgtggttcgccagcaggtagccaaccaccatggacaggtgcagttacatgagtgtctctaccggttcagcctcagccaacaggggcagggttccaccccttttgtatgccctaccccggagcagttcgggactgaggtcgcatggcccggagattggcccgatgcccagacaggggaggggcctacaggatcctcgatgatgcagatgaaccccatatggacgaggatatga

SEQ ID NO: 66228 - DNA, 471 bp, Glycine max
  Peptide Sequence Number=SeqID_157913
atggcacgcggagaccaatatggtcatctgctttccttcgtcgaaggctcaatgtctatcgaccgagaccgccaaaagagaacaatgtggtcatttgcacccttcccgaaaatgtcagcgtcttctggtcgagactgcaaaaaaggtctcacttctgctatcacgactcgagggtccgatagcatgcggagataccttatgcttattcgcacctttcgtcaactagaggccaacgagcccgttgacacgcagagactaggtctgatagcatatggagatacctcatggttatctgcacctttgtcatccagagacaacaagttcgatggcacacggaggcaacatatggttgctgaggttaatttagttaatagaggggtgtgggtagataaggatctagcttctcaaagaagcctcttgagaaagcttctcaaagaagccacgaggaagcttcttgaggaagcctcttaa

SEQ ID NO: 66229 - DNA, 273 bp, Glycine max
  Peptide Sequence Number=SeqID_157914
atggtggagaggttggtgtctacaatatctgaaggggatgaaggagatcaaggggactttggagggaatgtgcaaactgaatgcgggaaacaaaacagaggtagcttcacatacccatctttgaaagggatagtggtttcggaaggatacaaaaattggagattaagtagaataagggaagaagcaaagatggaggctataatggtggctcttgaaggagatgcactttcatggtttcaatggtctcaaacttgcaaatatataagaggatga

SEQ ID NO: 66230 - DNA, 222 bp, Glycine max
  Peptide Sequence Number=SeqID_157915
atggctccaagctcgttgagtatcttcctactgattaaggaaaagtataatgtgtttgcgtcaaccaatagatatctgatggacatcagcggaactgccccggtagatgaggaccttggacaccctaaagttcgttatgctgatggagaaaaccacgaggtcatcttggttgacgaggttgatgcccttgaagtccctgtccgtaaaggtgataggaggtag

SEQ ID NO: 66231 - DNA, 3958 bp, Glycine max
  Peptide Sequence Number=SeqID_157916
atggccgaatttctggatctcgaatcccaagacggcgtgcgaatgccgtggaacgtgatccctggcacgaagcaggacgcccaaaacgccgtcgtccccgtctccgccgtctacactcccataaagcacttcacctcgatgccgctcctcaactactcccctctccggtgccgcacttgccgctccgtcctcaaccccttctgcatcgtcgacttcgccgccaagatctggatctgccccttctgcttccagcgcaaccacttcccccctcactacgcatccatctccgacgactccctccccgccgagctcttccctcagtacaccaccgtcgaatacaactccgacgccgtgggccccaccaataccccctccgtgcccccagtcttcctcttcgtcgtcgacacgtgcgtcatcgaagaggagatcgggttcctgcgctcggcgttagcccaggccgtggagcttttgcctgagaactcgctcgttggactcattaccttcgggatgtttgctcatgttcacgaattagggttcggtgcggtgccgaagacttacgttttcaagggatctaaggatgttaccaaggaccagttgctcgagcagatgagtttttttgcgaagaagccgcgcccggcggtcggcgtggtcgctggcgcgagggacgggctctctacggagagtatttcgcggttcctcgtgccggcgtcggagtgcgagttcactctcaattcggtattggaggagctgcagaaggatccttgggcggtgccggcggatcagcgggctgctcggtgcaccagcacggcactgagtattgcggcgagtttgttgggggcatgtgtccctggctctgctgcaagaataatggcatttattggaggaccagctactgaaggacctgctcctgtaagagctactcatgaagcttgtgtagttatgtataagcttggcaatattgtatccaaacaactttctgaaccaattcgctctcacaaggatctggataaagattctgtgccacattaccataactgtgtgaaattctatgatggactttcgaagcagcttgttcatcaaggccatgtactagatctttttgcttgtgctcttgatcaggttggaattgctgaacttaaaacagctgttgaaagaaccggaggtcttgttgtacttgctgaaagttttggccattcagtgttcaaggattcactaaagcgtgttttccaatcgggtgattatgatttgggtctatcttcaaatggaatatttgagataaactgctctaaggacttgaaagtccaaggtattattggcccttgtgcatctcttgaaaagaaaggcccattatgctcagatgttgttattggtcaagggggtacaagtgcatggaagatgtgtggccttgacaaatccacatcattgtgtctatttttcgacgttgtgaggaaggaaactcctgatgcaacaatgcagtccacaagcaatcaattttacttccaatttttgacttatcagaataacagtgggcaaatgagattacgggttacgaccctttcacgtagatgggttgctggaccagaaagtatacaggaccaggacctcttatctgctaagaatttaaagtggctcaagagatgtgcaaggtttgagatgtctgatgatcttatgggtgagcaagtttacccagttcagtttaaggagtactatggacaagtctgcattttctcgagtagaggtgaggcaagagtgaggggtagagtgagcttccatgaggatcctcgacggacacacgccggaaacatggatgaacaacagcaaggctacaatcgagcaaattggcgggacaagaaggactggggtgatgtgagggagattttcatctctaagcaaaaaaacaaaaacggcaggagatacgattttgctagattcaaaggagtgaaggacgcacacaagctagcaagggagctggaccaaatggtcatcggcggactgaagatgtacgttaacatacccaagtatgggagagacatggcgaggatggtagcggcacaacctaaaccacagaggtatgaggagaaacatcaaaatacagcagcatattggagacaacctcacgcaacaccagcttcgacctcgtacgtggcagtggtggccagaaacaagcgaggggttgggcaatcgaaggaaacacacattcagcatcacaaccgtgtcccctccctatcatcaatacaccttgacatatcactgaatgacaagaaatggttcagtgaagcttgggtagggcggctgaaaaaccgtgcgtggtttgatagagttgaagacgacccattgtgggatttcggagcagacataactccgaagtacatgggggatgacatggtgttgttacttgggcttacggatgctaaagccaaaagaatgatgcaggaggcacgagagggagaagagtccatgttctactcgttggagaaatggaatccgagcctacgtatgggtcaaagactaacttgggtccaatgttggggaattcctttgctagcttgggataagacgcacatccaaaagattgtcgctgctatcggggatttggtggatgtcgatgacgatgtcgacgcagctcgaagggtggacagagcacgagtgctcattcgcactccatggagccccgcaatacaacgcacgataactgtatacgtaggtggggaggtgtacaaggttcaggtagtggagaaatacagtcaaagcatcgagacatgccactgccggcgaaggagtgttctgtggtcgtcggaggaggtcaagtccgacgacagcagtatcagaacgtcggtatcaggaatgagacgtgccccatacaacgacgacgaggcgcaagccatcacggtgccgccaaacacggctggccgacgacggaccttttccgacttcagtatcaggagagacgacctcgggacagcggctatacccaatggtctaaccatacaccttagtccgctgggtaactgctttaacccgagggtaacggtcacatgcatagataaggacgaagaccaggtggcacgtcaggggttggtggcaaatgagatgagcccagtcaaagaaaggtgcaaaatgtatggagcacaggctgtcgggagagtgggttcaaatgaggaggcaaacttttttcacaaaaaaggaaatatagtagctggaaaagaaggtgacatggcagtggtgcaggagttttctggggtggagacacgagacttacatcaggatgaaggagtgggtaatagtgggttggactttcctatccacacccccactaaagcaaaaggccatattagtagcagcccacaactaaaaaagagtgcactcagcagcaacagagaggattcaaatgaggaggcaaacttttttcacaaaaacggaaataaaatagatggaaaagaagatgacgtggcagaggtgcaggatttttctggggaggagacacgagatctgcatctggatgaaggagtgggtaatagtgagtcgggctttcctatccacacccccactaaaccaaaaggccttattagtagcagcccacaactaaaaaagaatgcactcagcaacaactggaaggaatgcacacaagtacagcatgaaatggtgaatgaaaaggatgggaagaatcagttggaggaggtagcagttatatggaacatggctcaagagttgggggcaacatgtttaggaaggggggtaaaatgggctgcaattaggagaatgatcaaggaagaacatattgatatgatatgtatccaagagacaaagaaggagaacattgacaagagcatatgccaagcattgtggggggacgctgaagtgagttgggaagtgcagcctgcatctaacacagcaggagggatcttatgtatgtggagtgaagaaactttcaaactacaaagcaaagtcattagaggag

SEQ ID NO: 66232 - DNA, 339 bp, Glycine max
  Peptide Sequence Number=SeqID_157917
atggtagcttgcccaggcgagctgagacttagccatgaagcaattgactcgcccaggcgagctggttacttaacatggaagtcttttggtggcccaggcgagctagaggctattctgggcgagcgaggggccaggaaactcaatgaaaagaccattttgcccctccttttggcatatttcccattcttgatcaaaacattgaatgatccttcgttttgtgcgaaacagaggatatcgagtcctatgaagcacaaagacaaggacattaagtcctataaaagaccaaagactttgaagtcttataaaagtgtaaaagacggaagacatggaagtctttga

SEQ ID NO: 66233 - DNA, 360 bp, Glycine max
  Peptide Sequence Number=SeqID_157918
atgatgcaatcctaccccacaaaggcattggatagaagactccaagtagattgggccaaagatccaagggaaggccctagggaggtgagcttagttatgagaggggtgtgtgtagctgatgcaagctccattggagcttgtaggcctaggatcttcttcatcaatggattcctttgcttcttggaagatgaatggcagcggaatgaagaaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 66234 - DNA, 240 bp, Glycine max
  Peptide Sequence Number=SeqID_157919
atgggtcgtatgcacaattgcaggctcaagttcggtcccagtttttctatccaactaacaaaccagaagcaaagcttcaagaattattttgatgatgccaaggaatttaagaattattttgatgatgccaaggaatttaagaattattttgatgatgccaaggaatttcaaagatcattcaagatgaatttaaagaatgaagaaagaaagatgtcaagcaaagcaaagatctcaagataa

SEQ ID NO: 66235 - DNA, 348 bp, Glycine max
  Peptide Sequence Number=SeqID_157920
tttatgtcacaaacaattggccaaagcataggcaactgcctaggggaatatcttgagtatgatgagaagaacaacaatccatggcatccctatttgcgcatcagagttttcattgatgttaggaaacctcttaagacgacgaagaggataaagaagcaaggcaatgaagtggtagaagtgagctttaagtttgaacatcttggcacattttgttacctctgtgggctgttgggatactctgatgactattgtgctaagcttttaacacttgaaaatgatgatggaacacacgataatggaggctcaagctcaaagccatctccaatgccagaccaaaaaggaggatag

SEQ ID NO: 66236 - DNA, 307 bp, Glycine max
  Peptide Sequence Number=SeqID_157921
atggatatcatttaccttttccagactttggcattgaagatgatgttgagcatggggaaagaaaagtggtctgtgatcagtgaaagtgttgtatcattggataaaggtgggttatcaatgtgggaagtgatagctcaagactcatggtcagggcgacgcgagactcacgggtgtgtcttccaagggaggaaaatgcgcggagtcgccaccaacgtttattcgaggaaaacgtcggaaaaactggaaaggtgtggtctacgaactttaagcgtgaaaggttcgggtgttgtttttacgcacggggaag

SEQ ID NO: 66237 - DNA, 446 bp, Glycine max
  misc_feature (19)..(19): n is a, c, g, or t
  Peptide Sequence Number=SeqID_157922
gtatcatccccttcgatanacatattgcggcagtagggactaccagcaacaatatgttatcaaagagaaaaactctagatgagggttcactgttatcaagcaagtcggagacccaacatgaccacagattcacctccactccttatgttcccatggacccggtggagtcgccaactgtcgcaacctacccttcggcgagagggcgacgcgagacttacgggtgcgtcttccatgggaggaaaatgcgcggagtcgccaccaacgtttatttgaggaaaatgttggaaaaactggaaaagtgtggtctacgaactttaagcgtgaaaggttcgagagttgtttttacgcacggggaagatattagcaccgcacgtgtccgtcacaagggacgacagccttcaatcaaggtgtttccctcgctcctacgtattcctcaatttcgatga

SEQ ID NO: 66238 - DNA, 743 bp, Glycine max
  Peptide Sequence Number=SeqID_157923
tacccgatggaaagaaagaggggcaggagtgttatgctcgtgtgaaagattcccatgctggccataagacaactaggctaccctatgagaggtgcaccgtcgaaggatatcatcgtgcctttcatcgcatgaggaaagataaagagcttaggggaagtagcaatggagtcatcggcggcaatcaaaagtggttgaagtctaggacacaagggataacttggctcccaaagctaaaaggcctaagtaggaaagaagctaaagtccctgaggaaagcgaagaagtgcaagctttgaaagtggagctcaaagaaacaagagtgatcaaggaaaagctaaagacgacagtcactagggttaggaaagacaacaacgagctcaagcttagaagggccaagagggacaagtcaaggatggaaagcatggtgttagaggataagttgacggcttgtcaaaggtcgaagaaaagtttgacggaacaactgagcagaacagaagagaatatgttgacaattattgataattataaggagaagatgaacctagttgctagtcacaggcagaggctagaggatgaatatgcgaaggttcgctctcactctgaatgggagtcaagagcttccaagggggcatgtgaagaaccctgggaccatgctttggccaacttcgagccttaccctagatatgccactgaggggctagcatttggtagcacaccccagcctaacacctcaaggggcccttag

SEQ ID NO: 66239 - DNA, 412 bp, Glycine max
  Peptide Sequence Number=SeqID_157924
taaagatctttcctctatgtctcttgttactttgtttggcaaattgcaggaacatgaaatggaactccaacgacttaataaaaatgaagaaactgtcaaaaagagcatagcacttaaagtctcctcatcaatgcaagaggaaaatgaagaagaagaatcagaagatgaacaagacttctcactctttgtgaagaaatgctacaaatgcaaccaacttggtcacatcaaagaaaattgtccctcaaatgaggaatggcctgagaagagtgataagaaaaggtatgaagaaagaaggaccaaaaaggcttacattgcatgggatgacaatgactcatctgatggttcagagaaggagatcaaccttctaaccaaggactatgagagcgatgagaacatctctcaagaagattaa

SEQ ID NO: 66240 - DNA, 1354 bp, Glycine max
  Peptide Sequence Number=SeqID_157925
atggctttcgcccagcgacaccactctgttactcagcgtcaagttctcttcttcaccaaattcagtaacagagtttcgctctcttcttctttggcttcgaaacggagttgtaattataattgcttttacgcgaaagcgcaaaatgctctcaacgaggaagcggttgaaactaagagttcggagttgaagaaggatacccaacgcaccccttcttcttccaaactggtccttgttgctggtggctctggaggcgttgggcagctggtagtagcatcactgcttcagcagaatattaagtcacggttgatacttaggaatcctgacaaagccacagaactgtttggtgaacaagataaggagaaactgcaggtattcaaaggagacactaggaagcagggagatttggatccatccatgtttgagggtgtcacacacgtgatttgctgcacaggaacaacagcttttccttcaaggcggtgggatgatgataatacaccagaaagagttgattggatgggagtaaagaatctagtatctgcattgccttcctcagtgaagagtgttgttcttgtgtcatcaataggtgtgaccaagttcaatgaattgccatggaggttgacagatggaccatacacatcttatgatctcaatactttactcaaagcaacagctggacaacgacgagcagtccttataggtcaaggagataaactagtgggagagaccagcagaattgtggttgctgaagcatgcgtgcaggcactagatcttgaagtcactgaaaaccaagtatatgaagttaactctgttgaggtaaagtttcagtggttaggtgcggtgaaggtgaaggtgtgctgcggtggtcggcgacggcaaacgaggtacgctgaaggtggtgcgtttgtcgcgaacgtacggatcacttacggatcagcatgtggtgcgaatgaaccacatgttgattgttcagatgcgttcaacacttctcaggtttttgagtgtcaagaggatgttttgtggtgggctcgatctgtggctcatgaaaacggatttgtggtggtgattttaaggtcggacagaaacacagacactaggactaggaaatgtgggtgtcccttcaagcttcgttgcaagccagtggttggaggagaaggctggatggtgaagttgatttgtggagtgcatagtcatgaattggccaagtcattagttggacatccatatgcggtgcgattgactaaaactgaaaaaacacttattgttgtgtcgcaacatgccctttcgcgggcgagcgaatgcgaggctcatgggtgcgctttccaaaggaggaaagatgcgcggagtcgccaccaac

SEQ ID NO: 66241 - DNA, 681 bp, Glycine max
  Peptide Sequence Number=SeqID_157926
atgtatgatgatgggaatgaagaggacaatgaatatgattcattggatattaaggtggaagaaaggaaacttggtcaatatgattcccctacttttatcttgtccaagagagcaacaacagggaatgaagggccacaagcctccaatgacaaggttaagggtcaaggcactatttttgaaggtcctttggatgttgtcaagaaggcttggagacctagaaagggaatgaaaaagaaggataagttagcttctagtgctactttgaaaaacaaagtagataaggtggtggtcaaagggattgaaaacataactatggtttctagaaaggaggttttggttattagagagaatcaaatggccatggaagaggtggtaaatagtgttcaaaatcatgatggaggttctttaatggacattcagcgagtggaatttcatactacagttataccagagcagaatcgggggataggtttcatagataatagggaaggttttcattattcttctaggccaccagatcaaccaatagttaagtcatctagtcataagccacctgattcacagaatatccatatggattgtgtgaatgaagggaattctaaaattgaggtggtgatggagacaactctttctcaaggagttgctagaaaggattccaaattcgatgtttttgatcaataa

SEQ ID NO: 66242 - DNA, 264 bp, Glycine max
  Peptide Sequence Number=SeqID_157927
atggtagtggaatggagaaggaagaaagatgattggagacaccactttaaggagaaaatgagtcaagaacaagctcaccaccacaggaaatcatggataagagcttggagcccactaatccaagatcaagtccaagattctccactaaatgtgcttaggtgtcatgaggcatctcatggaccaaaaatctaccctaaggcttttgagaaccctatggccttcttcaacagctctggcataatctttttggagtcttctatctaa

SEQ ID NO: 66243 - DNA, 207 bp, Glycine max
  Peptide Sequence Number=SeqID_157928
atgatgatcactggattccgcttaaaatgggaaggaatggtcccaaggcaatcaatcttggagagtggttacatggaggttgcttctttaggttcctacttgggtattcctttgcttgggaaaactcctcatcagagagtttctagcctcttcttgataaagtttctcataagtttgttgggtggaagtcgaagcaattatctctag

SEQ ID NO: 66244 - DNA, 162 bp, Glycine max
  Peptide Sequence Number=SeqID_157929
atgcatggaaagctgaagatgctcaagcatatgaccaaccatattgtcacacataatatgggagatattaaagagcattcacatagatccgacaaaaactctgctcttcatgctagtgtcattggacaacatttggctacctctagagatagttttacataa

SEQ ID NO: 66245 - DNA, 405 bp, Glycine max
  Peptide Sequence Number=SeqID_157930
atggctcaggcgctttgtgagcttcagttggaactgcaaaatgggtcaccttgtaccattgctgtgtcagggaattcaaaaggcgagactgagggattcatccccaaaacatcagcttctaaagagaccaggagaaacaaggtttcaacaaggatttcacactttcaacaaggagaaacaagatctaagaagaagaaaatagaacatttatttgattccgttagttcaagaaattccctatcaattgaaataattaagcaaaaggtagacacaatggtaaaactgtgtgaggtgttagaatctttaaagctcaaagtcattatggctaatatcacttctttttcagacactcttttgaagacagtcgtcatcaaggttaacctccctctcattttcccttcttaa

SEQ ID NO: 66246 - DNA, 885 bp, Glycine max
  Peptide Sequence Number=SeqID_157931
atggaacaaattccattgtttaatgagaaaatgaaattggctcagaaagcagccatggctaaacgatgggaagacttcaagaaaataatgaaggacgaccaggagaacttgctcaagcagtttgatctgtttgagaacagtgccatccatgttgcaactcgctctaacagcccacgactcctcagagaattgatagagatgttaccaaaagaagaaaggtggcaagctttgtgcaaggaaaatcgcgaagggaacacggttttacacgaggttgtgttttgtaagaagaagaaaatggctgatgttgtgtttgagattgaagatgagttgttattgcaacaacaatcatcatcactagaggaaaagagaacattgctagatatgagaaaccaccgaggtgaaacccctttgttcatggctgcaatgcatggaaagctgaagatgctcaagcatatggccaaccgtacaggcacacgaaatatggaagattttcgaaaacatttgcatcgatctgacaaatattctgctcttcatgccagtgtcatggggcaacattttgtgcttgggtctggtgactatcctcgcgggtctagctgtggagggttctggttctttctggtagctaacaatactcccttccccaaatgccaccttgtcctcaaggtggtagatttcgcggatctcggcccacggttcccaggaggtgtcctcggggggttgcccttcccattgcaccaggaccattggggagcagtgaaaggctgggtggatgcgcgagtccgccggaagttggagtttatatgctactgcacctacacgagcgataacttggaagggtccgaagaagcgtttagagagcttcgaatgggttggtccggtgactga

SEQ ID NO: 66247 - DNA, 690 bp, Glycine max
  Peptide Sequence Number=SeqID_157932
atggcagagccattgaagaagcgaaagggatcatcctccaccgccgctgctgctgcccatcgccgccacggaccatctgaagcatccatagcacctattcatccatttttatcatctccaagatcatccacattgttttcatccgatgatcagcgtctatggtacctttctcagttttcttctagaataatcttagaccctaggtacctagacgtagaattctttaatgatgaaacgtttgattgctatcaagtgtttcaaaattctggtcttgttgatttcatgtcattaaaattgccatattatcctgaacttgtaaaggtcttctactgcaatttaaaaattcaggatgacattattatttctgaggtgcatggtatttctatggtcattgatctgtcactgttcttttctttgactcatttacccagtcaaggtgcaccttttgagggcaccattgttgatgactggaaatttgattattcgagtcatgatgctcgtcgcatggtctgcaatgatcaagctgaaatgaccggtagattgttggtcgggttattaacatttgataatcgcatcatgcactatataattgttaggattttgcttcctcgatcttcaaatttagcacaagcctctgaggaggatttgattcttatgtgggcttttcttaccggtcgtcagatcgactag

SEQ ID NO: 66248 - DNA, 558 bp, Glycine max
  Peptide Sequence Number=SeqID_157933
atggagcatgatggaatgcttaaagaggcacaaaaatggttaaaggaaacagctcaatcatgctctactgttgctattctagttgctacggttgtatttgctgcagcctacaccattccaggtggaactgaaaatggcactcccgtattccttcattctcatgtgtttctctttttcactattatggatgtcgtggcacttgctacctcactagcttcagtggtggtgttcctttccatcctcacttccccatgtgagttgtgggattttcacaagtctctcccacgaaaactaaatttgggattcgctttgttgttcttgtcattgatgacaacaatgttagcattcagtgcaaccatgttgctgaccattcgcttggaatggaagaattggacctcaacattgatatatagtgctgctttctttcccgtcactatatttgcaatgattcaattccctgtttatgtgatgacacgaagcatcgtcaagcatctttggaagcaaattaagaaggtccttccaatgagattggttaaatgtttcacgaatctcaattga

SEQ ID NO: 66249 - DNA, 267 bp, Glycine max
  Peptide Sequence Number=SeqID_157934
atgcaagatgagacatatgtggaaccatatatgcctgagtacccggcggcggtagcaactatggaggaagcccctgtagatgcaccttctgatgtggagcagcctaaacatgcagtggaggtttgccaagcaattgcagaaagggtggagcggttgctcaacctaaggatagtgactgaaggcacagaagcacatgatgtcatgcaagactgcctaaggatcgctaggggtgtcactatagagcgtaatgtttatgtcaagtcgtga

SEQ ID NO: 66250 - DNA, 462 bp, Glycine max
  Peptide Sequence Number=SeqID_157935
atggcacatggtggttctcacttgggtgaagatgttgcaatttggctagtaagaatggagaaaaaacttgcaatggaaaaggatgagaaaggattaacatgtcttcaactactttccaaaatgcctcaggccttctatatcggttctaacgacctttctacatcggttatgacgcgtggtggtaacccgaggtcattgaatcacaacatcggttttatgaccatctttgaagggcggcttttctacatcggttgtctagctacaaccgatgtagaatgggtaggtttctacagcggttctaaggcgaaaaccgatgttgaatggaatgggcacgaatggaaaagtttctacatcggtcttcaatcaacctatgtagaatttgaagagtttttacatcgtttatcgcctaaccgatgtagaatgaggatattttctacatcgtttatagttgaaccgatgtaa

SEQ ID NO: 66251 - DNA, 1107 bp, Glycine max
  Peptide Sequence Number=SeqID_157936
atgcatccttattttcctaattcagaagatccaaggtttccaacacctttgggtgtaggacacaatgatcagaaagttcttgttctagcagctacaaatacaccttatgctctagaccaggctcgccaacacatgttcaaggcatgggcaatatacatgatgatgttcattggtcttcttgtgtattgtgaacctagcaaatggccttacaatgtctttttcttggttgataaattgaacagtgcagtacaaactacaattcaggatcttgcggcgaaaggacttgcttctaagatcctgccgcctcctatatcgagaacagattttgacaaagtacttgctagacaaagacccaccgtaagcaagtctgaccttgatgttcatgaggtggctgagtcaaatgatcacaaccaacagcaccagaagatctcagtgttccatggcttgacaaggccaaacatctcaattcagagctaccttgagagaatcttcaagtacgccaactgcaacccctcgtgcttcgtcgttgcctacgtctacctcgatcgattcactcagagacaaccctcccttcccatcaacaccttcaacgtgcaccgtttgctgatcactagtgtcatggtagctgccaagttcatggatgacatgagacaatggcttggatatcatgacttggtctacaaactaataaagcttaaagtggagatatcatgcctctctgaccaagatatcaacatacattttgaggaagactataacaagttttatgaaggcttctctaagaacctgaaacttggtattcatgaggattctcagaacaagacaaagctaattgaattgctcaagtatgactcaagtaagagtggtgatgagatgaccagcctcaaggactatgttacaaggatgaaggaagaacagaatgacatctactacattactggtgaaagcaagaaagttgtcgagaattcccccttccttgaaaagcttaggaagaaggggtatgaggttctctacatggttgatgcaattgatgagtatgctgttggtcagcttaaggaatttgagggaaagaagttggtctctgctaccaaggaaggcctaaaacag

SEQ ID NO: 66252 - DNA, 1143 bp, Glycine max
  Peptide Sequence Number=SeqID_157937
atgtatgattcagaaattgcaatgctcgtcacatccagcgtattaaagccacagcaacggaaatccctctccccacccagcaatcaaggagcactgggaagacaagagttggaatcaatgcctcctcatttgtgggtaatgtttgaagaaggttttggtaggattggaaggttggtgttacgtgtagctacttcccgagatgatgttgatgttgttgcaattaatgatccatttattgatgcaaaatatatggcatacatgttcaaatatgattctactcatggtccattcaaggggaccattaagattttggatgactctactttggaaattaatgggaagcaggttaaagtggtgagcaaaagagatcctgcagagatcccatggagtgattttggggctgaatatgtcattgagtcttctggagtttttacaacagtggagaaagcttcatcacatttgaaggctggtgccaagaaagttgtaatatcagctccatctgcagatgcaccaatgtttgtggtaggagtgaatgagaagacatacaacccaaaaatggacattgtttctaatgcaagctgtacaacgaattgtcttgctcctcttgccaaggtggttcatgaagagtttataatagttgaaggtttgatgacaacagtacatgcaacaacagcaacacaaaagactgtagatggtccttctatgaaggattggcgaggaggaagaggggcagctcaaaatataattccaagttcaactggtgctgcgaaggctgttgggaaagttcttccagagctaaatggaaaactcactgggatggcattccgtgttccgactcccaatgtttctgtggtggacttgacttgccggcttaagaagaatgcatcctatgaagatgttaaagcagcaataaagtatgcctcagagggaccactgaaaggaatccttgggtacacagacgaggatgttgtctctaatgactttgttggtgattcaaggtcgagtatctttgatgctaaggctggcattgcgcttagtgcttcctttgttaagctggtttcgtggtatgacaatgagtggggttacagcaaccgagtattggaccttatagagcacatggcattggtgggagctcaaaattga

SEQ ID NO: 66253 - DNA, 393 bp, Glycine max
  Peptide Sequence Number=SeqID_157938
atgttttctaagcaaccaaacacaggtttccaccaaacccaaaaccaaactttgagaactaatcaagacaataaaaacaaaacaagcgaacagtccaagcacagtcaagttcacagcgtttcgagatattttacaacaaaatgcagaagaaaagaagctgagagggaaagagactttggagagatcggaggaggaaggagcgagaagcgaggatctgaggagcgagttagcggccattggagaaggcgaaggaagcaaaaatcaaaccctagaaaattgaagatacctagcggaggttattatggaaatgaaatggtgccaatgaaggcagaggctagggtggaagagctagctatgtctcccaccatgagaaagcttattttcaaccgttag

SEQ ID NO: 66254 - DNA, 573 bp, Glycine max
  Peptide Sequence Number=SeqID_157939
atggttgaagattcatctaaaaccagtgaggatttgataaagaccacactgacagtgcatacaaagaaaccattgcaattcaaggtcagagctgtggtgacagtgaggaataagatcaaagaggatttcaaagagactatgttgaagcatttggatgccatcaatgatagcatagaaacaagaaatgttgtgctggagcttatcagcaccgagattgatccaaaaacgaaatctccaaagaagagcagcaaagcagctggtcaaagaaatccaatgtcaaagcagagagttaattatacaactgaattcattgtggactcgaattttggagtccctggagctattactgtgacaaacaaacaccaaagagagttcttcttggaaagtataaccatcgaagggtttttcagtggagcagtccatttcccctgcaagtcgtgggtacaaggagagaggatattcttttctaacaagaagaatcaatgctacaacatctctgaggatacctggcaacaagttctagctttcaacgggtttacctatgaaaggactaaatgcttagtaaaaacataa

SEQ ID NO: 66255 - DNA, 162 bp, Glycine max
  Peptide Sequence Number=SeqID_157940
atgacgtccaacttaaaggacgttaaagaagtgctcctgggaggcaacccagtagttatcattacatggcctggggataggcctactttttcaggaggaggaaaagtaagtgaagatgaagatatggcagatcctattgaatatttcattggaggagactga

SEQ ID NO: 66256 - DNA, 357 bp, Glycine max
  Peptide Sequence Number=SeqID_157941
atgccatctgtgaatggtgagattatgttgagaaagtggatgatggacaaagatacactagggtgtagtgggcagggaggtttacaggacctaggggaattagagagtggtgaccacccgacatttcgtgcttttatttggtgcgagaagctcaaaggcctcactttgttattcctaactggctttgagactatactttttgagttgggagctggggatcgatccgtcaaaatcaacaaggttgtgggagattttattgatgatgaggatctcacgccatccgagatagctttctacaggggtgtttgcagtgaagagatatccgggggagtgatggtttcgaccgatgaggaatga

SEQ ID NO: 66257 - DNA, 159 bp, Glycine max
  Peptide Sequence Number=SeqID_157942
atgggtttcttccaaaactgccccgtggtggaacgtcctgtgccattgtgtaacaccatcattgttgaaggaattaatgaaacattgggcttaatccggattttggggatggacttgaagagggcaaataaagtagcgcttaccttagttaatttctaa

SEQ ID NO: 66258 - DNA, 462 bp, Glycine max
  Peptide Sequence Number=SeqID_157943
atggcttatgcagatgatgtggtaagggtaagtgttgaaatttttttcgatggtgatgctcaagtctcattcccgatgtttatggatgagtggagttcaagcttgggtcatgtttctgtgtatggattctttgagcctcagtccatacacaatgcaaaggatatacgtggtgaatctcaacaatacattgaaacatgggttaacgaatcccaacaagaggtttacctaggagcttacttaaatcagatgttgtcatctggttctgttcattatagtcacattcaaaccggaggctatgtgtatggctattacgtcatgcattggatgtggaacatagtaagtggggagttgaacattgattggaccatgtggtttggggatgacacgtcgttagacaaggagaccatgacaacaatttgcaagaaacgggcatcatattttttaaaagttaaaatcatctga

SEQ ID NO: 66259 - DNA, 581 bp, Glycine max
  Peptide Sequence Number=SeqID_157944
atggataagagcttgaaggtaggagaagatgagtggagcaagagggaaaaagggggaaatgagggcaaggaagtttgcatcaagggtggaaataagggaatggataacacaactcaagctatggacatagtggtggatggtgaggctgggaatgaactgcttaatcactccagaagagtctatgccatagtatgtaacgctaaagttggtgaaggggaggaattaaaaggtagatttaacaatccttggactctagttggagatttcaatgacattttaattccatcggagcaaggaggtgaggtatttttgcagttgagagctacaatgtttaaggagtgtttggcactgcataatgtatcagaggagttctgggtctttaataaggaggagtttggtatcattggtagtgtcgcaacctacccttcggcgggggcaaacgctaaccggatgaagaatgaagaatggatgaagaatgaacgaagaacggtgaagaacgatgggatggaggttgaacagcagctcgcccaggcgagttggttgcttcctccagaagtttccttactcgcccaagcgagctg

SEQ ID NO: 66260 - DNA, 1347 bp, Glycine max
  Peptide Sequence Number=SeqID_157945
atgaaccttttgtcgccctcccaccgaaggaccccagtgattatagaagagggggaaactttatgtgcttattcgagatttgcactcctaaggcttgatcctcaggagttagttgttaagctctatatcctagggaggggatttgagctgaatgctgatggtctccctttgaagatcttaaggaagaacatgactactctagctcagacatggagcgttctttcttattgtaacttggtccctacctcccacacctctgacatcacattggagagggccaagttcatctatggcatcattatgaagatggatatgaatgtggggtacctcatctcccaccagatctctcttattgcccagcacgattcttccagacttggattcccagccttgatcacaactctgtgtaaggctagaggagtccaatcagattctagatccctagagatcctgagccatgccattaacttggcatacattaagaagaaatgttggaatctagatgatccaacagtgacatttagagggccaaggaaggccaggggtaagagattagaggcccccactacttcagtagtgccagacacttcaactccttcttcatccacagctccagatcctcccagtttgactccagcacaaactccaactattcttgctccatttccagttcagcttccagctccttcatcttctggaccatcagaattttcattcactctagagatgcttcattcaatgctacaaagcctccatagagggcaggtcatccttatgcagagtcttcagagcctcgacctgccttccatcatgaccgtggaggagtttcagacacaaatgtacctggctcaggagaaagagacttctacagatcagagaccagagccatctcctgcacctgttcctgaggagaccttgccatcttcaccagtcatggagcccaagcagcctatccaggatgtaccagctactccagtactggatcttaatgaagatcagccacatgatgagcaggatgttgtaggagagcaacatcctcagaagcttggttcaaagcaaaattgtcccaaatttgggggagtaattgccaaggttaaagagaggctaaatcatgaagtgctaaaagtgacagttaggctcagctcagcatttgggctaagcgcgcataccacgctaagtgtagcttcaacgcgcttagcacgacagaagaatttggcagagcataaatatttaggttacgcgctaagcgctgcggttgtctttagccaggctcagcgcatgactgaattagggaacaacaacaacagacacacaacacagcttttagccagagcaagtacaccatag

SEQ ID NO: 66261 - DNA, 315 bp, Glycine max
  Peptide Sequence Number=SeqID_157946
atggcagcaggaaaagaagaaaagaagaaagaagacattgaagtgatcactgccatttacaaagttaacctgcactgcgaggaatgtgggagcaaaatcaagaagcatctcatggttacccaaggggtacagagtgtggaaatagagtttgagaaaggagaaatcaaggcaaaagggaaaatagaccctttgaatatcttgaagcttatagagaagaagagcaagaaaaaagttgaattaatatcaccaaaagtgaagcctaaggatattactactacggaacaaaagacaaaggaaataaaagataaaatttga

SEQ ID NO: 66262 - DNA, 234 bp, Glycine max
  Peptide Sequence Number=SeqID_157947
atggtttgggttcgggggtgttcaacccttggcaaattgtggctctaccgcttaaggggtcacaattggttccctgagagtactggacaaccctttgcgattattgggaggcctactagatctaccttctgtcaggttatgaccgtcgaggtctacgaggatgtgggagatttcaacgatgatgaggatctcacgccacccgagatcactttctactgggatgtctatggttaa

SEQ ID NO: 66263 - DNA, 204 bp, Glycine max
  Peptide Sequence Number=SeqID_157948
atgaaggagcaagaaggcaatgaagatgacaatgccaacaagaaacaggaagagaagaagccgcgtttcatacataacaaagtgcgggtttgtacgtcaattgggttgaaacggattaaagacactagcagcaatgattccatgccatcaaagtcgccgcacgaaaactatcatcaacattatcttcatcaacctaaaaaataa

SEQ ID NO: 66264 - DNA, 1062 bp, Glycine max
  Peptide Sequence Number=SeqID_157949
atgaaaaacctcgccaacaatgttatccagatttggctgcaaaaactagaagatgcatctcttgagctgaaagacatcatggatgagcatgactatgaaacattgtggttggaatatgaagaagtcaagtgttgtctacctttaccagaaatggtacaaagctcttgcttatcttcttttcatcccatccatgctatttttctactcaaacttgctaagagaatgaaaagcataagtgaaagattagatgaaattgttgaagaaagaaagaagtttcatttcattgagacggttcatgagagaaaaagtggtgtcatagaagagagaagaagtggagtcatcaagtggaatcaaaccagctcactcatcattgagccaaaagtctatggaagagaaaaggataaggatcaaattgtaaacttttttgttgatattgagatagatgaattttacaaagttacaagtttcaagatccacgatcttgttcatgattttgcgcaatttgttgcaaatgaggcttgttgcattacatgttacaatgatataactacctttgctggaaaagtccaccatctctgctatttgtatgaggaaccattaattcaaatattgaaattagactattgttgttctctccaaaagttgcccaatagtttgatatgcttaaatgctcaacaacggctatctttcaagggttgcagttcactatcaagcttgccacctaagatagggaagttgacttacctaaaggttttaagcatgtacattgttggcaaggaaaaagggttcctcttggcaaaattaggagcatgggagttgaaagaaaatatttacatcaataatctagggaaagtgaaaagtgtaacggatgccaaaaaagccaatatgtcaagttttcagttcctaacttgtcttgagaaattgtcgattacaagatgcagaaaggtggaaggatttcctaaggctttacaacatatgatttccctcaaggatttatggttatcaaatcttccaaacctacaatcctatcctgacaactttggaaacctttccttgttgtag

SEQ ID NO: 66265 - DNA, 267 bp, Glycine max
  Peptide Sequence Number=SeqID_157950
atgacaattggtacgcttgccaaaagtcctaacagaatcccatttccagttcagctgggaaagtggcttgatgactgggtggttgtcggaaatggcgggagggagagttgctggagaatcgggcaagggactgtggtgaggcttcaacaaagaaacatggaaaacaagcgcatgctaagcacaattttaactagagagggaattgcgctaagcgagaagggtcgcgctaagcacaattccaacctaagagggaattgcaatgagtga

SEQ ID NO: 66266 - DNA, 225 bp, Glycine max
  Peptide Sequence Number=SeqID_157951
atggccataactatattttggtcaagttgcaaggtgagctttggagggaattggaggatgtgctttttcaggaagaagttctttggtttcagaagtctagatgtaggtggcttaagtatggtgataagaattcaaaatactttcactcctaaattactaaacttcgatccctcgtcagaccgaatcaatccaagcttcgtcctcagatccctcttgttggactag

SEQ ID NO: 66267 - DNA, 594 bp, Glycine max
  Peptide Sequence Number=SeqID_157952
atgaatgtcgaagaacgcaaaataggggaggagcttgccacccagctcgcccaggcgagcaaggttgcttcctccagaagcaaccgccttctggaggaagaaacgggaaggcctaagtgggcttcattgctatttgtacccccctttttactaaatgcacccccttacttttttgctttcgaagaagttacggaaactcacggattgcgcaaaaacacctcctatcgatttccgtcacattacggaatttcacggatcgcggtgccaagtatcttgaagcggccaatcaaaggttgcatatcatcaaataataatccccagacgaaattagggtatgacaactaccgttacccaccatcacctgaagagtcgacatcgatattaacgaataacaactcggtgatgagcgatggagccatagaggcgaaatgtctcgagagccgatgtcccagcgagagcattaaggctgatttggggaagaggagtgggttcaaagtctgtgggaacctcttggtgatggattttgtcaatggggataatgttgggtctacgtcatcatctatgataatgaggtggaggcgaggctggaaatag

SEQ ID NO: 66268 - DNA, 177 bp, Glycine max
  Peptide Sequence Number=SeqID_157953
atggtggatggaaatgcaacaatagaaaatcctagagaagagtggactgaggaagaaagaagattagtgcagtataatttaaatgctaaaaacattattacatctgccctaggaatggatgaatactttagggtatctaattgtaaaaatgcaaaggatatgtgggataccctacaa

SEQ ID NO: 66269 - DNA, 639 bp, Glycine max
  Peptide Sequence Number=SeqID_157954
atggctttgagaaagcttcccgcgaagaggtcccagaagggcaccactgaaaagggttccagtgtggccccccaagcgaacacagacttcgaaaggcaccgattccggagcgccgaacatcagcagtgcttcgagaccatcaagggatggcattgggcaccacttgtgtcacccatggctaaattcgacccggagatagtcatggagttctatgccaatgcccgacctactaggaggggatgccctcagccaattcctgggccaccccctgatcttagaggagggccaacagtgcgaggcgaggcaccacaacagcctggggacggccaacagcaggcagcagacacactgccaccacctccagagtccacctcagctcgtctacagaggttggaatgctatatgcaacatggggctagccagtgtgtagccaaccacaggggacagggccagggttccaccctttacacatggcctactccagagaaatttgaggttgcagtagcatggcctgaagattggcctgattctcagacaggggaaggacttgtggggacctccggagaagcggataaggcccaggaagatgaggatatggctgacttgttcgacttcttgggagggagtgaagccatatga

SEQ ID NO: 66270 - DNA, 75 bp, Glycine max
  Peptide Sequence Number=SeqID_157955
atggagcctccgagaaagaagaaggagagacgagagtcacttatttcaaatcgttttgggttgggactattgtga

SEQ ID NO: 66271 - DNA, 804 bp, Glycine max
  Peptide Sequence Number=SeqID_157956
atgccatttaggacttatgagaaagattttaagcgtaaatccagtttgagcaagtttagattgattttatggactggtgtgaggattttggctgtgcagaaaaatgcttgtgtgtggttggctgtggaaagagtagtgcagaatgagttctggatgttttctagtagatcccaacagtcaaaattgagaaaagctgtgattttggttggtgtttttagcagagttttctgcctttgccctgttttcttggctgtgcttgggaggattgatggggacccggtgttgagagaaacgaggatatgggctacgtgggagtacgtgagctcaaatggaggtgggcaacaggggatggtgggtttatgcgcgctttgtggatgtggaaaacttgttgttcaccatcgcccgaccgccacctatggtacctggagatatgtcgcgggggtcaggagaccttggggacgtcaggcgagctcctggcagtcaacagataaaaggaacaaagaccacaaagcaagggggcttgtggtggctggccagctgcttaaaaatgaagacatgaggctaagatggtctctggtaatcgattaccacgggaaaggggactggaacattgtggaggcctctggtaatcgattaccagcctgtgtaatcgattacacagagggatgggtcactggtaatcgattaccagcctctggtaatcgattaccaaggctgtgtaatcgattaccagagatgaaaagccttaagatacccattttaattgcatgtagtggttatgaaacgtattgtgcggcggcatag

SEQ ID NO: 66272 - DNA, 582 bp, Glycine max
  Peptide Sequence Number=SeqID_157957
atggggctaatgaagttgtcgtttgacttcctcggcattgcgcttcgaaacgcgaggctcgccgtggaccggcttgacacgctcagggaaatcgaggtggccaaactcgtcgtagacacgccgctgccgttctccaccaacgccgagatcggtggctacctcttcggcttcctcttcgcggcgcaggacgcgtctgcttcgtcgcttctggccgaagtcgtcggaatctggtcaccggagtcggatgaactgattacagtcgatatgcttagggagatgaagtacactcaggcggtggcatgtgaggtgggaaggattgagagaggcagttggcattctgatgcaagctccattggagcttgtaggcctaggatcttcttcatcaatggattcctttgcttcttggaagatgaatggcagcggaatggagaaaggaagagagagaggagacgtcacttcaaggagaagatgagtctagaagaagctcaccaccataggaggccatggataagagcttggaggaagaaggagatgaatgaagggagagggagagaagagcacgaaattttgtgctccaaatga

SEQ ID NO: 66273 - DNA, 411 bp, Glycine max
  Peptide Sequence Number=SeqID_157958
atggctacaccacccagctctcctcctcctcctcctactggtgcagcatcgcaatcgccatctaccttgaagtggacaagaaaagcaacacgactaagatcattggcgactagactagttggggcaaagagactgctggtccatgtcgatcctatgtccgggaaggccgacaatccccacagcaagaagttaagaacatatttgggcatcatcgctcgtgataaggctgaaattgatatccctgaagcatctgatctgatgacaaaaaagaaaatacttcagactatgggggagtggtggagacaatttaagtttgatttgacgtcaaaatgggcactcgtagccgacaaggaaagtgtcgatgacactgtatgcgaaaagtacatcattagcaagaagaagtgggcctaa

SEQ ID NO: 66274 - DNA, 378 bp, Glycine max
  Peptide Sequence Number=SeqID_157959
atgatgacattcaagaatgagttcaagattgagtcaagaacactacaaggatcaagagcaaatttgatttcaagaatcaagaaccaagattcaagattcaaagattcaagaataatcaagatcaagattcaagactcagagattcaagaatcaagagaagacttaatcaagataaagggtacatctacttgggctgttgtgactaagaacaagagagggtacatatcttgtggatcagttctagtggagggtacatccacaaggttgttcaaagagaacaagggagggtacatcccttatggatctttgcttgtaaaggattttacaaggttgaaaagaaatctcaaggaccacaggtcgcttggggactggatgtag

SEQ ID NO: 66275 - DNA, 150 bp, Glycine max
  Peptide Sequence Number=SeqID_157960
atgtggattcttggtaatcctaaaaagattgaaggtgctgagtactctaatgagagggccatttacattagtaatcatgcatctccaatagatatatttcttataatgtggttgactcctatagacactattggcattgctaaggaggag

SEQ ID NO: 66276 - DNA, 507 bp, Glycine max
  Peptide Sequence Number=SeqID_157961
atggaagagaactatggtgctaagcaggaagacatcatcctttatggtcaatctgttggaagtagtcgtactttggatcttgcccctcgtttaccccgtctaagggatgttgttctccacagtcctatactatcagggctgagagtcatgtaccctgtgaaacggacatactggtttgacatttataagttgtctcttctaagtcctgtcgcaacatgcccttttgcgggcgagcgaaggcgaggctcacgggtgcgctttccaaaggcggaaagatgcgcggagtcaccaccaacgtttatttgtggaaaacgtcggaaaaaccgaaggaaaccggtcaaaatgaaaattctaagttcgggagttgtatttacgtttgaggaaggtattagcacctcttacgtcgacaaaagcggggcttttgctcctacgtaccctccatcgaagaggaaatcagacctacgtagttctttcttaagagtgaatcaagcgattcttttgacttga

SEQ ID NO: 66277 - DNA, 267 bp, Glycine max
  Peptide Sequence Number=SeqID_157962
atggatcctgctgagaaaatgattgagtcttatggggttgttggttggatagcagaaacagaacatgcaatctcttcaataagaactgtttattcatatgtttatgggctttgcaaaggggttggtgttgggatgtacgggagtttgagggggttcaaaggatggtgtgacaactatgcacatgatttcattgccaagttgccaagtggatatgaaactcaattaaaggggcgcaaaaagcaatttgctttatttggaaagcactaa

SEQ ID NO: 66278 - DNA, 774 bp, Glycine max
  Peptide Sequence Number=SeqID_157963
atggaagaaccatcgaaaaagcggaaaggcacttcgagtcggagtcaacggcattccggggcacaggaaacctcaatgccttcctccattccctctggatcattgttctcatcaaaggaacaacgtatacgcgaaggtgtaccatttgaaggtgcactgattgacgattggaagtttgatttctctatacatgatgaccgccgattggtttgtaccaatcaagcggatatgaccggaagacttcttgccggttcattggcttttgaaagccgcatcctccattaccttattgttcacatcttgcttcctagatcttcaaaccttgcccaagcctttcataaaggtttacaaattgattgggcacaccttgttagatatcgcatgcataaggcattgcgattgaattccccattgccttatcctcatcttgttacccttttccttcaacacttcaacatccctcttgattctgaaccctatgttccaatgaagagatcattccttataggcgcttcagttatagcatcctttggttatattaaggagcatgatgactcttggataaagaagggtgctagaaatgttggtgaagaaggacatgagggagaagattcatctcttctttcgaagattttggaaaagtttgacggtcttcaaacctttgttggtgagaggtttgacactttggaattgcaagtggatatgcgcttcaatgaaatggagtcaagaatgacaaagttgaagaatgacttatgttgcttaaggcttggatag

SEQ ID NO: 66279 - DNA, 352 bp, Glycine max
  Peptide Sequence Number=SeqID_157964
gcctgatcttggtggtggtggtgtttcttcttcttcttcttgttttttatattataggcgaagaccctttatcagagcaagtgctggagcaagcccatgtgagttcagtagcctgaactctccgctggagccacgttccatggtggggaagttcctcagtgctgttcttcagaaccaccctcagatgttccatgtggctgttggggaggagctgaagctcttggctgaggatcgtgatgcggcacatgcccgcatggtgcttggttctgcctccgatgaggccttgcttcacagttttatgtgggttgtgatgggaggatctttgaatgttgaaatgttaatcatgctgtag

SEQ ID NO: 66280 - DNA, 285 bp, Glycine max
  Peptide Sequence Number=SeqID_157965
atgaagaagaagaccaagatccaccgaatgtatcaggcgaatgccgagggagattccgacgagcttgtagatcaaccgaaggtgaaggacaagatcggtgttgtgcctcatggcctttcaatcgattcagatgtcatcaagaggtgttccagggtatcgtttcgtagttctggttgcgggaaaaatttgcaaatggaagaaatgaaggttgcttcagacttgttggtgggtgaccctgcttcactggagaacaaaattgatgcaattcatttcggtggtccctag

SEQ ID NO: 66281 - DNA, 810 bp, Glycine max
  Peptide Sequence Number=SeqID_157966
cctcatcctgaggctttcaccatggttgatgcaaatagatcacggctcaacattcaagaggtggaacaaacccttacccgaatgatcaatgactccaacactgagatgcagctgaaacttgatcaggtcactgcatccttagttgagctcaagagtttgttcactcaacagccactcaaccaacctgggagctctatgatcaacaacatagagaggacccaatatggtagcagactcaatacccaagtgtttgttggaattcctcagacacaatcgttcccatcacaaacccattactctacgaggttttctaaggttgagttccttaggtttgatggaatgaaagttaaggagtggctttataaatgcaaacaattttttgcactagacaacaccccacctaaatcgaagaaaaggcagagaggagagctaaaggactctatcattctctttacacctggtcatcaattgaaacataagagatcccaactcctagtgatagaaatagaggatgatgagctagtagatgagggaatagaggtgatcaaagagaatggggtgctagccaagaagttggggtgtaagctagaatccataaccccactccctgtcagtgtggcaaatggtactcgattagaaacattgtatgtccgcatggtggagtggttatcaactctcaacctaattgtgtgggattttgctaagctacatatggagttttctatggaaggtaggaggtttgttctcagaggtgctaaaccctataacatcaagctgattaataacaaaaccttatcccaggcgatttaa

SEQ ID NO: 66282 - DNA, 1113 bp, Glycine max
  Peptide Sequence Number=SeqID_157967
atggtcatccatgcttgcaggagtgatgacttccctttcttgagggttacgttgggtagtctgcccttcttcttcatgtataaatgtttgtttgaggtcttgggtctcattcttctcttgaccgcttttcagtgtgctcttctcgagcacttgaatgtggccccttcccaactccacccgaatagttgggccatgccgagggcctttaaaattttgtgccccttcttgaacattcggcctaatgtgtcggtcttcctatttttcctccaaatgaagctaaatggcaagattggttgggcctccttgaataggatggggagccctgcttcctgttctactgacaatctgaccccaccaggaattatgggtgacttccattgggggccactggtgaagcaggtcgatcctactggtgggaccatgcgaccatctgctatcccccctattgctggagaagtaggtcaacctgctggtgaggctaagaggaggcaagatgacaacgttagggtgtcgggccacaagaatttgagggcctctataagcctttgtgcattgaggcaagttgcagggttgacagctgctatcgaggctcttgctctcgatattgttattgttgctacttctactcctctacctccttttgccgtagttgttcaggaggttactcctgctgctaaagttgatgcgtcggctactttagctggttctattgcagcatttttgtccaccgttgtcatactgttgttgagtgtcaatgtggtgaccactagtgctctcgtgatgtcgtcgccccttactacaactccaccagttcctccttctactgtgttggtggcggcatcaccttcctgtttttctcgtccccatgtttctttgaatcaactgtacgcttccaatgatgttgattcattgtgggttgcgtattacaaaccggttgaaaaatgctacggactccgccaaagtcttcatttaaagaagtttggcgattctggaggagaacggacaacaataccaagagactctacacaaggtggcatccttggaggtagaggtcaccaagtggaaagctattactcacacagtttggagacaggagcaccccaaggtagctaa

SEQ ID NO: 66283 - DNA, 1245 bp, Glycine max
  Peptide Sequence Number=SeqID_157968
atggaaccatcaaagaagcgaaaaggcacttcgagtcggagtcaacggcattccgggtcacaggaaacgccaattccttcctccatttcctttggatcattattttcatcagaggagcaatggatacggtacacaaaccttttttcttatcgttccattattgacccaaaattcatagatatggatttcttttcaaatgagagttttgaatgttttcaagcatttgaaaactccaatcttattccattcatgtctctaaaattgcctgtttattctgatcttgtcaaagccttctactcaaacttagaaatccaagaaggcaccctaatgcatgaggtttatgggattaagatagtcattgaccagtccctattctatgatttaacccaattgcctagtgaaggtgtaccatttgaaggtgcattgattgacgattggaaatttgatttttctgtgcatgatgcccaccggttggtttgcaccaaccaagtggatatgaccggaaggcttcttgccagttcattggcttttgaaagccgcatccttcattacctaattgttcgcatcttgcttccgagatcttcaaaccttgcacaggtttctgaagaagatctcattgttatgtgggcctttcataaaggtctacaaattgattgggcacatcttgttagatatcgcatgcacaaggcattgcgattgaatgctccattgccttatcctcatcttgttacccttttccttcaacacttcaacatccctcttgattatgaaccctatgttccaatcaagagatccttccttacaggcgcttcagtcatagcatcctttggttatcaaaaaaagcatgatggctcttgggtgaagaagggtgctcgacatgttggtgaagaaggacatgatggagaagattcatctcttctttcaaagattttggataggtttaatggtcttcaaacctttgttggtgaaagaagttgtcatcatcaaaaagagggagattatagaaacaagcttcataatgaatcaagattgattcaaagaagttttgatgataacaaaggtgatgacaaaaagctcaaagaatcaaggaatgagttcaagatgttcaagattgaatcaagaacacttcaaggttcaagaggaaatttgatttcaagaatcaagaatcaagattcaaggttcaagcttccaagaatcaagatcaagattcaagacacaagattcaagaatcaagagaagaattaa

SEQ ID NO: 66284 - DNA, 399 bp, Glycine max
  Peptide Sequence Number=SeqID_157969
atggttgaaagaggaggagaaggaaatagaccaccgaggaggactctaggttactatgcttatcaacaaggcccaaaacattacaacaacatagccattcctcctttcagcaataaggtcatggaattaaagccaacattgattagtctaattggctcgcatccctttgccggaatggatcatgaggatccatacacacatttgtctaccttcatggaactatgcagtactatgggagcttctgatgaagatgttgaagctgtaaggcaaaaacatggtgatgcaatcctacccgcaagggcattggatagaagactccaagtagattgggccagagatccaagggaaggccctagggttctcatgagccttagggtagatttcgagcccatgggctaa

SEQ ID NO: 66285 - DNA, 734 bp, Glycine max
  Peptide Sequence Number=SeqID_157970
atggctcaagtgaagatcttaaagcaaagtgaagttgctccaccaccatgctcacttccctcaaccatcatttccctcactttcttcgatattccatcgttctactgcaaccccatccgatgcatcttcttctatgactttccccaccccacacaccactttctccaaacagcacttcccattctcaacattcgtgatcttgttgacacccttcatgaccaacaacaacagcaacaagttaaggacttggttctacgggcaaaggtgttcacgcttctggagtgcatgttgttcgagaactttagttcggagcgagtgaaggaggaagctgcgatgacaatagcagcgatggtgaagttcaacaagaacgtgtttgtcggcccgttggtggacgagattctctgcaacagcgagatccccaaaattgtagggtttttgcgttcaagcgacttggggcttggcgttgccgcgttggattgtgttttggagcttgggtatatagggagaagggaagtagtggaagcgatgttgaaaattgatttggttgagattctcatggacttgcaaagggaagaagggtgttgtgagagtgattgtgattttgcgtttgagtgttgcatttcgaggtttgcgattcaggtggaagttggggaagggttgagtggtgaagagaagagagaggttaagtcagagatactgaggattgttaaggaagcttctcagtctgaagccga

SEQ ID NO: 66286 - DNA, 153 bp, Glycine max
  Peptide Sequence Number=SeqID_157971
atggaggagatacatggagaagaagatgaagaacaaggaattaaagccttggatcttcttcatcaatggagtcctttgcttcttgaagatcaatggaaacaaaatggagaaggaggaaaggtgattggagatgccacttcaaggagaagatga

SEQ ID NO: 66287 - DNA, 858 bp, Glycine max
  Peptide Sequence Number=SeqID_157972
atgttgcataagaagaagaatggcagcgaaaacggcaacaacaaggagaatgaagacaccaccatcaccaatgtcttgaaggtcgaagcacactacgaaggttgcgctccttttagggactgcagattctctgtttctgtacacatggagtcagtgtcgcgtgctaatttcttttcattcgaaagattctggctaccgtttcagtttagatatcctgagaattctgctcctggtcaactcccaagaacagtggatgtaattgcagaagtcgaaaacaaagaggctaatgcaccaatgtacagtgctgaagatgtcaaaaacattaaagagatagctgcaagagatgatgaatttgatttgctaagtaattcacttgcaccttctatatatgggcattcttggataaagaaagcagtggttttgttgatgcttagtggggtggagaagaatttaaagaatggcactcacttgcgagggttagagttttctcttgatctcctttctgtttcatcgtatttgagtattttagattttgatattccttttcccatactatctttgaccctgtcaccactgagctacagtttactcaatcccacagaatttttaggaaacattgtggttgaacatgattatgctgagtgcactggatctgctattcaagctttagttttgtttaagaagctatatccaaggcatagggagacagagataaagaattccattgccaatgcagttcatgtggcgagtaaaacttacactaattgtgctgccattcgcaaagccattaaatttctactttcaacactgaaagaggataatgggtggggagaaagctatctttcatgcccaaaacag

SEQ ID NO: 66288 - DNA, 486 bp, Glycine max
  Peptide Sequence Number=SeqID_157973
atggcttctcatctaaaaggtgttgcaaaatcaactatgttagatcaaatacgtaaggagttgtgtgagtacaagagagataatcctgcaagcacacaaaaagacttgcagagatggcttgagggaaaatttgagttgaaagttagtcaaggaacaatatcaaacacacttaagcggtcagatgactatctctctgctgaaatagaaaagggaagagcagagatcaaaagacataaaccaataaaatatcctggcatggagaaggttgtttatgagtggtttctccagcatcaagaacatgtgaatatcacaagagaattaattttgcaaaaggcaagagatacaatgaaactcgtgtatcctcatgatgattcagattttaacttctctataggatggcttgggaaattcaagcaccgacatggcataaagtcatttcatcgttttggcgagagtggatctgttgatgtacaagacatggagtag

SEQ ID NO: 66289 - DNA, 1770 bp, Glycine max
  Peptide Sequence Number=SeqID_157974
atggaaaaccagttctttctggcttctggggtgtcacaaacacaacaacaccctcttcactttgaaccttcaccaccaaatccttcttcagtgccctcttggcaatcactctcacccccaaacatgggaattcaactaacagttatgaattgtgcccctgagcaaacccaagattgcttttacaaccccaattgggacaagtcaacggcagatcatggccttcaccattttgattcctcagcactgagttcaatggtttcatcaccagcagcatcatccaaccccaacaacaagtccaatgagaatttcatcatcagggaattggtggggaaattgggacctattgggagctctgatgagatcccacaacactctcctcaccctttggttgtggcatcttcttgcatgaatagtaatggcaataacagcacctacacttcatgctacagcacccctttgagctcccctccaaaggtgaacattgtccacagtttggtgaatgagaggttggcaaatttgggaggagggaagtcaacaatggctttgaattccagtgtggctgaattctcagctgatcctggctttgctgagagggctgcaaagttttcttgctttggcagcaggagtttcaatgataggagtgtccaattgggggtgaacaatgctgaattggctcaaagatctgcaccagcaatggaacatggtgggaagttgcctagagtctcaagtagtccattgctcaaaacacttggatctcaaatgggtgcccaagagaacaagaattcagcaattcatcaggagcaggagaaaatggaaggggccaattctcaagaggaatctacaatttctgagcaagccccaaatggggaaattggggtgaaaacttcacaggatatgatgaattccaggaaaagaaaagcttcttcgaaaggcaaagccaaagaaacttcaaactcttttaatcctaccaagggtgttgaaggtagtgaggattcaaattcaaagcgcagcaagccaaatgagggcgacggaaatgaaaatggccaagtgaaggttgaggaagagtccaaagcagaggaagagaaacagaacaaaagtaactcaaaacctcccgagccaccaaaagattacattcatgtgagagcaagaagaggccaagccactgacagccatagtcttgcagaacgtgtacggagggagaaaatcagtgagaggatgaagctgctccaagatcttgtaccaggttgcaataaggtcactggcaaggcacttatgctagatgaaattataaattatgttcagtcattgcagcgtcaagttgagttcctgtctatgaagttggcttctgttaacacaaggatggatcttagtattgagaatcttatttcaaaagatgtattccagtcaaacaattctttggcaacactcccaaatgcagtattcccattagattcctcagcacaaaccttttatgggcaccagcctcagcaaaacaacccagttgcccataataacatacctaacagatcggtgacccactgctcagtggacccattagatacttctttgtgccaaaaccttgccatgcagttaccacccctaaatgtgtttaatgatggtggctctcagtttccattagcattcttagaggacgatctccacaccattgttcagatggggtttggccaagcagctaacagaaaaacaccaatacaatccccgagtttcaacggttcaaataatgtaccacagatgaaagttgagctctga

SEQ ID NO: 66290 - DNA, 420 bp, Glycine max
  Peptide Sequence Number=SeqID_157975
atgcgagtttatggaacagaagaagaagaacatggaaggtataagtggtggctagagaaattagctgacataagcttgcgacaaagtgctgcatatggagtatggaattttagctttaacattctttatcattcaactcaggttatcgctgtgctatttggaggaatgtctattctagcaggtcatatcacagctgagaaacttagaaggagttggagcaacaaagcaccagaatctattactttgtcattcaattgcccatcatataaaaagttaagcatagccttgaaagcttctagtgggacatcccttaaagtaacttctgaggacatgctttcttttgggcatgagaaaacttatgcctctggctttctagacctatgtaagtcctcatggtacaagcatacgagttatatttga

SEQ ID NO: 66291 - DNA, 447 bp, Glycine max
  Peptide Sequence Number=SeqID_157976
atgctgaagtcacccgcttttcgcaatgcattctttgttcttcttcttcatttgctgctcgctttggtctctgcacgaggatctcacataaccacttggaacattctcaccagctacagtaacaacagcggctttggcaaagaagttgtcgaagaaattaagaggaagatagagagctacaaccagagctgccaaggttctgagggtattatgttccaagacattactactctattgctttctgttgttgcaacatgtattatgttccaagacattactacgttctactacactgtcggtgatgaaatcgtgccacttgagaaaatttttcagactctgaggtgtgattcaaatggactcacaatagcatctgcagaaagcattttagagtcagagatgtggaatcctgtgtcttcatcaagtgttattgatgagttgcatgcttag

SEQ ID NO: 66292 - DNA, 885 bp, Glycine max
  Peptide Sequence Number=SeqID_157977
atggaaaacttgttccttcgtatttcttcaacgtgctcctttggtgtcaccattaccgattcccgtatcgtggaaaaccctagaatccaccttaagctgcgcagcttcttcactctctctctcattctctatgaggccatttcgaagctgctcaaagaggttttgtgttttctgaatggcaaccgcaccggctcatgctccggtgaagtcgcagcctctacacaacttcgccctccccttcttgaaatggggcgccagcggcaagaacagcaccaccaccgcttccgccgcccctctgaccccgactcccgcccccatcgcctcggatccagaaccgcgcgcaaccgattctcgctccctctcaaaccattgccaccaccacaactacacaaagccgaacacgatgacgcagacgacgccgtgcagaagccatggaaccagcgccctcgcaagcccacgcttctccccaaggccacaatcaagatcggcaccggaccttcccgaaaccaccaccacgccaccaacaacggagaattccacgacggcggcggcggtggcggtggcgacaacaacaaccccgcaccgaagtcgctgtggctccgtgggttttctgtcaagagtggaaatttcttctttgttaattgtctttcagtggggagtttcttattttatttggttttagtgcttgtcagttatgttgaggtgtcatgtatcttagcagatacagtatattttatattctgcaaagcaattatgcatctttttctttgttttcactcctttagttttgtagttgaaggattcaagaaaggatttagactacgggaaattgtggaagcctccatcaaatcatgggtttataccctgtacaaagcctactcctaa

SEQ ID NO: 66293 - DNA, 252 bp, Glycine max
  Peptide Sequence Number=SeqID_157978
atgaaagggagggctgagagcattttgggttttacaaagagacatcattttgaaattttgatcacgccaataaacaagcatagaatcacggttacctcaaggaaaaccacaaaggtcagaccgggcttcgttctcaaccgaaaccgcgaggcaagtttggaagattctacttctgttaaagggttcctctcggtgtggggtttcaatggagaacaacggcggtttgtggtggctactagtggctgtgggtga

SEQ ID NO: 66294 - DNA, 1152 bp, Glycine max
  Peptide Sequence Number=SeqID_157979
atggccaaatttggagcatcttcatctgtaggcatgttggctacagtcggggatggggaaggtgtggatgtaggtactcgggatggtccacgtggatcaatcggggatggggatggtggagatggtctaggtgcaacatcgggaggcctaactggcatagatataaaagacggggatgtggtagatgatgtcagactatctcgaggtggtagtagtctaaccacatatcattttttctttgcagttgtccctttcccactggagtcatctgacagggcgtccgctaagcgcaacactcatgggctaagcgcgaggaagactctggaagaagatgagctgtacagtttggactggaattcagagcttttcatgtctagggtttctagagagagaaaggtccaagttccagagagttttgagagattttgctatgtgaagatctgcagagaccagagcttgaagcaggagccggaggtttctggactatggaaagctaaatcctctgttgaatcttccttgggtaaaatgaatatcttgacggcacacgatcaagggtggaaacaagagttaagtccttacaatcaatatgaagaagaaagaactcctaatcttgaaagtgtgtttaaggaattcgtggcataccatgccagctcaaaagctaatcaaaattcaatgaaaaatcatgaaattcattttggtaagagctactcaatagaaaattttcacgggggaccaaagttacaaccttactatcaaaatgaagcagaaaaaggttccaatctggataaattgctgatgcaattcatggaagcaactaaatcaactcaacgagcactccaaagtatagaaatccagaaaagtacggttgaagctcaagagaaaagccctgtaaaagagcatgtgtcaagagaaaaagatgaggaacaagtacaacaacaatgggagaagtactcaacagtagaaaaacagctagaaaatattctccaaatcaataaccttcctcatcaactgattatcaagaaaggaaggcaaggagaacatgaggaaaccttaagtgccattctttctttaatcactaacacctttcttgaaatgatttggaatgtacttccagactatatgaagttcatggaatttctagctaaaaggtga

SEQ ID NO: 66295 - DNA, 558 bp, Glycine max
  Peptide Sequence Number=SeqID_157980
atgacccttgactcagtaacactgtcaaagataatgagaaagaagagaggatctagtgactcttccatcacatcattgaacctgatgaaggtgaagcatgtagaagcaaagcttcatggtgaatcaaaggtgattcaaagaggatacatctacttgggtttgactgagaacaagagagggtacctctcttgtggatcagttctagtggagggtacatccactaggttcaaagagaacaagggagggtacatcccttgtggatctttgcctgtaaaaggatttttacaagtcactcgatccaataaagcagaggttgttgagctgggtgatcgcatgcgacacgcagcgagagcactagtcgttggtgaggtcgctgtgacactggaagaggccatagacgacatcgaaggatgtggggataatgaagttgttgtggttgggaaaggcaatggagttgatgagggaggtgaggagcgagttgaaggtgtttttataggcgaaacccagcatgaacttgggttgggagaaaacttggatgacaatgatagagattcttag

SEQ ID NO: 66296 - DNA, 165 bp, Glycine max
  Peptide Sequence Number=SeqID_157981
atggaggtcacagaacaatcactaccattgtcatccttcacgattaaggtcgtgggcctaggtttggtgctatggcagatagcaggcaatgatgcaggggctcaaggtgtaggtataggggttcatgagggggttgagagagagagagctaagaaattcaagtga

SEQ ID NO: 66297 - DNA, 213 bp, Glycine max
  Peptide Sequence Number=SeqID_157982
atgtcagaaaaaccggaaaggtgtggtctacgaactttaatcgtgaaaggttcgggagttgtttttacacatggggaaggaattgtcgcaacctacccttcggcgggagggcgacgcgtgactcgcgggagcgtgttccaagaaaggaatacgcgcggagtcgccaccaacgtttatttgaggaaaacgtcggaaaaatcggaaaagacgtga

SEQ ID NO: 66298 - DNA, 180 bp, Glycine max
  Peptide Sequence Number=SeqID_157983
atgaatcatatactcatgtaccttaaagatttggatgcatgggtatctgtgactggatacgcatgcatgattggaaactttcatgttagttggaaaacaatacttcaacccatagttgttttattcactacaaaggcagagtacatggctttggtagaagtagtaatgaaagggatctag

SEQ ID NO: 66299 - DNA, 207 bp, Glycine max
  Peptide Sequence Number=SeqID_157984
atgaatgccaagtgtcgcaacatgcctttttgcggggcgtgcgaggcgaggctcacgggtgcactttccaaaggaggaaagatgcgcggagtcgccaccaacgtcgacaaaagcggggctcttgctcctacgtaccctccatcgaaaaggaaatcagacctacgtagttctttcttaagagtgaatcaagcgattctttttacttga

SEQ ID NO: 66300 - DNA, 590 bp, Glycine max
  Peptide Sequence Number=SeqID_157985
aacaagaagacaaacttcaaaatgatctatgtcatgaagaacgtgaggattccaaagtttctaaacttggaatggtattctcaacattggtgcagatgaagggaaccttctaccctaagttggtaaaggtcttttatacatgtgccaaagttggtatggaaggtaacctgtactctattgtcaatggtgtagagatggtgattgatgttgtagtttggaaggcagtagcaggaatagatataggtggagtccgcaagtttgaggaatctgtggatggctacaacaaaatggccatatacagaggtatgcttcttgacctggcaagaaatttaaggaacaaattgggtgttggtggtctaacagcggaagtcagaatgctggtatacattattatgtatattttggcaccaagatccaacaatcatgctcgagtcactgatgatgacttgcagattatgtatgggctgaaatcagactctccaaatgcactcaatgtcatattgaagtttggcatcaccaaagccaaaaagagggagattgttagagataagggaagcagcaacttggaacaacctaaggctaaagcttga

SEQ ID NO: 66301 - DNA, 117 bp, Glycine max
  Peptide Sequence Number=SeqID_157986
gaaaaagggggaggaggttgccgcccagctcgcctaggcgagctcagcttgcccaggcgggctgggttgcttcctccagaagcaatccagcttcgagaaatagtctggaaggcttaa

SEQ ID NO: 66302 - DNA, 474 bp, Glycine max
  Peptide Sequence Number=SeqID_157987
atggtagtttgggacaacaggggacgatggggtcacatgacaacaaatcttgccaaggtcatgaattcagagctgaaaagaacaaggagtctccctatctttgcattggtcaataacaccaaaacatcagtcgttaaactcaatgaaagtcaaacacaagccttatgcaacaaatacactagacttaagcctacatgcaatgtggtgccatttttaatgaaaaacctcgtcgagcacctaggagtacatgcaagacatgcctcacaatgtgatgtaagctccattggagcttcggaatggagaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaagagagctctgaaatctgaagtttaa

SEQ ID NO: 66303 - DNA, 249 bp, Glycine max
  Peptide Sequence Number=SeqID_157988
atgatgattaacttaaagatgattgcacaaccagatccttatcctttctgtaatctactcacctacggcagaagaatcccatttgcagaattgtttgctagaattgacgctgttgatgcaagcacaataaaacgtgttgctaaccgatttatttatgacaaggatattgcaattgctgctatgggacctattcagcgtttgcctgattacaactggttcaggcgcagaacctactggaaccgctactag

SEQ ID NO: 66304 - DNA, 546 bp, Glycine max
  Peptide Sequence Number=SeqID_157989
atggacagaggtgaagggtttgatgatggtgactttggtgatgaaggcagaggcatgggcacaaggttttcaaatattgtgggtgcggaagtaggagctggtggtggtgaaggaggttggatggttagaggcagcctctattgcataagtatattcatgttgaaaaggacagagtcattgaaggacttgagcaaagattctaagacacaccgttggagtaagggcggtcaaaagagttacctcacatgcagtattggaagtgataatcgttgcaagggcatcttcaacaataggttgggaagagacttcaacaagcgaaggttcaactgcatccacctagggtccaagatgagcgtttcaacaaccattccttgtcctggaacccaagggttcttatcaggagagaataaattacctttgagttctggatgtcttgcccaagtagtgacaattactcttcacattgcagctttagggtctaatggaggcaacctcaaagctattctatttggcatgaacttaatggttgtagttggtggaatgtga

SEQ ID NO: 66305 - DNA, 2976 bp, Glycine max
  Peptide Sequence Number=SeqID_157990
atgtcatcttcttcattctcaacaaaaccccaatggatctacgatgtgttcatcaacttcaggggaggagacactcgcaggaacttcgtctcccacctctactacgccctctccaacgccggcgtcaacaccttcttcgacgaggagaatctgctcaagggcatgcagctggaggagctatcgcgcgccatcgagggctcgcagatcgccatcgttgtcttctccgagacctacaccgagtcttcgtggtgcctctccgagctcgagaagatcgtcgagtgccatgaaacctacggccagacgatcgtgcccatattctacgacgtcgacccgtccgtcgtgcgccacccgacggggcacttcggtgacgccctggaagcggctgcgcagaagaagtattccgcgaaggatagggagtatgggttttccaggtggaaaatcgcgctcgccaaagctgcgaatttctctggttgggatgtgaagaatcacaggaataaagctaaactagtgaagaaaattgttgaagacattctcacaaagctagactatgcactcttgtctattaccgaatttcctattggattggaaccccgcgtgcaagaagtgattggagttatagaaaatcaatccaccaaggtctgtatcatagggatatggggaatgggtggatcgggtaaaactaccattgccaaagccatctacaatcaaattcatcgtagattcatggacaagagtttcattgaaaatattagagaagtttgtgagacagatggtagaggacatgttcatttacaagaacaacttctttcagatgttctaaaaacaaaggagaaggtacgtagcattgggatgggaacaactatgattgacaaaagactttctggaaaaaggacgttcattgtacttgatgacgtgaatgagtttggccaattaaaaaacctatgtggaaatcgtaaatggttcggtcaaggaagtgtaataatcattacaactagagatcgacgtctgcttgaccaacttaaagttgattatgtttatgatgtggataaaatggacgaaaacgagtcccttgagctttttagttggcatgcattcaatgaagcaaaaccaaaagaagacttcaatgagcttgcaagaaatgtagttgcttattgtggaggactaccactagctcttgaagtccttggttcttatttaaatgagaggagaaagaaagattgggagagtgtattatcaaaactagaaagaatacccaatgatcaagttcaagagaaattaagaataagctttgacggtttaagcgatcacatggaaaaggatatatttcttgatatatgttgtttctttattggtaaagacagagcctatattactgagatactaaaaggttgtgggctacatgctgatattggaataacagttctgatagatcgtagcctcttaaaagttgaaaagaacaacaaacttggaatgcatcaattgctacgggacatgggaagagagataatttgtgaaagttcaagaaaggaaccagggaagcggagtcgattgtggtttcatgaggatgtacttgatgtattgacaaataatactgggacagtggctattgagggattggctctgaaattgcatttcgccggtagagattgcttcaacgcttatgcttttgaggaaatgaagagattgagactgttgcaacttgatcatgtacaactaacaggagattatgggtatctttctaagcaactgagatggatcagttggcaagggtttccttcaaaatacatacctaacaacttttatctggaaggtgtgattgcgatggatttaaaacacagtaatctgcggctattctggaaagaaccccaggttttgaagtggctaaaaatcctcaatcttagtcactccaagtacttgaccgaaacccctaacttttcaaaactaccaaatcttgaaaagctcattctcaaagattgcccacgtttgtgcaaggtacacaagtccattggagatctctgcaatcttcatttgataaatttgaaggactgtaaaactctaggcaatctgccaaggggagtttataagttgaaatctgtaaaaactctcattctttcgggttgttcgaagattgacaaattagaagaagacatagtgcagatggaatccttgacaactctaattgctgaaaatactgctctgaaacaagtgcccttttcaatagtcaactcaaaaagcattggctatatatccctatgtggatatgaaggatttgcacgaaatgtttttccttctatcattcggtcttggatgtcaccaacattgaatcccctatcttatattagtccgttttgtagcacatcgtcatatctagtttccctggatatgcaaagttataattcgggtgaccttgggccaatgcttagaagcctttcaaatcttcgaagtattttggtgcgatgtgacacagactctcaaatatctaaacaaggattgacaaccagtgagtcttctgatgtttttctccctagtgacaatgatccttattggtttgcccatatgggtgagggacattcagtgttttttactgtgcctgaggattgtcgtatgaagggaatgactttgtgtgtagtttatttatccactcctgaaagcaaagcaattgaatatcttattagtgttttaatggttaattacacaaggtgtaccatccagatattcaagcgagacacagttatttcctttaatgatgtagattggcatgacataatatcacattcaggacccggagacaaggtggagatttatgtgatttttgggcatgggttggtggtcaagaagacagctgtctatctaatgtgtgatgaatcaattgacaagggaatggacccttctcctgagccaaagatagagccaaagaaaaatgcctttgtaaaattcataaagaaaattgtatcaagtaaaaatgaagagcagtag

SEQ ID NO: 66306 - DNA, 414 bp, Glycine max
  Peptide Sequence Number=SeqID_157991
atgatgcatggggagatgacctcagagttggatgccaaccacaaatcaaatattttcctttttgagaatttaagaggtttggccacacacttagcccttttctatccatttccatccttggaagcaattgtgtctgccatcaagttgtctgatcatgctggggaccaagcagcacaaggccaaagagtgggaattgatattggtggcaataatgataaccaagaagctaatgagcatatggagcctactactaaagttgtacctgttgtagatgtagagcctaaagagggtgagcttaatgatgttgtggttaaggagaatagtgcaaaaggtatcattgttgttgaagttgcttctaaggaaattgatgaagttgatagcattattcgaagtgtcatttcttccattgattga

SEQ ID NO: 66307 - DNA, 222 bp, Glycine max
  Peptide Sequence Number=SeqID_157992
ggtacatcctttgtggtacaagtagaggttacatctacttgggttgttgtgactgagaacaagagagggtacatctcttatggatcagttcaagtggagggtacatccacttggtttttcaaagaaaacaagggagggtacatccctattggatctttggcttgtaaaggattttacaaggttgaaaaaaatctcaagaaccgcaggttgcttggggactga

SEQ ID NO: 66308 - DNA, 246 bp, Glycine max
  Peptide Sequence Number=SeqID_157993
atggagaaacaatgtggaaagcaaattaagattgtgagatttgatagaggtagagagtactatgtacactattgtcgcaacgtgcccttttgcgggcgagcgaaggcgaggctcacgggtgcgttttccaaaggaggaaacatgtgcggagtcgccaccatcgtttatttgtggaaaacgtcagaaaaaccgaaggaaaccggtcgaaacgaaaattctaagtttgggagttgtatttacgtttga

SEQ ID NO: 66309 - DNA, 195 bp, Glycine max
  Peptide Sequence Number=SeqID_157994
atgggtttgtcagaccagtcagggtcacgatgttttgcgagaatgctccaaccatatgggattagcatagacataaaggagcactcaaacccggtgacccccaaggcctacactccgaagagttcgtcagggcctctccctcctgattcaggtccaacccctaaaatcattttagcacacaaacattgttcgtga

SEQ ID NO: 66310 - DNA, 219 bp, Glycine max
  Peptide Sequence Number=SeqID_157995
atgatgattttgcaatgtccatcgttaggttggccaagtttgccatcacctatgtctagcacaggtatggcaaacttagaatgtgttgttctacctccgggcaataataatgaagcaatcccactggaagcaacagttaaaacaatacctccattagagcgcacaacagatgataaagttttccacataaatgtcttgccaatcccaccatatccatag

SEQ ID NO: 66311 - DNA, 573 bp, Glycine max
  Peptide Sequence Number=SeqID_157996
atgtacaacaacaaagatgttcttgatgaagacattatcattgccatgaagaatatgctagataacaacaaccattatgcgcagaagtttagaatgacaagggataaactacaatcttcaatagtctctgacctaaagcttaaactggtttatgataggcaactgcgatcaaggaacaatgaagcccaaacaatactgcattcaagaagattgtttcagcaatggattgttgatggttactgtatgattgagtcgcaaaaactaaattatgttaggcaacatcaacaacaactcagagttgacaaatacatcaatttgaatgtctgtaacaatgcccctgaaacacttggcaatgaaaaagaaatttgtggtcatatcggatttccagacctatttttgacattaacgtgtaatcccacatggcctgaaatacaaagaaaggttaggaaatccaatctcacacctcatgactgccctgatgttgtctcaaggatatttaaaatgaagttaaatcaattgatgaatgatctcaaacgtggacatgtctttggtcctattctgggatgtaagtaa

SEQ ID NO: 66312 - DNA, 753 bp, Glycine max
  Peptide Sequence Number=SeqID_157997
atgggctacgtgggagtacgtgagctcagttggaggtgggcaacaagggatggtgggtttatgcgcgatttgtggatgtggaaaacttgttatgcaccatcgcccgaccgccacctagtaccacatgtgagggtggtacctggagatatgtcgcgggggtcaggagaccttggggacgtcaggcgagctcctgacagtcaacagataaaaggaacaaagaccacaaagcaaggaggcttgtgtggtggctggccagctgtgaatcttggtgggcaatcgattacaaggcttaaaaatgaagacaggaggctaagatggtctctggtaatcgattaccaaggggttgtggaggtctctggtaatcgattaccagtctctgtaatcgattacacagaggaatgggtcactggtaatcgattaccagatgaacctgcacggacgcttcagcgcacgatggagtggatactacccacgcctacaccatatcgtttagtggagccagtccaagtgatcgaggtaacgtcatccgaggaagacccagaggaggatctcgaggagctacctcccgagcctgctgtggatgctcttgactttctagagggtgatgaggacccacttcctgaggtggattttcccgaggatgtcatgtcggcatctgaggcagactctacggaggatagtggccctagagagatggcgatcagcgaagactcttcgtcataccaccactgtggacacctttgctctggatga

SEQ ID NO: 66313 - DNA, 556 bp, Glycine max
  Peptide Sequence Number=SeqID_157998
atgggcttgcttagttggtggtgggccctaatgtttcttcaagatagagacatgaaacactgggtgaatgcgaaattcgacagtcagggtgagacaataggcaaaaggcctattaaatctcttggacaatttggagtaagatggagtgagggaggtctgctggtacgaccagagtttaacgtaaagccaatcaccgacgtcaaagtggacttcacgatgatgtattctaagacaattccaccatggacaggaaacagaaccattgggaaggacgatcgtggacataggaacgaaggtattgttccagatgtactcatccatagtttagtgtcacttaacttgaatagttcttgccaaaaggtgctaaggaacaggggatctctatcggagactaagcttctaggaaaaccgttaaattgggtcgagaatgctctaaagtgtgcccctttagaaaatcgaccaacgatgactaagataacaatgaagtcgttggaaggaggtaagctggtgacgaaatccaaggaaaggtctgcccaaattgatgaagaaggtgttg

SEQ ID NO: 66314 - DNA, 210 bp, Glycine max
  Peptide Sequence Number=SeqID_157999
atggaccacttgactgaccctcccactaaattgatgctggtccaatggtctggtttggctcttaaggacacatcatgggagaattgggttacattgaatgactcatacaaccttgaggacaaggttgttcttccagagtggggcgatgttagccatggcagtaaccaacctgggaacaaacccaagagtagcaccaagagaccagcataa

SEQ ID NO: 66315 - DNA, 3330 bp, Glycine max
  Peptide Sequence Number=SeqID_158000
atgaattatccaaagggagaggaactaaacgaaggattattacgaaccatagaaggatgtcggatatgtgtagttgttttctccacaaactaccctgcgtcttcttggtgtcttaaagagttggaaaaaatcattgaatgccacagaacttatggccacatagttttgcccatattttacgatgttgatccctcccatatacgtcatcagcggggtgcttttgggaaaaatttgaaagcatttcaaggattgtggggaaaatctgtgttgtcgaggtggcgcacggtactcaccgaagctgcaaacttctcgggttgggatgtgagcaataacaggaacgaggctcaattagtgaaggaaattgctgaagatgttctcacaaaactagacaacacattcatgcatatgactgaatttcctgttggattagaatcccatgtgcaagaagtgattggatatattgaaaatcagtcaaccaaagtttgtatcgtagggatatggggaatgggaggattgggtaaaactaccacagccaaagccatctacaatcgaattcatcgtagattcatgggtagatgtttcattgaagatattcgagaagtttgtgaaacagatagaagagggcatcttcatttgcaagaacaacttctttcaaatgtccttaaaacaaaggtgaacatacaaagcgttgggataggaagagctatgattgagagcaaactttctagaagaaaggcactcattgtacttgatgatgttattgagtttggccagttaaaagtcctatgcggaaatcgtaaatggtttggtcaaggaagtatagtaatcattacaactagagatgtacgcctacttcacaaacttaaagttgattttgtttataaaatggaggaaatggacgaaaataagtcccttgagctttttagttggcatgcttttggagaagcaaaaccaacagaagagttcgatgaacttgcaagaaatgtagttgcttattgtggaggactaccgctagctcttgaagtcattggttcttatttaagtgagaggaggaagaaagagtgggaaagtgtattgtcaaaactaaaaataattcccaatgatcaagttcaagagaaattaaggataagctataatggcttaggtgatcacatggaaaaggatatatttcttgatatttgttgtttctttattggtaaagatagagcctatgttacagagatactaaatggctgtggactacatgctgatattggaataacagttctcatggagcgtagcctcgtaaaagttgcaaagaacaacaaacttgaaatgcatccattaatacgagacatggatagagagataattcgtgaaagttcaacaaagaaacctgggaagcgcagtcgattgtggtttcaagaggattcacttaatgtattgacaaagaatactgggacaaaagctattgagggattggctctgaaattgcattcaagcagcagagattgcttcaaagcttatgcttttaagacaatggatcaattgagactattgcaacttgagcatgtagaactcactggagattatgggtatcttcctaagcatctgagatggatctattggaaaagatttcctttaaaatacatgcctaaaaacttttttcttggaggtgtaattgcgattgatttaaaacacagcaatcttagactagtctggaaagaaccccaggttttgccgtggctgaaaatcctcaatcttagtcattctaagtacttgacagaaacccctgacttttcaaatttaccaagtcttgaaaagctcattctcaaagattgtccaagtttgtgcaaggtacaccagtccattggagatctccaaaatcttctgttgataaatttgaaggactgtacaagcctaagcaatctcccaagagagatatataagttgaaatctttggaaactctcatcctatccggttgttcgaagattgacaaattggaagaagatatagtgcagatggaatacttgactactctaattgctaaaaatacagctgtgaaacaagtgtccttttcaattgtaagattaaaaagcattgaatatatctccctatgtggatatgaaggattatcacgtaatgtttttccttctatcattttgtcttggatgtcaccaacaatgaatcccgtatctcgtattcgttcatttagtggcacttcatcatctttaatttccatggatatgcataataataatttgggtgatctagtaccaattcttagcagccttttaaatcttctaactgtttcggtgcaatgtgacacggggtttcaactatctgaagaattaagaacaattcaggatgaggaatatggaagttaccgagaattggaaatagcatcatatgcatcacaaattccaaagcattatttgagctcttattcgattggaattggaagttatcaagaattcttcaataccctaagcagaagcatatctgagggattggcaaccagtgcggttagtgatgtttttctccctagtgataattatccttattggttggcccatatggaagatggacattcagtgtatttcactgttcccgacgattttcacatgaagggaatgactttgtgtgttgtttatttatcaacccctgaagacactgcaattgaatgtcttattagtgtatcaatggttaattacacaaagggcaccatccaaatattcaagcgagacacagtaatttcctttaacgatgaagactggcagggcataatatcacatttgggacctggagacgagcgcgagttcacatgggattgggaacaactgcgagaagccgaagaagaatcgtcatcgaagaaggttatctgtcgtaccccattttggatgctttttcgtgtttcccctgttttcagcagcgacggtggcgccgtcgtgcactttgttgtcgtacaggtaccacttcaaaaaaaggaagggtctgaagtgagggatttcgggttcgggtgctgtcggaaggaagtgtgcgtggattcgttggtggagatgatcacatttgttcattggagcaattgctcgaacatgatgtcagaggcgagtgatgatgagaagcgaagtgttgttactgccatggactgtatattttctgtgctaacccattacagtgaggccacaaggagattggttgcatactttgtgggagttcaaatagaagacaacaataaaaatgatgatagtcattgtttgagtcctgagaagagacaacttagtgtggttagtgtagtcaaggttgcagtgaggactttatcaatgactgcggtatcttctgagtcgtag

SEQ ID NO: 66316 - DNA, 267 bp, Glycine max
  Peptide Sequence Number=SeqID_158001
atgaaggagacgatgaagaagaagaccaagatccaccgaatgtttcaagcaaatgctgagggagattccgatgagcttgtagatccaccgaaggtggaggatgagattggtgctgtgcctcatggcctttcaaccgatttagatgtcatcaagagttgcgggaaaaatttgcaaatggaagacatgaaggttgttttagacttgttggtgggtgaccctacttcactggagaagaaaattgatgcaattcgttttggtggtccctag

SEQ ID NO: 66317 - DNA, 330 bp, Glycine max
  Peptide Sequence Number=SeqID_158002
atgactcctaatactagtagtttgcattttccccaaaagagagcaatcggattcgagagctactttaatggctcgatcctatctcccaagcaaggtctttgtggcagagaaaagatctcagtaaggagcaagctgaagcatatggagatggagtgtgagtacttaaagaggtggtttggttccctcacagtagagcaaaatcggaggcccacccaccgtgatctcccatcactcctacgagccgctccctcctccacactttccatgtgtccccgctacgagcatgtcacctccaccgccgacaaaccactcgccgccgccgccatatag

SEQ ID NO: 66318 - DNA, 2511 bp, Glycine max
  Peptide Sequence Number=SeqID_158003
atggagcgtgagaagaaactcagtatactttatcaaaaacaaggacgtgcaacccagttttcaagtaaagcttctcgtgataagtggcttcaaaaggagattgatgatcttgaacgagtgctttcttcaaacaagggccaggcaacggtaaagttgtgccttggtgacttgttggtcatgggttcgaatccggaaacagcctctttgcatatgcaaggatcaagtgcatgtctaactgggagaaatgatcacttttgtcaacttcctaaggagcaaaagcttttggatgaaattgatcggcttaaagaagaactgcaggattgtgatgagaacataaacagacgtaaatcagaaattactactttggaatctctcattgctcagtcacgtgaagggcttaatcgttacaaagaagagagagacaagttacatggggagagaaagtccctatggggcaaagagaatgaacttactgctgaaattgataagctgagagctgaagttgagaaggctgaaaagagtcttgatcatgcaattcctggtgatgtgagaagagggttgaattcagttaggaagatctgcagggagtataacatttctggagttcatggtccaattattgagttactgaattgtgatgaaaagtttttcactgctgttgaagttactgcaggaaacagcggccggagtgcccgctattgcagcagagcgacagtgacgtgtgatgcagacttctttcgcgttgcgattggagtggctgggatcgtgcttctgactatgaagcccaaggacaattcattttcacagtggcggcatgagctaacaaagagcatggttagtgatgggtcagttatctgcaagaatttggatgtggcttcaagggttgctcgttctgatggtctggactgcataactctggatggtgatcaagtaagcaagaaaggcagtatgactggaggattttatgatcacagacgatcaagattgaggtttatgaatatcattaagcagaatgcagacactattcacattagagaggaggaattggagaaaatagaccaaaagattaatgaaattgttgctgaacagcagaagagtgatgccaaatgtgctcatgacaaatctgtgatcgaacagcttaagcaggatattgctaatgctaataagcagaagctgttgatttctaaagcacttgcaaaaaaggagaagtctgttggggatgtccagaatcaaattgaacagcttaatgctagtaatgctatgaagaatgctgagatgggcactgagctcattgatcatttaacaccagaggaaaaaaagcttttgtcagatctgaaccctgaaatcaaagaccttaaagagaagcttgttgcttgcaagactgatcgtattgagactgaagcacggagagcagagcttgataccaatctgaccactaaccttaggagaaggaaacaagagttggaggctgtaatatcatctgtggatgctgattctttggttgctgatgctgaatcaaaacagcaggaacttagtgatgctaaaatattggttgatgatgcaacagggcagcttagaagtgttactgaaagtataaatgaccgaacacggcaaattaaaaagatcaaagatgaattgaataaattgaaggacgagtatgaaaggaaacttcaggaagatgcaaaagaattagagcaattgcagagtaaaaaaaatacatatgctgctaaagaagaggaatatgccaagaaaataagggaactggggccattgacatcagatgcttttgaggcgtgcaacgagcaattgcagcaattcagtcatgtaaacaagaaagcacttgaccagtatataaattttacagaacaacgagaagaacttcagaaaagacaggctgaacttgatgcaggagatgagaaaattaaggagctgatatcagtgctagatcaacgtaaggatgagtcaatagaacgcactttcaaaggtgttgctaggcattttcgggaagtattttccgaacttgtgcagggggggcatggtcatctggttatgatgaaaaagaaggatggtgatcatgatgatgatgaagatgaggatggtcctcgtgaagcaaatccagaggggagagtagaaaagtacattggagtgaaagtgaaggcaagtgtctcatttactggacaaggggagacacagtccatgaagcagttgtccgggggccaaaaaactgttgtcgcccttacacttatctttgccatacagcgatgtgatccggctcccttttatctatttgatgagattgatgcagcgctggatccacagtaccgaactgctgttggaaacatagcaaacactcaatttatcactacgactttccgcccagagctagtgaaagttgctgataagatatatggagtaacacataaaaacagggtcagccgtgttaatgttgtatctaaggaagatgctctggaatttattgagcatgaccagacgcacaatgctgctgaataa

SEQ ID NO: 66319 - DNA, 811 bp, Glycine max
  Peptide Sequence Number=SeqID_158004
gcttttggacaaagtacgggttgtgcaatctgatacggtgagcttgactcaaggaggcttcactgcagggagcactacatcagagtcaagctgcgaagcagttaggctttgctgtaatatcttggtagagaggctaaagcctcttaaggaaaagctgcaggaggaaatggactctatcaaatgggagacccttattctccaggcatacatgcaagctgtgaacttatcagcatcttcattttatgtacctagtaatgattccatgggttaccttagttatggtgctgcagtggaaatagatcttctgaatggagaaaccagatttttgcaaacagatattatttacgattgtggacagagtctaaaccctgctgtggatttaggacagattgaaggagcttttgtccaggggttgggatttttcatgcttgaagaatacgaaacaaatcttgatggtttggtgttgcaagatggcacttggaactacaaaatcccaacgatagacactatacctaaacagtttaatgttcaaatcctcaacagtgggcatcaccagaaacgtgttctctcttcaaaagcttctggtgagccaccattacttctagcagcctccattcactgtgccacaagagcagctgtaaaagaggcaaggaaacagcttctttcatggagcaaccaagatgaagaagattcaacatttcagttgggggtccctgcaaccatgcctgtggtcaaggaactctgtggactggacattgtagaaagatacttgaaatggaaaatggggaaggacataatggtgctcacttaa

SEQ ID NO: 66320 - DNA, 271 bp, Glycine max
  Peptide Sequence Number=SeqID_158005
gttttctcaaacaagagtggaaaacatcatccatgaatcttcgggcaaatattgcagctcttgcactatgtgtggaaagattttattagacttgggtagaaatcctagaagaataaagaaaaggagaaagagcaatgtaaaaattgtgaaaaaagaacttgatgcagcttctaagggtcctctgatcaaggaagcaaagcaaccaattaattctgacacaactcaagtttctctgaaaattgttgaagaatcgttgttcagtgtgctgtag

SEQ ID NO: 66321 - DNA, 285 bp, Glycine max
  Peptide Sequence Number=SeqID_158006
atgcaacttttaatttccaattttatagttggaaaggcgtttgctgttgccactgcatttgtatttggtggtgctgcattggtatttggtatggtggcctccaagttagagctgcagaatatgagtgacatcaaaactaagggaaaagactatgttgagccaaaactagagaatatcaaagagcaatttgttcccttaaagatatgggcaagttttaaactgctgagaatatgtcaaggaagtggcatgtggaaagggacgatgttaagcagaagactatcataa

SEQ ID NO: 66322 - DNA, 1761 bp, Glycine max
  Peptide Sequence Number=SeqID_158007
atggaagaagcaaattcatttgtcatgtttgatcctgacattgtaaggggtctttgcaaacggggactggtctattttgatgttcctatttatcctgaagatcggtttaaagtttcccggcttgaaggttttgtttccaaaagggagcagtcttatgaagatcctattgaagagctgttgtatgcagtttttgtagtttcaaatgaaaatgtaacagttagggacttggcaacaaccctacaggctgatttgtcacagttgcaagctgctgctgcttttgggtgtcgattgggatgggcaacaaaagtacttgatccagaatctattattggagattcaactatacttgcatctcctgttgcaagtacaactagtgatgaaaatgcttttgttgctagtcaaaattataagaatactctttttgctaatgactccattcaacaaggggatgcttcagcttcagggaacaatggacctcgttcttcctacactcgagttgctttcatagttgatgctaatattacatcctatcttatgatgggatctgtttcaccaggcctgaaatctcatgctattacactctcatgcaaggatcttagtaccttggagggtgcaacatatgagggagaaatacaggaatttgctaaccatttatttagtctacgttgtgtcttagagtgtctacaatcaggtggaatagttaccaacataaaagaagagggaagttctgataagctgagtatgattacctcaagtaatgatgggccaaagcttgtggaggcttctatttacacggaccgtgtttctagtggaatagatgatgaaactcgttccattactttggaggatagcagtgatcatatccacgaagctgacaaggcacacacaaaatttgatgtgcctcttcctcattcaacaattcttcctagacctacaggtccagttcattttggtcctcccgcatattcttctatgagtccttggatgaaattggttttacactcaactgcaggacagtgcctgcgcttgcttcctgcaccattggctggttgtgagaaagcccttatatggtcttgggatggttccacgataggagagttaggaaggaagcttgaaggaaatttagtgaagggaagtatcctcttgcagtgcttaaattcacttcttaaacattcagctgtgttggtgctgcctcttggtagatgtgatcttaatgaatatggaaaattgactactttggatatccctttacccttgaagaatgctgatggatcaattccctctgtcggaaaagagctaggactaaatgaaaaggaagattctaagttgaattctttattgaccaatttggccaacaaaatgaaattgtggactgttggtcccattacaaagcttctttaccagaaagagcaagcttttggacagcctgtggaccctgccagtggaagatggaattcactagtggatctttctcccatttctggcgcattaagtgtgcgccagagatcatacacattacttcctgcccatgaagctgccacaaaaccaattaaagaatcccttgaagccgttacaaccaatacgataaaaactgaaccagaagaaaatgatagtaaagaagcaatccttcgtggagttaatcttatttttgatggttctaggttgcttccatttgatataggtgcttgtctccaagctcgccaacctatatccttgataattgatgcagctgctgcctcaacatatgcaccattccaatag

SEQ ID NO: 66323 - DNA, 1386 bp, Glycine max
  Peptide Sequence Number=SeqID_158008
atgggaatcgatcaacttcggtggcggtggtggaacgccgtcgttttgatcggaatggtcggcgttacagtagtaaccgttaccggttccgacagtcacgagaagcaggaacaagtggtgtctcgaattgccttcggatcatgctccaaccagagcgctcctcagcccatctgggatgcagtggtggacttccatccccaaatttttatatggctgggtgataacatttatggagacttcaaacgccctttcaaaatatttggacaggaaaggactgttggaccgtggaagaatgttccacgatttgttccttcctctgagcaggaaatgaaggctggatatgaaaaagctaagtctaatcctggctatgctcgactccaacagaatgctaaggttattggtacatgggatgatcacgattatggattaaatgatgcagggaaagaatttcatggaaaaataaccaaccaaaagttgcttcttgatttcttggatgaacctcaagatagcccacggcggaaacaggctggtgtatatgcctcatatacgtatggtcctgtaggtagagatatcaagattgtcctcttagataccagatatcacagagaccctgtaggaagtgatggaaccattttggggaattcacaatggttgtggttggagacagagctcaagggtccaccaacagctcttaccataattggatcttctattcaggttatatcaaatctttcagctaccattcatccattgttcgcaatggaatcatggggtcgttttccaaaagaaagagatcgcctttttaaattaatcgctgatagtaagagggctggagtattttttattagtggagatgttcactttggggaaatcacgagatatgattgtgctttggactatccactatatgatttaacctcaagtggggttactcaatcagttgaggaggttgtcccacctttcttgcgttcttttgtgagatttgtggcatggttgaccccatctactatgagagttaaggacgaaaattgcagatacaaatcttgtatttatggtcagccaaactttggaactattgagatagattgggactctcacccagtgactctgaaattcaaagtcagggacaaggatagtgtcacagttacaggggttgatgtttcattaacggaattacaaccatcaaattcagagattttagacagggtaaaagcagagcataataattcaaagcattgcacccttgaagttagtctgccatggatttttacacttgcttcagactttgccgacttgaaagctgcaaaagaaagcacgattgatacgcatagatatgtacacagtcagcaaaagggagcatgtgttattatctcttctcctttgtag

SEQ ID NO: 66324 - DNA, 942 bp, Glycine max
  Peptide Sequence Number=SeqID_158009
caaagtggcggtacacttctagctgagccttatcctataccgggtgcaaatgtggatgtcagtcaggataaggatattgatgaacacgaatggtttgaaaaaggaggttccgacactaacaatagcaggaaacttgttgcttacatgactgtagcaagaacatatttaggaataaagcctgctccaattgtggctggattctcatccaggggtcccaatgcagtgcaaccattgatactcaagcctgacataattgcccctggtgtcaacatattggcggctaattcactagcggcaagtccatcaaatcaaccatcagatagacgtcgtgttcctttcaatatacaacagggaacttctatgtcttgccctcatgttgctggtgtcgtaggtcttctcaaaacacttcatcctgattggagtccagcagccattaaatcagccattatgactactgatagcaactcatttgattatggctctggacatattcagcctaaccttgcaatggaccctggacttgtttatgatatgagaacaagggattacttgaacttcatatgtgcccatgatcacaaccaatattttctcaaatactttcatagaagctcttacaattgtccaaagtcttacaacatcgaaaatctcaactatccttcgatcacagtagcaaatcgagggatgaaacctataagtgttactcgtacagttaccaatgtggggactccaaatagcacatatgttgtgaaagctaacgtacttgaaggatttaaggttcttgttcaaccaagttcattggctttcaagacaattggagaaaagaagagctttcgtgttattcttgagggaaccagttggcctagtcatggttttccagtatttgggaacttgtcttggacagatggtaatcacacagtaaccagtcctattgtaatcctgtaa

SEQ ID NO: 66325 - DNA, 1771 bp, Glycine max
  Peptide Sequence Number=SeqID_158010
aaagttgatcggagcaagaatttttctcaaaagtcgggaggcgggaggtgggaaggttgatcaaacgctacgcagcggacgtgacttggtagggcatggcacccacacactgtcaacagctggtggtaattttgttcctggtgcaaatgttgaaggtaacggcaatggtactgctaagggaggatcccctagggctcgcgttgttgcctacaaagcatgctggaataaactggatgaaggagggtgctatgatgcagatattctagaagcatttgatcatgccatttatgatggtgttgatgtcatctctgcctcgttgggtgggtctaatccctatcccgaagccttgttcacggatgggatttccataggggcattccatgcagttgccagaaacatagtcgtagtttgctctgctggaaatgatggaccagcacctttaagtgtcacaaatgttgcaccctggtccttcaccgttgctgctagtacaatggacagagattttcgcagcagaatttctctcagcaacaatcaatccattatcggtgccagtctcaatcgaggcttaccgtcttcgtcgccatcgaaaaagttctatccggtgatttattctgtggacgctagacttcctagtgtgtccattgatgatgctcgtctttgcaaaccgggaacacttgatcctaccaaagtaaagggaaaaatactagtctgccttcgaggtaataaattaacttcagccagtgagggtgaacagggtaaacttgctggcgctgtggcagttctagtgcaaaatgatgacccaagtgataatttacttctggccgagaatcatgtattacccgctgcaagtataagtggaacgggaagtcataatattaaaaacggtacaggcaacaatggcaataacaaggagattttagcttacttgagtgctgcagaaacatatataggagtaaaaccagctccaatcatagcaggattctcatccaggggtcccagttccgtgcaaccattgatactaaagccagacataactgctcctggtgtgaacgtaattgctgcttttacacaaggagctggtccgtctaatcttccatcggatagacgccgatctcttttcaatgtgcaacagggaacttctatgtcttgccctcatgtcgctggcattgcaggtcttctcaaaacatatcatcctacttggagtccagcagctatcaaatcagctattatgaccacagctacaacactagataacaccaatcaaccgattcgcaatgcatttcataaggtagcaactccattcgaatatggtgccggacacattcagcctaaccttgcaattgaccctggactcgtttacgatttacgcaccaccgattacttgaacttcttatgtgcttctggttacaaccaagctttactcaacttatttgccaaattgaaattcccatacacttgtcccaagtcttacagaattgaagatttcaactatccttcaattacggtgcgtcatcctgggtcaaagaccataagtgttactcgtacagttacaaatgttgggcctccaagcacgtatgttgtgaatactcacgggccgaaggggattaaggttcttgttcaaccaagttcgttgacttttaagagaaccggagaaaagaagaagtttcaggttatactgcagccaattggtgcccgtcgtgggttatttgggaatttgtcttggacagatggcaagcacagagtaaccagtcctatcacaattcttccttag

SEQ ID NO: 66326 - DNA, 1827 bp, Glycine max
  Peptide Sequence Number=SeqID_158011
atgcatatgtttaggacttgggagcaacatcgcaagcctcatgatgaatattggccagtgaagctgattggagcaagaactttcctaaaaaatcacgagtctgaagttgggaaggttggtcgaacgctacgcagtggacgtgacttggtagggcatggcacccacacactgtcaacagctggtggtaattttgctcgtggagcaaatgttgaaggtaacggcaaaggtactgctaagggaggctccccaagagcacgcgttgtggcctacaaagcgtgctggcataaattggacacaggagggtgccatgaagcagatattctacaagcatttgatcatgccattcatgatggtgttgatgtcatctctgcctctatcggttcgtctaatccctataccgaagctttgttaacagatgggatgtccataggggcattccatgcagttgccagaaacgtagtcgtagtttgctctgctggaaatgatggaccatcacctttaagtgtcacaaatgttgcaccctggtccttcaccgttgctgctagcacactagacagggattttctcagcgacatttctctcagcgacaatcaatccattacgggtgccagtctcaatcgaggcttgcctccatcgtccccgtcgaacaagttctatcccataattaattctgtcgaggctagacttcctcatgtgtctattaatgatgctcgtctttgcaaaccgggaacacttgatcctagaaaagtaaggggaaagatactaatatgccttcgaggtgataaattaacttcagttagtgagggccaacagggtgctcttgctggtgctgtggcagtttttgtgcaaaatgatgagcaaagtggaaatttacttctggccgagaatcatgttttacctgctgcaagtatcagtggaacatggaatcaaagtcaaggaggtgctttcaacatcagcagcaagggggtcttagcttacttgagtgcggcaaggacacatataggagtaaagcctgctccaatcatagcaggattctcatccaggggccccagttccgtgcaaccattaatactaaagccagacataactgctcctggtgtgaacgtaattgcagcttttacacaaggagcaggtccgtctaatattgcatcagatagacgtcggtctcctttcaatgtgcaacagggaacttctatgtcttgccctcatgtcgctggcattgcaggtcttctcaaagcatatcatcctacttggagtccagcagctatcaaatcagctattatgaccacagctacaacactagacaacacgaatcaacccattcgcaatgcatttgatgaggtagcaactccattcgaatatggtgccggacacattcaacctaaccttgcaattgaccctggactcgtttacgatttacgcacctccgattacttgaacttcttatgtgcttctggttacaaccaagctttactcaacttatttgccaaattgaaatttccttacacttgtcccaagtcttacagaattgaagatttcaactatccttcaattacggtgcgtcattctgggtcaaagaccataagtgttactcgtacagttacaaatgttgggcctccaagcacgtatgttgtgaatactcacgggccgaaggggattaaggttcttgttcaaccatgttcgttgacttttaagagaaccggagaaaagaagaagtttcaggttatactgcagccaattggtgcccgtcatgggttgcctttatttgggaatttgtcttggacagatggcaggcacagagtaaccagtcctgttgtagttctgtaa

SEQ ID NO: 66327 - DNA, 528 bp, Glycine max
  Peptide Sequence Number=SeqID_158012
atggcagcaaaggcaaaagaagaaaacctgaaaatttgggaggaatggagtcttaggagtgaacacagaattagaccaatcaatgaaagcttagtgaaaaccatgtttgatctattgggtgattattgtgaggtacaaaatgttggacgctcagagctaccacgttctaagtcgcgggcctcgcgaggctccaagttgtttggcaaattgaaattcccttacacttgtcctaagtcttacagaattgaaaatttcaactatccttcaattacggtgcgtcatcctgggtcaaagaccgtaagtgttactcgtacagttacaaatgttgggcctccaagcacgtatgttgtgaatactcacgggtcaaaggggattaaggttcttgttcaaccatgttcgttgacttttaagagaaccggagaaaagaagtttcaggttatactgcggccaattggtgccagtcatgggttgcctttatttgggaatttgtcttggacagatggcaggcacagactttgtcataaataa

SEQ ID NO: 66328 - DNA, 162 bp, Glycine max
  Peptide Sequence Number=SeqID_158013
atggtttcaccactggccacaggattacaaaccttcaacgcacatgcccaggattacccagttttacaaattttcaatagtccaattttctttctaagaagcatggacaatgacgaagacacaggacataacacagacaaggaagatcaggtgccctgtggg

SEQ ID NO: 66329 - DNA, 1656 bp, Glycine max
  Peptide Sequence Number=SeqID_158014
atgtacaatgaagtggaagtgtgtcacaccgcaatgatcaacgagtccatgggcactgcactgcacgtggccgtagatttggacgaagaaggtgtggttgaagagcttgtgaaggcaattattcggcacaggcagggagagcaaagtgtgaagatcaaggctctagaaatggagaacgaccacggagatacccctctgcacgtagcagcgtccagggggttcgcaaaaatatgtaagttgatcattggaaccaacaatgaaaggatgtatttggtgagtcgaaaaaacaaacatggggagacacctctttttcaagctgctatcaactggaagaaacaggcttttgcttatctctctcacatttccaaccacagcgccaccttgcaagatcttgaaaggggcaatggtgacactattcttcactgtgctattaggagagaatatttcgggttaattattgttgttctaatggtggagggttcagatttggctgtgataatagtgcaatattatgattttcttagcacacataagaatatagagggattaactcctctcacagtccttgccactaggccgtcggccttcagaagtgcaagcaaactttcatggtggaaacaaatactgtaccactgtatacttgtagaatcactggaccctgaaggacaaatgaaggcgaacttgggaaagatggaggatcctaagtctgataaaatgaattatccaaagaactacgccacattatatgatttatttggtggattgttaagtgttgctgctctaattggggtactagattctcaaaagtctatctatttcttaagcatttttctttgggcaggaaagatgccttcggaaaataatcagcatgacacagaaaacccatcaaccaacaagtatacatttggatttggaactagtcaggttggatttttgccaccaaattatgcaacttttcaacaatttgtgaggtctgcatatgtacatactcttggcctttcaggagcggaattaaaggaaataaagaagacaaaaaagaggcatcaatggagtagtcaactcttgaaggcactattgaaaaggccttatgcagcattcacaggaagcgggggaaaaccaaccgatttggaagttgaagcagatatgtataatgtttatagccaatataaacaaggtgaaaccaccggattgggggggttggaagaagaaaagaaaactgaggctgatgacaaaaaaaattcaagtccaagtgagacaattagaaaggaaactgatgaacgtgctgacgagaagaacattgacaaaaaggagacagcatttttggttgcagcaagaaatggcatagttgaaatggtgaatgaaattttatatcgaattccaagtgtcatccacaacgctaattcaaagaaagaaaatgtgttgctcgtggcagtgaagaacaggcaacccctagttgttgagtgtttgaaaatgaaaatgcagtcaaagccagaagtttggaataacttgattctggcagtagatgatgatgagaacaccatgttgcatttggcagcatatgctccaggcggggataaaccttggcagatagctggttctgcattgcaaatgatgtgggatataaaatggtttcagactcacaatattcagaaataa

SEQ ID NO: 66330 - DNA, 390 bp, Glycine max
  Peptide Sequence Number=SeqID_158015
atgaagactttactcacgattcatcaattgggtactcaaaaagcatcatcaaactcaaacacaaccacacacacaaacacaaatgttaacaagaacatcattaacaacagcaacaacataagaaaaaaggccgagggtttggaggaaggagaagttggcgggttcggggaagccggagcggaaaatgccattatcaaccatggcgaagttgaggggcggaatgaagagatcctcgccgtcgtcagcgacggcgtctccggcgacggtgtgatcggagatagtgagctggatttggcggcacatgggggtggtgtcctgttgttgcctttgcctttggtggcggtgatgggtgcgttggagttctgccgccagttgcatatcaaagtttga

SEQ ID NO: 66331 - DNA, 3099 bp, Glycine max
  Peptide Sequence Number=SeqID_158016
atggcagagacaccaaagaagaagaagaaggggcacgtggttatggtacccttcatggcccaaggccacatcatcccattcctggcactagcaaggcaaatccaacaaagcacaagcttcaccatcaccatagccaacacacccttcaacattcaatacctccgatctgcactttcttcttcaacttctcccaatcatcaaatccgtcttgctgagttacccttcaactccactctacacgatttgccacccaacatagacaacacagagaagcttcctctcactcaactaatgaaactctgtcatgcatcactcacccttgagcctccccttcgctccttgatatcacagatcacagaagaagagggtcaccctccactttgcacaatatctgacgtgtttcttggctgggttaacaacgttgcaaagagtttatgtattaggaacctaagcttcaccacttgcggtgcttatggaaccttggcctatgtttctatctggttcaatctccctcacaggaaaactgactctgatgagttttgcgttccggggttccctcaaaactacaaattccaccgtactcaattgcataagtttcttctagcagctgatggcactgatgactggtcaagattcattgttccacagattgcactttctatgaagtctgatgggtggatctgcaacacggttcaggagattgagcctttggggttgcaacttctcaggaactatcttcaacttcccgtttggcctgtggggcctctccttccacctgcttcactcatggattcaaaacatcgtgcaggaaaagaatctggcatagcccttgatgcatgcatgcagtggctggattcgaaggatgagagttctgttctctacatttcatttgggtcacagaacactataactgcatctcaaatgatggctttggctgaaggattggaagagagtggtagatcgtttatttggatcataaggccaccttttggttttgacatcaatggagagttcattgcagaatggttgccaaaagggtttgaagagagaatgagagacaccaaacgtggccttttggtgcacaaatggggaccccagttggagattctgtcacacagttccacaggagcgtttctaagccattgtggatggaactctgtgttggagagtctcagctatggggttcctatgattgggtggccactagctgcagaacaaacattcaatctaaagatgttggtggaggaaatgggtgtggctgttgagctcactcaaactgtggaaactgtgatctctgggaagcaggttaagaaggttatagagatagttatggagcaagaaggaaagggaaaggcgatgaaggagaaggcgactgagattgcagctcgcatgagagaggccataacagaggaaggtaaagaaaaaggatcttctgtgagagcaatggatgatcttaatttgaatgataataaagttgcttgtaaagcatacttgttatgtactgctcagcaatctttagcaatagactatgcagaaaccaagacaacaagagttgagtatagtgttcttgtaccacagacagcgcagggtgtagcacatcattcctcgatcgagctcgctccaatggcagagacaccaaacaaaggccacatcgtgatggtacctctcatggcacaaggtcacctcatcccatttctcgcactagcaagacaaatccaacaaaacacaagcttcaccatcaccatagccaacacaccccaaaacattcaacaccttcgatctgcactttcttcttctacttctcctaatcatcaaatccatcttgctgagttagtacccttcaactctacccaacactccaacaaagacaacaacacacaaaaggctcctctcactgacctattgaaacttggctatgcatcactcacccttgagcctccttttcgctccttgatatcacagatcacagaagaagacggtcaccctccactttgcataatatctgacatgttccttggttgggttaacaatgttgcaaagagcttaggcactaggaacctaaccttcaccacttgtggtgcttatggtatcttggcctatatctctatctggtccaacctccctcataggaaaactgattctgatgagttccatgttccgggattccctcaaaactaccgtttccacaaaacacaactgcataggtttcttcaagcggctgatggcaccgatgactggtcaagattcctcgttccacagattcaactttctatgaagtctgatgggtggatttgcaatacgattgaaaagatagagcctttggggttaaagcttctcaggaactatcttcaacttcccgtttgggccgtggggcctctccttccacctgcttcactcatgggttcaaaacatcgttcaggaaaggaaactggcatagctcttgatgcatgcatggagtggctggattcaaaggatgaaaattctgttctctatatttcatttgggtcactgcacactatcaatgcatctcaaatgatggctttggctgagggtttggaagagagtggcaaatcgtttatttgggttataaggccaccagttggttttgacatcaatggagagttcagtccagaatggttgccaaaagggtttgaagagagaatgagagacaccaaacgtggccttttggtgcacaaatggggaccccagttggagattctgtcacacacatccacaggagcttttctaagccattgtggatggaactctgtgttggagagtctcagctatggggtgcctatgattgggtggccaattgttgcagatcaaccttataatgtgaagatgttggtggaagaaatgggtgtggctgtggaacttactcgttctacggaaactgttgtttctagggagaaggttaagaagaccatagaaatagtcatggattatgaagggaagggaaaggtgatgaaggagaaggcaaatgagattgcagcttacattagagaggccaaaacagagaaaggtaaagaaaaagggtcttctgtgagagcaatggatgatcttgttacaaccattttatcacccaaggttctgtga

SEQ ID NO: 66332 - DNA, 462 bp, Glycine max
  Peptide Sequence Number=SeqID_158017
atgtccataaaaagaagagttaaggagacacaagaattttactgtgaagctgaaaaccatggtatgatctcatcctacttgattgctatgctgatagttggtgctaacggatctggaaagacaaactttttccatgccatccgttttgtgttaagtgatctctttcaaaacctacgcggtgaagataggcaggcactactccatgaaggagctggacatcaggttttatctgcgtttgtagagattgtgtttgacaattcagacaatcgtatcccggttgacaaggaggaagtgcgcttgcgccggactataggtttcaaaaaggatgagtattttctagatggcaagcacataacaaaaactgaagtgatgaatttactggagagtgctgggttctcccgatcaaatccttattatgttgtgcaacaaggaaaggtattgactgatggtgacagtgcttga

SEQ ID NO: 66333 - DNA, 684 bp, Glycine max
  Peptide Sequence Number=SeqID_158018
atggccaagtttgaccctgagatagtcctagagttctatgctaatgcttggcccacagaggagggagtgcgagacatgcgttcatgggtgaggggtcagtggattccgtttgatgcaaatgccctcaaccagttcctgggtgacccgctagttttggaggaaggtcagcagtgtgagtttagccaaaggaggaaaagggccgatgggttcgatgaggaagccattgcccaactgttgtgcacaacggggcaggatttcgcccggactgctgtagggaggcggcgatcacaactccgagaagtaatccgaccgctgatcacccgggccttcatcgagaagtactgcacgcctaggcaggcacaaggtgatgcacatcaggccacaaacgcactgccaccacctcggcaggccgatcccactgggtccctaggcatggagcgttatctacagcatttggttcaccaacaggcggctaaccaccgtgggcaggtgcagatacatgagtgtctctaccgattcagcctcagccagcaggggcaggttccgccccttttgcatgccctactccggagcagtttggggcagaggtcgcatggcttggagactagcccgaggcctaggcaggggaggagcctgcaggattccccggtgaggcagatgaatcccatatggatgaagagatga

SEQ ID NO: 66334 - DNA, 465 bp, Glycine max
  Peptide Sequence Number=SeqID_158019
atggcacacggtggtcaatgtctcagcatatcagtgttacagttgtggattttgtatctgactgaaataagtatgcgagcgggaaattcttatctgtatggattcctcgagccacagtccattcagaggtttaggcaatcgcagtttgagattgaaagttacataaagagttggatgcagagttcaaaacacgatgtctaccttggagcctacctgaatggcgaacactggcagatggtggtcatcgcgcccaaggaacacctagttgtctggttttgttcattgcataataggccagacaactaccttaaggggataattaacagtgcattaaaaggtcttgatgatgctccacaacctaaatcaaaggctcctactaggtggattgtcatcaagtattttaacgatcctagaccattggagtcagagagattaaaggcgcttcggatccagtggacactgtaa

SEQ ID NO: 66335 - DNA, 405 bp, Glycine max
  Peptide Sequence Number=SeqID_158020
atgcaggttagctcgcctgggcgagcaacccctgcacgaaatgggttaaaaagggggagggggaaggtttctgcaccaaaaactcttccccctcattcaaaaaagcaagagctcacgggattcacggattttgcagcccttaggtcaccatttttcgcgtttttgattccattttgctctattattcatctccaacaagaaatggctccaaaaaagctttccgcgaaaagatctaggagggacgccgcggcggaagggaccagtgccacccccgagtttgatagccaccgtttcaggagcgccgagcaccagcagcgtttcgaggccatcaaaggatggtcgttccacagagagagacgcgcccagctcagggacaatgagtacacggatttcaggaagaaatag

SEQ ID NO: 66336 - DNA, 567 bp, Glycine max
  Peptide Sequence Number=SeqID_158021
atgacagatcttgtgagcgcggaagatgacgtaaatctccgcgtgtcaacgggcttgtcggccgcgattgacgaagggcgcagaagacgacacagcaaaaagaatgtttatacggataaccactcgggtatttccgcccgtcagcgtgactcaaatgtcagtatgacagatcttgtgagcgcggatgatgacgtaaatctccacgtatcaacaggcttgtcggccgcgattgacaaaagggcgcagaagacgacgttagtctcagtgctatcaggcttttcgtcttacagacagcaaaaaagaatgtttatacggataaaacactcgggtatttccgcccgtcagcgtgactcaaatgtgagtatgacagatcttgtgagcgcggaagatgacgtaaatctccgcgtgtcaacgggcttgtcggcgcgattgacgaagggcgcagaagacgacgttagtctctgcgtgctatcaggcttttcgtcttacagacagcaaaaaagaatgtttttacggataaccactcgggtatttccgcccgtcagcgtgactcaaatgtctgtatga

SEQ ID NO: 66337 - DNA, 843 bp, Glycine max
  Peptide Sequence Number=SeqID_158022
atgacagagtcactgctgttgttattcatgatgctaatgatatatttctccattagcttacctatcaatacagatgaacaaaaaacaatttatcacagaattatccaagctatcaacaacaatgaaggtggaatgtttttcctatacggatttggaggcacaggaaaaacattcatatggagaacattagcaagttcattgagagcagagaatcaaattgttattattgttgcttctagcggaatagcctctctattattaccaggaggcagaactgcacattctagatttaaaattcctgtaccaatttttgaagactcaacatgtaatatccatcaagggaccaaattagcagaattactgaaccagacaagtctaataatttgggatgaagcactaatggcccacaaattttgttttgaagcacttgatcaaagtttaagagacattatcacaaataaatcaagctcaaatcaaatatttggaggcaaagttatagtattcggtggagattttcgccaaatactaccagtcatcccaagaggaacccactcagacattgtaaatgcagcaatcaattcatcctatctatgggattcgtgtgaaatattgaccttgacaaaaaacatgcgcttacacagcaatctagaattagttgatgaacaagaaactgccacatttgctaaatggattctagacattggagatgggattatagattatgaaaacgatggttatgctacaattcaagttcctgctcatctactcattactcaatatgatgatccaatcaatgctatagtcaaatcaacattcccagacttagatcaacaccataattga

SEQ ID NO: 66338 - DNA, 312 bp, Glycine max
  Peptide Sequence Number=SeqID_158023
atgttgagagatggttatgagcctggaatgggttggggccagaacagtgattgcttgacaaacttggtggagtttgctgaaaactgtgggaggtttggtctgggttacaagtctatgaatgctgacaaaaggaggatttctttggaaaggaaagaaagaagcctagcccgtttacaagggtggggaccacaggttgagaggatccctatctgtcgcatcaacgagagctttgtcaatgcggggtggatgcatgaggatcaagttgttgtactggatgaagaaaccaatcaagatcaatcaaattgggtgtag

SEQ ID NO: 66339 - DNA, 702 bp, Glycine max
  Peptide Sequence Number=SeqID_158024
atgaattcctccatgatttatattcttgtctttgtccagctttggttgtttaggttaccatgcagagagagtgtgtgcatcccaagtgagcgtgagacacttttgaagtttaagaataatctgaatgatccttcaaataggctttggtcttggaatcataatcataccaactgttgccactggtatggagtcctctgccacaacgtcacttcccatcttcttcagcttcacctcaactcttcaccttctactgctttctatcgttactatgatggctacgattgggaaggttataggggattccagtttggtggagagataagtccttgtttggctgatttaaagcatttgaattacttggacttgagcgccaatgattttgaaggtatggcaattccttctttccttgggacaatgacttccttgactcacctcgacctctcgtatactggattcatctggaagattccatttcagattgggaatctctccaatttggtctatcttgaccttggaagtgattttttggagcctctgtttgctgaaaatttagaatgggtatcaagggtaatgaattcccaggtccgattcttggtggtattcgaaacctcacacttcttcaaaatcttgacttgtttaaaaattcattctcatcttctatacccgattgcttatacggtcttcatcatctcaagttcctga

SEQ ID NO: 66340 - DNA, 210 bp, Glycine max
  Peptide Sequence Number=SeqID_158025
atggctcaggaggaggtaccttcaccagatcccatgccagagccatcccttgcacctatatctgagtacactatgccatcactaccagcaatggagctagagcagcccattcttcagaatgtacctgctgctccagtgctggatttaaatgaagatcagccacaggatgaccaggatgaatgcattgaccgtatcctggtgagagtgtga

SEQ ID NO: 66341 - DNA, 132 bp, Glycine max
  Peptide Sequence Number=SeqID_158026
atgatgattcagaaacaacgtgcaaaattagtcatggccacagctaggtgggcactcaagacgacgttcctaaatgaaaaactctacacggttccggaatttcaacaaacactattgacaacaacgaagtaa

SEQ ID NO: 66342 - DNA, 672 bp, Glycine max
  Peptide Sequence Number=SeqID_158027
atgccacctttctccaaagatattccttcaactattgttgaacaacaagagaatgatgtatatgcaaatcgtactaatcatgatgagggtttatgggagaacattcgtacggccatggcaacaccaccaacgtcctcgccacaatcaaaaaaccctccagaggttacttcgaaaaggacaagacaatccacgaggcttagaagtctgacaactagatgcttagatggctcaaggccagttgtgaacgtgaatccggctacaggtcaacaaatatttgatcctacgatcaagtatggccttgatccaaaaacatgggcggaatttgcaaaaagccacaaaacccctaattggcagggtatacaaaagaaggcccaggaaattaaaaaatttaatgactgcccacacatactatctcgtggggggtatgaactgcttgacaagaaacttatggaggagaagagcaagcgtcgacatgaggaacatctgtttattgaaaacccaacactcaacgtcgacccaccatccccagtggcaagacacttgaagtggaagatcgcccacacaaagcggtatggccaaatgacatctgaagtggcacaagaaattgcagacaaaattgattcattacaggaacaagcaacacaggggagttttgtttcgcatgggcgataa

SEQ ID NO: 66343 - DNA, 465 bp, Glycine max
  Peptide Sequence Number=SeqID_158028
atgcatcacgtgatcgttataggtaaagctcagccgcgagccatccggactgaacacatgcacgtgcgagccaccacgcagcgcacccggcgtatagggcgcggtgatatcgcaggcgtcgaggttctctgcgatgccctgctgaacaatcacgccgcgccggtgatgaaagtcataatgccagtgcgcatcgggatgctccggcccatgaatacagacatagcgcggcggcagatccggactcacggtcaccacgccgacgtgcgcgccatcgcgcgcctgatacagcacctcgaccgcgccgctgtgcacgttgacgcgctcaatggtcaggctggtaaacgcagcgccggacggccgcacatcaaatgccagccactggctgtcggcggtccagacgttgatattggtcagctgatgatggcgctgagtaaagatgtaaccgttgccggacaaattacgtga

SEQ ID NO: 66344 - DNA, 261 bp, Glycine max
  Peptide Sequence Number=SeqID_158029
atgccggacggcgccgcgccgcgctatctgctggcgatcgtacccggcgactgcaaaatcaacttcaaacacgccgcgcgtgccattggcggtaagaagtcgacgtttgccacccctgagcaggcacaagcgctgacgcagtgtgtgatgggcgcggtgccgccgtttagttttgatgaccgactggcgctgcgcgtggatgcgcgcctgcgtgatgtcgggacgctgtggtttaacgccggtgcgctggaccgctcgtag

SEQ ID NO: 66345 - DNA, 576 bp, Glycine max
  Peptide Sequence Number=SeqID_158030
atggcgggtgaaacgcaggaacaggagagtcagagcagtcgttaccgtcagatcgctgagcagataaaacaggccattcacagcggatcgctagccgcccgacagccgtttgccgtcggtgcgcacgctggcgacgcagatgagcactacgcagtggcgcggccgaagtctggcttttttgtcgcaccgcgtcccacagagaaaaaagtgccggcggtattcagcgagcagccgcgcgaagtggcgccgctggatgagcaaaccgaactgcacctggcgatgctgggatcggactgccgcgtgcggctcgatctggccaacggcgacatctcgctctatccggtgaaaaaaattggtctgctgatgcggcagatgggttacagcaaaccggcgctgctcggtaatacggtgaaaggcaccggctatgcgccgctcaaggcggaaattgcccggcgcgcggcgatttcgctggcgctgcgcagccaccacgcggccgggcgatatcgtggcggtggagtcgccgtgctacttcgtgctgctacagatgttgcacaacctcaacctgcgcgtcattga

SEQ ID NO: 66346 - DNA, 536 bp, Glycine max
  Peptide Sequence Number=SeqID_158031
gtgcggataaccataaggtgtgtccgcgtgctactagacccttaggtcacgatagcaaaattgagacttttttgcggtctcagccggaagacgctggcatcttcgggaagggtgcagatgaccacattggtgcggataaccataaggtgtgtccgcgtgctaccggacccttgggtcacgatagcgaaattgagatttttttgcggtctcggctagaagacgctaacatctccgggaagggtgtgaataaccataaggtgtgtctgcgtgctaccggacccttggttcacaatagcaaaattgagactttttcgcggtctcggtcgaatgacactaacatctctgggaaagatgcagatgaccacattggtgcggataaccataaggtgtgtctgtgtgctaccggacccttaggtcacgatagcgaaattgagactttttcgtggtctcggccggaagatgctgacatcttcgggaagggtgcagatgaccacattggtctctgcatgtcaaagggctcgcttgcctctagctga

SEQ ID NO: 66347 - DNA, 195 bp, Glycine max
  Peptide Sequence Number=SeqID_158032
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaggtggctcgcccaggcgagctcagctcgcccagggcgaagttaa

SEQ ID NO: 66348 - DNA, 141 bp, Glycine max
  Peptide Sequence Number=SeqID_158033
atgactatccagcggaaacactgggttcaacaaaaccaagagaagatcactcaaagtgtatcaatctcacacagtgcggggcgagaaagtcgctggcgcacaggattttggttggaaatcaaagggagaggaccactttag

SEQ ID NO: 66349 - DNA, 756 bp, Glycine max
  Peptide Sequence Number=SeqID_158034
atgtcttcaccttcagagggttacacatccgcaacttcagatgacatatacgtcctccccatgagaggactagacgtcctcgcctttggagggctacacgccctcgcctttagaggactacacatcctcgccttcagagaacttcacgtccttacctttagagagttacacatcctcatcttcagaggactatacgtcctccccttgagaggactacacgtcctcgccatcagtggactacacgtcctcgccttcagaggacttcacgtcctcaccttcagagggttacacaccctcaacttcagaggacatatacgtcctccccttgagaggactacacgactacacgtcctcgccatcagaggactacatgtcctcgccttcagaggactccacgtcctcaccttcagagggttacacgcccttatcttcagtggactatacgtcctccccttgagagggctacatgccctcgcctttggagggctacacgccttcgccttcagaggactacacgtcctctccatcacaggactacacatccttgccttcagaggactccatgtcctcaccttcagagggttacacgccctcattttcaaaggactatacatcctccccttgagatggctacacggccttgcctttgtagggctacacaccctcacctatagaggactacacgtcctcaccatcggagggctacatgcactcgcctttagaggactacacgctcttgcctttagagggcgacac

SEQ ID NO: 66350 - DNA, 354 bp, Glycine max
  Peptide Sequence Number=SeqID_158035
atgatgagaggagaccgtgtgcgtgcagatggacctttggcaaggcactgcccgtgtccacggcaaatctatgcagtgtctaaccagtgttcgtcatattacatggattggttctacatgatttcacactcattcatgagtctggcacaaccaagggatcctcctagagttccgtcgaatggttttgtagcaattgttgataagttggagaagctactgaacctgaggatcctgaccgaaggaacagaagcctatactgttgctgaagaatgtctgggcatcacaagaaattacattagccaatcaactgtaggtcatagatcaaggcgtaggcggcgtacggacggtctttga

SEQ ID NO: 66351 - DNA, 951 bp, Glycine max
  Peptide Sequence Number=SeqID_158036
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggaagtaataaattggggtttatcaggacccatgcttcgggcttccggaatacatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccaggttttatcaatttgcaaattcttcctcaattagttaaaagaatgaaattggccgatattatgacaatactaggtagcatagatattattatgggagaagttgatcgttga

SEQ ID NO: 66352 - DNA, 105 bp, Glycine max
  Peptide Sequence Number=SeqID_158037
atggaagacatgcagctattcgaactacaagaacaaggaggaacccaggaagaatttgtagtaggaagtaatttgttgctactgtcaattacccatttcaattaa

SEQ ID NO: 66353 - DNA, 808 bp, Glycine max
  Peptide Sequence Number=SeqID_158038
atggtccaagaacttgatggacacatgcaaggccctattatgtccctagccctcgacgggcatctcctcatcagcaaaggtgaggcaattgttggtggtaatattgttgatgatggccctgaagccctccacggatatgtcttgggcgacgtgggcctcattcaagatcttgacctgaagtgcccgatgaggctcggagttcatgatggggttttattgagatgttcaattaccttgaactcgctttgctggatgatccgaaggaactcatttgcttcttcagcagatattttctttctattgaagtcttcctctcccttagcaaatctcgcagccgagatcgcctcatctagaatcgggtttgccttgtcgctttcttccatgcccaccttcgcctttcccttcatgtccttggaccgcaccaacgggttgggtgccgcgaagattcacccactacgggtcatactactcgtgccagagatgttagtaaccttggcagaggataggtttttgaggggcgtacctccatgggaccgtcttggcactcttgtaaggggaaagggcaggcttcttacccaggataggctggaagcctcagggcttttgggtggcagcatctctggtgaagtggatcaccaatggtttaggcttgctcgggcttttgtcagccaattgcatgcacaaatgttgctcccccttgcttccaccaccaacttcaaaccaaccttgatccattatcccttgcagcaaatcctctgccacagggcatacctctacatcgggcgccgcccctgggtgtaccaagcag

SEQ ID NO: 66354 - DNA, 106 bp, Glycine max
  Peptide Sequence Number=SeqID_158039
atgtcaacgtcatcacgtcggctcggtgactcctcaccagaatcttactccctgcaccctgctgctgtcattcagctcccacaaacaatgttcgtgatcatcacag

SEQ ID NO: 66355 - DNA, 282 bp, Glycine max
  Peptide Sequence Number=SeqID_158040
atggtactagagtctattctaaatccatcgttgggtcacctgcatttggcacactccaggctgaaagtcctgggagtgagcccaccaaacctgtctcagaaaaacgacgatctcggactcattcactgttggctcatcgtgaaatttgagtaccacgttggaaacccaattctgagcattctcaccgttggggattgcaaaaacatgtcggagctaagagaaatacccttcgcaccctgtagctttctcttttcccgcagaaacccaaaaaggtctcagtaa

SEQ ID NO: 66356 - DNA, 132 bp, Glycine max
  Peptide Sequence Number=SeqID_158041
atggttaaagcacgtcaaaacggagtacagaaagggaaaagagggaggtggttgccgcccagctcgcctgggttgcttccaccagaaggcaccgccttctgttggaacaccctggaaggtccaagtggcctg

SEQ ID NO: 66357 - DNA, 282 bp, Glycine max
  Peptide Sequence Number=SeqID_158042
atgattcagatgattctccacctccaatcttgccatactccattgaatgctccacaattctcaaacctcttcgtattctgccccttacacattttcaccaaccactgtgtcaacttcaacatttattcttcacaggccacttcttcagcagatattcaatgttcattccttgaacaaaaaatactaaaacagctcagagaatgccttcagagttatcgactgactcaaccaagacaaacaccagttctgattcatcaacaattacaagcaaggtgcatgtga

SEQ ID NO: 66358 - DNA, 114 bp, Glycine max
  Peptide Sequence Number=SeqID_158043
atgaccatgattacgaattcgagctcggtacccccaagggcattggatagaagactccaagaagattgggtcaaagatgcaagagaaggccctaggattctcatgagccttagg

SEQ ID NO: 66359 - DNA, 327 bp, Glycine max
  Peptide Sequence Number=SeqID_158044
atggtgagcaaagtttggagctttgatggaggcttcaatggtgaggaagaagaagggaatagcaactccctcgcgtttctctgcacccgtcggggcccgttttcgaaagatgtcacagaggtgtcatcctctgaagaggattttgaagaggacccagaggagttacctcctgaacctgctgtggatgctcttgacttcctagaggatgatgaggacccactccctgatgttgattctccagaggatgttatgtcagcatctggggcaaactctacagaggagagcggccctggggggacagcgaatagtgatgactcttcatcatag

SEQ ID NO: 66360 - DNA, 1176 bp, Glycine max
  misc_feature (1174)..(1174): n is a, c, g, or t
  Peptide Sequence Number=SeqID_158045
atgaaaaatctcattgctgagctgttggtcaatctggcgcaaaaagaagaagaggcaaaagagctgacggtacaggttgaggcgctggaaattgtcgtcaccgcgttgctgcgccatatggctgaggatgcgcagcaacgtttgattcaggatatcgaaactgccatggagcaggtcaagcccgggccgctggtggacgaccgtgacacccagcttctgcagcaatatataaaaaagctgctccggcatcctcacgacaaagtgaaattatctgccctctttattgccctgttaccgctgctggctcccccggttattcatgcacaaacaacttcttcgccggtgctggaaaatcgcgcggcgcagggcgatatcacgaccccaggcggggcgcgccgtttaacgggcgatcagaccgaagcgctgcgcgcttcgttaatcaataagccggcgaaaaatattattttgctcattggcgatggcatgggtgattcagaaattaccgccgcacgaaattatgccgaaggcgccggcggtttctttaaaggtattgatgccctgccgctgacgggccaatacacccattattctctggataaaaaaaccggcaagccggattacgtgacggattccgccgcttcggcaaccgcgtggaccaccggcgtgaaaagctataacggcgcgctgggcgttgatatccacgaaaaagatcatcagaccatccttgagctggcgaaagccgcgggtcttgccaccggcaatgtctcgacggctgaactgcaggatgcgacgccggcggcgcaggtggcccatgtgacctcgcgtaaatgctatggccctagcgtgaccagcgaaaaatgcgccagcaacgcgctggaaaaaggcggcaagggctctatcaccgaacaactgctgaatgcccgtccggatgtctctttaggcggcggggcgaagacctttgctgaaacggcgaccgcaggggagtggcaggggaaaaccctgcatgagcaggcggtcgctcgcggctatcagattgtgaccgacgccgcttcactcgccgctatcagcgaagcaaatcagggtaaaccactgctcggtctgttctccgacggcaatatgccggtgcggtgggaaggcccgaaagcctcttatcacggcaatatcgacaaaccgncg

SEQ ID NO: 66361 - DNA, 387 bp, Glycine max
  Peptide Sequence Number=SeqID_158046
atgggttctccacctgcctccactactcctcctcctccttctccttcttctcctcctcgtcctcttcctacttcggacgcatcggcttcgacgtctgccgtgaagcggacacgcaaagcctcacgtctacgatcgttgtccactagaccacctggtgttgagagaccagtggtgcatgttgatcctgctaccgggaaggccgacggtccccataggaagaaattaagaacatatttggggattgtggcacgtgataaggtggaaatcacctacgagaactggaaggaggtccctactgctcagaaggacctgatttgggaggatattcaggcggaatttgatatcccagaggcttctgacagtaggacaaaaaggaagttaatatag

SEQ ID NO: 66362 - DNA, 213 bp, Glycine max
  Peptide Sequence Number=SeqID_158047
atgatcaggcctctcgatgagttaatctcttataagggtggacccttgggtacacgtcctcaccttcagaggactacacgtcctcatttacagagggccgcacgccctcgccttcagagggctatgcgccctcgccttcagaggactacatgtcctcgccttcagagagctgcgtgccctcaccttcagagggttgcatgtcctcgcctttag

SEQ ID NO: 66363 - DNA, 3145 bp, Glycine max
  Peptide Sequence Number=SeqID_158048
gtcctatgatgcagatggtggattccttgctggtgttatgaataaaaagtccttatggaatgatggacatggactgaaacaaataaaggttgacgacggggatagagatcgggatcgagatagagatagagaccgttatagggatgatgggatgaaagaaagggaccgtgaattccgagaaagggacaaatctactgtgattgccaacaaggatgttttaggttctaagatgtctctatatcccagcaaggaaaagtatttatccaaacctataaatgagctggacctttctaactgcgaccagtgcactcctagttaccgcctcttaccgaaaaattacccaatacctgtagctagccagaaaacagaacttggtgccggagtgttgaatgatcactgggtgtctgtcacttcaggaagtgaggattattccttcaaacatatgcgcaaaaatcagtatgaagagagcttgtttagatgtgaagatgacaggtttgaacttgacatgttgttagagtctgtaaatgtgacaaccaaacgagtagaagagctgttagacaagatcaatagtaatataattaaaggagacagcctaattcgtattgaggagcacttaacagctataaatcttaggtgtattgaacggttatacggtgaccatgggcttgatgtgatggaagtgttaaggaagaatgcacctctagctttgccagtgatattaacacgcttgaagcagaaacaagaagagtgggcaaggtgccgtgctgattttagtaaagtttggggtgaaatatatgctaagaactatcacaaatctcttgatcaccgtagcttctactttaagcaacaggatacaaaaagcttgagcaccaaagagttgtcaatcgcacgctatagtgctgttgcgttgtggctatggcacaactttgatgaatggttgaaaacccctgtttacctccacaatactgcgtcgtttaagcgctgtcgcattgtggctatgggccactctaagcccatcatgttactgcttgctgttgtgcctggagtcgcacaaatcatggccatattaacggctatttgtggcattagcaagacaaccttgctggcagaaatcaaagaaatcagtgaaaagaaacgcaaggaagatgatgttcttcttgctattgctgctggaaatagacggccaattcttccaaacttggagtttaagtattctgatccagatattcatgaagatttatatcagctcataaaatattccagtggagaaatttgcacaaccgaacacgtggataaagttatgaagggtgcagaggatacagaagatgttgtcaaggctaagaataatcatgtcaaaaatggcactgcaactgttgctgaaagtgactgtagccctgttgtgggtgctatcataatgaatccaaagcatataaatgtttccagaaatggggatgattgtatgccattagatcaatcaacttctaataaagcatggcagtcaaatggtgggcatggtaaaatgaatcgtattgcattcacacctgatggaccatcaggatttaacaataagcaagaccagtccagtgaacggttagtgaatgctaatgtctcaccagcatctggaatggagcaaagcaatggaaggacaaacatagataatttgtcagaatgtatggaactgatacatttctttgttcaaggactcactgccactccaactagacctggtaatgcttctgttgagggaggacttgatataccgtcatcagagggtggtgattctacaagactgggtacatccacaaatggggccatcaccggaggcaccaaagttcaccggtaccaagaggaatcagttcgagccttcaaaagtgaaagagaagagggtgagttatctcctaatggagactttgaagaagataactctgaagtttatggaggtaatggtttggatgcagtgcataaaggaaaggatggtggtgtgagtcggcaataccaaaatagacacggggaagaagtttgtggtgaaactagaggagaaaacgatgctgatgctgatgatgaaggtgaagaaagccctcacaggtcatcagaggacagcgaaaatgcatctgaaaatgttgatgtttctggaagtgagtcagctgatgctgaggagtgttctcgagaagagcatgaggatggggaacatgataacaaggctgagagtgaaggtgaagccgaaggaatagctgatgctcatgatgttgaaggtgatggaatgccattgccatattctgaacgctttctactaactgtgaagcctctagcaaagcatgttcctccaatgttacatgagaaggacatgaattcacgagttttctatggaaacgattccatttatgtgctgcttagacttcatcagacattgtatgagaggatacaatcagcaaagattaactcatcatccgccgataggaaatggaaggcttcaagtgatacaagctccaccgatcaatatgacaggttcatgaatgccctttacagtttgctggatggttcttctgataatacaaaatttgaggatgattgtcgagctataattggaattcaatcatatgtcttattcacattagacaagttgatatataaacttgttaaacagcttcaagctgttgccgctgatgagatggataccaagcttttacaactatatgcatatgagaaatcgagaaaacccggaaaatttgttgacatggtttatcatgaaaatgcccgtgttcttctccatgatgagaacatatatcgtattgaatattcacctggaccaatgaaactgtctattcaactgatggactctggacatgataaacctgaagtgactgctgtgtcaatggaccctaatttttcaacctatctacacaatgacttcctatctgtcgtccctgacaaaaaagagaagtcaggaattttcttgaagaggaataaacgtagatatgctggtaatgatgaattttcaagccaggctatggaaggactacaaattattaatggtctggagtgtaagatagcttgcagttcatctaagcctaaatggttgattttgctcatttcactgattcctgcatttgagtatagtatgatgcctgttagattgtgtttctga

SEQ ID NO: 66364 - DNA, 377 bp, Glycine max
  Peptide Sequence Number=SeqID_158049
atgcgaatttcgcttgcgattctcttttctgttgtttcaggatttggctcctccgaggggttaggattcgcgcttcgcgttgattcctcgcggttagatctgaactgtgctcgttgctcttgctcttgctcgaatgagaagcctgaaatgaagaggtccagagatgaagttttcacgagttgttctcaactcaaacggcccgtggtgtcttcacgaggagaagcgtctgggcaaccgcagataatgaacggaggtgctcagaaactgacaactaatgatgccctagcatatctcaaggcagtaaaggatatatttcaagataagagggacaagtatgatgactttttggaggttatgaaagatttcaaggctcaaag

SEQ ID NO: 66365 - DNA, 1818 bp, Glycine max
  Peptide Sequence Number=SeqID_158050
atggacccagagctgcaacgccggaagaggaagcgtgtggtggcagcaagacaccttcacatctcatcatcaagatcactgttcctctgcttctccttcttaatcttccttcttttttggtattcccaccatcattttttcttcttcaccccttctacttttagaccttctctcacagcctcaactttatctcttctctattcctctgcaagcaactccgttcttgacccttttcaacccaccgcaccctcctactctctccaacaccgtatcctcttccccgaccaccatctcctcattatcaccaacccccaacaacaaaagctccacgaactagagtgcgtctactacacgcttcaccccaacgcttcctcttccggttcacctgaaccggttttccaagttcatgttcgaccggtcctgtccacggaccgttatgacgaatctcgatccattgttaggtgcccacttacccaaacgaactcctctgccggcgacgcctccaaagccgtcgacatgcggcggcgcggcgaggtgggtcatcggaatttgggcgttttgatgaaccaaacggctcaatcttgggacagggtggcgtacgaggctacccttgacggagacaccgtggttgtgttcgtgaaagggctgaatctccggccacacaagatatcggatccgacccggatccggtgccatttcgggctgaaaagtttcgacaaagacaatgcctttttacttaccacgagagctgtttctgtggctcaagaagttgtgaggtgtatgttgccacagagcatgaggaataatcctgataaggctcgaggaattcgggttactgtgagttatttgggtggcaatgtgaggcacccggttcgtgttcttgtgcgttctgtgtctagggttagtagccctggtggtggtggtaaagttcagaagaggaatagaaagaagtatgagttgtgtgcgtgtactatggtgtggaaccaagcttctgcgctcagggagtgggttatgtaccatgcttggcttggagtggagcggtggtttatctatgataacaacagtgatgatgacattgagaaggttgttcaggatcttgatcttcaagggtttaatgttagtagaaaatcctggccttggattaagactcaggaagcagggttttcgcattgtgctttgagggctagagaggagtgtaaatgggtggggttctttgatgttgatgagttcttctacttccccagtgagtttcggcaaccattgggggagggtgttcctggtgagaattatctgagatctgtggttgccaatttctcatcttcgaaatttattggggagataagaacagcttgtcatagctttggcccttctgggttgaagtcacccccgaaacaaggggttactctagggtacacttgccggcttcaaagccccgagcggcacaaatccattgtgcggcctgatttgcttgacatcagtcttttgaatgtggtgcaccattttcagcttaaggaggggtttagataccacaacatgcctgaaggtactgctatagtaaaccactacaagtaccaggtatgggaaaccttcaaagccaagttcttcagaagggttgctacctatgtggtggactggcaggaggaccagaacaaagggtcaaaggatagagcaccgggattaggaacagaagccattgaaccacctaactggcggcaacagttttgtgaggtttgggatactggcctgaagaacttccttgtatcttattttactgatcctgcaacagggttgatgccctgggagaggtcttctcaataa

SEQ ID NO: 66366 - DNA, 1812 bp, Glycine max
  Peptide Sequence Number=SeqID_158051
atgataagccaaataattggcaagaagtttgaacgtgtattggcttttggggcaaatggtgcttctattttggtcactactcgtcttccaaaggttgcaacaatcatgggaacaatgcctcctcatgaattatcaatgttatccgaggatgaaggttgggaattgttcaaacaccaagtctttggaccaaatgaggaagaacaagtagagcttgttgtcgcagggaaggagatagtaaagaagtgtgggggagtgcctcttgcaataaaagcactaggaggaattttacgcttcaaaagaaaagaaaatgagtggcttcatgttaaggaaagcaatctttggaatttaccacacaatgaaaactccataatgcctgtcttgagattaagttacctgaacttaccaataaaactaagacaatgttttgctcatcttgcaatatttcccaaacatgaaataataataaaacaatatttaattgaatgttggatggctaatggattcatttcatctaatgaaatattagatgctgaagatgttggtgatggagtgtggaatgaattatattggagatcattttttcaggatatcaagacagatgaatttggcaaagttagaagtttcaagatgcatgatcttgttcatgatcttgcacaatctgttgcaaaagatgtttgttgcattacaaaagacaatagtgcaactacttttctcgaaagaatccatcatctctcagatcataccaaggaagccattaatccaattcagttgcataaagtcaaatatttgaggacctatataaattggtataatactagccaattctgttctcatatattaaaatgtcattctttgcgggtgctttggttgggacaaagggaagaattgtcatcttcaattggtgatttaaaacatctaaggtacttgaatctttgtgggggacatttcgttactcttccagaatcgctatgtagattgtggaatttgcagatattgaaactagaccattgttatcatctgcaaaaattgcctaataatttgatacaattaaaggcccttcaacaactatctttgaataactgctggaaactatcaagcttgcctccttggataggaaagttgacttccctaaggaatttatccacttactatattggcaaggaaaaagggttccttttggaagaattaagaccactgaagctgaaaggaggtcttcacattaagcatatgggaaaagttaaaagtgtattggacgccaaagaggccaatatgtcaagcaagcaattgaaccgattgtctttgtcatgggatagaaatgaagagtctgaattacaagaaaacatggaggagattcttgaagcgcttcaacctgatacccaacaacttcagagtttgaccgtgttaggatataaaggtgcttatttcccacagtggatgtcttctagtccttctctcaagaaattagtaattgtaaggtgttgcaagttaaatgtgttggcaagttttcaatgccaaacttgtcttgaccatttgacaattcatgactgtagagaggtggaaggtttgcatgaggctttccaacatttgactgccttgaaggagttagaattatctgatcttccaaacctagaatccttgcccaactgctttgaaaatcttcccttgcttcgcaaattgactattgtaaactgtcccaagttgacgtgtcttccatctagcctaaaccttagcagtctagaacgattgacgattgatgcttgccctgagttgaagaagcttacattccccatattagaccatgacgatgaataa

SEQ ID NO: 66367 - DNA, 543 bp, Glycine max
  Peptide Sequence Number=SeqID_158052
atggggcatgtatatattgagaagctcttgctccactgtgccagtgctttggagagcaacgatgtcaccttggctcaacaagtcgtgtgggtgctcaacaacgttgcttcccctgtgggggacactaaccaaaggctcacctcgtggttcttaagggccttaatctccagggcttcaagaatttgccccactgccatgagttttaaaggaagcaacaccattcaaaggaggttgatgtgtgccaccgagcttgccggcaatgttaagtctcggtcggcggcaccctcaattccgacatcctcagcagcaagacccgagggagaagttgacacttcgaaaaagcgaaggaggagagcatcaaagagcgaattcatcgacgtgaacgaaaaccaggtttctgtctcttcagggctggcaccaatcgtgcaaagcgcgtatgaaagtggtgttggtggtggacttgttcctctgtggcatggtaacactgctgtttcggggcctttcttcatgttctcgaacgcttcaaacccagttcttccgtaa

SEQ ID NO: 66368 - DNA, 447 bp, Glycine max
  Peptide Sequence Number=SeqID_158053
atgaaagagcaacagatgggaatggcatcatgttcacatagagggctgtctgagaagaggttacctggtttactcattgcagtttcagacttcacaggaggttcacctcagcctggaggctcttcaaaggagttgttgtggtcgccagaggaagcaaatgcaagagaggaaaggaaggggcatgttgtgaatgaggcaaatgccaaggcattggctaaagttctcaagtttcatggaaacataaaaatgcttaagcttggttggtgccagctatttatggttctacccggtggtgtagatagtgctgttagcccttgctttgtggcgtcgagccctgactcgatggggcgtgttgcgagtcccacatcgggcttagttgctgatgtggtgttgtggatgaattggcgtggagcggttgcggtgctcgtttatgccaccgcattatga

SEQ ID NO: 66369 - DNA, 726 bp, Glycine max
  Peptide Sequence Number=SeqID_158054
atgctgaaaggagagggattttacatggaagaagctattgttgttaataaaattcttgatgaatatgtcttagcttatgggcaattgataaatttggagaaatctaaaattgcctacagtaagaatgttggaggagctgtgaggaatttgataacctcttttcttggggttcgagatggaatgggaagtggcaaggaatacaatgcttgtgttataacacctatgatggatgtagggcaagacatgaaagtttctagtattattgaccccatcaaccattgttgggacattaacactatcagccacatcttatcaccacaagatgtccaagttattgtcagaacacctctcttgcctatggtagaaggagattcacgcatccgggctcttaatcaaaatgtcagtaaacacttctctacagcagcgaatatctatggcgttatggagtatgtggagacgaaggaacggagtgaaccatctcactactcaatggttcagcattctcaagtgctacattggataccacctgagcctggttgcgtaagggatgagcgagggagacaaatgatggcaagagctgagactaaaatgccttgcatggacgcccagctaggagaggcttggggacttttagaagttataaattttatgcaagcaaaagggggtagtagacaatttgaagagttcgataaagatgagtctgacataggctctgttattcaatag

SEQ ID NO: 66370 - DNA, 282 bp, Glycine max
  Peptide Sequence Number=SeqID_158055
atgactctagccctgctacctataacaaccatcatcaaaaccaacagaccacctccatcatcaaacaccaaacaccatccatcaaatctggtggagtcggggtcgacaacaagggtggctcatgcgcattgtgataggatgaggcgctccaataagaggaggcgaagggcgaagagcccgatggagaagtccttgtcgttaggggaggagaggatttggtggatgcggttttggagggggttgaaggagaaagaatcaaggaaaaagaaagagaaaatataa

SEQ ID NO: 66371 - DNA, 1306 bp, Glycine max
  Peptide Sequence Number=SeqID_158056
gcaacccgctagccatgctggcgatccgtgtgtgtcgcaaatcgccattaccatttgcgatttggccactgacgcgctctgcttcactgctgcactgccatggcaggaactaggctcagctattggaactcgccatgccacaagcgacttgctcagtgacaccaaactcgccattgccaatggcagtttgggtcctgcatggcacactgttcatatggggaaatttgccgcgttggtgatgccagccaaattgatgcgtcaaagtgacaaagaaagagggaaactcaaatcaaaagatataaagaagctcccgagcgtcgaatatttgaagaagatacatgagggagttaaggacttatctcaagatttatttatcccgaaaatcccgtttctcaacccgaaaaacccgaaactcccaagaatcccgctatttaaatctcccccaccgccaatgtaccgtttacaactaaagtccgatcccccaccgccaatgtaccgtttacaaccaaagtcccctcccccactgccaaacgcaccaccgaagcaaatcaatattaagggcctgtccgtcgtcaaagattacttatctgactacggctacattgaatcctctgggccatttaacgattctttcgatcaggaaataatatcagccattaagacctaccagaaattttccaatcttcaagttaccggcggcctgaacaaacagcttattcagcaaatgttgtccatacgatgcggtgtccccgacgttaacttcgactacaacttcaccgacgacaacatttcctatcccaaagccggacaccgctggttcccaaacagaaacctcacatacggttttcttcccgaaaaccaaatcccagacaacatgactaaggtgttcagagattcctttgcgaggtgggcccaagcctcggggactttgagtctcacggagacaacctacgacaacgccgacatccaggtagggttctacaacttcactaactcgaggattgaagtgtatggtggcagccttatatttttgcaaccggattctagtaagaaaggggtggtacttctgaacggtaacatgggctggttacttccaagtgaaaacgccacactgtctaaagatgatggagttttggacttggagactgcggcgatgcaccagatagggcatctacttggacttgatcactctcacaaagaggactctgttatgtatccttacatattgtcctcacagcaacgaaaggtgcagctttccaattctgacaaggccaacattcaccttcagtttgctaagcatgattaa

SEQ ID NO: 66372 - DNA, 894 bp, Glycine max
  Peptide Sequence Number=SeqID_158057
atggatttcaccaacccttcacttcttctctccattttccttctactacttccttctctgatctcatcacaaatctgccagagaaactgtggcaaagaaactctcaagtacccttttggaagtggccctggttgtggtgaccctcgtttccaaccacatgtaacatgtagcaaccaaaagctcacattcaccactcacacaggctcctaccctattacctcaattgactacacaaaccaaatcatacacatctcagatcccaccatgtcaacatgctcctgcactgtccctagcaaaggctttggcctaaactgggatgcaccatttacttttgctgatagcaccatctttgctctggtggattgctcaatgaactcatcatctatatgtcaatcaaatggctatgatgatgggagcaattccaattccaagcttttatgtgatcaagagacaccaatttgtagtcttctatactcatgcaggcctattagcaccaccattaaccttccaatctcgacgtgctgcgtttacacgccggttaatctcggtccagcgtttgagatggatctgcagaagctgcaatgcccttcttacacggggttctacaacttcaatgatcaagaaatggatcctgagaagtggaactatggtatagcactcaagtacaagttcagtgtcacaaatgactatcctggctcgtgtgatgcttgtgaaaggagccatggggtgtgtgggtatggtgggacctataactcttttatctgcaattgtcctaatgggattaacactacagcggattgtttcttcatatcttcttataacaatggttttcgaaatggggttgcttggttgatctatcctgtggcatgttctcttgtttggttcttcttgtaa

SEQ ID NO: 66373 - DNA, 186 bp, Glycine max
  Peptide Sequence Number=SeqID_158058
atggagactgatttgagtctgggttgggtcgctcacatctggtgggtcagggggcgattcaggagagtttatattagaaagggacggttgaagcacaggccgcggtcacgacatgacgcaagttcctccggtgacaagcgtttgaggccaggagctgggaggcgcggcggtggcggtggcagttga

SEQ ID NO: 66374 - DNA, 354 bp, Glycine max
  Peptide Sequence Number=SeqID_158059
atggagaatgtcataaatcgtcaaagtcgtccggccacattctcacctactattcctctgctaaggaaggctcattttgatgcctccgaagaaactaacaagttgtggcttaaagcgaaaacgaaaggtttctgctattcgttgacagattggatgcagaatccgattgtgtgtttagggtgtagaaattatgaaaaagctccaactttgcaggagaggcttgaattttgttctgtcattattgatgtcaatgattggtttgtggaaacttctggtgcaggttgctatgttgatggggtctggaagggatatgttctcgtgacgtatggattgttttggaatagcaaacagtag

SEQ ID NO: 66375 - DNA, 435 bp, Glycine max
  Peptide Sequence Number=SeqID_158060
atgtcaaatagaaagtataaatctagttatgaaaaattgaaaaaaaaacaaaaagttgaaaaactaattgaatctcaacgtggtgcccttgataaatttgttattattcataaaaatgacgtagaagcaagttcaataggtgaaaatgtgatagaacaaccactgatagatcatactaacaacgaagaaaatgttatagaacaaccatctatggataatactgacaacggtgtagaacaaccacctaaagatgatactgacaatggtaaaaatttgatagaacaaccacttataaataatactcacaacacaaataattataatttcaatcaagaactagaagacaatattttagaaataggagtagaagggaatgttgagcataataacacttctagtgaagtacctacaaatatttatgacctaagactatag

SEQ ID NO: 66376 - DNA, 1116 bp, Glycine max
  Peptide Sequence Number=SeqID_158061
atggatgaattagatgtaacttcaagtgacaagcagtatcctgggtgttactttctggtatgcaggggaattgaagctggaaaatcaggcattgagggtatattgagtcggttggagaaacaaagaaatagatcttttggacttgacttagataatgtttcttttgaaaataatgaagataaagatgaatgggatcctagaaccacaacggatacaatggccgctggcctagaaaatggtagcagagcatcctcatcaagctctactagcagtcatctcagtggttctcagatcaaacatgatccgcacggatctcaattaggtactgaaaatttaagaaactcgcttaagccagagacgtggaggagttggattattcagagaactggttttctggatacagattttgaagatgctgaaattgttcccaatgaaactgagaaaggaggcatgagtgacgcttcaagacaacctgatatcctcaacagaagggagttatcttctgaacatataaacagagaaacaggactatattctcttgatggaaatgcaaatcacagtgacattaaatcccgtatccagaatctggaatcggagctatcttctatacttcacttgttgaggtctagctcggataaaattacaatgcagatggtccagaagagctcttctgatgatctagcaaagctttccgatgcttgggaattccaggaaaatgagatcatgaatgctcaggacagattgcgttctatacgggctaagttgtcagtgttagaaggaaagatggcattggcaataatggatgcacataaggtagttgaagaaaagcagaagaagattaataatgcgcaaaaagctttgcaaattctgaagactacttgtgtagtttggcctaatagtgcttcagaagtacttttaacaggatcatttgatggttggtccaccaagagaaaaatggagaggttaagtagtggtatattttctttgaacttgcagctgtatcctggaagatatgagatgaagttcattgtagatggagaatggaaaattgatccattgcgccctgttgttaccagcaatggctatgagaataatcttctcatcatttatgattga

SEQ ID NO: 66377 - DNA, 204 bp, Glycine max
  Peptide Sequence Number=SeqID_158062
atggctaccacagtccagagctaccatatggatggctatgcattctttgttgttggcatggattttggagtatgggcagaaaatagccgaagtacttataataagtgggatggtatggctcgctgcactacacaggaaattatgaggcagttatgctggaatgaaccattttcatacataacaagaaaggggacatacgattag

SEQ ID NO: 66378 - DNA, 1306 bp, Glycine max
  Peptide Sequence Number=SeqID_158063
atgagcacttctcaacaacgttatctcctcttcgctttcacaacgttaatagttgtcttcagcttcaacacttcaccagtctcagctcgtttattccccaacgtgtcttccatcccaacctggaactcctcccacgcgccaccgggtggcgcgtggaatgcttatcgcaacttcaccggatgccgcccgggaaaaacatataacggactttcaaatctgaaaaactactttcagtattttggctatatctcgaaagcgttgtcgaagtcatccaacttcacggatgactttgacgacgcgctcgaggcagccatcaaagcctaccagaagaacttcaacctcaacatcacgggcgagcttgacgaccctacgatgaatcaaatcgtcaagccacgctgtggcgtggctgacatcatcaacggaaccacaacaatgaactccgggaagtcaaacaccactgattcaccgaagtttcactcggtggctcattattcattcttcgacggccagccgcggtggccggagggaacgcaagaactaacctacgccttcgatccggacaacgctctcgacgacgtgagtaagaccgtgtttggcaacgcgtttagcagatggtctgaggtgaccacaatttctttccgcgaaacgtcgtcgtacgcggctgcggacataagaatagggttttacggtggggaccacggggacggtgagcctttcgacggcgtgttgggcacgttggcacacgcgttctcgccgacgaacgggaggttccatctcgactcggcggaggactgggtggcctccggcgacgtgacaaaggcgtcgctgtcgaacgcggtggaccttgaatccgtcgcggtgcatgagattgggcacttgctagggttagggcactcttccgtcgaagatgctattatgtaccctacgataaccgcgagaacaaggaaggtggagctcaatgaagatgatattctagggattcaggttctctacggttccaaccctaacttcacgggaactcctgctacgtcttcgcgacagagcgacacgagcgacggtggtgttaggcacgtgggagtcacgggcgctgtgcttttcaccttccttttgttcttcttcgtgtttggattgcacccttccaacgctaacgttgcttccttcgctcaggatgcaccaacagattccgaatgtggtccggccacgcttggcggcgtctgcaacatttatccggttgacaccactcatgtctctggggcgtggtggcactgcttccatcttgatggggcggggtctagagatttggtgg

SEQ ID NO: 66379 - DNA, 1005 bp, Glycine max
  Peptide Sequence Number=SeqID_158064
atggctcatgggatgaattcactacttacacccgtggccacaactacaaaggcttatccaacgtcaaaaactacttccaccatcttggctacatccctaaccctaatgcaccaccttttggacgacaaattcgacgacaccctcgtatccgccatcaaaacattccaaaagaactacaaccttgacatcaccggcaagctcgacaacaacactctccgacaactcacgacgccccgctgcggcgttcctgacataatcaatacaaacaccacgacacaacacactcagcttcacattcacacggtctcccactactccttcttcaacggcgcgccgcggtggccggcgggaacaagacaactcacgtacgcgttctccccggagctgaatctcaactgcgccgccaaaagcttgtttgcaagggccttcaacagtggggaccacaatgatgggcttccttttgatgggccgcttggggagtgggcccatgcattcgctcccaccaacgggtggtgccacttcgacgccgacgagtactgggtggcgtccggcgacgtcacgcaatcgccggtggcgcgtgcggttgaccttgaatccatagcagtgcacgagattggacacttgctagggttacaccactcgtcggatcagagagccatcatgtatgcttatttaccacctcgtactaggaaggttgccggtgggttgcagtttgaaatattgctggtaggtcttgatggctgttattgtttcctcgtcaagagaaacgttgaatggcgtagaggattgaaggggaaacttttgttcgatattgtccatgtgattctcccatattccttgcttgaacgccttgcccccttttgcccttctcactttggcagtggaagaaggatggaaacggaaattcgccaaaagggattggtcgacaaggagaaggaatgcataaggtatggtttcatgttaacggctatttcttttagtctctcagagcttgagtctacttag

SEQ ID NO: 66380 - DNA, 1210 bp, Glycine max
  Peptide Sequence Number=SeqID_158065
cacccaacaacaacagcaccccttttgtttccttccaccaagaaccgattttgccaccgacccattcctccaaatgcttctcctccgtcaaagcgccgtcgtttcctccctcattctctgcttcttcttcccaccattgctctgcctcggaatccgctctttcccaaccaccgcagacgacggcgcgttcttccactacaccgaggcgccggagtatcgaaacggggcgggttgccccgtttcgtcaacccgaaattttcttccttcatgcgacccttctctggtccacatcgccatgaccctcgactctggctacctccgcggctccatcgccgcagtgcactccgtcctccgccactcctcgtgcccggaaaacgtgttcttccacttcatcgccgccgagttcgacccggcaagcccacgggtcttaacccgactcgtccgctccatttttccttccctgaacttcaaagtttacatctttagagaagacactgtaataaacctaatctcttcttcaatccgacaagctctagaaaaccccttgaactacgcgcgcaactacctcggcgacatgctggacacttgcgtgtcccgcgtgatctacctcgattccgacgtcgtcgtggtcgacgacgtcggcaagctctggcgagcagcgatcacgcacggacgcgtgatcgccgcgccagagtactgtcacgcgaacttcacgaagtacttcaccgacgagttctggaacgaccctttactctcgcgcgtgttcaatacgcgcgagccttgttatttcaacactggggtgatggtgatggatttggcgaagtggagagaagggaactataagagaaagattgagaattggatggagctgcagaggaagaagaggatttatgaattgggttctttgccaccgtttttgcttgtgtttggtgggaatgttgaagcgattgatcataggtggaaccagcatgggcttggtggggataatgtgaatggggtgtgtaggtctttgcatcctggtcctgtgagtttgcttcattggagtggaaaagggaaaccttgggttaggcttgatgagaagaaaccttgtcccttggatcgtctttgggagccttatgatttgtataaacaagtgaaggatagtgttagagatcagaattgggggttctcttcttctattttggttggttatgctcatgacttgttatga

SEQ ID NO: 66381 - DNA, 270 bp, Glycine max
  Peptide Sequence Number=SeqID_158066
atggtgagcatgaatgaaggtgagaagaggatagatgaagaaaaacaacagctagtaactgaacaaaaaattgatccagtggtggaacctttgagtgagactgaggaagaagtggaagcagaaggagataccaataatagcctaggatcttcttcattaatggattcctttgcttcttggaagatgaatggcagaagaatggagaaggaagagagagaggagacgccacttcaaggagaagatgagtctagaaaaagctcaccaccatag

SEQ ID NO: 66382 - DNA, 414 bp, Glycine max
  Peptide Sequence Number=SeqID_158067
atggcccacttggagctctcgattcatggcgcggctcaacagagcagccgcaccgtcctactatttaaagttgagaataggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 66383 - DNA, 711 bp, Glycine max
  Peptide Sequence Number=SeqID_158068
ggctacacgccctcaccttcagagggctacacgtcgtcacctttagaaggctacacatgctcaccatcagaggactacacatcctcgccttcagagggctatacgtcctcaccttcagagggccacacgccctcgcctttagaggactacatgtcctcgcctttagaggactacacgtcctcgcctatagaggactacacgtcctcgccttcagagggctgcacgccctcgccttcagatgactacactggactacacgccctcgtctttagaggactacacgtcctcgccttcagagggctacacaccctcaccttcagaggactacacgtcctcaccatcagaggactacacatcctcgccttcagaggattgcacatcctcgcctttagagaacggcacgtcctcgccttcggaggactgcacgtcctcatcttcagaggactacacgtcctcaccttaagagggctacacgccctcgccttcagaggactacacaccctcgcctttagagggctacacgccctcgccttcgtagggctacacgcccgcgccttcagaggactacacgtcctcgccttcagagggctacacatcatcgccttcaaagggctacacgcccttgcctttagagggatgcacgccctcgcctttagagggctgcacgccttcgccttcagtgggctgcatgtcctcgccttcaaagggtga

SEQ ID NO: 66384 - DNA, 755 bp, Glycine max
  Peptide Sequence Number=SeqID_158069
atgaccacgcaggccggtaatctggcctacgtgtcactgctggcgctggtgccgctgattgccgtggtcttcgcgctgtttgccgccttcccggtgttctccgacatcagcgtgcagctgaagaacttcatcttcactaacttcatgccggccgccggggatgtgattcagcgctatctcgatcagtttgtcgccaacgtcaacaaaatgacggcggtgggggcggtcgggctgattgtcactgcgctgctgctgatgcactcggtcgacagcgcgctcaatgccatctggcgcagcgacaagccgcgcccgatggtctactcctttgcggtctactggatgattctgacgctgggaccgctgctggccggtgccagtctggctatcagctcctatctgctgtcgctgcgctgggtgaacgtgaccggcgtcaccagcctgatcgatcaggcgctgcgcatcttcccgctggttttgtcgattctcgccttctggctgctgtacagcattgtgccgacgcggcgcgtgccgggacgcgatgcgttgataggtgcggtggtcgcgggtctgctgttcgagctgggcaaaaaaggctttgcgctctatgttacgatgtttccttcgtatcagttaatttacggcgtgctggcggtgatccccatcctgtttctgtgggtttactggacctggtgtattgtgttgttaggcgcggaagtgaccgtcacgctggatgactatcgccagttaaacagcag

SEQ ID NO: 66385 - DNA, 1359 bp, Glycine max
  Peptide Sequence Number=SeqID_158070
atgtccgctgaacacgttctctcgatgatgaacgagcacgaagttaagtttgttgacctgcgttttaccgataccaaaggtaaagaacagcacgttactatccctgctcaccaggttaacgctgacttcttcgaagaaggcaaaatgttcgatggctcttccatcggcggctggaaaggcattaacgaatcagacatgatccaacgctcatcatccgctgtgacattctcgagccaggcacgctgcagggctacgatcgcgacccgctccattgccaagcgcgcagaagagttcctgcgttcttccggcatcgccgacaccgtactgttcggacctgagccagagttcttcctgtttgacgacatccgtttcggctcttcaacttccggctcacacgtggctatcgacgacatcgaagcagcctggaacaccggtaaagagtacgaaggcggtaacaaaggtcaccgtccaggtctgaaaggcggctacttcccggtgccaccggttgactcatcacaggacatccgttctgccatgtgtctgaccatggagcagatgggtctggtggtagaagcgcatcaccacgaagtggctactgctggtcagaacgaagtggctacccgcttcaacaccatgaccaagaaagctgacgaaattcagatctacaaatatgtcgtgcacaacgtcgcgcacgcctacggcaaaacggctacctttatgccgaagccgatgtttggcgacaacggttccggtatgcactgccacatgtcactgtctaaaggcggcgtaaacctgttctctggcgacaaatacggcggcctgtctgaaactgccctgttctacatcggcggtatcatcaagcacgctaaagccatcaacgccctggcaaacccgaccaccaactcatacaagcgtctggtcccaggctacgaagcaccggtaatgctggcttactcagcgcgtaaccgttctgcctctatccgtatcccggtggtggccagcccgaaagcacgccgtatcgaagcgcgcttcccggatccagcggctaacccatacctggcgttcaccgcactgctgatggccggcctcgacggcgtgatcaacaagatccaccctggcgatgcgatggacaaaaacctgtacgacctgccgccggaagaagaagctgagattccaaaagtggccggttcactggaagaagcgctgaacgcactgaacgaagaccgcgagttcctgacccgtggcggcgtgttcaccgacgacgctatcgatgcttacatcgaactgcgtaaagctgacaacgaccgcgtacgcatgaccccgcacccggttgagttcgaactgtactacagcgtttaa

SEQ ID NO: 66386 - DNA, 382 bp, Glycine max
  Peptide Sequence Number=SeqID_158071
atgactagaggcaatccatctgacttacaaccctttgatcctgagatagataggacatttcatagattagttaggcatcattttacaccttttgatcattatgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacttgatttcacctatgaaagcttgtgcatccaataccctgatgaggatgtcccatatgttcttaaaactggactgattcatttgcttccaaagtttcatggccttgcag

SEQ ID NO: 66387 - DNA, 436 bp, Glycine max
  Peptide Sequence Number=SeqID_158072
ggtgaagttgcggagacattacagtatatggtgtcaccacaagggaggaacacatggatagttgataatctcatgccttatgtggagaatataacgatcttatccgaagagcaagaaaggatcactgagcctatgacacatggtccagcatcagagccggaagatttttcccaacaaatggaacaacgtggccatggaatatattacacgccaccaacattttctcagtatccttcacagatgtatcagtatcctttcgaaggtcatgacactgatatgtctacaagcgaacattcgtttggtggtgttgtggaaacacatcctcatttttcatggctgactatgaccccttcgcagcaacatgatgccccaatggcaacacctaatgccccattagctctgcaatggaatgtacccgaagcaatacccgatatgg

SEQ ID NO: 66388 - DNA, 984 bp, Glycine max
  Peptide Sequence Number=SeqID_158073
atgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctccttgttgctggatggaatctcgagtcgaatcttctctttgtttctcgagtctatagtgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaacaatctattccttga

SEQ ID NO: 66389 - DNA, 294 bp, Glycine max
  Peptide Sequence Number=SeqID_158074
atgcacacagagacaggcccagggggatgctcgcaggccgcagatgcgccgccacctcatcaggctggcccagctggatcatttgatacggagtacctgcagagccagggttttacttcttttctgtgccctactccggaccagttcagggcagaggtcgcatggccaggagattggcctgaggcccgggcaggagaggcaccagcagaggctcccgacgaggcagatgaggcccgcgaggacgaggagatggccgatttacttgatttcttaggagggagtggagccacatga

SEQ ID NO: 66390 - DNA, 189 bp, Glycine max
  Peptide Sequence Number=SeqID_158075
atgagggttcactggtgcgtcttccaagaaaggaaaatgcgcgaagtcaccaccaatgtttatttgaggaaaacgtcggaaaaaccggaaaggtgtggtctacgaacattaatcgtgaaaggttcgagagttgtttttatgcacggggaaggtgtttccctcgctcctacgtatcctcaattgcgatga

SEQ ID NO: 66391 - DNA, 285 bp, Glycine max
  Peptide Sequence Number=SeqID_158076
atgggtgccaagtacctcgaaatggtcaagcaaaggttgcaagccatcaaacaatggtccccggacgaaattagggcaatcaattcgtggggctccgaactcgatggtggaggatgcatgaatggcaatcaattcatggggctccgaataagatttgatggtggaggatgcatgaatggcaatcaattcatggggctccgaataatatttgatggtggaggatgcacgaacaacgctaggcaatcaattcgtggggctccggacttgatggtggaggatgcatga

SEQ ID NO: 66392 - DNA, 184 bp, Glycine max
  Peptide Sequence Number=SeqID_158077
tcctttcgctaagcgcaagcctcgggctaagcgaatctttggtcatgcgctaagccgcgagtctcaagtgcttagcgcccaacccttgcatctgaggctgattcgttccgctaagctagccaaggccaagctgagcctaatcgaattcgatctgaattcagctaagcgacagccaagccgctaa

SEQ ID NO: 66393 - DNA, 171 bp, Glycine max
  Peptide Sequence Number=SeqID_158078
atggtagcttgccaaagtgagctgagacttagccatgaagcaactagctcgcccaagcgagctggttacttaacatggaagtcttttggtgccccaggcgagccagaggctagcctgggcgagctaggggccaggaaactcaatgaaaagaccctctcgcccttccttttg

SEQ ID NO: 66394 - DNA, 673 bp, Glycine max
  Peptide Sequence Number=SeqID_158079
atggcagaatcgtcaaagaagagaaagggatcatcctccaccactgctcctgctggccatcgccaccacggaccatctgaagcacccacaacacctatctatccttccttatcatctccaagatcatccactctgttttcttccgatgatcaatgtctacgatacctttctcaattttcttctaggatcattttagaccctaagtacctagacatagatttcttcaatgatgagacatttgattgttatcaagtgtttcaaaattctgacttggttgatttcatgtatttaaaattcccttattatcctgaacttgtcaaagtcttttactgcaatttaaaaattcaggatggcattatttcttctgaggtgcatggtatttccatgatcattgatcaatcattgttcttttctttgactaaattacccagtcaaggtgcaccttttgagggcaccattgttgatgactggaaatttgattattctagtcatgatgctcgccgcatggtttgtaatgaccaggctgaaatgaccggtagattgctggccggatcattgacctttgataatcgcatcatgcactacattattgttggaattttgcttccccgatcttcaaattcggctcaagcctctgaggaggacttgattttgatctgggctttccttaccg

SEQ ID NO: 66395 - DNA, 72 bp, Glycine max
  Peptide Sequence Number=SeqID_158080
atgcgtcctccaccatcaggtgcggtgcctccgaaaaaagaagaaggagagacgggagtcgtcatagactaa

SEQ ID NO: 66396 - DNA, 729 bp, Glycine max
  Peptide Sequence Number=SeqID_158081
atgactgagaatgttcctcacatgactgaagatgtccctcatatggctgaggatgcacctaagatgactgcggacgtacaggctgatgatggtgctgaggggtcacatgctgatgatgctgagggattcccaagtgggccatgtgacccatcagtgctgacttcatttgcagaccatgttgcacatgccatttggagtgaacatgaacgtcctgagttgaagttggtgttgcacaggaggaaggtgacgttaattgggaggccagtgcctgagattgaaggattggttgctgccacaggattaagtccattgatcgggtgttcagttgttattgacgatcctagacttatatctgcatttgtggagaggtggcacagggagaccaacaccttccaccttccagtaggagagttgacgatcacattggatgatgtgtcgtcactcctccatctgcttatcagtggcgccttccatagctttcatgctctttctgtggacgaggcgatatttttcttgacagagttgcttgaggtgtctgctgaggaggctagagcggagacaacacgatcacgcggggcatatgtacggctaggatgggttcgagacatctatgagataagatgccaggcacgacgatggattgtagcagctcgtgcttatctactgcacctagtgggttgcactcttttttctaacaagagtgcaacatatgttcatgtgtgcatctaa

SEQ ID NO: 66397 - DNA, 446 bp, Glycine max
  Peptide Sequence Number=SeqID_158082
aggggcatttggttaccgtatcgggcgaggaagacatcttggtgagttgcccgtcctctatgccatatgtggaagccgcggaagagtcattagaaacaaccttccagtcttttgaggtggtaagcattgcctctgtagattccttctctgggcaaccttgcctgtccgatacggcaataatggtggcccgagtgatgttggggaatggttatgagcccggaatgggtttaggcaaggacaacggtggtagaaccagcttgataagctccagaggaaaccgtgggaagtttgggttaggctattgtcgcaacctacccttcggcgggagggcgacgcgtgacttgtgggtgcgtgttcccagaaaggaatacatgaggagtcaccaccaacgtttatttgaggaaaacgtcgaaaaaaccggagaagacgtgatctacgaactttaa

SEQ ID NO: 66398 - DNA, 600 bp, Glycine max
  Peptide Sequence Number=SeqID_158083
atggtacttcgaacttggaacgagtatgaagaaattaacgatacttctttaccttttgagttgttctgccggatcgtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaatatgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttattgtcatttcgggacaagcggatcatttatgatgaagaggatgagcttcaagagaatgattcagagttcttgcagggtggaaccatgcagtaccagacacgagatagatcttccaaagaacagggcttttttcgaataa

SEQ ID NO: 66399 - DNA, 432 bp, Glycine max
  Peptide Sequence Number=SeqID_158084
atggctccaaagaagcttatagctaagagggcaaggaaagatgccgctagagaaggttccagtggggccccacaggtggatgtggagtttgatggacatcggtttcagagtgaggaacaccaatgccgatttgaggcaattaagggttggtcgttcctcaaggagaggcgggagggccaacgctatgagtttagtcaaaggaggagccaggcctgggggtttgacgaggaagccatcagccaacggctgtgtgttccagggatcatgcctcctagacacccagtggagccggagaagtccaatagggcactggggtttctggctttgatcacgggcctttgccaattctatggggtgtcggtcactcctgccaggcttatctggccccccatcaacagggcattcatagagaaatattgcatgcccaggtag

SEQ ID NO: 66400 - DNA, 300 bp, Glycine max
  Peptide Sequence Number=SeqID_158085
atgtcgtcaactgcacctttgtcatccagagacggcaagtccgatgacatgtggagataccttacggttatccgtaccttttgtcagctagaggcaagcaagcccgttgacacacagagactaactacgtcatctgcacctttcctggagatgtgctttgatgataacaaagatgatgacaaaaagcccatgagaatgatttcaagattgagtcaagaacaattcaagaatcaagagaaaggttcaagagaaagtttcatcaagaagattcaagattcaagattcaagattcaagaataa

SEQ ID NO: 66401 - DNA, 141 bp, Glycine max
  Peptide Sequence Number=SeqID_158086
atggtggaggatgcacgaacaacgctagcgctaggcaatcaattcatggggctccgaataagatttgatggtggaggatgcacgaacaacgctaggcaatcaattcgtggggctctggactcgatggtggaggatgcatga

SEQ ID NO: 66402 - DNA, 81 bp, Glycine max
  Peptide Sequence Number=SeqID_158087
atggaggagatacatggagaagacgatgaagaacaaggaattaaaatcaatgacaatggaatggagaaggaaggaaggtga

SEQ ID NO: 66403 - DNA, 78 bp, Glycine max
  Peptide Sequence Number=SeqID_158088
atggagaacgagcaattgctgattgaacagacttggagatcaactcaagagcacagtgttataagtattttctgttaa

SEQ ID NO: 66404 - DNA, 1041 bp, Glycine max
  Peptide Sequence Number=SeqID_158089
atggcatctaagaaaaggaaggctccttctacaccttcccaggccatatatgacagatccaagttcacctctcaagaagcttgggagagatatactaatataactgtgccgaggaaatttcttctagagaggaatgtggtagtttattacactgagtttgatgagttcaaggaggaacccgagagaagacactgggataaggaattgactgattttgctaacaacaacatcaacgttgccattgtgaaggagttttatacgaacctctatgacaccgaggataaatcacctaagcaggtgttggttgctaagctttgtatcccagggaggggattcaagctaaatgctaatgggcagccattgaagatattgaggaagaacatgaccactttagctcagacatggagtgttctttcctttctcgaactgattcctacctcccatacatttgatgtgactttggacagagccaagttgatttatggtattattatgaagatggatatgaacttggggtacctcatctcccaccagatctctctgattgcgcaacatgacacatccagacttggattccctaccatgatcacatctttatgcatagccagaagcgtccagtcagattctagatccctggagaacttgagccctgccattaacatggcatatattaagaagaattgttggaatcttgatgatccaatagtgacatttggagggctaaggaaggccaggggtaagagatcagaggtccccactacttcaacaccaccagagacaccaattccttcttcttccacagctccagtacctctcattcagactccagctatttcacctacatttacacagctaccacttccagctcctttatctgcaggaccttcaaactttatatttacaccacaaatgttgcacttcatgctccaaagcatccacagggggcaatccattatcatacagagccttcagggcttaagcttgccatccatcatgagcatggatgagtttgatttgcaggtggcctggctaggagcctag

SEQ ID NO: 66405 - DNA, 343 bp, Glycine max
  Peptide Sequence Number=SeqID_158090
atgaacaaaaatgatgagtacactaagggcgtctgtgcggctaagcgcgccctgtgcgctaagcctgagtgtcattctggtgaggctgagctacgtgtgccctgcagcactaagcttaaatggcatcaaataagagaaaggcacctgccacatcttcccaagtctgatatgaccgatccaagttcacttctcctgaggcctgggaaagaactggagagaagaaaatgggatgaggaattgaccagttttaatgaaggcaacattgatgttgccattgtgaaagaattctatgctaacttctatgatccagaggacaaatcaccaaaacaggcgagggttagag

SEQ ID NO: 66406 - DNA, 213 bp, Glycine max
  Peptide Sequence Number=SeqID_158091
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggactagggctcaaggaaaccatacactgaaccataacctaagcttgtacttaaatcattcataa

SEQ ID NO: 66407 - DNA, 135 bp, Glycine max
  Peptide Sequence Number=SeqID_158092
atgacgttagtctctgcgcgtcaacgagctcgtttgcccctggttgacaaaaggatgacagaaggtgcagaagacgacgttagtctctgcgcgtcaacagctcatttgcccctggttgacgaaaggtgtggataa

SEQ ID NO: 66408 - DNA, 411 bp, Glycine max
  Peptide Sequence Number=SeqID_158093
atgggtgcaaatacctcgaagtggtcaaacgagggtcgcatcccaacaacggatggtccctggacgaaattagggtatgacaggaatgttgtgaaactttacggattacgcaatgatgcttgtcttttcttctggaatgttgcgaaactttacgaattacgcaacaatgctctttttgactcccggaatgttgcggaactttacggattgtgcaacaatgcttgtttttttccttctggaatgttgcaaaactttacaaattacataacgatgggtgttaaacattttgaggcggtcaagcgaaggtcacatgccaacaaacaatggtccccgaacaaaattaggggaaatgaaataccagcaagcgcaccgggtcgtcaacctaaagtactaaacctcgatccctcgtaa

SEQ ID NO: 66409 - DNA, 624 bp, Glycine max
  Peptide Sequence Number=SeqID_158094
atgcagggtgaagttgcggaggcattacaatacatggtgtctcctcaagggaggaaaacatgcacatttgatgatctcgtgccttatgtggaaaaaattacaattttatccgaagagcaagagagagtcactgagccagtgtcacatggtcccgcatcagagcgtcagtttcccgcacaacagtttcacatgcttcagtcaagtattgaaactcaggggatagccagaagaagggacactgttgaagcggaagaatattcccaacaaatggcggagcgtggccatggaatgtattacacgccacaaaaatttgctgagtatccgacacagatgtatcagtatccttttcagggtcatgacactgatacttctgcaacccagcaatcgttcggtggtttttgcggaaacacaagctcattttcatggcccacaatgaccccttcacagcaatatcatggaccaattccaacacctaatgccccgttaggaacacaatggaatgtaccgggacaaatacctaatacgggtgacttattcggtgttgatttgcgtcacgcattttctgcggaggctgacgaagaagaagcggggaggcatcggggcagaagaaatcctgatcgctaa

SEQ ID NO: 66410 - DNA, 333 bp, Glycine max
  Peptide Sequence Number=SeqID_158095
atggcacgtcagccggagttggggtcaacacaggagtggagatggcactggtacttggcaccctttgttgcacaatacgtgaagttccgagacatgccgaaaatcaaaaggaagcattgttacgcaatccgtgaaattccgatgttcctccaggaggcggttgcttctggaggaagcaacctggctcggctgggcgagctaggtggcaagctcctcccctattttcctataaatagagggaggagtgaaggtgaaaggggttcagcccttctgattttcaaccgttcttcgtcgttcgtcgttcgttcttcgtcgttcttcggtcttcaaccg

SEQ ID NO: 66411 - DNA, 135 bp, Glycine max
  Peptide Sequence Number=SeqID_158096
atggcatttttccaatgctacttggactacaaggctcaaaacgcacaagtgagcaatgctctcggaaacggaaatgtcacgcacactccagacatcttctcaaagaccgcaacgtatttacttactacttcttga

SEQ ID NO: 66412 - DNA, 411 bp, Glycine max
  Peptide Sequence Number=SeqID_158097
atgtcgctattcttgttctggttagtttcggtaattctgctattgctaacaacaccccctttgaaaaatccaccttttcctcaaggtggtaagcttgacgaagctcatcccaattttcctaagttgtatcctcgagtgcaagaccgcgccattgcaccaagaccaggcgggtcagaggatctttggtcatatccaatttggaggagagaatggatagtggttccaataaggggttgttacctacaacatttgggggtagagggtctgaatctcgaacaagaggaccatggtgagggcaaagcaaggaacaatgaaacacatgatgaatcttcgaattttccagcaactggaagcaatgggcacctgcccaatgtgttcaatgatttcgaagggtccatagtagcgttttga

SEQ ID NO: 66413 - DNA, 147 bp, Glycine max
  Peptide Sequence Number=SeqID_158098
atgccaacgtcatcacgtcggctcggcggctcctcaccagaatcttactccttgcaccctgctactgttattctgctcccacaaacaatgttcgtgatcatcacaggtgatcagcctgggggcccaaaggagttccctaccaggtga

SEQ ID NO: 66414 - DNA, 102 bp, Glycine max
  Peptide Sequence Number=SeqID_158099
atgtatagcagttcgagctttttgataattcttgtgctacaaatagggaaatggggttgttcagaatggtacaaaaaatggagaaagaaagatagtgcttga

SEQ ID NO: 66415 - DNA, 411 bp, Glycine max
  Peptide Sequence Number=SeqID_158100
atggttaaggagaagtgtaaggaggtaagtgtctcctccaagaggttagcaaagaaggagagtcattttgcaataaacacaaacattaaagaaacttcccttcttagacaacctcaacatcttctcctttgtaaaaggacacttgtaagcattgccacacctcttgggcttgagtttattcctcaggtgctcatatgggacaccttaggtttgtcgtactttttagtaggagtaatcaacatgaaaatacaaaaaagggatcaaggggttcccatagaccctaagagaataaagcaccactcattgagttggtgtggaactatgttctgtcatgggaagatgcccaagaaaggggttttcagaccttaccctactctaacatacccaacaccactcaaggggatcctctag

SEQ ID NO: 66416 - DNA, 318 bp, Glycine max
  Peptide Sequence Number=SeqID_158101
atggtggtaggcaataccaatgatttcataattttttatgaaactgatgtttctgtggtttctttggatgagcaactggaagactggactgacaaagaaattagtgatttttcatctttgataggtgggtcatatgctcctgatgcccttgagccattaaatggagtccttaccattccattgacaaatgatgcctcagtgaatctccatatgtcaaagagtgcaaagggtcctactgagttgttaacaggatgctttaatggctttaagtggattactggctttccagcattgcctggggagaggataagaacataa

SEQ ID NO: 66417 - DNA, 273 bp, Glycine max
  Peptide Sequence Number=SeqID_158102
atgactaaagcacgtcaaaagggggtacagaaagaaaaggaaggagatgcttgccacccacctcgcccaggcgagctaggttgcttcctccagaagcaaccgccttctggagaaacatcctggaaggcccaagtggtcctgattgtgctacgacacttttcttttggcttccggcatgtctcggaacttcacaaattgcctaacgatgggtgccaaatacctcgaagtggtcaaacgagggtcgcatcccaacaacggatggtccccggataa

SEQ ID NO: 66418 - DNA, 789 bp, Glycine max
  Peptide Sequence Number=SeqID_158103
atgaacttccaggatctccatgacttcaacttagtcctcctaggcaaacaagagtggagactgttaaaacaccttgactctctagtatctcgtacacacattttgctgatggttgcagatggtgcattggaaatggagccacaacaagggtctaggaagacccatggctcaggggaccttattgaccaagataagggtaactggaacctggatatccttaacagtatcttagactgggaggacgataatgcttatttagtctgcacaacataccatggggatcgtgccttgattgatatgcattacttaaaagagattgtttacccaccaggctacatctccaacatagaggtattccttgctttgccacttgtgtcacttagtatgtggaaagctttagggaacttattttttgttttaataacagcagctgataacaaccaggttgcgcggctaacgagatgtatagtcagtggaggaatgcgcaaaaagcccagcctcaagctgagtagtcttccattgttgcccaacctcaagcccattggccccttccagctcctggctttgttgaaatgcaatgttgatgcgactttttttgaggaccgcagagcttttggcatggtgttctgcttgtgcgatgacaatgggtctttcgtccaagcttgcattcagacagaaaatttccttcttttcgttgcagaaggcgaggccatcgcggtgctggaggcaatcaaatggcttctcaacctgggtgtggagaatgtcatcgtcgagtctaactgcatttag

SEQ ID NO: 66419 - DNA, 233 bp, Glycine max
  Peptide Sequence Number=SeqID_158104
ccacccatccccgaggtttcagtcgcgtccgatctctctacgcattcaatggatgtcaagggatgactgaggatttaggagcgattgttgaggatttggagcgggtcatcaacctcaggatggtcactgaaggcactgacttatatgacatcatgactcattgtctgaggagagctagaggtgatgccgcagatggaagtcttaggccgcgacagagacgccgcatagattag

SEQ ID NO: 66420 - DNA, 353 bp, Glycine max
  Peptide Sequence Number=SeqID_158105
atgccccacacccaggcgcgacctgctgcacacagaatgcagccagcagcgacgacccacggcgcgaacgacgatgacgagcacaacgcgaatggcggcgacgacccacacgtagtgaacatcgcgatccaactcaatggtaacgttgcaactttcaagaaaactccaccaaatgtagtcgaagagttgaaggaatatatggctaccaaaaaaagtgggaccacttatagtacttctggcagtggtaatatggcaaatataagagattttgaatttggtgaaccaattggatgtgatggaagtgaagatgagtttgcggactcttgtaattctactgcaagtgcaaagacaaa

SEQ ID NO: 66421 - DNA, 324 bp, Glycine max
  Peptide Sequence Number=SeqID_158106
atgattgaaaaatcgtcgtggaaagtgttcacttttcacgacgacgacttcaaagacgattttagaatcgtcgtggaatgtgctaaagaacttacatggaaaacgttgtttctagtagtgcttgaaaatccttttaaacaattattagtagggaggggaggagaaaaggaaaattcattgggtgaatggagtaagtggagggatattaactccctacaaggagataatctatgcgtcgcaagcggctggatatttaggagcttgctcagaagcgtaggggtgggagagaaacttctttctggaatgattgttgggttagagtag

SEQ ID NO: 66422 - DNA, 663 bp, Glycine max
  Peptide Sequence Number=SeqID_158107
atggcggctgcttctagaagatcaagcgggccagtcctccgaacactctcgccggcgggaaggtttcgcaattcccggccatcgccggcgaccaccgccttcgcgtcctcaacttcaaccttctccgcacgctccaccgctttcttccagaaccgttccagctctcccacacgtgacaatctatacggttcttcttccggttcggttccctccgtccggttcggttcaattaccccgaactcttccatctccgtcgcgggtgccggcaggcatagccaccaccagaagcggacctgcatgtgctcgccgacgtcgcatcccggttcgttccggtgcagccttcacaagagcttcggctcgcgctcggcagtggcggcggcgtcgcctaaccggctgaacgcgcggcggtcggcgatgacgaactcgctcgtgagaatccgcggcgtcgaaggcgaattggggattgttgttcttggtacttggtggcatagtagcatgaaatttgttttggacacgtataactatgtagggacaaagagctataagtgtgactataagtctcaaattgaggataagtttcatagctggcccaaaggtcttaaagcttataaggatatctcggggttttactggggagcaaaggatcctaattacagtggttga

SEQ ID NO: 66423 - DNA, 207 bp, Glycine max
  Peptide Sequence Number=SeqID_158108
atgagtcagggttgggcacaggtgatgttggaagggcttgcatcgacatcagatctagaggtggatatgacacttgacgtcgaaggaaggtggagggattggtgtgcaaccatatgtactagtgaatgcggtggcatagttgtgcgacgacagtggtggtcgttgatggtgagtgtggtgagtgtggatgttgatggcacaatttga

SEQ ID NO: 66424 - DNA, 738 bp, Glycine max
  Peptide Sequence Number=SeqID_158109
atggcagcggaatggagaaaggaagagagagagaggagacgccacttcaaggagaagatgagtctagaagaagctcaccaccataggacgccatggataagagcttggaggaagaaggagatgaatgaagggagagggagagaagagcacgaaattttaaattcttatgtgggtcgtgctcattgtggacctcgtgggagttgggactcgcggcttccaaatgaacaaggttgtctgctaccgtcgtggaccatcgcacgctgctgcgttgcatgtcgcctggtgtcgcgtgttgtggcttccaacaaaacaagggagaaagaaaaaatgcacgagcaagcacaaagaaaatccctaaaccagtcacagcaaaaacgacgtcgtttcgcgggatttttttttcaactaaactcgcgcaactcggaccagactcgcgagtttgcacgagttcactccgagtccaccgagtctactctgagtttgctcaaaaacgagtttgcttttgagttgacttgtgggactgaagtaaactccgaggttatggaagctttgaattgggcaaggggattgagggctttgtcgttgttgtcagtagcttgtcattcttgggacgtggagaataaaagaagtcatgcttgcgacgacaatgaatctccaacacaactgcaaaggggtgccgctggcaacattgagtattcactggtggtgacaagggattcatcggtgacaaaagtgtag

SEQ ID NO: 66425 - DNA, 678 bp, Glycine max
  Peptide Sequence Number=SeqID_158110
atggattgtgacatgttcgggagtgacaacagagggaatggagacaatgaggctgaaaaatcaattgggagtaagggtgaatctcaaaaagaacattctttagaggtaccattgccaaccaatatgggttcactcagggtggaaaaggataaagtagtggttagggatctctttggtgtaacaaccttggatgatgtggtggccacaataaagcatttgggacaaaaaatggaaaacatagaaaattataacaaaaggagactcgatgccatggaaaggactaacacaacaatgctgaaagccatgtgcaacttggttaaacaagactacaaccagttagccaaagacgttgccgaggatgcagcaatgaatggggctcgcaatagttccacctatgatgaaacattacgttgtggaaatcctaataaggcgatgtccaaggcgactgccaggtgtggcacaaaggaagcatataggaaatgtagagtggatctgaaaaatatagaaaccatcttcatcctagggggcgatgatgatgactttccaatgctgaaaaataatgcagtgaaggcaaaattcctaggccaggaaaataataacaaatattcctatcccgagatagtgaacctgtcaaggcccaatgaggtgaagaccatagatgactcatccccacaatag

SEQ ID NO: 66426 - DNA, 693 bp, Glycine max
  Peptide Sequence Number=SeqID_158111
atgccgaagcgtgatagaaccaagaaaaccgcgaaagcaaccgaatcagtacccgaacctcaacctcaactgcagccaccacaattcatcgacctcgaaatccaagcgatggagcgacaaattggcgcgatcagggcggttcgcgacgtggagatcgagcacctgctcacggagctgcggttcctgcgctcgcggttcagcagcgaagagctccggaagcccgtgctgcaggttttcgaagaaaccctaccgaatctcgctgtcgtgaacgacgagcgcagcaagaagcttgaagtgaaatggagagagacggagggttgtaacgatggtgtggatttgcacgcttctttgctccagaggttgtccatggcttccatccctcgcttccctgggtttgaatattccaccaatgaaggtgcttctttggtgtcagggagaatgagctttattggggctgatgacctgcatttcaaggacattgctttggaggaaccatctgacactcagactctagcagtgcaagaaggtcttcagactcccggtgtgactagtcagaggttgtcagttgggatgacacccaaaacacttaggctgcccaaacctggcgagatgcttctctctgtgcatggatcacctctaggtgtttacaaggataataacatggaagccatacatggtatgaaaaatggttga

SEQ ID NO: 66427 - DNA, 507 bp, Glycine max
  Peptide Sequence Number=SeqID_158112
atgggtgttctaacccctcccacaatctcaaaaagtagcttaggacaccaatattctcgcgggaggtctgagattcatatccaacattgggcatgggacacatgcatgctgttggggttgacgtcaagagtccacaacgagttacaaatcatagcggaagatggtgtttgggtgaaggagattggaggaatcccattggtagatagggtcaggtttttcaacgtttcagaaaagaatacggaaaatacccaaaagggagggcaaaagggtcatttggaggatttttcatactcctggttcgcccaagctagcctctggcttgcttgggcccctagaaaacttagaggcgtaagggggctgaaggaaagggttcaggatttcaacattgaaagatttagtgaaattaaggaaaagaaagagaaaggacaagataaaacgagattcaggtgcttccgactcgcatccgtgatcgattcctacatcgttcttcgttcatcaaccggttag

SEQ ID NO: 66428 - DNA, 291 bp, Glycine max
  Peptide Sequence Number=SeqID_158113
atggcttcagaaaaagctgtgggatggtcaatgtcatcagatataggggatcatcaacctcatgatccgacctatctgcaggttttgatttgctggcctagctttggagatcgacatgttaatagcatgtttgtgaatgaagtttgtaaggttgggttggacatgaaggatgttgtgtgtgataggaaccttatagaaaatatggtcaatgatctcatgggtcacaggaagaaggagtttctgaatttggcacgggaagtggctatgttggctaaccatagtgtgaggtga

SEQ ID NO: 66429 - DNA, 402 bp, Glycine max
  Peptide Sequence Number=SeqID_158114
atggctccaaagaagcttccagctaagatggtaaggaaagatgccgctggagaaggttccagcgcagtcccacaagtggatgtgaagtttgatggacattggttccgaagcgaggaacaccagcgccgttttgaggcaattaagggttggtctttcctcaaggagaggtgggtccagttcagggaagaggaatatgccgagttccaggaggaaatcaccaggaggcagtggactcaacttgcggcacccatggctaaggagtcagggacaagcgctcctgggtgcggggccaatggatcccttttgatgaagatgccatttgtcacaacctacccttcggcaggggtgcgaaaaagccgaaacaatgggccaaagcatttgtcgccaccaacgtttatttga

SEQ ID NO: 66430 - DNA, 195 bp, Glycine max
  Peptide Sequence Number=SeqID_158115
atggacacctatctccgtgtgattagtgatcccatgaagggagttcaacggaacactaaaataaaatttgacggagttgttccgtttctcattcctatgacgaggggtgggggtcacaaaccactctatgagggttcacctagtgagtgtggtggtggggccaccactgtgagatatgggttaatctctaagtga

SEQ ID NO: 66431 - DNA, 414 bp, Glycine max
  Peptide Sequence Number=SeqID_158116
atgtggatgttgcgggtcattaagaaaaatttcaaacctgcaaggtatccaaatgcaacaaatgtaaatgatcatgatgaaggtgataactttatcaatattgaagaagaagaagaacaacaagaaattgatcaagctgagatagatgaaacagcatgtatcgccactgccaaaagcggaacgagggttggtatcgccattcgcattggcggaacaagggctggtacggaacaagctgaggtcacatctcgccattcgtgttggcggaacaagctgactgggcattccgccagtagcagcagcgagacccaggttccttcttttcttttgcagctagggcatggcatgctaaggttcacatgggtacagtttgattcacatgcgcctgtaattattgtggagaagattatgggt

SEQ ID NO: 66432 - DNA, 228 bp, Glycine max
  Peptide Sequence Number=SeqID_158117
atgaagaataacaaggttgcaacaactgttgtctcgctaagcgagggatatgcgcttagcgagcaacatccgctaagcaagacaatagctggtgaggagaatctggaagagaatctgccatgtatgcacacgctcagcgcgccatccgtttgcccagcgagtcatttgtctcttctggtgcccagcgcgcctgactcgctaagccaaaaatcactaacttgtgcttag

SEQ ID NO: 66433 - DNA, 234 bp, Glycine max
  Peptide Sequence Number=SeqID_158118
atggagattatgactttacaggctcaaggttcagctcaatcaattaaaaacaagctcaacatgggtgcaagggatttatcattcatgaacagggatcagcatcatcgacactacatggaggtgccagagggtgtaggagttggagctgatggtggtggagtagagggagctggtggtgtagaaatagaagcagagggagcagaagaagatgggccctcagatcctctagcctaa

SEQ ID NO: 66434 - DNA, 417 bp, Glycine max
  Peptide Sequence Number=SeqID_158119
atggcattaggggtcatgacaggttgcctaggcgagttgttgcttcaatctgaagtaaccttgcttgcctgggtgagcaagctatgtgacattgatgtcaagatggaagataaagatttgataatgattatgttagtctctcttcctctattctatgagaactttgtaagttctcttagtgtaggcaaggattcaattacacttgaagaagtcaagtgcaatatctattctagagagcttcaactaagggcatctagggatggtgatgaagtctctgtgttcaaattatcagtgagtaattcttttaaagggcaagaaaagaaaaactacaattattacaaagttgatcctaaggatatctacaattactacaaagaattgggtcattggaagcaagactactcttgttcggcatga

SEQ ID NO: 66435 - DNA, 246 bp, Glycine max
  Peptide Sequence Number=SeqID_158120
atgtcagttatattaacagttaaggaggagaatgaatatcttgatgggaaaacattcacatcagcctcaactttgagcaaaattgtttgtaactcgctggacaatgaaactcatatatatattgatgcaatcctccctaggaagggaccagtcactacagccaagagaaagaggctccaagaggatttggctagagctgctgaagaaggcctaagggttctcatgaatctcaaggtagatttctga

SEQ ID NO: 66436 - DNA, 402 bp, Glycine max
  Peptide Sequence Number=SeqID_158121
atggttaagttaaacgaagatgagcctctccgaagaatcgtcgtcgtctttgttaccctaatgattaatatgattgctcgcgcacgatcgaggtcaaaaacccagtgttcagagctttctcctgttgtttctgagtctgcggtgtcgcgcgctcctaagttcatagttgagaccccagtgtcccctgagttcagagctgagcccctggtgtcacgcttttttggccatcgtcagccaggtccttctcctatcattcccatgagattagaccaacttcaacttacatgtcctttgagaggaagttcatctccctcctcaccatcctccacctacataaagggttattatggaagaaagagcaacctcatagttgtcatcatcactaggataggcagaatctaa

SEQ ID NO: 66437 - DNA, 729 bp, Glycine max
  Peptide Sequence Number=SeqID_158122
atgtggttaatgtctgtgatgatctcaaactttcgtttgtgggagcagatgagcagcaaccagacaaacacttcatatgaggcatcttccttatcagaacattgtgatttggccaattcaagtgcattaaagaggccaaatggtattgataattctgatttgatagatgatgctatgtcagaggactttggtacgggtattgagattcatgatacacttttagaaggttgtgactatgtattacttccccaagaagtttggaaacaattatttagatggtatggcggtgacctacattggcaaggaaagttatttagttcaggtctttcccagactgaattggcagtagaggaaactattggacagcttcacataaaagcttgtggaatatttaatcttcagccagaccaagtgtgcatttgggattactatgtccgtcgaaagcatgctttgatgaatgacatgaacaaaactctcgacaatgctaatttacaaatggaccaagatccttcaaaatcaagcttatcaattgttggtggcttatctgctagcagaggtgcatctagaggctacaacatggacctttctacatctcggaacctaaattctccagttagagatgtggaaaacccttatggaaccattggtgtcaccacaagaggttcatttggtggtctcattggattgctgaatcttggcaatacttgttacatgaatagtgcaatatag

SEQ ID NO: 66438 - DNA, 204 bp, Glycine max
  Peptide Sequence Number=SeqID_158123
atgacagctcgtggaggtcaccggtggtcgatggtggtggaggaggaggttgggggtgttgagggaaggtttaggggaagaagacggaggtataatggttgttttatgttgctagataattgggttgcaagcctatattccaaatttgaaagcgatttaacggttaacaaatccaagattgcggttttaacagaacaagtttag

SEQ ID NO: 66439 - DNA, 323 bp, Glycine max
  Peptide Sequence Number=SeqID_158124
atgactaccaaccttgctaaatgtatgaattctgttttgaaaggagcccgagcattacctattgctgccttagtcaatgaaacatttaataaaataaatgattcatttgttactaacggcatcaaaatcatgaatatgataaaggcagggcataggtactccaaagacgtatatgtcatgatgcaagaaaatcaacacattgctacctcgcattatgttcgcatgtatgttcgagaaacatgggagtttgaggttcaagaaattgaaaatacgcgacttgatcgacgagcaatggcatgcactgtcaaattgaatgaatggtc

SEQ ID NO: 66440 - DNA, 297 bp, Glycine max
  Peptide Sequence Number=SeqID_158125
atgtttgcctacagtcctttcgctaagcgcatctctgttcatgtgctaagccgcgagtctcaagcgcttagcgcccaacccttgcatctaaggctaatttggtccgctaagctggccaaggttgagctaagcgaacttaaattcgatctgaattcagctaagcttcagcctgatcgctacgcaacaacttatccatggctaagcgggacctattgtcgccaagcgcaattccttatggccttaattgaggtccatgacactaagcgccagtcatggcagctaagcgagattcattga

SEQ ID NO: 66441 - DNA, 544 bp, Glycine max
  Peptide Sequence Number=SeqID_158126
atgcagatgggagacagaggtagaggtagtggtcgtagaacatttaatcgtggtacaagacgtggtacccacagtttgagagctccaattatcgtcaatccttccccctcatccattcacatatcaacctcggagtcgattattcatgttgttgcacagactccaaacacacttcctacagctcaagaccaaccaaatcctacctttgtaagggagtcaattcctactacccctgttagagatgcttcaccttcagcaccagatgattctgttacacttgagtacccaacaaatccaaattgtgaacatattgttgatgaaaggcctttcattcgtgcatataaaggagagtttcaaccaacacatgggtgttgtaatatcatattaaatattattaggacaaaatttgatgaaccagctccaagttggttgaatgtgtcagttgaccttcgcgataggtggtttggagagtttaagaaagagtataggtggcacccacaagaagagcgagccattagagttgtttttgagacaaaatgttcat

SEQ ID NO: 66442 - DNA, 327 bp, Glycine max
  Peptide Sequence Number=SeqID_158127
atgcagcaacagcagcagcaatcacaacaaagacaacaagcaactgaggctcctcctcaaccttccttagaagagttagtgaggcaaatgaccatccagaatatgcaatttcagcaagagataagagcctccattcagagtctgacaaatcagatggggcagatggctactccgatgaatcaagctcagtcccaaaattctgacaaattgccttcacaaactgtgcagaattcgaaaaatgtaaataacacaagagaattgttaacccagttcggtgcaacgtcacctacatctgggggctaccaagccagggaggaaatccactaa

SEQ ID NO: 66443 - DNA, 418 bp, Glycine max
  Peptide Sequence Number=SeqID_158128
atgacggtgaaaacctctgacacatgcagctcccggagacggtcacagcttgtctgtaagcggatgccgggagcagacaagcccgtcagggcgcgtcagcgggcgccattcgccattcaggctgcgcaactgttgggaagggcgatcggttcgggcctcttcgctattacgccagctggcgaaagggggatgtgctgcaaggcgattaagttgtggggacgatcaagttcgatagtgtcgcaacctaccctttggcgggagggcgatgcgagggctcacgggtgcgtcttccatgggaggaagatgcgcggagtcgccaccaacgtttattcgaggaaaacgtcgaaaaaaccagaaagacgtggtctacgaactttaagtgtgaaaggttcagaagttgtatttacgcacggggaag

SEQ ID NO: 66444 - DNA, 204 bp, Glycine max
  Peptide Sequence Number=SeqID_158129
atgccgcgaatcctcttgaaagagaggggtgccttcgggaacgcggacacaggtggtgcatggctgtcgtcagctcgtgccgtaagactgccggtgataagccggaggaaggtgaggatgacgtcaagtcatcatgccccttatgccctgggcgacacacgtgctacaatggacgggacaaaggatcgcggtgggatcctctag

SEQ ID NO: 66445 - DNA, 177 bp, Glycine max
  Peptide Sequence Number=SeqID_158130
atggaaactcccgagaaattaaaattaacattacttttcactcggatgtccgattcaggcacatcagatatcgagacgctcgaaattgaacaacggaagctctcgagaaattcaaatggtcgtaacttttcgcacggaggtccgattcaggcgcatcatatatttagacgctggtaa

SEQ ID NO: 66446 - DNA, 798 bp, Glycine max
  Peptide Sequence Number=SeqID_158131
atggggacaaggggttgcatcagttacaatcccgttcttgctataaggcaacttggctaccctatgagaggggcaccgctaaagcaagagctctcgcctgtcatttcacgaggtttcaataagaccagcatggagacacttcagaaggtccgcaaggcatgggaggtggtgcaaaagaaggacaaagaactcaggggcagtaacaatgggcccatcggtggctaccaatggtggttgaaagcccacgtgcaaggtttggattggctcccgagtttgagaaccgctaaaagggaggaagttgaggcaccggaggaagacgaagaggagaatgctgaactaagagatataaatatagctaccatcaaggccttggaacaagagaccaagagggctcgtagggaagagcacggccggaacaagttccgaggggctctgtggggcagcaatagcgagctaaagctccggagagaggaaagagaccaatcccgagtacatagcatgatcttaaaggaggagttagctgcttgctcaagatccaagaagagtttggcccaacacttagaagccacagagcaagctataatagggcagtacgaagaagagttaaaccagtctttgacccatgagcaaaagctagtagaggactttgcacaagcatacgccgagaaggaagcaagagggagggtgattgatgcattgcatcaagaagcgacgatgtggatggataggttcgccttgaccttaaatagaagtcaagacctcctgcgattactagccaaagcaagggccatggccgaa

SEQ ID NO: 66447 - DNA, 288 bp, Glycine max
  Peptide Sequence Number=SeqID_158132
atgagcaacaccctggttcttcgccccggccatgtcactctcgcccagtggcggcaggtctatcgcggcgcgccgctggcactggatccggccgcgctgccgctagtgcgcgccagtgctgctgcagtcgccgccatcgtcgccaagggtgcgccggtgtatggcatcaacaccggcttcggcaagctggccagcgtgcgcatcgagcgcgaggacctggccaccctgcagcggaacatcgtgctctcgcacgctgctggcgtgggcgaaccgatgccggccagcgtg

SEQ ID NO: 66448 - DNA, 612 bp, Glycine max
  Peptide Sequence Number=SeqID_158133
atggcaagaatagccaaggtagtcaaaatctcggcgcaagagttggaccgagtaaaacaaaacagaaatgggatagtcggaataccaaggaggcatttggaggaaaaggcaaaggtgttggcagttcaagttgtcctccttccaaatgtggatgggatagtggacttagcggcgattgatgccttccttgcttatcaccaaagaaaggaaagttcggttgttgctattttggccgatacctatgacactttcgaccgaagatgcgaaaagagtggcgcaaggattgtttgttgtacacttactctctatgtgtggctagtctcgcacctctttttccatgaaagtagacccgcttgtcccttgcaaggtcaccgcatatacgccgataaatggaaggaaaactgggagcaactcttggctagtgtgctagtgcccaccgtggaagagtttgaagagatcttgggatgtccgctaggaggacgaaagccatatctcttttctaggttctatccctccatggcaagaatagcacccataggaatgtctcctcatcgggttgtctttggcaaggcatgtcatcttcctatagagatagagcacaaagcctactag

SEQ ID NO: 66449 - DNA, 1159 bp, Glycine max
  Peptide Sequence Number=SeqID_158134
atggcctccaggaagcgtaagagcattggggcaaggccaactgttcaatatgatactagacggttccatctgcttgatgcttggaaccgttatgcaaataacatttttggaaggagcatcttgccagagaaaggttgagatataccacacagagtttgatgactttaagacagagttggagaggagtaatcttcacaaacacctcaccaacttggctgatgggactattgatgtggctttggtgaaagaattttatgctaatctctacagctctgaggatccttcaccaaagcaagccagagagggggagacattacccacttactctaggtactgcaggttacccacagaccagagagagattgaggctgctctttgcataccagggatgaggttcattttgaatgctaagggccatccagggaggattctcaagaaggatctgactaccttggcccaggtgtggagtgttctctcttactccaacctggcccctacatctcatacatcagatcttatagtggacaaagccagactaaggtttcctgctttgattacccccttatgtcgagcccgaggggttatctctgacagcctcacatttgagcgcctgagccgggccattaacttggcctacattaggaagaactgttggaacattattgatctaatagttgctttccggggggctaggagggcgaggccagctgttattccatctacttctgtagcttcaacacctactccagcatctaactttacagctccttcagttccagctcgtgttgacacgcattgctttgaagccatgcttcaaagtatccatcagggtcagattctattgctgcagagtctatcggtggatgcttcctctgagaccaccattccagagccattcactcttcatcctgaggcaggggaagaacaggtgagaccagagactactacaactcctgagagatcccttaagggcacatcagagcctcctactccagtggcgggcctctcctcaccacagcctgcagttgacacttccactcttttacttgacataccagaggaccagaccacaccagtcctggcactgaacacctctccaccagctaccccagtacatcacttgatagatgaaaaggatgctcagactcagaatacatag

SEQ ID NO: 66450 - DNA, 303 bp, Glycine max
  Peptide Sequence Number=SeqID_158135
atgatggtgacccatgtaatgttggggcacggttatgagcctggaatgggcttggggaagaataatgatggcaaggccaacttagtagacatcaaggaaaaccgcgggaagtttgggctaggctataagcccacgcggactgatatgagaagaagtgtcttagaaaggaggaacagaggcatgggcccgcaactaaggccacaagtgagagaggcccctccttgccacatcagcgaaagctccgtaagtgcgggcttaagacacaaagagaaagtctccatgacacatgaagaagccccttaa

SEQ ID NO: 66451 - DNA, 840 bp, Glycine max
  Peptide Sequence Number=SeqID_158136
atgaatatacctgattcagaagggaagaacttgcatcagtatctcaatttcaattcaaacatgggtttgattcacactccatgttctgagaaatatttaccatccgaaaaaaggaaaaaacggagtccttgtctaaaaaaatgccttgagaaagggcagatgtatagaacctttcaacaagatagtgttttttcaactctctcaaaatggaatctattccaaacatatataccatggttccttacctcgacagggtacaaatatctaaatttcatatttttagatactttttcagacctattgccgatactaagtagcagccaaaaatttgtatccatttttcatgatattatgcatgggtcagatatattatggcgaattcgtcagattccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatctttgatgattccatcatacatgattgagttgcgaaaacttctggatagatctctttctagtgctctggaacaattaggagattctctagaagaatacggagttttgcttttggtggcaacatgctatggggtggtgtcccacttatggggtcaaatcaatacgttctaa

SEQ ID NO: 66452 - DNA, 75 bp, Glycine max
  Peptide Sequence Number=SeqID_158137
atggcgccaaaaacttgttcagtcgcggcaagtgcaccggatcacgcaagtagtataaaacggtatgtaaactaa

SEQ ID NO: 66453 - DNA, 837 bp, Glycine max
  Peptide Sequence Number=SeqID_158138
gcgctggacgcgggcatcaacttcttcgacaccgctaacagctactccgatggcagcagtgaggagatcctcggccgcgcgctcaaagattatgcgcagcgcgatcgggtggtggtggcgaccaaagtctactttccgctgagcaacctgtcgcaggggctgtcgcgcaccaatattctgcagtcgattgatgacagcctgacgcggcttggtatggagtatgtcgatctgctgcagattcatcgctgggattacgccacgccgattgaagagacgctggaagcgctcgatcaggtagtgcggtcaggcaaagcgcgttacatcggggcttcctcgatgcatgccacccagtttgcgcaggcgctgcagttacagcagcagcatggctgggcgcgttttgtcagtatgcaggatcagtacaacctgattcagcgcgaagaagagaaggagatgcatccgctgtgccagcgcgaaggcatcgcggtgctgccgtggagccctctggcgcgcggtaagctgacgcgtccgtggggagaaaccactgcgcgttcggtgtcggataacgtaatggaaaaactctataccggcaccgaagagaatgacgcggccattgcgcaacggctggcaacggtggctgcggacaaaggcgtgacgcgcgcgcaggtggcgctggcgtggctgctgcataagccggtggttaccgcgccgattattggtgcctcgcgcgagcagcagtttgccgagctggtgaaagccgtcgacgtggagctgagttcaaccgatatcgccgagctggagagcgtctatcaaccgcatccggtggtgggattcgagtaa

SEQ ID NO: 66454 - DNA, 235 bp, Glycine max
  Peptide Sequence Number=SeqID_158139
atggcgggcaatcgaaccggcggtgcccggggcataatcgggctcaggccgctgccaaaaccggtcgccagcagcgtcaaagtgatcaaatcccttgtgatggaaactgcgcggcttgccgttctccagcagcgtcagcccttctgcttccggcgcgatctggccgatgctggtatacgccacgcccagatggcccagcgccacatccagtgcaccacgattgacttccggcacg

SEQ ID NO: 66455 - DNA, 507 bp, Glycine max
  Peptide Sequence Number=SeqID_158140
atgagcgtccacgtgacccaagtgattgctgacgccatctatttgtttgtatgtatgccacccagcaggcaccctctagacccggataagcctaacagagccctgggatttttggctctgatcacaagcctctgccaatccttcggagttcaggtcacccctggcaaagtgatccgacaaccgatcactcgagccttcattgagaagtactgcacgcctaggcaggcacagggtgacgcacctcagggcgcggatgcaccgccaccacctcggcaggctgatccggcagagccactgggcatggagcggtatctacagcatttggttcgccagcaggcggccaaccaccacagacagtttgcggctgaggtcgcatggccgggagactggcccgatgcccaggcaggggaggagcctacaagatctcccggtaggatggatgaaccctgcatggacgaggatatgactgacctgttcgatttcttgggagggagcggagccacatga

SEQ ID NO: 66456 - DNA, 390 bp, Glycine max
  Peptide Sequence Number=SeqID_158141
atggaggatagggtcacgaccgaccgatcgtcgtccctttcccggcgctgggcaagcggaggacgtcgctgcaaggcagcccagtatcctttgaattcacagttagctcgcctgggcgagctgagctcgcctaggcgagcaacccctgtacgaaaatatgaaaggggtggagggggaacattttcttcacccaaaacccttccccctcacttcaaaaattcccaagctcacgggaattacaagaacagcagcccccaagcttccgttgttgagttttgcttctcttttcacgctttaattcactccccacaagattgtgggactgttttatatatatggggacagcataggggatccgaaatgggtgcccaagtgcaattccaagcttag

SEQ ID NO: 66457 - DNA, 342 bp, Glycine max
  Peptide Sequence Number=SeqID_158142
atgcagtcagatgtttggggtagtataagtgatcaagggatagtaaatcatatcacaggaggaaattttgcgcagagttccattaccattaatgggtggctccgtgattcttatgggcacaggcatcccagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagtaggataa

SEQ ID NO: 66458 - DNA, 162 bp, Glycine max
  Peptide Sequence Number=SeqID_158143
atggctaagctcaccctcatgcaaaaatacatgaaaatacaatgggaagcttccttgagaagaaaggaagctagcctaggcgagctcagctcacctgggcgtgcaaggttacttcaggttgaaggaatgaagagaaaaataggcgtgagggaggctgagtaa

SEQ ID NO: 66459 - DNA, 279 bp, Glycine max
  Peptide Sequence Number=SeqID_158144
atgggattgaggagcagaatcgtcttaggcgatggtcaaatgccgggccaaatccaaagacagagacaaatcaaggtaaatggtaacgcggccacagtttgctgcgcaatgtcatttcctgctctcaggtacttagggacagatgcgagtagaggctacgcccatgatcgatggatcatcgtcccatgcccagcttcggacaagcgggaagcgcagctgggaggcaacctagtatcctttaaattcccagttattattactgtagtatctttaaggtaa

SEQ ID NO: 66460 - DNA, 510 bp, Glycine max
  Peptide Sequence Number=SeqID_158145
atgggtgacatagaagaggtgcaagaacaaatgaaggccaatatggaggccttgaaggatcaagtggcttccatgatggaagtcatgttaagcatgaagagaatgatggaaagcaacgcggccatagttgccgccgccagcaccgtcgctaaggcggatcctacccatccctccgccataaaccaagcgaaccaacccgcccaggacatggtgggacaaggaggagcggtgttgggcagtaccggtggttcacatttggggtataataggaatgcttacccatacgacttacccctcaattatacgccgcccaccatgcacatgcctaatgagaacgttaatcatgttgttcccgttacctttgagggtcaacaaccccaacctataggaggcacccgcgaagaacctcggaagcgtgctcaaggtgacttcgacccatatcccactttcaccactgagggactagcatataatgttatgcctcagcctaacactgtgggaactccttga

SEQ ID NO: 66461 - DNA, 201 bp, Glycine max
  Peptide Sequence Number=SeqID_158146
atgttcattctaaccccaattgtgataaactcatcccttacctctaagcgggctcacaaaaagctacgatgcaaagtgatgagaatcctgaaactggccaaatacaggctaaaggcccaagtggagaaggacgaagacccaagtggagaaggacaaagcccccgagtggagaaggatgaaggcctaagtggagaaagatga

SEQ ID NO: 66462 - DNA, 363 bp, Glycine max
  Peptide Sequence Number=SeqID_158147
atggggtgtaagcaacaacttaaaaggaagtctacttcaaaatcttatggctctcactcttatccaaagaaagaccaagctcaaggcatcttaggggtgaccccttcgaagcccaaatatgataaggggaagatgatagaaaaacaatcccttaaggatagtatgcaagagaataatagctccataaagtgctttaaatgtcttggaagaggacacattacttctcaatgccccaccaagaaaaccatgattatgaggggccaagacatttatagtagccaagatgaggctaatacttcaccttcctctactgaaagtgaagaagcaaaaggggaagaatttagtgaagaaatctacccctaa

SEQ ID NO: 66463 - DNA, 222 bp, Glycine max
  Peptide Sequence Number=SeqID_158148
atgcctcaatcagatcttagattaatttcaaacaaaggaaacaaattgatacatgttgagtttattgtccctgtaccacacgtaaagcaagtgaagctttccactgctggaggcaggattattctcagcagtgatggtgtctgggatgctctaagtgcagaaatggcccttgattgctgtcgtggcatgtcacctgaggctgcagcaacccatattgtgaaa

SEQ ID NO: 66464 - DNA, 301 bp, Glycine max
  Peptide Sequence Number=SeqID_158149
atggcagaggtctccacagaggccattgcctccctcgcccaatattatgaccagtcgttgaggtgctttacctttggggttttccagttatcactcatggtggaagagtttgaagagatcctaggatgccctctagggggaaggaaaccatacctcttctcaggattctatccctctttagctagaatttctaagatagtccaaatctcgatgcaggaattagaccacagaaagcaagtccaaaatggggtggatggagtaccgaggaaatatttggaagcaaaagcaagaatcttagcag

SEQ ID NO: 66465 - DNA, 902 bp, Glycine max
  Peptide Sequence Number=SeqID_158150
atggcgcttcttgtgtgccttcctcttcctacaacgcttcatcttcctcttcctacgacgcttcttgttggtcttcctcttcctagagcgcttcttgttcgtggttcttcctcttccacttatccttcgtcttcctctgtggtcgtggtttttgttgttggtgcaataggaaaagccttggggaggagagacgcgagtgacgatgatgatgtcccccagcagcataggcctgcatcagcccgtagacaacgacaacaagagcgtgctgtcgaggaccctcctacggccggttttccaggtggaccctatgacacatcagttctcagagaatatgaaaattacattgctttgagagtgtggaatggagaggaacatcctgagttggagctatcttcccatggaaggaagatggctaagtttgggaggcttgctccagagattgaaggccttgtggcggccagtggactaagtcctttgatcatctgttccctagatacgggcgatcggggaataatagaggtgactatcaccttggatgacattacgtcgttgctacatctgcctgttgtaggggtgttccacagcttcgagctgcttgatgtcaaccacgctgtcgatatgttggtggaattactcgaggtcagcgctgtagaggtgggagctgagacgattcagtgtcatggctcttatgttcgactattgtggctgcccgacgtgtatcagatgaagatcgaggcatgtgactggattgtagcagcgcgaacatatttgttgcatctgcttggatgcacactctttgctaacaagagtgccacacacgtgcacgtggtattcttggatgcattgtgtgacttgtcacgaagtgtgggttatgcttggggcgttgctgcacttgtgcacat

SEQ ID NO: 66466 - DNA, 1074 bp, Glycine max
  Peptide Sequence Number=SeqID_158151
gaacatcctgagttggagctatcttcccatggaaggaagatggctaagtttgggaggcttgctccagagattgaaggccttgtggcggccagtggactaagtcctttgatcatctgttccctagatacgggcgatcggggaataatagaggtgactatcaccttggatgacattacgtcgttgctacatctgcctgttgtaggggtgttccacagcttcgagctgcttgatgtcaaccacgctgtcgatatgttggtggaattactcgaggtcagcgctgtagaggtgggagctgagacgattcagtgtcatggctcttatgttcgactattgtggctgcccgacgtgtatcagatgaagatcgaggcatgtgactggattgtagcagcgcgaacatatttgttgcatctgcttggatgcacactctttgctaacaagagtgccacacacgtgcacgtggtattcttggatgcattgtgtgacttgtcacgaagtgtgggttatgcttggggcgttgctgcacttgtgcacatgcttctggatagactgatccctgatgtggtgtgttggattccgtatggtgaccatcgttcatttagagaatttgagtttggctacatcgagattattctaccatatcttgttatgtcttcgctctctgatgaagaaattgatgatagatggatgcagttcagtgagtacattgcacatgtagggaaattatgtgcagcgcctgaccactgttcgtcatattacatggattggttttacatgatctcgcacccattcatgagtccggcacagccacgggatcctcctagagttctgctggttcagcaatatgacacatttgttgaaccagatgtgtatcagcaaccgatggtggcagtggcacctaatgaggcagacgttgatgtgcatcatttggaaagactactgaacttgaggatcctgactgtagtaacagaagcttacactgttgctgaagaatgtttgggcatcgcaagaagctacattggccaaccaactgtaggtcacagatcgaggcgtaggtggcgtatggacggtcattga

SEQ ID NO: 66467 - DNA, 273 bp, Glycine max
  Peptide Sequence Number=SeqID_158152
atgacaagaaccatagggtcagtacaaattccatggagtttctggtcgagaaagcagttacactcacagactaagtttcttctttttcaacctccttcaaggtctcaaaggataaaagaagaaccaagaagtggcgtcatctattggaacatcaagatcaagaaagaagggaacaacaaaatggaagcaatcttgattcaacatggttgtgcagaagctcttgaaggagaagaaaagatgtcagagtctctaagctcaaaggagaaatcataa

SEQ ID NO: 66468 - DNA, 846 bp, Glycine max
  Peptide Sequence Number=SeqID_158153
atggctagggcaattgtgtatagctctttctctccctacccttacctacacattactggagggattgtaatgactggcaaaattggaaaccatctttgtcttgtgggaagattcaaactaactgactatgatgctcaagaagacgttgttgtgtccttgattcaaaaccttattttgagaaatggaaggtttgcaaatgcagctgagcatagtgtcagaccaagtgcgagagttgaatgcacaacttggagaggggcggtgattaaggttggaaggatactagattcattaccatgcagccatactgccatagcattagatgtaatagtagatgttgtcgggatcgacaactttttggatgagctaatggagaagtcaacgtcgttgtatttctacgaatatggaagtggacttgcccgaagccagagtgagtttaccttgcgttccctaactttcacagttgaggggctgagagctgctatggacaagctgacatgtaagattcaaagctacatgagatccatagtgccttgctcaggcgctaggaagaagctgcaaatgcaacaggaagaaccgtctaagatcaatgaaccctttggtgatgatgacatcatggtagtgaacaccaaaagtgttagatccgttagtgtcctaaacaatttagagaccattcaattggatgactttgatgttaatattcctcaaggacagtcacgtgaaggcctcagcgcaccatttactagaagcatggccaaaatgagtgccaaagggaaaaagatggggaaatcagtggtcgacaaaggtcaaggtgatagcaatgcaacctctaaaaatatagtggattga

SEQ ID NO: 66469 - DNA, 348 bp, Glycine max
  Peptide Sequence Number=SeqID_158154
atgtttcaaagcatacatcaggggcagattgttctattacgaagtttacagctggtagcacctccagactctatcccttttgctgaacagtttaagccaggcccgggactcagcccccctttcacagggaggacgaaggtctcaccgctcagaaagagggtagttgaaacacaagaagctgcagccacttcggagaaatctcttgaggctacttctgagcctttagaaccagtgactacaccagtcctatcttcgaacacctctcctctagctacccctgtgcttcacttaacagatgaggaggatgttcagacacaggatacccaggacaaatcacatgatttttaa

SEQ ID NO: 66470 - DNA, 312 bp, Glycine max
  Peptide Sequence Number=SeqID_158155
atgtctccttcacctctaggatctcacaaccactcaaaaactcatctcaaactctcagaacggcttccgcttcaagctctggttttatacacaaaagttagtcgtattcatcgactaacaactatgcaccagcaaagccaggaccctagtcctttcccttggcctaccctcgagcaattcgaggctataattgtctggccaggagatgagcccgattttgagataggggcaaggcctgcaggggcccctggggacgaagatggagctcaggaggatgacgacatggctgatgtgttggatttcttcacttga

SEQ ID NO: 66471 - DNA, 1205 bp, Glycine max
  Peptide Sequence Number=SeqID_158156
ttgatggaggagaagaaaaagaaacattggaggaaactactaaatctggaaacactgacactatcattgatcctccatctcccatcagacgacacatgaagtggaagatggtctgcactaagaaaactaggcaaatgacttctgaggaagctaaggaaattgctgacaagattgagcaagccacacaaggttcctttttcgcccatggacgtcaggatgtactgactactgccattgggcgactagaacaccctagtcgtatgcgtgctgctggagtcagtgtcacgatcaaacgatactttggatcggctccaaggacctcctgcacgtcttcatccatggctcccgaagacctggagcagctaacgcaaaagatcagggacaaactggaggagtcgatcacagaaaagtcgaatgatccagacacaggtgactcagagaaatatgggttgtacatcgaagaaaatcctccccacctggttgccctaggaagactttatgaggggtcgacaaccgttcacaacatccctttgagctatgatcaagtcaaggttggtgttgaggaatttagagatgcagatgctcacattcctttacccactaaagagtcgttgctggttatgttggatgctaccgtgtttggggtgtttaatgacaacttccccttgtacataaagcatgaagatctatctgaaattgcacatggtggtcaatgtctcagcatctctgttatacagttgtggattctgcatatgactaagacaaatatgcgagcggggaatgccgatgtgtatggattcctcaagccacagctagacaactacctcaaaggaataattaacagtgctttgaaaggacttgacaatactccacaaagtaagtccaaggctgctgctaggtggattgttgttaaattcgtctttgtcgcaaattggcctgcacttccatcactgcaaccacattgtggagttcgtgtttgtggagttcatctctgccacttatcgattgaggaaaaagtcccggaaagggtgggaatcgattttggaagtgcattgtggtttgccttaagactcccagggcgttcttcttctttctccttctgccctaagttcgtctttgtcgcaaactgggttgcgtttccggtgggaagcgattttggaagtccattgttgttggctttaagactcccagggaagccattgaag

SEQ ID NO: 66472 - DNA, 93 bp, Glycine max
  Peptide Sequence Number=SeqID_158157
atggatgcaccggaggccaggaaaattgttaaagttcaagtaggtatgataggacgacttaagaataaagcgcaatggattagaatagaatga

SEQ ID NO: 66473 - DNA, 240 bp, Glycine max
  Peptide Sequence Number=SeqID_158158
atgatgcggttgagaactttgaaggatctatctttccatggccataatcaaactcctttatatcagtattacaactataagaacccaagtggatcatataagtgcaaggaaaaagcaaaacaaaggcattttactaaaaacagaaccttagttctgtcgacagtgcagctgattcagagaaaaaaaacacctcttaaggatagattgtttccaccccatgatgacacaactcgactatga

SEQ ID NO: 66474 - DNA, 186 bp, Glycine max
  Peptide Sequence Number=SeqID_158159
atggcgatatcgccattggcactggcgattccttcccaaacaccaaactcgccagttccactggcggataatgtctatggccctattaacttgaaacaggtgcagaaaaatgatcaatcaacactaaggtctagtggtccctatggaaactcaagcaacttggatcaagaagatgccgcctcatag

SEQ ID NO: 66475 - DNA, 666 bp, Glycine max
  Peptide Sequence Number=SeqID_158160
atggagtggctaggagggggggacaaggctcagggaccagctgaggaacaagtggggagcaggtgggcttgggggagaaggagggagtgggggcggaccagctgccctttaatggagctggatgcgcttagctgccctgcgctagcaggggcgcctgcaacaggggcgctagcagtcacaccagtactctcaactttgaccaacaacaacaccctggtcaaagcctcatatgcctctactaccgtgaccaggaacaatggttgcgctaggcctcttcacttcactcaagaaacaacaagggttctttctcatctctttactattcatcgtcgttccgtcgagcttgccgctgttaaggatcccctcattgcaacctcaagtggattccaggaactaggtcgacgggcacgacgagcttcagataacatggacctatttgacaacttcgtgatggtggtaatcctcgtcatccaaatcgggactttagggttatctgtgtttggaggttgtgttgaagatggagtcattatctttgaggttggttcgaagggtgcagtaattgacgaagttgtcattgtgggctacatcgacgaagccatgctagtgatggattggaggacgttgttatggaccgtcatgattctgacgccttcttggtcgtggtag

SEQ ID NO: 66476 - DNA, 210 bp, Glycine max
  Peptide Sequence Number=SeqID_158161
atgttggtggcgactccgcgcgtattcctttcttggaacacgcacccgcaagtcacgcgtcgccctcccgccgaagggccaagcccaaaatgcgcgcgtcacgcgctaagcattcatggcagcacaggcgctaagcgaggcgttaagcacgaagatgcaagattcgttacgcgcgctaagcgcgaggcacacgctaagcctgcagcatga

SEQ ID NO: 66477 - DNA, 585 bp, Glycine max
  Peptide Sequence Number=SeqID_158162
atggacatgagaccaagatcacattatgtacatgagacaaagatcacaaaaacaaaatgtgtatattctttgtcaaagtttgtgccgatagcagattgtcatagtgttgaagacattgagcattctattatctcttgcaaaagttatcaccattctatattttcttctggtagctctagtacgattagaagctacacaaagcagtcatcatacggtaacaggtcacgagagaacaattccttatcagattttggatcttcttctaagatttatatatatatgcaacttgatgggttgaccctttactacttctaccagccgttcaaggaagatgaatttgaacagagcactgaagttcaaataatatttctagcagagccaaagccggttttctatgagtttgattgggaattcgatgaacttgaaataaagcttgccaggttgtattttgtgaaaattaggaagaatgatttttgtgataccctaatttcgtccagggaccatctgtttgttgggatgcgaccctcgtttgaccacttcgagatacttggcacccatcatcaggcaatccgtgaagttctgtga

SEQ ID NO: 66478 - DNA, 552 bp, Glycine max
  Peptide Sequence Number=SeqID_158163
atggagattcttccactatacaaagtgatagtagggttacaaggatgtgtttacaaaattgtctcagtctatggtggctcactcaagcttgaggatagagacttcccaagctatttatctctacttggatctattaggaatgaaggctcctacccttatttatactactccatctccacaatgaatggtggagattacttgtatcctagggtggagattaattctctagaatgctccacacattctaggagtctctacactcttctactctttttcatatccttccataaggttccagaagccgatcaccaagtcgaacaacctggctctaataccactgttgggaaaaactcgatgggaggaaatatcggggagattcttttacccgatgtgggacttcatctcacacttagccttcatgctctagctacctgcggtacttgcaccgccgctccatctgcgggacacgctgcctggactcactgcttggaagactttcgatacaagggatccccaaggctgagatccatcaccgccattttactcgtctga

SEQ ID NO: 66479 - DNA, 702 bp, Glycine max
  Peptide Sequence Number=SeqID_158164
atggaattttctggaattgttgggttgaatggaactacagatttggaatctgatacgagtaaagtgcctctgcgaacagtagaaatcctggcttcttgccatgcattggtatttgttgagaataagctggcttatgtagcgcctgtggagtttgctggttcagggttgcttgcgattgcatttgttagcttgtcttccccagaccaagggataagaagattagcgtatggcactcttgataaatttaagaatgcagtagagaaagtgcctgctgggaaagttcagctagagaatcttatgagactcaatcaaaatgtcttacagaagtgccaaaagaggaaggatgtaatgggacttcggcttctattaaattctgttcaaaacagcatagaagagccatggcaaagaatcccatcagttattgctttatttgctgcagaggcatcttgtgtattgttagatccggcacatgatcattatgcagctatcagtacattttttatacattcatctaagttgaatatgagggttatgtttgataactttttttggagtacctctgtcaatttcaaagcagagaggtcttggatgctttgcctagtatatgcagggatgaactcagatgatgatgttgcgatatatatcaggaactctatccttgagaagctaatgagtttttacgtctctcctctttcagattga

SEQ ID NO: 66480 - DNA, 183 bp, Glycine max
  Peptide Sequence Number=SeqID_158165
ggggagattgtggaagctatgccttccaagattattttgatgatgccaaagaatcaagagttaagcaaattagaaagattcaagaatcaagtttcaagaatcaagattcaagaacaatcaagatcaagattcaagactcaagattcaagaatcaagagaagactcaatcaagataagtactaa

SEQ ID NO: 66481 - DNA, 292 bp, Glycine max
  Peptide Sequence Number=SeqID_158166
atggctgaaccatcatccaatgctgctactgcaagtgcaacgaggaaaaataaggtagacccaggctggaaatattgccattcactagtggaaggagatacaaacaccattgtttcttgcaagaaaactcccccaaatgtagtcgaagagttgaaggaatatatggctacaaaaaaaagtgggaccacttacagtacttctggcagtggtaatatggcaaatataagagactttgaatttggtgaaccgattggatatgatggaagtgaagaagatgagtttgcggactctt

SEQ ID NO: 66482 - DNA, 297 bp, Glycine max
  Peptide Sequence Number=SeqID_158167
atgaagatctcagactcattcacttggatcgttgtgaaatttatgcaccaggagaaagatgcatcctacgtaggaccatggaatggaggcttcaattccttctccttctctctaacgtttgggaaccctaacagagcaactggaggaggagctctagagaacaccataaacgccacaattgataacggagaacacatcgaggtaagggatgaaattattcacaattggagattagtgagaacatgtgtaggaatccttagagtatcaattggaatgagttttgagatatttctgtaa

SEQ ID NO: 66483 - DNA, 681 bp, Glycine max
  Peptide Sequence Number=SeqID_158168
atgaacaaggccatcttcaccagattctttcactccactcctctcttggaacgcaaatcccgcacttttggggaatctagatgcaacaattactccaaaagattccgaaaactccgtgccaaacaaacgctgcttcacgatgtcaatgcctacgcacaattcatgtgtcagggtgcggtgatatttttcatctttaactgcttagcattaaatagggaaaatgagctattgtgtaaggttgttgtggtgccccttcctctacaatcattttttattgagcttttggtacaaggggtactcaaaacagtaggtagagttcgagaggaaagaatggaatccatacggctttctagtgcggttaatttagataaagtttgcattgctatgctcctccccaatatgttgttaaaactggaccagaccggtcagtttgaccggaaatcggtgcctaggctgctccgggtgagttatcggatcggatctgcatctgaaccggatcagccccatgtcagttttgtgaaccttcgtttgtgctctcaggcctcagctctcatttctcacaaatctagccctattcccctctttgatctctcatctcaaacccacacaacaccgcgacattttcgctcctgcaaggttgccgcaccgcaccgttttgtgacagtagcacctggattctaa

SEQ ID NO: 66484 - DNA, 786 bp, Glycine max
  Peptide Sequence Number=SeqID_158169
atgcccaaaatcccaacaaacccttcacaacccacctaccaatattcctcgcatcagccaaattattcagccaacgttggaacccttcccaatctggcgtccgtccaacaaagattgcccactcaaccacaatggtctcccccacaaaatttgtttcccgcacagtctcaacccaccggaaacaccaatcccaacacaaacacaaacccgaggaggaacttcacagaaagaaagccctcgaagctcaccctgataccaatgccttatgctgatctactgccatctttgatcagcaaccaaatggctgtggtgagccccaggaaggtctatcaatctcccttcccccgatgggcattttatagagtagtgtgtggccttcaagaacaagaagacagtccgaatgtgaggactaatccactcaccagtcatggaggctcaatggttaatgcaatggaagagtgggagcctcgagggctgaagcagatgagggacgtgtcaacctctagaaggttcattttggaagcactacgcgaagttggtatgattcgccttgatggtgacaaaggagattcctatttaatgcattcgagggcatcgcacaatgtggatacgtgcttaatggcggaagagttgctacaggggatgatggataacgaccaatttgaagtctgtagtgcgaagaaagggaagggggatgtgtgcatgcagttagatgataaaaaccgaagtaagcccaagcctttggtgatccacttcactagggatgtcgccactcagaagccctga

SEQ ID NO: 66485 - DNA, 324 bp, Glycine max
  Peptide Sequence Number=SeqID_158170
atggtaaagtgtcttgtaaagttgcaaaccaaatttcgagaagatccaacggttaacgaaggctgggcagcgtttctactgaggctgcttcatgcttcctccagaagcttcattaagaggcttctagcacactccagacatctgctcaaagatcccaacggtcagatcatggaaatgtgttttgtgaagttgcagaccaaatttcgagaagatccaacggttaatgaaggctgggaagcgtttttaccgaggcagcttcatgtagctttctctagaagcttcattaagaggcttcctctagaagcttccttgtggcttctttga

SEQ ID NO: 66486 - DNA, 471 bp, Glycine max
  Peptide Sequence Number=SeqID_158171
atggattggattggaatggttgatgatagagttataaggttggctctgagtgggaaagaagaagtggttgtgaggtgggaactcactcatgagattaaggaagaggtgatcgttgatgaagcgcgaggcttcggcgcctccgtgtccgtcgtagacgccgacgaagacggcgtcggagccggtctcgacctggctgtgatcctcgatgacctcgtccttcccccagacgagcgcgtcgccgacggtggacacgtcatcgagattgtcgcccttgctcatgcgtgcatatcgccgcaccgccagagagagaaagggataaagaggtggataatgaaatgcacccagatgggagagaggggagagtgtgatgtgaagagaggaagaatcagaataatgaaatgtaatcagatgggggagaaggagtggaacaagatttttggtgatggggaggggaaaagattggaactttga

SEQ ID NO: 66487 - DNA, 1026 bp, Glycine max
  Peptide Sequence Number=SeqID_158172
atgatgcttactgtttgtaaaggacctacctcatttgaggatttaagaacagttgataatgttcagtatcctacatataaagaagcatgttttgctatgggatttttgcaagatgataaagaattcattgaggcaatcaaagaagcaaaggaccagggttcaacacattatataagaatgctatttgtgttgttacttttaactgcaacaatgagcaaacctgaacaagtttgggaccaaacttggcattggatggctgatgacattgtctataattataaaaaaatcatcaacaggttcagaactcttcagaatccggtcttgcttgaaattgaagaactgctgcaagcaaatcaaagatcgcttagagactatccttcaatgccatatccagaggatgcaaattgtccatcctatctagacaatagccttatattagctgaactgaattacaacaatcaagaacttagatcagagtttaaacatctattttctcacatgacagacgaacaagcatcaatttacaatcagattgttgaagttgttaataaagatgaaggtgatatgttttttctctatggatatggaggtacaggaaaaacatacatttggaaaacacttgcaagttcactaagagctgacaataaaattgtaattatggtagcctctagcggtatagcttctctattattgcctggaggtagaactgcacattcaaaattcaaaattccaattccagtttttgaagacttaacttgcaatatccatcaaggaactcaattagctgaactattaaatcagacaagtctgatcatttgggatgaagcacccatggctcacaaattctgttttgaggcacttgatcacagtcttagagatatcatcaaacacaactcaaaggacaataaaatctttggaggtaaagtcatggtctttggtggagatttccgacagatcctgccagtcattccaagaggcagccgctctgatattgttaacgcaacaattaattcctcttatctatga

SEQ ID NO: 66488 - DNA, 639 bp, Glycine max
  Peptide Sequence Number=SeqID_158173
atgaagttggagatcgacattggagaaagagaagtatcacaagtggatgaacaagagattgctagaagaagacgagagcatattgcaaatgttctagttgatgatgatgatgctctatcacagtttggcatttccaataggaatgacataatctacaaagctgaacaagaacccgcccaaagacagtttgttatagtgactccaactccatggatgagacaggcgtctttcttagatgttcattcccaatcaagccattacctatcctccaagataattgattacgtgatgcaagtgtatgaagatcttaaatcaaaaagggagaaatgggaaagagctatacaagctaagcttattgcaaaaatagctaaggaaaaaactaccaaggtcacccaagttaaaccttccaatgaggccacctcattacaaaaaaaggatcataatgcagttgttgtttttctcagcaactcaagcaacacgaaggatgttgatcccataagctatgttgcccccaatgtagatgctctttcaaaatacaaagttcaagccatggtaactctagctatgcggaagcaaagggaagaaacaaaggagttggtgacccaagctattatgaagcaaagagaagagacaaaataa

SEQ ID NO: 66489 - DNA, 1050 bp, Glycine max
  Peptide Sequence Number=SeqID_158174
atgggatcttcctccaacaccacctctgttggccgtcgccgccatggaacctccggagacccaccagcactagctcctccctctctttcatctcctcgagtcattctagaccgtaagtaccttgaccttgaattttttgatggagaaacatttgattgttaccaagtgtttcaaaactatgctttggtcgatttcatgtctcttaaactaccatactttcctaaattagttaaggttttctataataatttgaaaattcaagatggcgttctttattctgaggtgcataacattcctattattgtttatcagtccttgtgtttttcattgactaaactgcccagtcaaggtgttccttttgagggcacttttgttgatgactggaaatttgattattcaagtcgtgatgctcgcaaaatggtctgcaatgatcagactaacatgaccggcagatcacttgctgggtcatttactttcgattgttgcatcatgcactatatcattgttcatattttgcttcctcgatctctaaatcttgcccaagcctctgaggaggatttgattttgttatgggccattcaaactggtcgtcaaatcgactgggcccatctagtttggtactggatgcataaggcattaagggccaatgcacatctcctgtatccccaccttgttactctttttcttcatcatttcaatgttcctttggatgatgaaccatatgtcaaggctaaaaggtctttctccattggtgccggtgttgttacctcctttggttaccggaaggatgttgatggtcagtgggttcgcaaacaagacttgccaccgcctattcctgacgaacataccccatctcctccaccacaaagggatgcttcttcttctctactaactgaagtcctcacagagctctgcaatcttcgagcatttgtgggtgaacattttgatgtgatggatactcgctttgatgggatggatactcatatcactaggcttaaagattatgtgagtttcatcaggcgttgcttcaatcccctgaccgactcttag

SEQ ID NO: 66490 - DNA, 168 bp, Glycine max
  Peptide Sequence Number=SeqID_158175
atggtgatggtggtgttgtgcacggaggagagggagacggtgatgtcgcgtgcaaaggagagagagaacgacggtggtgacgcaacgatgaaggtggtggttggaggtggtggtgtgaagatagttgtgaggaaggaggaatcaaaagaaaggagtgttatcaaatga

SEQ ID NO: 66491 - DNA, 417 bp, Glycine max
  Peptide Sequence Number=SeqID_158176
atgccttttgtcttcactgactacatgagagatgccataaggatttttgcactatgtgaagctagatttatttatgtgatgactcatgattcgattggacttcgagaggatggaccaactcatcagccaatagagcatttggcaagcttcagggcaatgccaaacactttgatgcttcgtccagctgttggtaatgaaaagggtggctacaccatttcagacaactcatcaggtaacaagcctgatgttattttgattggaactggttctcagttggaaattgttgttgctgctattgaggatctaaggaaggaaggaaaagttgttacagttgtttctattgttagctgggaacttttttataagcagttagatgaatacaacgagagtgttctacctgcttcagtaaccgcttga

SEQ ID NO: 66492 - DNA, 480 bp, Glycine max
  Peptide Sequence Number=SeqID_158177
gatgtgtggaaaaaggcacaggccatccagaaacagaacactgtcccccatgttttatctcgtgggggttatgaatatttggagcaaaagctcctggctgagaagaccaagaagaagttggaggaagctgcccagccaggaagtgttgatggcatcatcgaccctccatcccccgttagacaccacgtgaagtggaagatggcccgcaccaagaaaataggggagatgacgactgaggctgcaaaggaaatcactgagaagatcgattcctttaaggagcaggcgacacaggaatccttcgtcccccgtggacgtcaggatgttctcaccgtttctattgaacgtccagagcaccctagacatgtctgtgctgctggagccggtgtcaccattaatcaatacttcggatcggctccatggacgtcccacaactcttcctctctgcctcttgaagaattgcaacagctgacccagacttga

SEQ ID NO: 66493 - DNA, 522 bp, Glycine max
  Peptide Sequence Number=SeqID_158178
atggaggccatgaaagagcaaatgaccataatgatggaagccatgatgagtatgagaaaaatgatgaaggtcaacacggctacagtcgttgccacaagtaccgccactgatgtggacccgactcacccatctggtattaaccaagtaaatcatccagtcctggatatggtaggtcatggaggtgaagcattgggaagtacgggcggcccctattttgtacagatccagagcaagcatcctttcccaccatatggtttgcctcccaactacgcaccacccaatgttgcacacgcgcccgatgagaatgtcgacaactccgctctcatacccattgagagccaacaatcccaatctggtcatgcacatgcctctcaacccatgggggagacacatgaagtaccccgagaccacactctggccgacttcgagcctcacctcggatatgccactgaggggcaaacatttggtggcgtacccatgccaaacaccttggggggccgtcagtatcgcccacaaccataa

SEQ ID NO: 66494 - DNA, 484 bp, Glycine max
  Peptide Sequence Number=SeqID_158179
taatcctgaacgagaaagtgcgcggactggtagaaaacgtgcgtgcgcctggaggaaagagctgcaacagctacgcgatcagcaagcggcgcaggaaagcgcttcactgagtagcaaagcggttgaggtgaagggcgcgaaactgctggtaagcgaactcagcaatgtcgagccaaaaatgctgcgcacgatggtggacgatctgaaaaatcagcttggttctgctgtcatcgtactggcaaccgttgcagaaggtaaggccggtgagctgattggcgaactggctgcgcaggtcggcggtaaaggcggcgggcgtccggacctggcgcaggctggcggaaccgacgcccaggcactttctggcgcgctggctggcgtgccggagtgggagcaaagaatgcttattctaactcgtcgagttggtgaaaccctcatgattggtgatgaggtaactgtaacggtgctgggtgttaagggtaaccag

SEQ ID NO: 66495 - DNA, 2544 bp, Glycine max
  Peptide Sequence Number=SeqID_158180
atggacttcagtggccacacccccatgatgcagcaatacctgcgcctgaaggccgatcatcctgacatcctgctgttttatcgcatgggcgatttctatgagctgttctatgacgatgccagacgcgcatcgcagctgctggagatctcgctgaccaaacgcggtgcgtccgccggtgaaccgatcccgatggccggcgtgccctatcatgccgttgagggctatctggcgaagctggtgcagctgggcgaatcggtggcgatctgtgaacagattggcgatccggcactcagcaaaggtccggttgagcgtaaagtggtgcgcatcgtaacgcccggcaccatcagtgatgaagcgttgctgcaggagcgccaggataacctgctggcagccatcttccagagccagcgcggttttggctatgccacgctggatatcagctccgggcgtttccgccttagcgagccgggcgatgtcgagaccatggcggccgaactgcagcgcaccaatccggcagagttgctctatccagaggatttgcaggccatgacgctgattgatcagcgccgcgggctgcggcggcgtccgctgtgggaattcgaaatcgacaccgcacgtcagcagttaaacctgcagtttggcacgcgcgatctcagcggctttggcgtcgagcaggcgcatctggcgctgcgggcggcgggctgtctgctgcagtatgtcaaagatacgcagcgcacctcgctgccgcatattcgctcgctgagtatggagcgccagcaggacagcgtcattatggatgcggccacacggcgcaatctggaaatcacccagaatctggcgggcggcagcgaaaatacgctcgcggcggtgctggataaaaccgtcacgccgatgggcagccgcatgctgaagcgctggctgcatatgccgctgcgcgacgtggccaccatcacgcgccgccaggaatcaattgccgaactgcagtcgctgagcgaagaactgcaaccggtgctgcgccaggtgggcgatctggagcgtattctggcacgtctggcgctgcgcaccgcgcgtcctcgcgatctggcacgcatgcgtcatgccttccagcaattaccagaactcaatacccagttagcggacgtggccgcgccccatctcaatgtgctgcgcgatcggatgggggatttcagcgaactgcgcgaactgctggaaagcgccattattgaatcgccgccggtgctggtgcgcgacggtggtgttatcgcgcccggctataacgccgagctggatgagtggcgcgcgctggccgacggcgccagtgactatcttgaccgcctggagattcgcgagcgcgaaaaactggggctggatacgctgaaggttggcttcaacgctgtacacggctattacattcaggtcagccgcggacagagccatctggtgcctatccattacgttcgccgccagacgctgaaaaatgccgagcgctatatcattcccgaactaaaagagtacgaagacaaggtcctcacgtcgaaaggcaaagcgctggcgctggaaaagagcctgtatgacgagctgttcgatcgcctgctgccgcacctcgaagcgctgcagcagagcgccgcggcgctggcagaactggacgtactggccaacctggccgagcgcgcctggacgctcaactattgccggccggtgctgcaggagaaagccggtatccgcatcaccgccggtcgccatccggtggtggaacaggtgctgaaagagccgttcattgccaacccgctgtcgctctcgatgcagcgtcgcatgctgatcattaccggccccaacatgggcggtaagagtacttacatgcggcagacggccctgattgcgctgatggcctggatcggcagctatgtgccagcggaagagacggtgatcggccccatcgatcgcatctttacccgtgtcggtgccgctgacgatctcgcctccggtcgctctacctttatggtcgagatgaccgagaccgccgacattctgcataacgccaccgaaaacagcctggtgctgatggacgaaatcggccgcgggacgtccacttatgatggcctgtcgctcgcctgggcctgtgccgaaagcctggcgaatcgcatcaaagccatgacgctgtttgccacccactacttcgagctcacgagcctgccggagaaaatggaaggcgtggtgaatgtgcatcttgatgcggtggaacacggtgacagcatcgcctttatgcacagcgtgcaggatggcgccgcgagcaagagctacggcctggccgtggcggcgctggccggtgtgccgaaagaggtgattaagcgtgcgcgccacaagttaaaagagctggaagcgctgtcgggcagttctgccggctcaacggtagaaggctcacagctgccgctgctggtggcagaaacctcgccggcagtggaggcgctggaagcgctcgatccggacagcctgacgcccaaacaggcgctggagtggatttaccgtctgaaaaccctgatgtaa

SEQ ID NO: 66496 - DNA, 1128 bp, Glycine max
  Peptide Sequence Number=SeqID_158181
gtcagccgcggacagagccatctggtgcctatccattacgtccgccgccagacgctgaaaaatgccgagcgctatatcattcccgaactgaaagagtacgaagataaggtccttacgtcgaaaggcaaagcgctggcgctggaaaagagcctgtatgacgagctgttcgatcgcctgctgccgcacctcgaagcgctgcagcagagcgccgcggcgctggcagagctggacgtactggccaacctggccgagcgcgcctggacactcaactactgccgcccggtgctgcaggagaaagccgggattcgcatcaccgccggtcgccatccggtggtggaacaggtgctgaaagagccgttcattgccaacccgctgtcgctttcgatgcagcgtcgcatgctgatcattaccggccccaacatgggcggtaagagtacttatatgcggcagacggccctgattgcactgatggcctggatcggcagctatgtgccggcggaagagacagtgatcggccccatcgatcgcatctttacccgtgtcggtgccgccgacgatctcgcctccggtcgctctacctttatggtcgaaatgaccgagaccgccaacattctgcataacgccaccgaaaacagcctggtgctgatggacgaaatcggccgcgggacgtccacttatgatggcctgtcgctcgcctgggcctgtgccgaaagcctggcgaatcgcatcaaagccatgacgctgtttgccacccactacttcgagctcacgaccctgccggagaaaatggaaggcgtggtgaatgtgcatcttgatgcggtggaacacggtgacaccattgcctttatgcacagcgtgcaggatggcgccgcgagcaagagctacggcctggccgtggcggcgctggccggtgtgccaaaagaggtgattaagcgtgcgcgccacaagctaaaagagctggaagcgctgtcaggcagttctgccggctcaacggtggaaggctcacagctgccgctgctggtggcggaaacctcgccggcagtagaggcgctggaagcgctcgatccggacagcctgacgcccaaacaggcgctggagtggatttaccgtctgaaaaccctgatgtaa

SEQ ID NO: 66497 - DNA, 1164 bp, Glycine max
  Peptide Sequence Number=SeqID_158182
gcgacgctcgatcgctgctacagtctaccgagaagctcaacacgccgcgtacgcgacttctacaacacgctgccgctgcacgatggcaaccattatcccggccaaagcaaaacagccgactataaagctcgcgcgcagaaattctttgatgagctggacgccttcttcaccgaactggaaaaatcggggcgtaaagtgatggtggtggtggtgccggaacacggcgccgcgctgaagggggataagatgcaggtttccgggctgcgcgatatcccaagcccatcgattaccaacgtccctgcggcggtgaaattcttcggcatgaaggcgccgcaccagggcgctgcggtggaaatcactcagccttccagctacctcgcggtttctgaactggtggtgcgcgccctggacggcaagatgtttaccgaagataacgtcaactggcagcagtacaccgctaacctgccgcagaccgcggcgttgggtgccatatccgcagtaaagacgaaaaaggccgcaggaggattcctgcggcctgttcgggcgcaaattgccaacgcagcagactcacgcccgccggtccgtcacttctggttatgcatccagctgacgataatactgaccacaatgccagcgattatcggcgccgccagatcgtcccataagatcagacccaactgtgtgagcgtcatagagccgcctcaacgtgcgagggttttctctttccagcaacttatctatgccgccggggttcaagcccccgcaacattgcgcctcaccgggcgaacccggcttggcgtcgattctactgctccatgttatcgccttcaccacgccctttggcaatctgcgaggcgcattccagccctcccccgcagaaatcatcacgcgacaacccgcctcccatcacgcccgcgctttctccggattctcatcctgatcaacggcaaagcaggccaccagttggccgccgtaatccttaagctgcggttgaagctgggtgcatgggccaaagcgtcggcggcaacgcgcattaaaggcgcagcccggcggcggattcagcgggctcggcagttcgccggtcagcttgatgcgctcgcgccgatcgtccgggttcagtcgcggcgtcgccgacagcagcgcctgagtatacggatgacgcgg

SEQ ID NO: 66498 - DNA, 165 bp, Glycine max
  Peptide Sequence Number=SeqID_158183
atggtgccttctggaggaagcaacctagttcgcctaggcgagctgggtggcgaacaaaaatgttcaaccctcctgattttcaaccgttctttgacgctcttcgttcgttcttcgtcgttcttcggtcttcaaccgatttctaaaaggcctaaaatcaacatgtaa

SEQ ID NO: 66499 - DNA, 446 bp, Glycine max
  Peptide Sequence Number=SeqID_158184
gtttaggtgcaggtgctgctactggcggagacacttcaatttgcttgccagaccttaagccatctgccccatctgatttgtcagactctgaatggaggctcttgtctcttgctgaaattgcatattctggaaggtcatttgcctcactaactcctctaaggaaggttaagaaggggcctcagttgcttgttgtctttgttgttgctacttcattggaggaagaacatatggcctgcttggaccaacaacattctggaaaggagggacaggctattgttgctgctgttgttgttgtgaaggatttgcccatctccgatttggatgattcctccaacttggattgtatttgttgcttgaaagatcataattattctgttgttgttggttttgctgctgagggggtctattataaatgtttgcagcataggcttcaggttgctcattga

SEQ ID NO: 66500 - DNA, 498 bp, Glycine max
  Peptide Sequence Number=SeqID_158185
atgatgtttacgcctcaaggcaaaaaattgattatcatcggtagtttggacagtaggtatatcaaaatgctcatcaaaaatggaaaaatcaatgaaaaagagctaaaaaataaaaacgagaaatatataatggtcgttgttaataattctctgcccggtgtggatgaggcgctggtaattgtcggaagcgacagacgcggaacagtgtacggaacctatgaactctcggaacagatcggggtttctccttggtatgactgggcagatgtttctgttaaaaaacaacaaaatttatccatcaaaccaggaaaatatacggcagatgagcccgctgtaaaatacagagatatttttcttaatgatgaagcgtcttgtttaacgacttgggtacataatacttacggcacaaattatggtgaccaccgattttatgcaagagtctttgagctgctgcttcatttacgcgccaactatctgtggcctgccatgtggagctag

SEQ ID NO: 66501 - DNA, 538 bp, Glycine max
  Peptide Sequence Number=SeqID_158186
atggaagaaaatcacaagaagactctcaagttcttagatgttacaagtgcaaccaagaaaaggtatgatgaaagaaggaccaagaaggcctacattgcatgggatgacaatgattcatccgatgaaccatcaaagaagcgaaagggttcttcgagtcggagtcaacgacattctgagactcaggaaatgccgattccttcctctattccctctgcctcattgttttcatccgaagaacagcggatacggtacaaaaatcttttctcttctcattccattattgatccaaaattcattgatatggatttcttttcaaatgagagttttaaatgcattcaggcatttgaaaactccaatcttattcctttcatgtctttaaaattgcctgtttactctgatttagttaaagccttctattcaaacctagaaatccaagaaggcactttaatttttgaagtttatgggattaaaatggtcattgaccaatccctattctatgacttgacccaattattcagtgaaggagtaccatttgaag

SEQ ID NO: 66502 - DNA, 333 bp, Glycine max
  Peptide Sequence Number=SeqID_158187
atggctactccacccaactctcctcctcctcctccttctactaatgcaacaacacaattaccaccagttggggcagagagaccggtggtccatgtcgatgccataaccgggaaggccaacgatcctcacaaaaagaagtttagaacatatttggggatcgtcgctcgtgataaggttgatgtgacatacgagaattggaagcaagtctctgctgctcataaggatttgatatgggaggatattcaggcacttgtagccaacaatgacaatgtcgatgacactgtatgcaaaaaatacggcattagcaaggagaaatggacccaattttgttag

SEQ ID NO: 66503 - DNA, 117 bp, Glycine max
  Peptide Sequence Number=SeqID_158188
atggttagctgcctcacaagggatgtcaacgctgaagcaataagagttttgtccattaaagtgcctccactggctgcatcaatcaaacttctgtccattaacatcaacccctcatag

SEQ ID NO: 66504 - DNA, 327 bp, Glycine max
  Peptide Sequence Number=SeqID_158189
atgggttctccacctgcctccactcctcctcctcctttggacgcatcggcttctccgtctattgtgaagcggacacgcaaagcctcacgtctacgatcattgtccactagaccacctggtgctgagagaccagtggtgcatgttgatcctgctaccgggaaggccgacagtcccctcaggaagaaattaagaacatatttggggattgtggcgtgtgataaggtggatgtcacctacgagaactggaaggaggcggaatttgatatccaagaggcttctgacagtaggacgaaaaggaagttactgcagaccgtgggggagagatag

SEQ ID NO: 66505 - DNA, 480 bp, Glycine max
  Peptide Sequence Number=SeqID_158190
atggctgctagtgaccatgcaatcttgtgtgttagagcacacatcccaaccaaaagaagtctgatggagctttcatcacaggatgctttgttggcccgaaacaagttgctatccaagcaacttaaagctttaactgaaacattgagttgtgttatatgtggtggagcacatgattctggctgctgcattcccacagaagatatagcacatgaagtgaactacatggggaaccagccaagaccaaactttaatgcaaaccaaggtgggccatctaacaggccacaacaacaagggcctagtctctatgacagaatgatgaagctgaaagagactcttgctcagttcatgcaagcatccatgtccaatcaagagcacagagttaggcatcaagaatctagaagtccaggtgggacaattggcaaaacaactggcagaccgaccgtcaagcagctttggtgccaacacagagaagaatcctaa

SEQ ID NO: 66506 - DNA, 243 bp, Glycine max
  Peptide Sequence Number=SeqID_158191
atgtggggtgctaataccttccccgtgcgtaaatacaactcccgaacctttcacttaaaagttcgtagatcgcgtcttttccggtttttccgacgttttcctcaaataaacattggtggtgactccgcgcgtattcctctcgtggaacacgcatcccgcgagtcacgcgtcgccctcccgccgaagggtaggttgcgacaactagcaacagaatactcaaaatgctcaaaatggaaagaatga

SEQ ID NO: 66507 - DNA, 348 bp, Glycine max
  Peptide Sequence Number=SeqID_158192
atggcttctccacctacatcgcctcctccttctccttctcctcctcctcctccttcttccgatgcatcagcttcaccgtctatcgtgaagcggacacgtaaagcgtcacgtctacgatccttgtctactagaccacctggtgctgagagaccagtggtccacattgatcctgctaccggcaaggccgacgatccccacaagaagaaattaataacatatttggggattgtggtgcgtgataagatggacgtcacgtacgagaactggaaggaggcggaatttgaaatcccagaggcttctgacagtaggacgaaaaagaagttacttcagactgtcaacgagagatga

SEQ ID NO: 66508 - DNA, 498 bp, Glycine max
  Peptide Sequence Number=SeqID_158193
atgcttcagagcattcatcagggacaaatcattttactccagagcttacaggtgatggcgcctccaggatccattcctactgttgagcagtttttggcgagtgtaacctggcctggggcccaaccttctcttcacagggaaaatgaaggtcccacagcccaagtaccacaacatatggaggatgagtcatccgaggacaccattccagagccattcattgtagaggaggaggcaggtgagacacagattagacaggaagctgctgctactcctgagagatctattaaggtcactttagagcctcctgcaccagtggtggacctatcctcgcctcagcatgtagtagatccctccactcctatactagagataccagaggacctgaccacacttgtcctgactctgaacacctctcctctagctactccagtacttcatctgacagatgaggaggctgttcagacacaggacactcaggaccagtcacaggaattctaa

SEQ ID NO: 66509 - DNA, 161 bp, Glycine max
  Peptide Sequence Number=SeqID_158194
atgatgaatgggttatcaacaactaacatactgattgtgattgtttggtcatatttgcctgtgccattttattctagtgggatgatcaatgataaagatgattctcagtcccaatctagccagagtaatgtgtggaaaaatttctgcagaatgctcaagtg

SEQ ID NO: 66510 - DNA, 667 bp, Glycine max
  Peptide Sequence Number=SeqID_158195
gaagacacatcttactgaaaggaaggtggaaatataccacactgagctagacgagtgtaaggatgaattggagaggcgtaacttccatagacgcctcaccaatttagttgacaacaacatagacttggctttagtgaaggatttttatgccaacctttacatctttgaagacccttcaccaaagaaagtcagggtcagaggccaccaagtgaggattgatgcagatagcctcaacacattcttggagaggcctcatgtagttgagggcgagactttaccagcatattccagatactgcaggttgcctacagattataaagagattgaggttgccttatgtataccaggccgagggtttgttttcaactctgagggccatcctgggaagattctcaggaaagatttgatgactcttgctcaggtgtggagtgttctctcatattccaacctggctcctacttcacacacctcagacctgacagtagatagagctaggctgatctttggcctagactctcagatggacataaatgtgggagcccttatctctggccagatcacatctatagcccagtctaactcttctagacttgggttccctactctgatcaccgcctgtgtaaggccagaagggttaattatgatagcttggctttcgagcgcttga

SEQ ID NO: 66511 - DNA, 222 bp, Glycine max
  Peptide Sequence Number=SeqID_158196
atgggttggtacaagggtccttgtggcagccatcatgcacaacaatgcaaattccctgacttggcccagattacgcaccatgtccaaaaagtgctagacggcaaagacactcctatgcacacacgagacatggctgatcatcttttctctcaacaacaaaccggcacctgcaacatcatcccaaccatgaaggcacaaactaccacacctctgtactcatga

SEQ ID NO: 66512 - DNA, 852 bp, Glycine max
  Peptide Sequence Number=SeqID_158197
atgccgacggtgctggtgggcgccctggcgattgatgccagcacggcgcagggctctggcaacgctgctatggctgcacgtactggcgcaaaaagagattcgcatcagctggggctactattttcgcgtcggcatcaccctgacgttaccggtgctggccgtgacgctggcagctctggcgctgcgcctttccctttgaccgttaagagactgacaatgactaacattaccatctatcacaacccggactgcggcacctcgcgcaatacgctggcactgattcgcaacagcggcgtcgagcccaccattgtgctttatctggttacgccacccacgcgtgaaacgctgcagcaattgatcgacgccatggggattggtctgcgcgcgctggtgcgtcaaaacaccgacgcctggcaggcgctggggcccgtacgtgaaacgctgagcgatgagcaactgctggatgccatgctggcgcagccgattctcatcaaccgcccgattgtggtgacgccactgggaacgcgtctgtgccgtccttctgagcaggtgctggatatcctgcccgatgcgcagcgcgggccggcgcgtcagtctttagtcggtcagaaatcgtccgggataatctgcttcaatcgcgtgtacctggtcataacggccaaacaggcgatagcgattgcgggcaatcaggttgtagatcagcagctgtttgccgcgttcgctctgaatcgccgcaaagtgataatcgcgcggcaggcggtggcgcagcagaaaaatcacccaggcattgcacagcttgcattgtccatcataaagaatgatcggctggccggactcgggttgtacggatga

SEQ ID NO: 66513 - DNA, 900 bp, Glycine max
  Peptide Sequence Number=SeqID_158198
atgcccgtcaattttgacctcaacgatctctacgccttccgcgcgctagtggagtacggcaactttcgtctggcggcggagtccatctgcctttcgcagtcagcgctcagccgcagaattgagaagctggaagcggcgctcggcacccggctgtttgaccgcaccacgcggcgcgtcacgctgacgctgtatggccagaactttgctcagcgctcggagcagttgctggataatgtcgaatcgatgctggccgacgtcgagcgcgccagccaggatcgcaccggcctgatcaccgtcgctaccgtgccctcgggcgcttactattttatgccggaggtgatccgccgctttcaggcgcgttacccgcgcgtgcgcatcaagctgattgatagcagcgtcggcaacgtgatggatgcagtgagcagcggacaggccgatttcggtatctgctttgcgcgcaatttaccgccggagcttaccttcacgccgctggtggaagatgtttacgtcgccgcctgtcgccacgatcatccgctggcgacgcgccagcagctcagctggcaggagtattttgcgcaggattatgtggcgctggataaggtgtccggtaaccgcaatctgctggacagtgcgctggcgcatcttacgcccgcccggcaaagtatctgcgaaacgcgccatgtcacgacgctgctggggatggtagaagcgggcatcggcattgctgccgtgcccgcgatgtcgatgccggcgaacgggcatccgctactgcgccagctggcgctgaccgatccgcaggtcacccgttcggtgggattaattcgccgcagcggacgtatgcaatcttacgtcgctgcggagctggaaaagctgattatcgaacagtctcagcacgcttaa

SEQ ID NO: 66514 - DNA, 705 bp, Glycine max
  Peptide Sequence Number=SeqID_158199
atggcatcattgggaggttatcatgaatggctgaaagttcgtacacgaggtttagattggcttgccaagcttaagattatcaacgaagagaacttcgaagctccggaagaggatgaagaagtccgagctctgaaaaccgaactaggaaaagcgagacttgccaaagaaaaatttaagttggtcgctacagacgtttggaaagagtgttccgggttacaagaagaaaatgtagctaccgcaaaagcccttgaacaagaaaccaagagggctcgcaaggaacaacatggccgtgacaaattccgtgaagcattgtggggaagcaacagtgagctcaagcttcgaagggaagagagtgaccaatcacgagcacaaagcatggtcttaaaagaagagttagttgcttgctcaaggtccaaaaggaacttgactcagcgtttgtgcgagacagagaccaacatgttagctatcattaccaagtatcaagaagaactaagcctagccacccacgagcatagggtggcggacgagtatgcccaagtgtacgcggaaaaggaggctagaggaagggtgatcgactcgttactccaagcggcaaccatgtggatggaccgattcgctcttaccttgaacgggagtcaagaacttccccgattgctagccaaggccaaagcaatggcagacacctactccgcccccgattgctaa

SEQ ID NO: 66515 - DNA, 858 bp, Glycine max
  Peptide Sequence Number=SeqID_158200
atgaaattgcagcagttgcgttacatcgttgaagtcgttaaccacaacctcaatgtctcctccacggcagaggggctgtatacctcgcaaccgggcatcagtaagcaggtgcgcatgctggaagatgagctgggcgtgcagatttttgcccgcagcggcaaacatctgacgcaggtgacgccagcgggtgaagagattatccgtattgcccgcgaagttttgtccaaagtggatgcgatcaaatcggtcgccggtgaacacacctggccagataaaggatcgctgtacgtggccacgacccacactcaggcacgttatgcactgcctggcgtaatcaaaggctttattgaacgctatccgcgcgtttccctgcatatgcatcagggctcgcccacacaaattgctgaggcggtctccaaaggcaatgccgatttcgccattgccaccgaagcgctgcacctgtacgacgacttaattatgctgccgtgctatcactggaaccgtgccattgtggtcacgccggatcatccgctggcggggaaatccaatgtgtcgattgaggagctggctgatttcccgctagtgacttacacctttggttttaccggccgctcagaactggatactgcgtttaaccgtgccggtttaacgccgcgtattgtttttaccgcaaccgatgccgacgtgatcaaaacctatgtgcgtttaggactgggggttggggtgattgccagcatggcggtggacccggtttccgatccggatctggtgcgcattgaagcttcagaaatcttcaccaatagcaccaccaagattggtttccggcgcagcacacttcctgcgcagctatatgtatga

SEQ ID NO: 66516 - DNA, 771 bp, Glycine max
  Peptide Sequence Number=SeqID_158201
atgccggcaggcggcacagaatgcgccgacctgctggacaatcgcatcattcttgtgaccggtgcttccgacggcatcggccgcgaagccgccctgacctatgcgcgctacggtgcgcgcgtgattctgctcggccgcaacgccaccacgctgcagcaaaccgctgaggcgattaatcagctcaataaacagcccgccgctacgctgctgctggatctggcgcacgccacaccggaaagctgccagcagctggcgcaacaggttgccgcgctggtgccgcggctggatggcgtgctgcataacgccggcattctcggtgaaatcgtgccgctggcggaactcgatccggcggtctggcagcaggtgatgcaaatcaatctcgacgccaccttctatttaacgcaggcgctgctgccgctgctgctgaaatccgacgccggttcgctggtgttcaccacctccagcgtgggccgcaccggccgcgcaggctggggcgcgtatgccgtgtcgaaattcgccaccgaaggcatgatgcaggtgctggccgatgagtataaaaaccgccatctgcgggtgaactgcatcaatcccggcggcacgcgcaccaaaatgcgcgccagcgccttcccggaggagaatgccagcctgctgaaaaccccggccgacctgatgccgctctacctctatctgatgggcgatgacagccgccgtaaaaccggcatcagctacgatgcacaaccggggcgcaagccgggaccggccagcgcatga

SEQ ID NO: 66517 - DNA, 657 bp, Glycine max
  Peptide Sequence Number=SeqID_158202
atgagaacctccctgctttggccggcgcttgcagcgctggtactgagcggctgttccgtgggccatactgagtacagtcgtacggcgctgcagcacgtggatatgagcgtgaccggcatcccgacggtactgggtttgggcatcctcggtacaaccattccgttaacgccggaatacagtctgactgccgcgcacgtggccaaaaccgccgtgcaacgcgtgaaggcttatcacccctattgcgacgtcgcgattatttatcataaaaacagtccggatacgctggcgaaattccgcagcagcgcggtaggcgagccaattaaaatgtatggctacagttttatttccgcgatgccggtggagtcgagtggcgttaatctggcgcgcaccgccattaataatcgctggaataaaaagccctgtatggcaatggcttccgatgccggtgtcgttcaggggatgtcgggcggcgctgtctataatgccgaccagacaatcagcggagtgattgtgggttacagccatgaaattgctaacgtacgcagcaaaaaagtcatcttaaaagatgtctcgctgtacattccgtacggcgatttcaaacgctggctggaagccaatatcggccagacgccacaaacagcgcccggcccggcgtaa

SEQ ID NO: 66518 - DNA, 1563 bp, Glycine max
  misc_feature (1548)..(1548): n is a, c, g, or t
  Peptide Sequence Number=SeqID_158203
atggctaatgcgaaacctacattgaagttgattaccggtaccgcgccctaccgcgaagatccggccgcagtgtttcatcaactatgcggcgcacgtccggcaactctgctgcttgaatctgccgatatcgacagcaagcagaacctgaaaagcctgctgattgtcgacagcgcgctgcgcatcagcgccctgggcaatgttgttaccctgcaggcgctgtcggaaaacggccgcgcgctgctgccgctgctggacgaagcactgccccccgaggtgcgcatcgccgtgcgcccggacggacgtgagctgcatttcacgccggttgagggtctgcacgatgaagactcccgcctgaaagcgctgtcggtgtttgatgcgctgcgtctgattccgcatctggttaacagcccagccgaagaacgtgaagccatgctgctgggcggcctgtttgcctacgatctggtggcgggatttgaagatctgcccccgctgcgcaatgaccaaagctgcccggattactgtttctacctcgccgaaacgttactggtgatcgatcaccagcagcgcagcgcccgtcttcaggccagcctgtttgcaccgtccaccagcgagtttcagcgtctgcagagccgtattgaacagctgcacggtcagatgacgcagccagcgcctgcgctgccggtgcagcgcgtcgagcagatgacgctgagcaccagccagagcgatgaggcttactgcaatgtggtgagcgaactgcagcaggccattcgcatcggtgaaattttccaggtggttccgtcgcgccgcttctcgctgccgtgcccgtcaccgctggcggcttacgatacgctgaaaaacagcaaccccagcccgtacatgttctttatgcaggatcaggactttgcgctgttcggcgcttcgccggagagctcgctgaagtatgacgccagctcgcgccagatcgaaatctacccgattgccggtacgcgtccgcgcggtcgccatgcggatggctcgctggatcgcgacctggacagccgtattgaattggaaatgcgcaccgatcataaagagctggctgagcacctgatgctggtggatctggcgcgcaacgacctggcgcgtatctgtgtgcccggcagccgttacgtggcggatttaaccaaagtggaccgctactcgtttgtgatgcatctggtgtcccgcgtggtcggcacgctgcgcaacgatcttgatgtgctgcacgcctatcgcgcctgcatgaacatgggcacgctgagcggcgcaccgaaagtgcgtgcgatgcagctgattgcggaaaaagaaggcacgcggcgcggcagctacggcggcgcggtcggctacttcaccgccagcggcgacctggatacctgcatcgtcatccgctccgcctgggtggaaggtggcgtcgccaccgtgcaggccggtgccggcgtggtgctggattctcagcctcaggctgaagcggatgagagccgcaacaaagcccgcgcggtattgcgcgcaatcgctactgcccatcactgnaaggagattttctga

SEQ ID NO: 66519 - DNA, 883 bp, Glycine max
  Peptide Sequence Number=SeqID_158204
cgaacggctcggcacgcagcggcgcgtctggctgtatgccagcggcgacgcggcggtgaaagcgaatcgcccgctggtgttattgctcgacggccaaaactggatcgaaaggcacgcgctgctgccggtgatcgagaacgaaaccgcaacaggacggctgccgcccgcgtgctggctgctgatcgatgcgatcgacggcgaacaccgggaaaacgagctgccctgcaacgccgccttctggcaggcaatcatcgatgagctgctgccgcaggcgcagaagcgcgaagcgttcagcgaggaaggggcgcgcaccgtcctcgccggccagagctacggcgggctggcggcgttatatgccggtgtgcactggccggaacgtttcggccacgtgctgagccagtccggttccttctggtggcctacggtgcaattcgttacccagttcgaaaaacgccacgaactggaggaaggctggctgatacgccaggttcggcaacgcgacgcggcggcgccagcgctcaacgtgatccaacaggccggcgatcgggaggcggatatcgaattcgtcaatcgccagatgcacgaggcgctgacggcggcggggcaccgcgccgactaccgcgtgttttccggcggacatgacgcgctctgctggcgcggcggcctggaacaacaaaacccgttcgatgacgaaagcctccgtttctccgttttggtcaacgcgcagcagcagtattcgctgtggccgcagtttgccgacgcgccgcaggggtggcgcgtgctgatggggccggcgtcgcgcggcgaatgcatcgactacatcgaaacgcactggcaggacatgcggccggcggccttgaaagcggcggatgcggcgcgttaa

SEQ ID NO: 66520 - DNA, 141 bp, Glycine max
  Peptide Sequence Number=SeqID_158205
atggtgcaacttaaacaccaagaagagaataaaggtgtcgagggaaggaacccagagtatgaagaacctcgggatttgaggtcaaatcctttccaaggtggaggggatgatgcaatcctaccccccaagggtattggatag

SEQ ID NO: 66521 - DNA, 891 bp, Glycine max
  Peptide Sequence Number=SeqID_158206
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtgatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggg

SEQ ID NO: 66522 - DNA, 462 bp, Glycine max
  Peptide Sequence Number=SeqID_158207
atgatggaaatcgactttttagttcaacattacagttacatgcttgtagcaatgaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttattccggtaactatcgtcttgagtccaacccg

SEQ ID NO: 66523 - DNA, 423 bp, Glycine max
  Peptide Sequence Number=SeqID_158208
atgttttctccttatggaaagataatttccgaggacttcttatggcacacacgaggcccaaaacgcggggagccacgtggttttgcttttatccagtacagcacaaaagagcaatttctgatttccatagttaaagtgagaatgcaggaagcagaattagccaaggagaagatgcatgggaggttagcttgcggccggccattgtttgttcgtcttgctggtgaaaagttcatgttggaaacagctgataactctacaaaagcagctggtgaagggcacaagatgcatctcactggtggtggtggtgccatgggacaaacaagtcgacatgccaaaatagctgctataaaaaacaaattgaaatccttagaggaggagagttctaggtccaagaaacaaaagcgaagtgacaatatttcttga

SEQ ID NO: 66524 - DNA, 1551 bp, Glycine max
  Peptide Sequence Number=SeqID_158209
atgtactattcttccaagcaacgcatcatcacttggttgatcttaatcatgattgttctctacatcctttattcttcaaattttcttctcttaaccaaggtcaagaaggattgttctacctccattcatttagatgaagccacccaagaacatcttgagatgagtggtaatatatcctcaactacaaaaaccattgaaagatcaaatgttgaagagggcaacaatgaaaaggaggaggaagaagaagaagaagaagaagaagaagaagaagtatcccttgaccagttatctcaaagacaagacacgaagctcaaacacattgtttttgggatagctgcttcatccaatttgtgggacataagaaaagaatacataaaagtgtggtggaagcctaatcaaacaagaggggtggtgtggttagatagcaaagtgaggactcaagcaaatgaggggttaccagagattcgaatttctggggacacctctaaatttaaatatacaaatacacaagggcaaagatctgctttgaggatttcaagggtggtaacagagacattgaagcttggaatggaagacgtgagatggttcatgatgggagatgatgatacaatatttattgtggataatgtggttagaattctttctaagtatgaccacactcaattctattatgttgggagctcatctgagagccacgttcaaaacattcatttctcttatgctatggcatatggtgggggaggatttgctataagctatccattagccaaggagctcgcaaaaatgcaagatcgttgcattcaacgctaccctgctctatatggaagtgatgatagaatgcaagcttgcatggcggagctaggagttccattaactaaggaacctgggtttcaccagtatgatgtgtatggggaccttttaggccttctgggggcgcatcctgtggctccactagtgacattgcaccatcttgatgtggtgcaaccaatattcccaatgatgaatcgagtgcaatccttacaacaactaatgaaatctgttaagcaagactcaggtagcgtaatgcaacaatcaatttgctatgacaagaagagatattggaccatctctatttcatggggctatgtggttcaagttttgaggggagtattatctcctagagagttggagatgccaacacgaacctttctaaattggtataaaagagctgattacactgcatactcattcaacacaagacctgtgacaaataaaaacccttgtcagaaagctttccttttctacatgaacagaacacgatatgatccagttaggaagcaaattattggtacatactatcgtttcaaatctagacctccttactgcacttggaaaatggagtcaccagagaaaatcaattccattataatttcaaaaagaccaaatcctcttcgttggcaaatgtcaccaaggagggattgttgtagagttttaccatcacgaaagaactcaactatgtatatatgggtgggcaagtgtcagcagggagaagttagtgaattgagtctttaa

SEQ ID NO: 66525 - DNA, 612 bp, Glycine max
  Peptide Sequence Number=SeqID_158210
atgaagaaagtagtgttaaaggtggacttacatggtgatagaaccaagcaaaaagctatgaagacagcatctggcctttcaggggttgaatcagtttctgtggacatgaaagatatgaaaatgatcgtagtgggggacattgatccagtgagtgcagtgtccaagctacgaaagtgttgtcgcactgaaatagtttcagttggaccagcaaaagaggagaaggagacagaaaaggaggagccagcaaaaaaagtagtcttacagttggacttacatggtgatagaatcaagcaaaaagctatgaaaacagcatctggcctttcaggggttgaatcagtttctgttgatatgaaagacatgaaaatgatcgtgttgggggacattgatccagtgagtgcagtgtcgaagctacgaaagtgttgtcacactgaaatagtttcagttggaccagcaaaagaggagaagaaggagaatgtggagccagcaaaagtaccagttcctctaaagctccatgaagcctatcccctttattatcagatgacaccacattatggtcaaagtcactatgtcacaagttacgaagaggatcctagtggctgtgtcatctgctaa

SEQ ID NO: 66526 - DNA, 1128 bp, Glycine max
  Peptide Sequence Number=SeqID_158211
atggcggcggtggcgtggaatctgacggcgatgggagcttcgattatgatcatgatagttgttcaggtcctcaagatgcttgcgctgacagattctcctctacttattgctaaaacatttgaagcaattaaaataccaacaagtacacgaggcactgtgattaaggagctgtcaaatgtcaaagaggaagtttatggagctcttgattcctatgttgcttgggaattagagttccctttaattacagtgaaaaaggctctcaagaccctagaatccgaacaagaatggaagcggtggatgctaagcaaaggtcaagggaagacaatgggaagctatttcacattacttaatgctttagtagaggatgaccgtcttgatgaagctgaagagctttggacgaagttattaatgcagtacatggaaagcttgcctcgtagattttttgataaaatgatatctatctaccataagaggggcatgcatgagaagatgtttgagatatttgccgacatggaggagctttgtcttcgacctaatattgctgttgtctcgatgattggggatgccttcaaagagctgggtatgctagacaaataccagaagttacatgcaaaatatccaccaccacaatgggaatacagatacatcagaggaaagcgtgtaaaagtcaaagtggaagttcagtctaatcaggtcaacacatacatagaaaggcatgggaatgttgaaccaaactcagacttaaacaagaattatagattatctgaaaagacttcagagatagtcgatcaacaactcagacaggatgcgaatgtaatatccatgaaacctgaacaaatttcaggcataaacaacaattatagatctgaagagacttcagacatgattgatgatcagcaacttggacaggaagcagatgtaatatccatggaacttgaacaaatttcagatgattcatatgacattggaatcattatttccatgtgcatctcctacaagttgttaggagataagagtgaagacactctaggaataggactagaagaacatgttcttaaaaatttcacaaaatgtgagattgagaatctggtgatggccatttcatctacccaaaaattttcatgctga

SEQ ID NO: 66527 - DNA, 345 bp, Glycine max
  Peptide Sequence Number=SeqID_158212
atgaagggaatgccgaagtgcttggaagcggcaatgagccccgttccggagaggtcgcacaagctgaacacctcccccaagaagactggcccgccgccgccttttccattggcaccaagccgcgcgatgcggactgactttgctgggggatgggcgggcttggaagtggctgagtccacggtggaggaaccggagagcggaggcgcgaagaagagagggagggagacggagagaggcgaagttggaggcggtggattggaggaaggtggagatgtggttgtggttgtggcggcgacggcggtgaggctcggacggcagagccatgccacgggcattgacggatga

SEQ ID NO: 66528 - DNA, 1227 bp, Glycine max
  Peptide Sequence Number=SeqID_158213
atgactcatgaagattgggatctctttgccatagttagaagttgcaaagctgctacctttactgccaccacaaacactgaaaccccacccacccccgcccccaacactacctcatgcttggatttgagccaagaaaatggctcattctcttttcccaatcttgtgcaaccaacaacgaatgggttccaagagcttcaacatcaacaattggtaataaacttcaaccccaccaacaccacgagcaccacttctagcactagcactatcactagtggtcttggcatcaatcccaactccactttttctgaggttgcgggattcattggacaacagcaaggttaccaccaccatctccttcctgctcccacaaatcacacctccattggaacacccaccactactggttttgacagattccaacaccaccaacaacagcaactccaaagcccagaacaaaaccaaccaccccttcaagcaccccaaacaagtcccatcctttcaccaaccacacaaccacaaacacccagatcaagaaaaagaaaaagccatcagaagaaaatggtgtgccatgtaacagcagacaatctgtcatcagacttgtgggcatggcgaaaatatgggcaaaaacccatcaaaggctctccatatccaaggaactattacagatgcagtagctgcaaaggctgcgtcgcgagaaagcaagtagaacgaagcacaaccgaacccaacacgttcatcgtgacctacaccggcgaccacaaacacgcgaaacctgttcagcggaactccctcgcgggaagcactagaaccaaaccatccacgacccgtttatccgaacccaatgaatccgtgacttgcccaaaaagagaaaacgcgtgttcttcaaattccgagctttctcccatgttgtcagtttccgacacgccgaaaaacgaggaaacggtctcggccggtgaacccgattgccctgacatggaaattgagccctccgaaaacgacgacgacgacgttttgatacccaacacgggtgccatgtccgacgctgttctcttgggcttgaccaatgttgaccgcgacggcgtttcgacgcttggaattgatcagaaaaacacttccgggtcgtgccagtcttatccggaacccgacccgttttcaaaacccggtttatattcttcagcccttggccccgcaaaactcgccgaccttcttgatgactgtaatttgtaa

SEQ ID NO: 66529 - DNA, 651 bp, Glycine max
  Peptide Sequence Number=SeqID_158214
atggtgtgccatgtaaccgcagacaacctgtcatcagacttgtgggcatggcgaaaatatggacaaaaacccatcaaaggctctccatatccaaggaactattacagatgcagtagctgcaaaggctgcgtcgcgagaaagcaagtagaacgaagcaccaccgaacccaacacgttcatcgtgacctacaccggcgaccacaaacacgcgaaacctgttcaccggaactccctcgcgggaagcaccagaaccaagccatccacgacccgtttatccgaacccaatgaatccgtgtcttgcccaaaaaaagaaaacgcatgttcttcaaattccgagctttctccaatgttgtcagtttctgacacgctggaaaacgaggaaacggtctcggccagcgaacccgattgccctgacatggaaattgagccctctgataacgacgacgttttgatacctaacacgggtgccatgtccgacgctgttctcttgggcttgaccaatgttgaacgcgacggcgtttcgacgtcagaaaaacacttccgggtcgggacagtcttatccggaacccgacccgatttccaacccggtttagattcttcagctcttcgccgcacaaaactcgccgaccttcatgatgattgtaatttgtaa

SEQ ID NO: 66530 - DNA, 822 bp, Glycine max
  Peptide Sequence Number=SeqID_158215
atggctgaccacacaaccagaaagaccacgatggaaagacttgaagacgcagttgctcgcctatccaacagccaagcttccctcaatgacaaatacgcagaactttctggcaaggtggactcgattctcgatcacctccacctgcggtcacccaaccataatcatctcaattccaacactcacctccatcaacgtaatgtagccaaattagatatcctgcgattctcgatcacccacctgccgcccatgactgcctccacctctactcccggccatgccataacacaccacccacaaccacccctgcaggagccatcccttccttctctttctgtacatccagctcaatccattgggattgattttgcaagtactcggcaccgtctgttaagcttgtttagtaccacagctctgcaaaccatgccaccttccatggattccacagtgccaacggcactgctggaacatcaccacacaatggatccgaacacctcaccatggtgccccgacacaatcaccgttccctggagagctcgcgtcactccccaaacgatgccgcaaagcttccacttacccaagatcacgccattcccaaacgacaacgttttgtccacagcacaaacactagaaaccccgccaacgcctctccccaaaccggaaaacaaaaatctaaaagttttccttcaaatccgacccctccttttgtcgcccgttcaagctccgtgcaagagacctaagagcgcgtggcctcagaaccccgtcaaaaacaacgcgccaccaggtgctgaatttccaagaacaagaatcccaccgcgtgcttaa

SEQ ID NO: 66531 - DNA, 472 bp, Glycine max
  Peptide Sequence Number=SeqID_158216
atggctattggcagtgctaaagtcatcattatcattctaaagtcatcagttgttgtttctgctcaagaccatattatgtgcattcagactgagagagaagcactcctccaattcaaggctgcacttctggatcactatggcatgctctcttcttggaccacttctgattgctgccaatggcaagggattcgctgctccaacctcaccgcccatgttctaatgctcgaccttcacagtttaggcctcagaggagagatccaccagtcgttgatggagttgcaacaattaaactatttaaacctcagttggaattcttttcaaggcagaggaatcccagagtttcttggttctctcaccaacttgagataccttgatctgtcacattctgattttgaaggaaaaattccaactcagtttggctctttttctcatttgaaatacttaaatcttgctgggaattattatctggagg

SEQ ID NO: 66532 - DNA, 1425 bp, Glycine max
  Peptide Sequence Number=SeqID_158217
atgaaagacaccattgttctataccctaatgttctaaggggacacctagtttccatggtggagctaggcaaactcatactaactcaccacccttcactttccatcactatcctcatcctcactccaaccaccacctcttccaccaccagcgtctcctgcaactctaatgctcgatacatcgccaccgtcaccgccacgacccccgccatcacattccaccacgcccccttcgccacactccccccctccactccttccctcccctctcacatcctctccatcgaactcacccgccacagcacgcaaaacctcgccgttgccctccaaaccctcgccaaagcctcgaacctcaaagccctcgtcattgacttcatgaacttcaacgaccccaaagccctcactgaaaatctcaacaacaacgtccccacttacttctacttcgcttcatgcgcgtcctttctctctctactccttcgtttaccaaccattcaccaaaccgttactagagagaaggtcaaagaccaaccgctgcagattcaaatccctggattacccacaatctccaccgacgattttccaaacgaggccaaagacccttcgagtgaaagctaccagtccttgcttcaggtagcggaaaacatgaggtgcagtgttggcattatagcaaacacgtttgaagcccttgaagagaaatccatcagggcgttatgcaaagatgggacgttgccgcctttgttttttatcggaccgttgatctctgcaccgtatgaagaagacaaagggtgcctgagttggctagactcgcaaccgagtcagagcgtcgtgttgctgagtttcggaagcctcggaaggttttctagggctcagttgaaggagatagccattgggttggagaagagtgagcaaaggttcttgtgggttgtgaggtccaggttggatgatgctgactcgatggaggaactgagtctggacgagttgatgccagaagggtttctggagaggaccaaagagaaggggctgataatgagaaactgggccccacaggttcagttactgagtcatgactcggtgggtgggttcgtgactcactgcgggtggaactcggtgttggaagcagtgtgtgaaggggtgccgatggtggcgtggcccctctacgcggagcagaagatgaatagggtgattatggtgaaggaaatgaaggtggctttggaggtgaacgagaacaaagatgggttggtgagtgcaacagagttgggggaccgagtcagggaactgatggactcggtaaagggaaaagagattagacaaagggttttcgagatgaaaaaaagggctgaggaagcaatggctgaaggtggaacctcgtgcgtcacgttagataagttggctatcaagttgtggaaaggaaacatgattgacatctaa

SEQ ID NO: 66533 - DNA, 267 bp, Glycine max
  Peptide Sequence Number=SeqID_158218
atggatgctatggatatggaggcatctttgtggcaccaaaggcttagtcatataagtgagaaggggttaaattgtttagccaagaaagatatgcttccaggattgaagaatgtagatttggaaaaatgttctcattgcatggttgatgtttgtggccctttgaaggttaaatcctttagtgatgctgatatgatgactaaggcattactaagatggaagtttgaagcttgctctgagatcatcagtttggcagttacctttacatag

SEQ ID NO: 66534 - DNA, 1422 bp, Glycine max
  Peptide Sequence Number=SeqID_158219
atgaccatgaaagattccattgttctatattcagctttgggaagaggacaccttgtttcaatggtggaactaggtaaactcatactaagccaccacccttcactttccatcaccattcttttcctaaccccaccccccaaccaagacacccccacctcccccaccgccttcacctgcgacgccaccgccaaatacatcgccgctgtcaccgccgccaccccctccatcaccttccaccgcatccctcagatctccatcctcaccgtcctccctcccatggccctcaccttcgagctctgccgcgccaccggccaccacctccgccgcatcctcagctacatctcccaaacctcaaacctcaaagcaatagtcttggacttcatgaactacagcgccgcacgtgtcaccaacacgcttcaaatccccacttacttctactacacttccggcgcctccaccctcgccgctcttctttatcaaaccatctttcacgaaacctgcaccaagtccctcaaggacctcaacacgcacgttgtaatcccagggttaccgaaaattcacactgatgacatgccagacggagcgaaagatcgtgaaaacgaagcttacggggttttttttgacatagccacgtgcatgaggggcagttacgggattatagtaaacacgtgtgaagccatcgaagagagtgtgttggaagcgttcaacgaagggttgatggaaggaaccacgccgaaagtgttttgcattggacccgtgatttcttctgctccttgtagaaaggatgataacgggtgtctgagttggttaaactcgcaaccgagtcagagtgttgtgtttttgagttttggaagcatgggaagattctcgaggactcagttgagagagattgctattgggttggagaagagtgaacaaaggtttctgtgggtcgtgaggagcgagttcgaagagggtgagtcggcggagccaccgagtttggaggagttgttaccagaagggtttttggataggactaaggagaagggaatggtggtgagggactgggccccacaggcggcgattctgagtcatgactcggtgggtgggttcgtgactcactgcgggtggaactcggtgttggaagcgatttgtgaaggggttccaatggtggcgtggcctttgtacgcggagcagaagctgaatagggtgattttggtggaggaaatgaaggtggggttggcggtggagcagaacaataacgggttagtgagttccaccgagttgggtgaccgagtcaaggagctcatgaactcggataggggaaaagagattagacagaggattttcaaaatgaaaaacagtgccaccgaagcaatgactgaaggtggatcctcagtagttgcattgaataggttggtagaaatatggagggagcattaa

SEQ ID NO: 66535 - DNA, 840 bp, Glycine max
  Peptide Sequence Number=SeqID_158220
actctaagaaaccggtcagcggcaattgatggtgaaattgacagggttcttagtaacacattagattccacaagaaactcaaatgcatcaaaggaggagacaaatggtatgcctcctttaacaaaggaggaaataaatggcagtccttcaaaagatgatggaatagtagataaaccagtagaagcacatgtcttgcttactttagaagaaaaggactatacaagtgttagatggaaatatatactgtggaaatcctgcgtatacataatcacattaggaatgttgattgcaatgcttctaggtttgaatatgtcatggactgctatttcagctgcactagctttggtagttcttgatttcaaagatgctaggccaagcttagagaaggtttcctattcactcttgatattcttttgtggaatgttcatcacagtagatggcttcaacagaactgggattccaggtgctctttgggatgtcatggagccttattctcgagtaaatcaagctagtggagtagcaatacttgctctagttatattaatcctatcaaatgtggcttcaaacgtaccaactgttctattgcttggaggaccagttgcagcctcagctgctgcaatttcccaagcggatgagaagaaagcatggctcatcttggcttgggccagcacagttgcagggaacctttcactattgggatcagctgctaacttgatagtgtgtgaacaagctcgccgagcccccaacattgcatacacattaaccttctggagccatctgaaatttggtcttccttccacccttataatcactgctattggtttgacactcataagatga

SEQ ID NO: 66536 - DNA, 615 bp, Glycine max
  Peptide Sequence Number=SeqID_158221
atggcattagcaccggttccaaaacttgtccttggttcagttgcctttgcaatcttctgggtgttggcagttttccctgctgtgccttttcttcccattgggagaactgcagggtccctgctaggtgcaatgcttatggtcatattccgagttattagtccagatcaagcatatgaagcaattgatcttcccattcttggtcttctttttggcacaatggttgtcagtgtttaccttgaaagagctgacatgttcaaatacattgggaaattgctctcttggaaaagtagaggagcaaaagacttgctttgcagaatctgtgtgatttctgctgtctcgagtgcactcttcactaacgataccgcttgtgttgttttgacagaattcatattgaaaattgcaaagcagcataacctcccaccccatcctttactacttgcacttgctacaagttccaatattgggtctgctgcaactccaattggtaacccccaaaatctggttatagctgttcagggtagaatatcatttggacagtttctaattggtattcttccagctatgcttgttggggttgtagtgaatgctttaattcttatggctatgtattggaag

SEQ ID NO: 66537 - DNA, 129 bp, Glycine max
  Peptide Sequence Number=SeqID_158222
atggacaagcaagatgcatcgttccttgctctgtttcgttgccagaacgaggagattcgacctaatctctttcgcagtggaaacggtggtagtgatggtggtctaaagcgaagaagaaagacagggtaa

SEQ ID NO: 66538 - DNA, 302 bp, Glycine max
  Peptide Sequence Number=SeqID_158223
gggaggtggttgccgcccagctcgcccaggcgagctcagctcgcccaggcgagcagggttgcttcctccagaagcaaccgccttctggaggaatattccggagggcccaagtgggcctgggaaatggccccgaggaagcttgcctcaaagaggtccaggaaggacaaggcagccgaaggaactagttccgctccggagtatgacagtcaccgctttaggagcgctgtacaccagcagcgctttgaggccatcaagggatggtcatttctccgggagcgacgcgtccagctcagggacgacga

SEQ ID NO: 66539 - DNA, 434 bp, Glycine max
  Peptide Sequence Number=SeqID_158224
tggagcgggtgctatccgagaacaattggccgatctggatttgagaattcttatggattcttcgttgatagaatggaaagaattaggggaagagggatccccggacaatgaaaacgaatgggaagatcgaaaagagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattag

SEQ ID NO: 66540 - DNA, 384 bp, Glycine max
  Peptide Sequence Number=SeqID_158225
atgaggtcctgggtgaggggtcagtggatcccgtttgatgcagatgctatcagccagctcctgggatatcctttagtgctggaagagggtcaggagtgcaactatggccagaggaggaaccagtccgatgggttcaatgaggaggccatcgcccagttgctatgtataccggggcaggattttgcccggactgctaccgggagacgggtgcggatcatgcgcaccaacatgaccaccctgactcagatctggatgactttgctgctcagcaacatccagcccagcgaccataattccgacctccccctgccgaagtgtatggcgcctaccaggcaccctctggacccggataagttcacagggccctgggatttcccgccttga

SEQ ID NO: 66541 - DNA, 87 bp, Glycine max
  Peptide Sequence Number=SeqID_158226
atgcggaaattgattaaggttaagtggtggctggacagaaatatagaaatggcaataactgaagctacagggctccaaatgaggtga

SEQ ID NO: 66542 - DNA, 273 bp, Glycine max
  Peptide Sequence Number=SeqID_158227
atgatgatggtgtgggttttctttcctagatcaaactctcaaccgcttggactacttgccaacttcacctccttgtctcattttctctgctcttcctcttttgtttctcaattcttgaaagtgagagataatcatcatggtagagtgattcttgttgaaagtaacaactacgactactactttaaggttttgttgattggtgattctggtgttggcaagatgatgcaatcctacaccccaagggcattgaatagaagactccaagaagattga

SEQ ID NO: 66543 - DNA, 156 bp, Glycine max
  Peptide Sequence Number=SeqID_158228
atgaagtcgttgaggggaaaggagatcgcgttggtgaaggtgcagtggggaaccgatgagggtgattcaacatgggagttagaagataggtgtatatgcatatatgttcttggtagaagtaggaatagtgggggcaagatacgcgggttaggctaa

SEQ ID NO: 66544 - DNA, 486 bp, Glycine max
  Peptide Sequence Number=SeqID_158229
atggaaaacgccagcaacgcggcctttttacggttctgccttttgctggccttttgctcacatgttctttctgcgttatcccctgattctgtggataaccgtattaccgcctttgactggcacgacaggtttcccgactggaaagcgggcagtgagcgcaacgcaattaatgaaacagctatgaccatgattacgaattcgagctcggtaccctgttcaaatagtgttagtgtttgtgtgtatcaaatgaataaatatttacctcaagcgtcgccctccccagtggagtcgccaaccgtcgcaacctacccttcggcgggagggcgacgcgtgactcgcgggatgcgtgttccacgaaaggaatacgcgcggagtcgccaccaacgtttatttgaggaaaacttcggaaaaaccggaaaagatgcgatctacgaacttttaagtgaaaggctcaggagttgtatttacgcgcggggaaggtattag

SEQ ID NO: 66545 - DNA, 366 bp, Glycine max
  Peptide Sequence Number=SeqID_158230
atgactacctcagactcaacccagttccagatggctaagtgggtaccatgtctctgcagacaaggttgtctgatcacaaaaccaacttatctcagactcagaaaacccggagccgcctcattcgtacacttacttcatctaagtaatatgtgggtggcaactatattggctcgggggacaaagagatcgagaggggaaagaaaagaaagaaaagaaaagaagaacaagttagacataggcgaagaccttactcatatttggtctagactgtacgacggtgcagatggaatattccccattgtgcatggcgataatttggcagtggtctatgtgaagggtcttgatcagacatttcgtctatattaa

SEQ ID NO: 66546 - DNA, 1595 bp, Glycine max
  Peptide Sequence Number=SeqID_158231
atatggagctacgattgcgtctcgtgacatcaagagtattgtctcttcgacagcggatgtttcaaagctcgccgatcttgacaatgcagatacggcctctattgcgtcctcgcaacttgacgacttcgatggagatggccattttgcaaagcgagtgttaaaaccaagaacaaatgtgctaggcgacgaagtatttacgttcgggagcaataagaacctgaatcttggtgtaggggaccaggacgaccgccagtatccggaaagaataactttccgacgtccagatcacctcttgcagcggttcttttccgatttccaagagcagcagttggatgaagggagttcagatttccaacaagtgcgcggagttacagatttgccagcattgatcaagaacaaacctatcaagatccagaacattgccatgtccaagctgcacacagctattctcactaacgatccagagtcgaacctgttcttgtgcggcttcggccctggagggcgcttaggtaccggtgatgagtcaacaaggttcagctttgtctgcatcgagaccggagggttggctagcaagaaggtcatctctgttgcccttggccaggatcacactctcgcaataacagagaacggcgagatattcagctggggaagcaacaagtttggtcaattaggctatggtcttccaagaactaacaaccgagacgatgtgccgatgcagaagaccccacgacagatattcaatccgttcaagaaggaaactattcttggagctgcagcatctgctatacactcagtcgttttcagtaactttggcctttatacatttggcaagaatgaaggtcaacttggacttgtcgactccgatgcccgatctctcgagactcagacaacccctcggcgtgtcggagcgtctctttttagtgcacccatccagagtgtgtccgctattgaccaagccacgaccattcttctccagaatcatgaggtttgggtattctcacaatacggctattcgagactgtctttcccattggacatcagttcaagtttcattagaaacagcttcatgtctacccggtacgacacttctatcaatcgtattgttaaggtgacgtccggtggaaatactatatgtgcgttgtccagttctggtgaagtcttcacagtacaagtcaaccgaacagagaacccaccaagttcgacttctaccacaaacccaactaagacacggaactctttatctacaccggctcgagtgtggtctgtgaagaaggctcacatggccgtcaaagacgtcgacgttggacaagatggctcgatcatcatttgcacggcttctggatcggcctggaggaaagaaaagcgggggaaagcgaaggatagctcctcaaaggaccacaaatttgcccgcgtacctgggctatctcgagttgtgagcgtatgtagcaacgcatttggagctttcgcagctgtacaacagaactgtgacgtgaccagggagcaaatcaatgtcgaccaaagcaccctatggaaggatatgttaccactctcacctttcaactctgtagtagggtctcttgccacggatcacgacg

SEQ ID NO: 66547 - DNA, 141 bp, Glycine max
  Peptide Sequence Number=SeqID_158232
atggcgctaaagagcataacaaaggcgcaaaacagagcaaggaagccaaaaacctcagcttttaagaggatcttaggtttaggagtaatttctaggttcctagaggctaagttcgacgagacatctgagaacgaggtttaa

SEQ ID NO: 66548 - DNA, 165 bp, Glycine max
  Peptide Sequence Number=SeqID_158233
atggaccctaagagaataaaggtaattcctgagtggcctactccaccaagtgttgaggaaagaatccatgagtttcaagaacctttggatttgaggtcaaatccttttcaagggggagggaatgatgcaatcctacctgatcgaggtcgtacccgaatcaaataa

SEQ ID NO: 66549 - DNA, 111 bp, Glycine max
  Peptide Sequence Number=SeqID_158234
atggctatttataggaaaaggccatttggtgcaagggaagctcgcccagggatgaagaaatttcatggcccaagcgagccacatgcttgcctgggcgagtttaggtcctga

SEQ ID NO: 66550 - DNA, 297 bp, Glycine max
  Peptide Sequence Number=SeqID_158235
atgagggtagaacttgaaacaacaaacaaagtccaagaaacgaagaagctcagggaagaagctgccaaactccgagtagcaaggagatataatacaaaggttcaaacacgagctttcaacctggtgacatcatatggtgagtccgaggtgaagccagaaaagatcttcgagcaggaaagcttggccccaactgggaaggcccattcagggtcactacaagcctggacaacggagtatacctactacaacaattggatggcaaagcaattccaagaacatggaatgccactcacctga

SEQ ID NO: 66551 - DNA, 358 bp, Glycine max
  Peptide Sequence Number=SeqID_158236
gatgaggctgctacttcaccttcctctagtgaaagtgaagaagcaaaaggggaagaatctagtgaagaaatctacccccaagaagaaggacaaccattagtggttaagagaagtacacttgctagcattgccacacctcttgggcttgagtttattcctcaagtaaagaagttgttggatgagggtttggtttgcaagagcttaaatccttgtgctttgttggtgcccaaaatagcaccactcattgagttggtgaggaaccatgttccctcatgggaagatgtccatgaaaggggtgttgagggaaggagcccagagtatgaagaacctcaagatttgaggtcaaatcctttcccag

SEQ ID NO: 66552 - DNA, 57 bp, Glycine max
  Peptide Sequence Number=SeqID_158237
atggaggataggcgaacagtcgctaggcaatcaattcgtggggctccagactcgttg

SEQ ID NO: 66553 - DNA, 1472 bp, Glycine max
  Peptide Sequence Number=SeqID_158238
gtcgactctagaggatccccaaaaacgttgcagaagcaaccatttagcctggatcggagcttgcggggaggggcccgggaggcgtgcggcgaggacgtgggagagagaaacgtcggccgctgcgcatcccggggcgctgctcaccagcacattccattcggttatatggacgcctcccccgatgatctcccttcgtaatttcgccttgcgccgcggcgagcggctgctgttgtccaatgtcgacctgaccctgcacgccggttaccgggtgggtgtggtcggccgcaacggtgctggcaagtccagcctgttcgcggcggtgaagggcgagctggaggcggacaagggcgatgtcgatctgcccggcaaggtgcgcatcgccagcgttgcccaggaaaccccgtcgctgcccgacccggcgctgagcttcgtgctgggcggcgacatcgaagtggccgcggtgctggccgccgaggccgaggccaccgcccgtgaagactgggaagcggtggccgaagcccacacgaagatggccgagctcaatgcctacgacgccgaagcgcgcgccggcaagctgctgcatggcctcggcttcccggccgagacccaccatcgcgcggtgtcctcgttctccggcggctggcgcgttcgcctgaacctggcccgcgcgctgatgatgcccagtgacctgctgctgctggacgaaccgaccaaccacctggatctggacgcggtgtattggctggagcagtggctgctgaagtacccgggcaccctgctgctgatctcgcatgaccgcgagttcctcgacaacgtggccacccacaccctgcacctgcacggtggcggcgccaagctctacccgggcggctacaccgacttcgagcgccagcgtgccgaacagctgcgccagcagcagatcgcgcacgagaaggagcaggccgagcgcgcccacctgcagagcttcattgaccgcttcaaggcgcaggccagcaaggcggcgcaggcgcagagccgcatgaagcgcctggccaagctggccggcaccgaagcggtgcgcgccgagcgcgagttccgcatcgagttcgcgccgccggccaagctgccgttctcgctgatccgcctgaaccacgtcgaggccggctacggcaaggatgcggtgatcctgcacaacgttggtttcggcctggaagcgggccagcgcatcggcctgctcggcccgaacggtgctggtaagaccaccctggtgaagaccctggtgggcgagctggcgccgatcgtcggcgagcgcatggcgcacccggacctgaagatcggctacttcgcccagcacacggtggagtcgctgcacgaaggccagtcgccgatggagcatttccgcgagatcgcgccggacgcaccgaaccagtcgttccgcgatttccttggcaagtggaacttcccgggcgaccgcgcgttcgagccggtcgatg

SEQ ID NO: 66554 - DNA, 201 bp, Glycine max
  Peptide Sequence Number=SeqID_158239
atgcagctggcacgacaggtttcccgactggaaagcgggcagtttgatgggactgaagcttggagagtgatgctgaatgatgagactcaagccgatgatgcagctaggactagggaggagaatagggcattgtattggatagagaaatcagaaatcacatgcatgcatgaccgcttaatcagctacgcatgtaggaggtga

SEQ ID NO: 66555 - DNA, 885 bp, Glycine max
  Peptide Sequence Number=SeqID_158240
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagggtatcgggttgcaaaggagataatctcgattgtagtagttttcacattaaagatgaacttatcccaagtgatgatgagggtaccgagctcgaattcgtaatcatgaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaacccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacaactag

SEQ ID NO: 66556 - DNA, 1104 bp, Glycine max
  Peptide Sequence Number=SeqID_158241
atgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 66557 - DNA, 225 bp, Glycine max
  Peptide Sequence Number=SeqID_158242
atgaatgtcaaattacaaatatacaacaaagccttaataaacgaagacatgcaaatcattcattttggtgtccgtgatgtcgtgaggatgtgccacatggtcgatcccatcttcgtgcttggcgatcaggatttcttctgccccgatgcctccccgcttcttcttcgtcagcctccgcagaaaatgcgtgccgcaaatcaacaccgaataagtcacccgtattag

SEQ ID NO: 66558 - DNA, 492 bp, Glycine max
  Peptide Sequence Number=SeqID_158243
atgaaagtagacccgtctatccccttcaaggtcatcgcatgtgcgccgagaaagggaaggcaatttgggaacatctcttggctagtatggtgggggcatccattaattggttcccccaatggaaggaaggaagagttagggttctgtccttgtgcatggagcacggtgcaaagaaaggataaggaacttaggggaagcaacaatgggatcatcgttggatatcacaagtggttgaaggctcgaacgcaagagcttgattggctcttgaagctaaaggcctcaagtgaggaagaggctaaaaccccagaggagaatgaggaggtgcaagccttaaaggcggaacttgaaaaggcgcaagcagtcaaggaaaggttcaagatgacggccatcaaggtccggaaagaatgtgacgaactgagagacgtcaatgtggccacaaccgaggcattggaattggaaacaaagagggcccgaaaggaagaatggggttga

SEQ ID NO: 66559 - DNA, 606 bp, Glycine max
  Peptide Sequence Number=SeqID_158244
atggacatcgccattgtgaaggagttttatgccaacctctatgacctcgaagataaatcacctaagcatgtgagggtgagaggtcatttagtgaagtttgatgaggatatcttgaacacattcttgaagacccctgtagtgttggaagagggggagaacttgtgcacttattctcgatttgcactcttaaggcctgatcctcaggaattggcagctcgattatgcatccctggaaggggattcgagttaaatgctgatggactgccactaaagatcttacggaagaatctgaccacgctcgcccagtcatggagtgttctttctttctctaacatggtccctacctctcacatctctgatatcacattagatagggccaggttgatttatggaatcattcagaagatggatatgaacttgggctatattatttcagctcaaatttctatgattgcccagcatgactcttctaggcttgggtttctagccttaatcactgctctctgcaaagccaggggagtcatttctgattctttaacattggagagcctcagttcaactattaatgtggattatgtgaagaaaaactactggaaacctagatga

SEQ ID NO: 66560 - DNA, 1174 bp, Glycine max
  Peptide Sequence Number=SeqID_158245
gcttgtttggatggagttattcccagcacaaccagacttgtccttacaaatcagccctccaaacgcgaaacccacatcaagttggaggagaagcacagaagaagacatggatttggggttttggaagagagccttggactcaagaaactccattcaatcaatggccaaacaagactcttgcttcgacctctccctctccaatccaaaagcttcagataacaacaacaaccaccactccaacaccaccacctctaacctcattcatcatcaccacttccaaaacggtgccacccccactaatgccaccaccaccaccaccaaccccttccaactaccctttcagaaaaaccactacttccaccagcagcagcagccactgttccagcctcagcaccaaagcctaagccaagaccttggctttctaagacccattaggggaatcccggtgtaccaaaaccctcctcctataccattcactcaacaccatcatcatcatcatctccctctagaagcttccaccaccaccccttctattatttcaaacacaaacaatggttccacccctttccactctcaggcccttatgagatcgaggttcttgtcacgcttccctgctaagcgtagcatgagggctccgaggatgcgttggacttctaccctccacgctcgctttgttcatgccgttgaactcttgggtggccacgaaagggctacacccaaatcagttcttgagctaatggatgtcaaggatctcacgttggcacatgttaagtctcatctacagatgtaccggacggtgaaaactacagatagggcggcagcttcatcagatgtgtatgataatggatcgtctggagatacttctgatgacttaatgtttgacataaaatcctcaagaaggtctgatctatccgttaagcagggaagatcaagtgttaatcaagataaggagtatcatggtctttggggcaattcttccagggaagcttggttgcatgggaagacaaagactgattctgttggaaacgtgcctttttctcttgagaaggaaatggatccaaagtgcctaagctatgagagaatatcagatggaagttcatcctcaaatctttcaggatcaagcccgaagaagcctaatttggatttggaattcagcttgggccagccactttaa

SEQ ID NO: 66561 - DNA, 1059 bp, Glycine max
  Peptide Sequence Number=SeqID_158246
atggcgtcgtttttgtcttctctccctgccgtttccgctcgtcccatccccactagtgccttccctctcagaaaacctctctttcaaactccacccaccttgcatttcaaaaatcataggtttgccgttagctgcagttacgcagaagcaggtgtcaacgctgattctagctctaacaccatagatgttgtggctgatgttagaagtgaacggattgtagtcttgggaggaaatggctttgttggttctgccatatgcaaggcagcagtgtccaggggcatagaagtaataagcctaagcagggcgacctacttattcggatgcttgggtagaccaagagatgttttctatgtaaactgggatgaagtacttgttggagctaccgcagttgtttcaacacttggaggttttggtagtgaggaacagatgaaaagaattaatggcgaggctaatgttgtggctgtgaatgctgcaaaggaatacggtgagccatctgcccatctcattgagcatgaattttcagataaattaacctgtgttcagcctttgttcatagagaagaccggtagactctgtagtgaggagagtagaccagatggagagaagacaaacaattcgaggcagaggaagacccaaaaagactataagagaggaattcccaaattcatcctgatctctgttcatgattataacttaccatcatttttactttcatctgggtactttacgggaaagaggaaagcagaatccgaggttctctccaaataccccaattcaggtattgtcttaagacctgctttcatatatgggaagaggagagtgaatggttatgagcttcctttggatttggtaggggagccagcagaaaaaattctacgagcaatagagaacttcaccaaacctttaagttctcttcctgcatctgatttactcttagctccacctgttagtgttgacgatgttgcgctggctgttatcaatggtgtcacagatgacgacttctttggtgtttttacaattgaccagatcaaggacgctgccaataaagtacgggtatga

SEQ ID NO: 66562 - DNA, 591 bp, Glycine max
  Peptide Sequence Number=SeqID_158247
atgattcggcctaaagcccaagagagattgaaatgtacacctgaccctgagaaagtggcgaagagaatgggtgggtctagcagtagcagtagcagtagcagcaaggacgcccaagaccttttccgcgctctttggtctgcttatgcttcaaccccaacaaatctcaagatcattgacctctacgtaatctatgccgtcttcaccgctctcatccaggttgtttacatggctttggtgggatcatttccatttaactccttcctatcaggagtactttcttgtgtaggaactgctgttcttgctggctatcttgttttgcatgttttggtacattatgagtcttctaagtctactagatacatatgcgcagcgcagcatgggacttataaacctgctacgtacataggcataaatcttgttcttgtctttctgatcattgttatcctccttcattttggaccagtctgtctcaggatccaagtgaataaagataacaaggaattcaaggatcttgcacctgagcgtgcttttgcggattttgttctctgtaatttggtgcttcatttggtgatcatgaacttccttggttaa

SEQ ID NO: 66563 - DNA, 396 bp, Glycine max
  Peptide Sequence Number=SeqID_158248
atggatatttccttatgcattgtaattagtcttactaatattgtgtacggattgagcccaccccaagaactgctgaaacacatccctagaagactgagctgcaccaataatcaaatcctcaatgagatacatgcattgttcaaagagcagccctcaggtgaaagtgagattgaggaggttgttgaaaagataaaagacgagaggaagaaaagcgatgtgaaaggccaagttattttggaagagttggacagcgaaccctcctccaatgccccgaaaataatgtgttcttcggaggcatttcttctaagcatcgcctcaaggacactgaaaagaaccaaagttagggaggcccttgaacggggagcagcggaattgattggttggaagccaaaataa

SEQ ID NO: 66564 - DNA, 801 bp, Glycine max
  Peptide Sequence Number=SeqID_158249
atggaagccacaaatgtcgcatcctgggaaaaagtaaaagacaactatgaaatatggaaaactctaatgaaaaactatttggtgggcaatgatctgtgggatgctatcgagacaccttctactccgagacatgatgctcatcggatgaatgcaatggctttgcatatcattcaacgatcatgtggatcaaagaatttcgatgagatttggcaatttgataaagcccaagcagcttggaatcacttgtgcgttcgttacagtgataatgagttaaaagccaaaccagatattgagcaaggtgttgtaggcgatgatgattttgagaataaagagctgtacaagtacgtggaagatggtgattggaaaaagacagagagtttcatcagcggtaacaaggtggaagtgtcgcgtttggcgccggattcaggttcggttcttcacgttgcagcaatggcagggcatgcgaacattgttagggagttaataagcacgtcaggaggaaaagaattactaaagaagacagaccagaggggttttacagctcttgctcttgttgctcatcttactgggaacatcgatgtagcaaggtgcatggtagacaacattgacgacaacaatgtccgccaggatctgcttactacaaagaaaagcaacgttgaaatccctcttcttctggctgctgataagggacacacagaaatcactcgctttctttacgaaaaaactcccacggatgagctcagccaacctgatttagttttgctgcttgaacgatgtatcaaggccgaaatatttggttag

SEQ ID NO: 66565 - DNA, 2097 bp, Glycine max
  Peptide Sequence Number=SeqID_158250
atggccgcagaggagccattggatgcttccccctcgccgaatctgttttccgaaaccctaagtgccgccgaattggtcgccgatttggccggttattacgctcagtcaccgacaggcggcggttctactcttccggaggattccgatgaggacacggcggcagacgataccggcgtgccttcctcgttccggcagctcaaccacgatgactcgtcttcgctgtggtcgtcggcgttgggttccaattcgcgcgtctcttcggtggcgccggaatcgtggattgctgcacaaggaaattggctcttacctgaaactaaaggttcagacggtgctgaacccgcctctgaagctgtgccttctaagatgggagcagggcttctgaatcttggcaatacttgctttctcaacgctattctgcaatgctttacgcatacagtgcctctggtgcagggtcttcgttcaagcactcatcttatcccttgttctgtattgttgggggttactgatgataagatgtttagaagatatcagcaggaggatgcccatgaattcatgcagtgtgccttagataaactggaaagatgtttcctagatttgaagaagagtaatttaaattttgaagatgataatcttgtagagaaagtttttggaggtcgtttcattagcaaacttcaatgttctacttgtggccacacttccaacacttttgagccactcattgatatgagtttagagatagataatgtagattctcttccaagtgctctggaatcttttactaaggtggaaaacattgatgaaaactttagatgtgataactgcaaggaagaagtgtccatggagaagcagcttatgttggatcagacaccatcagttgcagcattgcatttaaagagatttaagaccaatgggatccttgttgaaaagattgataagcatattgatttcccattggagttagacttgcagccttacaccattaaagttatggaagacctagtggctgaaaatgatgtaccgttgaaatatgatttatatgccattgttgtgcatactggactttcatctacctcagggcattacttctgctttgttcgctctgctccagacacatggcataagttggatgattcaatggttactaaggtgtcggtagactctgtactgtctcaggaagcgtacatattattttatgcgcgacagggtactccatggttttcaagtattatggaagagaaaacacaatgtttggatccgaatattatgactacatctcctaagtctgttttagacgttggtgacaacatgtctaaatcaaatcctattttacttcccaatattgaaagaggtgtggctgatgtatccaaagaatattctgagcctcgctttgattattattgtcaagaagatcacaattttcttgaaataaatgatactgaagatgctactcatggctttggacagttgctctctggatcaaatcaggtaatttttgattcgaatggctctaaagatgttgatgtccaaaagctgtttagtaacaggggacataatgataatactcttggctgtggacaatttccctctgggtcaaatcaggaaagtgttgatttgaatagctcaaaagatgttgatgctcaaaagctgtttaggaacagaaccaccttggatgatagtgccatgcttgacatgggaaattcatatattgagaatagtagtcttgataataacaaccgtcaggaaggtggtgattttagagagaatgctggtttccattctttaactccgcctaactcgcctcctgatgatgcttcagataagttccacaactcacgtggtaatttgaagagggagaatcttcggagctgtaaaagatcatcaaacaagttaactggggtttctgaagaaagacgagaagctgtgaaatatctttgcaagaatcgttcaaggagggggttacttttgaaatttgttacttcgaacaaagttctggacaagaagagaaaaaagatggattcttcgcagtgtaagaaaagcaccaaaaaatcaaaccatacatctgtcagcccccctgtggcagctgggagttcacagtga

SEQ ID NO: 66566 - DNA, 750 bp, Glycine max
  Peptide Sequence Number=SeqID_158251
atggctactttagaatcagctctcactctcttcgcacctcaacggttctctgcaaaagcaccaatctccatcaagctccatgcttccacctcccatatcttctcttccaagtccttcttcaaaaccggaagactctgcttccagttatgctccactctgcaagaggtagcaccaacagagcaaacacttgagcctatccaaccaacagacaacgtaaagaagctctacgtagttaacttgtcttggtctctgacggcggcagacatcactgacctctttgcccaatgcggaaccgtaactgacgtcgagataataaagagcaaagatgggaggagcaagggctatgccttcgttactatggcttccggggaagaggctcaagctgctgttgataaatttgactcttatgaattatcaggacggataatacgggtagaacttgcaaagagattaaaaaaacctccttctcttccacctcctccaggtccccgtcctggagagacacgccatgtaatttatgcatccaaccttgcatggaaagcaagatctacccatctcagacaagtcttcactgaaaatttcaaaacgccatcgtcagccagggttgtctttgacagcccttctggacgatctgctgggtacggatttgtttcttttcttaccagggaggatgcagaggctgccatttctactgtggatgggaaggttcaagagaactatcctatagctttcttggatacaaaaccataa

SEQ ID NO: 66567 - DNA, 459 bp, Glycine max
  Peptide Sequence Number=SeqID_158252
atgtcgatctttttcagaatcaaagcagacaactccgaaatcctacttccgccaccaccgccaccgccaccgccacaaatcaccccatcaacgctaatattcttcaccgtggcggtggtcgtgttctgcttcgtgggtttcagcattctcttcttctgcagaagggctgatgatggagatcagagcatgcaagaacagaagattgaattttgcacgttcacactcaacgggccggggcattccatagttatgattagaggtgaaggaagagatgatggtgatgatgataaatacacgttgagattgccagagaatgtggcgttgaaaattgtaaaaggagggcacaactactccaagatttgttctagttccaaagacatggcaaggcttaatgctgcgccttgcaagaaggttatgttcaaactgtatttgacagttcctcatcccgtaatgctataa

SEQ ID NO: 66568 - DNA, 336 bp, Glycine max
  Peptide Sequence Number=SeqID_158253
atggctatggcagtgacagtgacaccctaccctttcttttggtttggctcaaaaggaaaaatccaacactctcctaggcacaccaccattgactacactgcaaccctctttcacacttgtgcgttgaccactttaaacttggacgtttcgcgtcacgtgccataccaatgctatgaaatgaacccattacccatccttgccgctgccatatatatacgtgcgtttcctagctaccgacctaccatgaatctgtgcagtggcggagccagaaaaattataaagtctggacaaaaatttaaagatagcaaattcacattgtatataatatgtaaatag

SEQ ID NO: 66569 - DNA, 1614 bp, Glycine max
  Peptide Sequence Number=SeqID_158254
atgggtaagaggaaacaaaaggacttacaacaatcctcccaaaccgacaccgtttcaacaccttccagcattttcagcaagctcttcgccatcgcgccggaacggaccaccgcaaccaccgccgcctctctattttccgatgacaacccctttcgaagaaaacctactccactttccgactcaacaaaccgcactcagaaccctaacgacggcgaccaccccgtgaacaccgattccggcgaggaaaagaagcggaagaggaacaaggaaaaaacggacaaaaccccagccccagccatcgataccgttgtttccgtaatcgaagcttcggataaatcggagaagaagaggaaacgcgattccgacgaaggaaaagaccttattgtgggtgcagaagcgagtgggaagaggaaaaggaaaaggggcgaagttgagaaagattgggaggagaagaagtatgggattgtggaggaagggcttgagaataaaaccgttgggatcaagaggaagacgttggatgatccagctgatatgatggtttcaaaggagggttttgatgatgaggataaactcttaaggactgttttcgttgggaatttgcctctcaaggtgaaaaagaagactcttttgaaggagtttaagaagtttggtgaggttgagtctgtgaggattcgttctgtcccaatacaagataccaagaaacctagaaagggagctatccttgcgaagaaaataaacgatgctgctgatagtgttcatgcatacattgttttcaaaacagagcaatcggcacaggcttctttgtcacacaacatgtccctggttgaaggaaatcacattcgtgttgatagggcatgcccaccccgcaagaaacataaaggggagagtactccactttatgatgataagagaactgtttttgtgggcaacctcccatttgatgtgaaggatgaagagctttatcaattattttgtggtatatccaacctggaatcaagtatagaagctgtcagagttgttcgagatcctcatcttaatgttggaaagggtattgcttatgtgctatttaaaaccaaggaagctgctaaatttgttgttaagaaacggaacttgaagcttcgtgaccgagagttgagactctctcatgccaaagttgatgctaccccgtctaaaaggccaaacccatcatcagctcatgctcctagtacccctgcaaaaaggccatacccattagcacatgctcctagtacccctgcaaaggagttttctgtggcttcacggtctccatcaagcagtaataacatgtcaaagtcaaacagaaaaaccaatgcatcttatcagggtctacgtgcaaccaaatctgatgtgcacaagaaaatccaaggaggagaaaaaccaaaagaacgcatgacaaaaagaccttcagtagctgccagaaaggctaaagcaaaattgggcaaggagagtgatctaccaaaacaagcagggatgaaacgcaagcttgatagtcgtactccagacagcaccctacgtaataggaaagcaatgttctcagcagacttgaaggcacatttgacagcgaatggtgaagaattaagaaaaatcagtggatag

SEQ ID NO: 66570 - DNA, 609 bp, Glycine max
  Peptide Sequence Number=SeqID_158255
atgttaaactcagaaaaggaccgtcaaaatttgtctcaattaaaggaagatcaaaagcgaagggaacgtgaaaagatcaatgaaatgctcaatatgaaagaaattcatcgtgattccaagctgtgcccttcttgtgacatggcaatttctcgaactgaaggttgtaacaaaatgaaatgtggtaactgtgaacaatacttctgttaccgctgcaacaaagcaattgatgcatcagatccatatggacatttcagggatggttcatgtgaattgttcccacgagaaatggttgattcctgggaagagcgcattaatcatcgccaggcggtaggacaactacaggctgagctctttcctcaacatggcttggcgtgtcctagttgtcgtcaatataatccaaaggacagtttctctgtcatcactaacaactttctctattgccattttgaattcttcaacagattggaaataataatcacttgttttgctgggcatgccaacgccattactgctacttatgcaaagcgattgtcaggcgtggcactaagcattatggaccaaagggctgcaaacagcactctgagggatagtataagcacaatcccttag

SEQ ID NO: 66571 - DNA, 306 bp, Glycine max
  Peptide Sequence Number=SeqID_158256
atgctgaagacgtcttcaagaatattttatggacatcaaggcacagccttctcctcaagcaccaggctaagaacccagatgcagataatggctgcaatcatgcttgtaggctcttcgctatgcgaaggtatgggggagggatgttgtacgcagccttacccttgcatatgcaaagaggccgtttccggattcgaacccatgaccaacaagtcaccaagacacaactttaccgctgcaccagggctcgccctcattactatcaattctataactccattttttttatcgctaaatattagttattag

SEQ ID NO: 66572 - DNA, 593 bp, Glycine max
  Peptide Sequence Number=SeqID_158257
ggcccgaaaggaagaatggagcaagaacaagttccgaggggctctatggggcaacaacaacaagctcaagcttagaagggccaagagggatgagttaaggatggaaagcatggtgttagaagataagttgaaggcttgtcaaagggcaaaaagaagtttgatggaacagctgagcagaacgaaagagaatatgttgacaattattgatcaatataaggagaaggtgaacctagctgctagtcatggccagacgctggaggatgaacatgcgaaggtatcggctctgcatattgaaaggcaagcaagagagagggtgatagaatcattgcacggggaagctatgaaatggatggataggttcgctctcgctctgaatgggagtcaagagcttccaagattgttagccagagccaaggcaatggccgacgtgtacttagctcctgatgaagttcatgggctttttgattactgtgaacacatggtcgacaaaagcggggctcttgctcctacgtaccctccatcgaagaggaaatcagacctacttagttctttcttaaggggcgaatcaagcgattctttttacttggaaggtg

SEQ ID NO: 66573 - DNA, 222 bp, Glycine max
  Peptide Sequence Number=SeqID_158258
atgatgacaaaggtgatgacaaaaagctcaaagagcaaattcaagactcaagaggaaaatttgaagaacacttcaagattcaagaagaaggatgaattcaagaatcaagattcaaggatcaagcttcaagaatcaagatcaagattcaagattcatgattcaagaatcaagagaagacttaatcaagataagtatgaaaaggatttttcaaaaactgagtag

SEQ ID NO: 66574 - DNA, 84 bp, Glycine max
  Peptide Sequence Number=SeqID_158259
atgtgttactttaaacgtgcgcatgatttcgttctaaaccggaggggaaatgaccctgaggaagctcgcctcaaagagatctag

SEQ ID NO: 66575 - DNA, 246 bp, Glycine max
  Peptide Sequence Number=SeqID_158260
atgtatggcattgctatggctgcccttgggatgctgagcaccattgcgacagggttggctattgatgcctatgggccaatcagtgacaatgcaggaggtattgctgagatggcaggcatgagccattgtattcgtgagagaactgatgcccttgatgctgctggcaacactactgctgccatacgcaaggtatatgtttttgttaacgttattaagatggttttaaacttcttatatagtaattaa

SEQ ID NO: 66576 - DNA, 825 bp, Glycine max
  Peptide Sequence Number=SeqID_158261
atggacttgaaggaaaattgtacttatgtcatgcacaattttaaagtgctcaaaaacaacagtcagtacagagtctgtgatcaccaatttaaattggtgtttactagagttactgttgtaaggcagtctgttctagattacctcccttttagaaaatacaggtttgctggatttgccaatgttgtggctgggcagtttgaacctggcctattggttgacattatcggtgttgtggatgaggttgtctttcgccatgttttaggaaaaggtagaagggttgtatttaaactaaaggacttgaggatcttatccgccatcggcttgcagagttggacattgagacccggtcagtttttaaatcccatggtcaaggcagttcatagctttcaggttctacccaattatcatcaaaggaatcattctttggaaaggttgaggtataggcttgaggtgatggttaaccacagagatgaaagcacaaaattcctgctttgggaccgtgaatgcactaaattgattggtcaatcagctgatgcaaataataggcttaaaattgaagatggtgatgttgatttaaatgcttcaccccaagcacttgataagctactgggttatgtgcttgcctttaagataaaggtccaacccaagttcaggaattctgccattttgaagtgttcaactgactcaagcttaattgatgttgtgatggacatgctacctgatgctgagacatcttcaaaaatcaatgtcccagtcttcggttccaatgatcctacccaacatgaatttgtgagttttaatcatgaccctcatcttttaatgtga

SEQ ID NO: 66577 - DNA, 472 bp, Glycine max
  Peptide Sequence Number=SeqID_158262
atgctggatgaatacaacgtgcgtgcaaaaactttcaggatggcaagagatagattggaagatggtcaagtggataatgttaggttgaaattgattgctaaccgtgaaaaagatggtcgtgcatataatgtacctactgttccagaagttgcaacactaattgtagctcttcaataccctctcctatttccttacggggaagatggatatagacttgatatcctacatagtagtgcaccagggtatactatggttgaatcagaaaggctttcttacatcagaaacaaccaagaaaaacttcaagttgacaagttttgcagcttacaacactcattggatgacggaagcacgaaaggcctaaataaaggcttgaagagtgtgaatttcagagagcgtagagcagagcaaggggccaagttttcatcttttagggagattagtgagtttttgagtgattgtgagattcctaaag

SEQ ID NO: 66578 - DNA, 624 bp, Glycine max
  Peptide Sequence Number=SeqID_158263
atggataagattgaagtccgcggtgctcgcacccataatttgaagaatatcaacctgatcatcccacgcgacaagctcattgtagtgaccggtctgtcgggttccggtaagtcttcgctggcgtttgatacgctgtatgccgaaggccagcgccgctatgttgaatcgctttctgcctatgcgcgccagtttctttccttaatggagaaaccggacgtagaccacattgaggggctgtcgcctgccatttccattgagcagaaatcgacgtcgcacaacccgcgctcgaccgtcggcaccatcactgaaattcatgactacctgcgtctgctgtttgcccgcgtgggtgaaccgcgctgtccggatcataacgtcacgctggcggcacaaaccgtcagccaaatggtcgatcaggtcctggcgcaggaagagggtcggcgcctgatgctgctggcgccggtggtaaaagaccgcaaaggcgagcacaccaaaacgctggaaaatctggcggcgcagggctacatccgcgcacgtattgatggcgaagtgtgcgatctgtcggatccacccaagctggagctgcagaagaaacacaccattgaggtggtgatcgatcgtttccgc

SEQ ID NO: 66579 - DNA, 396 bp, Glycine max
  Peptide Sequence Number=SeqID_158264
atgtgggcatgggaacgatgcacgactttggctccaaagaggactcctcccgtgatccaaaataagccactcggacacaggtggttgggacgtggaaatcagcatattgggaatgatgatctgattgtatttcgtcgcaagttggatatcatgaaacgacatgagtttctgtgggagccttacacaacaagcattatgtcgtcgttgcctccgatatgtttggttggtagcgtagcgtggtgcgcggtggtaccactaatttgtttccatgttgttgagtggcaccaacccgatagagtgttgcgacaatttgggatgcaacaacctattcccgagtgtatacaacatctatatattggtagtagttcatgctcacgtaaccacaagctgcaataa

SEQ ID NO: 66580 - DNA, 768 bp, Glycine max
  Peptide Sequence Number=SeqID_158265
atggcacgttctccagacaagataaagaacatcgacgactcaaaagaaactcttaacttgctcccattgtgttgtaactttaacgaaatccagggtgatgagatccatgatgtttgtaaacaagaccaactgaagtcttggaagatggacttgaaggaaaattgtacttatgtcatgcacaattttaaagtgctaaaaaacaacggtcagtatagagtctgtgatcaccaatttaaattggtgtttattggagttgctgttgtaaggcagtgtgttctaaatgacctcccttttagaaaatacaaatttgctggatttgccgatgttgtggctgggcagtttgaacctggcctattggttgacgttatcgatgttgtggatgaggttgtctttcgccatgtttcaagaaaaggtagaagggtagtctttaaactaaaggacttgaggcttgcagggttgggcattgaggcccggccagtttttaaatcccatggtcaaggcagttcccagctttcaggttctatccaattatcatcaaaggaatcattctttggaaaggctgaggcaaagactattgctgagattaacaccatctctgaagaaattgtttgtgtaactgttggcacaattactaggattgttatggacaatcattcatggtgttatatagcttgcattcagtgccataaaaaaattgatgcgaagatggcgcccttcacatgtgcatgtggcaaatacaatcaggaagttgtgcttaggtcattgtga

SEQ ID NO: 66581 - DNA, 1863 bp, Glycine max
  Peptide Sequence Number=SeqID_158266
atggctcaaccatgcttacccggcaactcagttcaggagaacgttatgattacccgtcatcgtatagccggtttactgttgtccaccttgctgctgtccagcggcctggccgccgccgctcaaacgccgggcaaggttatcgcgccgctgcgcggcaccatcagccaggtggccgacggcaatctgcagctgaccgatcgcaagggtgagacgctcagcgtcaagctgaacgatcagaccaaagtgctcagcgtgtccaaggccacgctggacgacatcaaaccggacagctttatcggcaccgccgccgtgccgcagccggacggcacgctcaaagcgctggaggtgcacgtgttcgccgccagcctgcgcggcaccggcgaagggcactcggcctgggaatccgccgacggcaaagtggacaccatgaccaacggcaccgtcggcaaactggtgaaatccaacggccgcaccctgaccgtcacctacggcaaccagcagaaaaccgtcgtcgtgccggaagacgtgccgatcgtgacgctggatccgggcgatttgagcctgctgaagccgggcgtgcacatcgtgctgttctccgccgtcaacgataagggcgagcgcgtcgccacccgcatatccgccggcaaagacggcaccgtaccgccgatccatgaaaaccaacgcgtcgcggccggtgcatcgctggccggttcgaatcactcattggatcaacctgttcgccatgatgacgctgggcggttggctgggcggcgcgattggttggcatttggcggtgatgtggctaatggcgctcaacgccgcctgctatctgctgtggagcctgttcagcggccattttcgccgcgatctgttgccgcttcgcgtcggcgcgctgcggcaggatatctggctggcgctgacgctgcgcctgcgccaccggcatggccactacaacgccattcaaaagctgatgtatctcggcgtgctggcgctgggcctattgctggtgctgtccggcctggcgatttggaagccggttcagctgcagggattggtcgccctgtttggcggcttcgatttcgcgcgctacgtgcatttcttcgccatggtcggcattggcctgttcgtggcgatccacgtctttatggtgatcgtcgtgcccaaaacgctcgccgcctgatgctgcgctccggcctgacgctgggcggcatcgccatgctcaccggttgcaacctgcaagacggcgatcgggtggataaggtgctgtgggccatgtcgcgctggaacgaccgggtgcaggcctggctgttcagcggccagcggctggcgcaaacttaccggcccgatcagattacccagcctttccccttcaacgcgttttacccggaatacaacgtccccgagatcgatctggccggctaccggcttgaagtcgctgggaaagtggagaaaaaagcgccctggacgctggaacagctgcagcggctgccgcagcaaagccagatcacgcgtctgatctgcattgagggctggagcgccatcggccaatggggcggcgtgccgctgcgcacctttctgcagcacgtcggggcggatctgaatgccggttacgtcggcttcaaatgcgccgatcgctactactccagcctcgacatggccaccgcgctgcacccgcagaccattctggcgctggatttcggcggcaaggcgctgccggcggactatggctacccgctgcggctgcgggtgcccaccaagctggggttcaaaaacgccaaacatatcgccgccatctttgtcagcgacgtcaatccgggcggctattgggaagatcagggctacaactggttcagcggcatttag

SEQ ID NO: 66582 - DNA, 288 bp, Glycine max
  Peptide Sequence Number=SeqID_158267
atgaagtattatcgttctaagattgatgaatgggttgtcatcaacaaaaagggggacattgtggaagcaatgccttccaaggttattttgatgatgccaaagaatcaagagttaagcaaagtttcaagcaaagattcaagaatcaagtttcaagtttcaagattcaagattcaagaatcaagtttcaagaatcaagtttcaagaatcaagaataaccaagatcaagatttgagactcaagactcaagattcaagaatcaagagaagactcaatcaagataagtattaa

SEQ ID NO: 66583 - DNA, 519 bp, Glycine max
  Peptide Sequence Number=SeqID_158268
atgtcctgcccaatgatcataacttcgaccttcctctgccgaagtgtcagctggtgtatgccacccactaggcaccctctagacccggataagtctaacagggccctgggggttcccgtcacacctagtaaggtgatccggccgccgatcacccgagccttcattgagaagtattgcacgcctaggcagacgcagggtgatgcgccacaggccgcacatgcaccgccaccacctcatcaggctgatcctgctgggtcattaggcgtggagcggtatctacagcacttgatacacgagtgtctctaccagctcagcctcagtcaacagggccagggttctgctccttttacgtgccctactccagatcagtttagggctgaggtcgcatggcccgaagattggcccaaggcccaggaggaggaggcgcctgcaggagctcctagtgatgcagaggaggctcgcatggatgaggagatgatagacttgctcgacttcttgggaggaagcggaggcacgtga

SEQ ID NO: 66584 - DNA, 219 bp, Glycine max
  Peptide Sequence Number=SeqID_158269
atgcacgagacatcggggtttagcagtccaggagacaacatagaacacatgaatgttgttagggaatcagctatatacttaccagaagcctctttcatagctgatgagcaccagcaaagggttacccttgaagattactctagtagctcagtgccgcaattctttacaagtattgcgcgttgtttggcttccggcaagtgcaccggattgcacaagtag

SEQ ID NO: 66585 - DNA, 633 bp, Glycine max
  Peptide Sequence Number=SeqID_158270
atggcgtctaggaaatgcaagagtagtgattctaggccacaggctcagtatgatactaggagattccaatcattggaagcctggaaccgatataccgataacattttggaccggaggatccttccggagaagaatgttgagatttatcatactgagttcaacgagtttaaagcagagttggagaggcgtaactttcacaaacacctcattcaagaagggagcatagatgtggcggtggttaaagaattttatgccaatttgtatagtccagaagaccaatctcccaaatgtgccagaggggaatctttacccacttattctagattgtgcaaattaaggactgatcccagagagatggaggctagcctatgcatttcgggcaagggttttattctgaatgctgaggaacaaccatggaagctcctcagaaaagatcttactaccctggcccaaacatggagtgtcttctcttattctaacctagctcctacctcccatacctcatatttgaacacagacagagctaggttggtctatggcttaatcacaaagatggacatgaacattggtggtttgatctctggacagataaccatgatagctcaatccaactcttctcgcctaggcttctga

SEQ ID NO: 66586 - DNA, 567 bp, Glycine max
  Peptide Sequence Number=SeqID_158271
atgtatatggaatgtaccgtgcttagtccacattatacagctccagaggcttgggggcaacttctgaagaaatcattaaatttgttctgggaagatgcaataggtatatcagcagagtctgatgcctggagttttgcttgtacactggtagagatgggcacgggttttgttccttgggctggtttaagttcggaggaaatttatcaagcagttgtcaaggcaaagaaactgcttccacactatgccagtgtggttggtggtggaatacctagtgatttgtggaggatgattggagagtgcttgcagttcaagccatctaaaagtgatagagttgtcccctgtgaaagaattagaagtttctcagaaaaacccattccatcttcatcaattgatcttcttttcaaggctgcatcagactatggcagcaacagcctatcttctctgctggaagctcaaaatgctgatgaacaaactgctctccacttagcttgtagatgtggcagtgcagaacttgttgaggcaattttggagtatgaagaggcaaatgttgacgtctggacaagatga

SEQ ID NO: 66587 - DNA, 237 bp, Glycine max
  Peptide Sequence Number=SeqID_158272
atgaatactgtccatcttgccgcgccgatgccggcgaaaccctggtaccgcgagttctggccgtggttcctgatggccgggccgttcctggcggtgatcggctgtgccatcacgatctacctggcctatacgcagttcggcaaccagccgatccaggaaggcgtggtcaagcgcggactggtgatcgagcaggtggagccgctgccgacgccgccggccgcggtcggcgttcgttga

SEQ ID NO: 66588 - DNA, 364 bp, Glycine max
  Peptide Sequence Number=SeqID_158273
atgcatggaaaatcctctgcaagtgatttggttccattagacttggaaattgaagccaactatagacggaacaacacagagcggagaagaaaatttctgcaggacaggacaacgttaccaattcttaaagaatctcaatcttctgagtcgtcttctagttttccagatacaagggaatccaaaaatgcagtgcttgaggccgacataatggctgaagagcaatcaagaagagtaacccttgaagactactcagcttctactgtgccgcaatttttcactagcattgtgcaaccagaggttcaagcccagaatattacctatcctcattcactaatccagttggtacagggcaacctattccatg

SEQ ID NO: 66589 - DNA, 624 bp, Glycine max
  Peptide Sequence Number=SeqID_158274
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtgtgagtaggaaacagaaaatatctattctagttttatcatcagctatgggttcgaatttaagcgaaattctagagaatgtttgttatcctgaaattttcgtttcttcctaa

SEQ ID NO: 66590 - DNA, 87 bp, Glycine max
  Peptide Sequence Number=SeqID_158275
atggcacataagaccccagttattgtagaagagagggagaatttatgtgcttattcgagatttgcactcctgagacctgatccttaa

SEQ ID NO: 66591 - DNA, 861 bp, Glycine max
  Peptide Sequence Number=SeqID_158276
atgctctcctatgccggcgatgccaaactttacgttccggtgtcatcgttgcatctgatcagccgttacgccggcggcgccgatgaaaatgcgccgctgcacaaactgggcagcgatgcctggtcacgcgcgcggcagaaagcggcggagaaagtgcgtgacgtggccgctgaactgctggacatctacgcccagcgcgcggccaaggccggctttgcctttaagcacgaccgcgagcagtatcagctgttctgcgaaggttttccgtttgaaaccacgccggatcaggcgcaggcaattaacgccgtgctcagcgatatgtgccagccgctggccatggatcgcctggtgtgcggcgacgttggctttggtaaaaccgaagtggcgatgcgcgctgccttccttgcggtggagaacggcaaacaggtggcggtgctggtgccaaccaccctgctggcgcagcagcattacgacaacttccgcgaccgcttcgccaactggccggtgcgcattgagatgctgtcgcgcttccgcagcgccaaagagcaggcgcaggtgctggagcaggccagcgagggcaaaattgatattctgatcggcacccacaagctgctgatgagcgatttgaagtggcgcgatctcggtttgctgatcgtcgatgaagagcatcgtttcggcgtgcgtcacaaagagcgcatcaaagcgatgcgcgctgacgtcgatattctgacgctcaccgcaacgccgattccgcgtactctgaacatggcgatgagcggcatgcgcgatctgtcgattatcgccacgccaccggcgcgccgtctggcggtgaaaaccttcgtgcgcgagtatgacagcctg

SEQ ID NO: 66592 - DNA, 1239 bp, Glycine max
  Peptide Sequence Number=SeqID_158277
atgctcaccggttgtgtggtgaaacaacaaaccccggcgccggttgaaccgacgcagccgaccacgccaacccagccagaacaaccgcccgcgcagccggtgccgccgccgcaaactgtgccgcagccgccgaaactgaaaaccatcaactggaacgccagcgtccagccattagtcgccaatatggtgcagtcggcgggcgtcaatccgggcagcgtgctgctggtggatcgcatcaaaaacagcaccaacggctcgctgcaaacggaaaaagccacggcagcgattgagaacgcgctggcgaataacggcaagttcagcctggtctcaaacgatcagctcaatcaggcgaagcaaacgctcggcctgtcgccagaggatagcctcaactcgcgcagcaaagcgattggcctggcgcgcatcgtcaacgcgcagtgcaaaccggcgaaatcatctggtcgggcaacggcgttgcacaaccctgatccccggctgcagcatctggttcagcaacaatggccgacggcgcaagctgccggtcattttttcgcgctgccaggactgagcggtaacagcgtgcagcccatcccgtttgtcgatcgtcagcgcgaataccgcatcctgcgtcagttgcgtactacggcgctggcgccgcagccgctgacgtggcaggcgccgtggctgctgcagcgctggctgccgggcgaggtgctgtcgccggatcagttcagcgcgcagcgcgcagcggtgctgacactgctgctgcgcctgcatcaccagccgctgaccggttatcgcttacggctggcgccgttgctgcagcgctactggcagctgtgtcagcagcggcactggcgctggcagcggcgcttaaaccagttgctgcagcgcggtgaaccgtcgccgctgcggctggcaccgctgcacatggacgtccatcccggcaatctgattgccacgccggatggcctgcgtttaattgactgggaatatgctgcggatggcgacgtggcgctggagctggccgctgtcggcgcggtggatggtgtacaacacgatcactggataaccgactatgccgccgaggcgcggctgtcggcaacggcgctgcggcgtcaaagccggcgctggcagccttggctgcagctgctgatggccagctggtatcagctgcgcgccgagcagagccatgaccaaacattgcaacggctggcgcaagccagctggcaggatctttaa

SEQ ID NO: 66593 - DNA, 1080 bp, Glycine max
  Peptide Sequence Number=SeqID_158278
atgaaaaaaatagttgccggcgccgtagtcatcgctggcctggctgccgcattgagctactggcagattaaacgctttgccgcgacgccattaaccattcaccaggaaaccctgtataccctgccggccggcagcggtcgcgtggtgctggaagcgcagctggagagccagcacatcattccgcaaagcatctggtttggcccgttgctgaagctggagcccgatctggctaacttcaaagccgggacgtatcgccttgagaccggcatgacggtgcgccagctactgcaattgctggccagcggcaaagaggcgcaatttccgctgcgctttgtcgagggttcgcggctgaaagagtggctggctgagctgcgtaaagcgccataccttaaacacacgctgccggatgatgaatttgccagcgttgcggctgcgcttaagcttgatgtcagccagctggaaggcggtttctatccggatacctatctgtatactgccaacaccagcgatgtggcactgctggagcgggcgcacgcgcgcatgaacaagctggtggatgaggtctggcaggggcggatggccagtctgccgtataaaacaccgcagcagatggtcaccatggcgtcgattatcgaaaaagagaccggcgtcagtgaagagcgcgcgcgcgttgcctcggtattcatcaatcgcctgcgcaccggtatgaaactgcagaccgatcccacggtgatctacggaatgggcgacagttataccgggacgctgacgcgcaaggatcttgagacgccgaccgcgtacaatacctataccatcagcggcctgccgccgggaccgattgccatgccggggcgcgcctcgctggaagcggcggcccatccggagaagaccaattacctctatttcgtcgcggatggcaaaggcggtcacacctttaccaccaatctggccagtcataataaagccgtgcaggtttaccggctggcgatgaaggaaaaaaatgaaaaggcattgaagacgtggtctttacccgtgagccgggcggcacgcctttggccgaacagctgcgcgtgctggtga

SEQ ID NO: 66594 - DNA, 645 bp, Glycine max
  Peptide Sequence Number=SeqID_158279
atgccaccgaaagcccgacgtactccgtatgcgattaccacccatggcgatacgcgtatagataactattactggctacgggacgattcacgttcccgcccagaggtactcgactacctgcatgaagaaaacgattacggtcgcaaggtcatgtccagccagcaggcgcttcaggaccaactgctgaacgaaatggtgcagcgcattcctcagcgcgatatctccgcgccctggaccaaaaacggctatcgttatcggcatatctacgagcccggcagtgaatatcccatctatcagcgacagtcggtattaagcgccgagtgggatgaatgggatattctgctggatgccaaccagcgtgccgcccacagcgagttttatacgctgggcggtatgtccatctccccggataacaccattatggcgctggcggaggattatctctcccgtcgtcagtatggcctgcgattccgcaatctggaaaccggtaactggtatccggaaatgctggaaaacgtctccccggattttgtctgggcgaacgattccgagacggtctactacgttaaaaagcacgccgccacgctgctgccttatcaggtgtggcgccacagtgtaggcacggactccgccgatgacgaactg

SEQ ID NO: 66595 - DNA, 585 bp, Glycine max
  Peptide Sequence Number=SeqID_158280
atggcgagccaagagaagtgggggccgtttgcggatatattagatttgttgatttttggagttgtcctatttccgaacgtggacggtttggtggacttagctgccattgatgctttcctcgcatatcaccacagcaaggagagtccagtggtggctatcttggcagatttgtttgacacctttgaccggaggtgtgagaaaaacagtgcacggattgtctgttgtttacccgctcttagtgtatggttggtttcacacctattccaacaagacacaagatacccgtgtccgcttcaaagttatcgctcatgtgccgaaaaaggaagagtcgattgggaccaacatttggctgggataggaggcaacgcaatcaattggtttcctcgttggaaggaaggcaaggaaggagttcttttctcgtgtggggactaccctaatgttccattgatagggactaggggttgtattaattataatcccgcactcgccataagacagctagggtaccccatgaggggagcgccaacagaagaaagtctctcgcctttccttgtgagggatctaaacgcgcaaagtctcaagtga

SEQ ID NO: 66596 - DNA, 561 bp, Glycine max
  Peptide Sequence Number=SeqID_158281
atgaccggaaggcttcttgccggttcattggcttttgaaagccgcatcctccattaccttattgttcgcatcttgtttcctagaacttcaaaccttgcccaggtttctgaagaagatctcattgtcatgtgggccttcataaaggcattgcgattgaatgcccctttgccttatcatcatcttgttacccttttccttcaacacttcaacatccctcttgattctgaaccttatgttccaatcaagagatcattccttataggcgcttcagtcatagcatcctttggttatataaaggagtatgatggctcttgggtgaagaaggatgctagaaatgttggtgaagaaggacatgagggagaagattcatctcttctttcgaagattatggacaggtttgatggtcttcaaacctttgtttgtgagaggtttgacactttggaattgcaagtggatatgcgcttcaatgaaatggagtcaagaatcacaaaggttgaagaagatgtgtcttacattcattcaagctttgatcttccaccaccgtcgccaccatcatcttag

SEQ ID NO: 66597 - DNA, 660 bp, Glycine max
  Peptide Sequence Number=SeqID_158282
atggaggccggaaacacatacgtttcacatgagatgcggagagtgtactatcactctacaagacgtctctgtgttgttaggtggctgcgacgtggaaaccaacatatcggcaatgatgatgtgaaagtttttcgtcgcaagttcgatattatgaaacgtcatgacggtgaagttgcggaggcattacaatacatggtgtctcctcaagggaggaaaacatgcacatttgatgatctcgtgccttatgtggaaaaaattacaattttatccgaagagcaagagagagtcactgagccagtgtcacatggtcccgcatcagagcgtcaatttcccacacaacagtttcacatgcttcagtcaagtattgaaactcaggggatagacagaagaagggacactgttgaagcggaagaatattctcaacaaatggcggagcgtggccatggaatatattacacgccacaaacatttgctgagtatccgacacagatgtatcagtatccttttcagggtcatgacactgatacttctgcaacccaacaatcgttcggtggttttgcggaaacacaagctcatttttcatggcccacaatgaccccttcacagcaatatcatgggccaattccaacacctaatgccccgttaggaacacaatggaat

SEQ ID NO: 66598 - DNA, 492 bp, Glycine max
  Peptide Sequence Number=SeqID_158283
atggctgaagtagacgaggtgcaagagcggatgaaggtcggcatggaggccatgaaagaacagatggccacaatgatggaggccatgatgagcatgaagaagataatggaggtcaatacggctacagttgccattgtcggtgttgtttttagggtggacctgactcccccatctggcctcaacctaataaatcgtccaacctcagatacgggcggccctcattttgtgcaagtcctaaacaagcatgttttcccgccatatggtttgcttccgaactatactccacccaataagaatgtcaataacttcactcctatactcattgagagccaacaacctcaaactgatcatgcacatgtctctcaacccatgggggagacacatgaaatatcccatcgcaatctagccgactttgagcctcgcctcggatatgccactgaagggcaagtagttggcgatatacccctgcaaaacactttggagggcccttag

SEQ ID NO: 66599 - DNA, 438 bp, Glycine max
  Peptide Sequence Number=SeqID_158284
atgggtctcaaagctgcagcactcgactccaattcgaatggtcgccgcttgacgagcggaatttgcaagggacgaaggggccggtggggggagcaaacaaagctcagagttgcatcgaagcgttcaagcaggcaaacattgaatacttcttgggaatttctgtttccacatttaatgcacaaaccggcccgtactggcgcggcaagtgtttgccaaactgcgtggcaccggtgcggcatgcgggctttgaagtctcacatattttggcagctctttaatttgagtaaaagttttttgccattttggcaagaatgcacgatttcaggtcatcggtactcgtggttaaggtctcaagtgataagagagcgacaaattttcaaattttcgatctacatgttcaaaaggcgcgccgcgtcgcgtcgcgccgcccagatataa

SEQ ID NO: 66600 - DNA, 294 bp, Glycine max
  Peptide Sequence Number=SeqID_158285
atggagcggtatttacagcacttggttcgccagcaggcggccaaccacaaggatcaggtgcagatacatgagtgtctttaccagctcagcatcagtcaacagagccagggttttgctccctttgcgtgccctactccagatcagttcagggctgaggttgcatggcccagagattggcctgaggcccaggcagggaaggcgcccgcagaggctcccggagatgcagaggaggcccgcatggatgaggagatgatagatttactcggttttttgggagggagtggagccacatga

SEQ ID NO: 66601 - DNA, 573 bp, Glycine max
  Peptide Sequence Number=SeqID_158286
atggagaaaacacattctcaagaatttataccatggaggtttagaaaaagttgttttactcacctcttgaagaagaacaaacctttttctggtatcgtggggatgtttggttgcccagttgcattggatgaggatactaaaagcctctcaaggttggactttgctaaagtcctcgtgaaacactcttcacataactcaatcgtgaagaacgagactataagggtggacagggtggtccataacgtgaggagtatagaggaaatgcatatgaaaatgaataactcatccttctttgataaacacgatagcttggaggtagaggaggaagcactatggaaggggggcaacgtcaaagacgacaagtttagggcgggacagaggagaaagggttgcaatagagatgtatttgtactagcaccatcagacaaagatgtcaaagggagtgtcgcaacctacccttcggcaggagagcgacgcggggctcacgggtgcgtcttccaagaaaggaaaatgcgcggagtcgccaccaacgcttatttgaggaaaacgtcggaaaaaccggaaaaggtgtga

SEQ ID NO: 66602 - DNA, 429 bp, Glycine max
  Peptide Sequence Number=SeqID_158287
atggatgagcgttcacgtggcccaggaatggcgcctactaggcaccctttggacccagagaagtccaacagggccctggggtttccggctctaatcacgggcctctgccagtcctacggagttcctgtcacccccagcaaggcgcagggtgacgcacatcaggatgcaggcgcaccgtcgccacctcggcaggccgatttggttgggccactacgtgtggagcgcctcagtcagcagaggcagggttctgccccttttatatgtcctaccctggggcagtttggggctgaggtcgcatggcctggagactggcccgatgcccaggcaagggaggagcctgcaagatcccccggtgaggcagatgaatcccgtatggatgaggatatgactgacctgctcggttttttgggagggagcggagccacatga

SEQ ID NO: 66603 - DNA, 204 bp, Glycine max
  Peptide Sequence Number=SeqID_158288
atggtgcaatggaagcatggcgaaggccatggagtgaagttaaggtggaacaaaaggggaacacaacaccaaggctctagattaagagatatgagggaaggttatcgaggtgaagcatgtattgagaatgaagggagaatgaatgagcaagggaagagggacatgagggtagtgtatgataaggggaaaaggatgatcccatag

SEQ ID NO: 66604 - DNA, 189 bp, Glycine max
  Peptide Sequence Number=SeqID_158289
atgctccaaccatatgggatcaacataggcttaaaggagcactcaaatcgggtgacccccaaggcctacactccgaagagtccgtcagggtctctccctcctgattcagttttaactcgtcgtcctttaagggtcttagcattaactcgtcgtcctttaagggtcttagcattaactcgttgtccttaa

SEQ ID NO: 66605 - DNA, 387 bp, Glycine max
  Peptide Sequence Number=SeqID_158290
atgcatcttgtacctaatccattagaggtacatgcagggcacagtaagaatgcaacgggaaagagatgggtcgttcttgttgctggtttaagtggttatgataattataggcaccaagcagatgtttgccatgcctaccaaatactaaagaatggtggccttaaagatgaaaacatcattgttttcatgtatgatgacattgcccaccataatctaaacccaaggcttggcactaaaatcaataaaccaaacgatccacatgtttataaaggagttcccaagttccttccaaacaacatcttcgggattggtatgtcgccattggataagtacatcagtgatagctcggtttcccttcttcttcattctcctatccaagaccgctag

SEQ ID NO: 66606 - DNA, 93 bp, Glycine max
  Peptide Sequence Number=SeqID_158291
atgaagatgaatggcagaagaatggagaaggaagagagaaaggagatgtcacttcaaggagaagatgagtctagaagaaactcaccaccatag

SEQ ID NO: 66607 - DNA, 2424 bp, Glycine max
  Peptide Sequence Number=SeqID_158292
atgattagcacttggcccttcaaagtcaaccacttggtggttccttgctttgaaataggcccttctggtgttactgatctgaataggagaaggagggtgaaacagggtattattttttctgtttctcatagttcaaaagttagtgtttctcaatgttcaagagggtatgggactgtggtcttttctggacatgcaaagttggatttgagatgtgggattttgttgggattctctaaacccaaatttggtatcattttcaagccacacaagagtcatgttggagacttagctccacccttggggtgggcactggatgaggaaggcgttgggagtgaattggttgaggagaatattgattctgatgattcatcggttaacagtgagtcgaagtgtgtaaactctttgaatttggatcatgttaaggacagtgaccatgaaggaaaaatgcgtggtgatgacaatagcaaggaaagtggtgggagtgaattggttgaggagcagactgattctaatgatgcatcggttaacagtgacttggagggtgtaatgtctttgaaattggatcaagttcaggagagtgactgtgaagtaaaaatgcatggtgatgacaatagcaaggaaggtgctgacgaagagtgtgatggtaaggttgatgtgagagcacttgccctgagattgcagaccgtgaagacagtggaggacgtggaggagattcttaaggacaagggggacttgcccctgcaggtgttttcgacgataatcagtggttttagtaaagagaagaaaatggattctgcattgattcttttcaactggatgaagaagaggaagatagaaaccaatggctcttatggccccaaccttttcacatataatggtctattaggtgtagtcaaacaatctggtcaatttgcagaaatggaagctattcttaatgaaatggctgaagatggaattgcctataatgttgtgacatataacaccttgatggcaatttacattgagaaaggagagtgtgacaaagctctcaatatgcttgaggagatccgtaggaatggccttactccatcccctgtatcctattcacaagccttgttggcatatcggaggatggaagatggcaatggagctctaaatttctttgttgagtttagggaaaaataccatcaaggtgaaataggaaaagatgatgatggagaagattgggagaaagaattcatgaagatagagaagttcacgatccgtgtttgttatcaagtaatgcgctgttggcttgttagtcgtgataacttgagcaacaacgtgttgaagtttctttttgatatggataatgctaggattccactaccgcaggttgatcttgagcggcttgcatgggcttgtacccgtgaagatcactacattgttgtgaaagagctgtacacccggataagaggaaggtatgataagatcagcttgtctgtctgcaaccatgcaatttggttgatgggaaaagcaaagaaatggtgggcagctttggagatatatgaagatttattggacaaagggccaaaaccaaataacttatcatatgaactgatagtctctcacttcaattttcttctcagtgcagccaagaggaagggaatttggagatggggtgttaagttgttgaacaagatggaggataaaggcctgaaacctggaagtagggaatggaatgcagttcttctggcctgttctaaggcttcagaaactactgcagcggtgcaaatattcaagagaatggtggaaaatggtgaaaagcccactataatatcatatggggctttattgagtgctcttgaaaagggaaaactctatgatgatgctctccgtgtgtggaaccatatggtcaaggttggggttgaaccaaatgcatatgcctacacaattatggcttcgatttatactgcccaaggaaattttaatagggttgatgccatcattcaggagatggtaacattaggaattgaggtaacagtggtgacatacaatgcaataatcactggctgtgcacgtaatggtatgagcagtgcagcgtacgaatggtttcaccgaatgaaagttcagaacatctctcccaatgagataacttatgaaatgctgattgaggcccttgcaaatgatggaaagccaaggctggcatatcaattatacacgagagctaaaaacgaaggccttaccctctcttcaaaagcttacgatgcagttgtccaatcctcacaggctaatggtgcaaccattgaattaggtcttttaggacctcgccctgctgataaaaagaagaaagtgcaaattagaaaaacattgaatgaattctacaacttagctggtgttcccaaaagaagtcaaccgtttgatagaagtgaaatttatcactcacagacacaagaaaatccataa

SEQ ID NO: 66608 - DNA, 747 bp, Glycine max
  Peptide Sequence Number=SeqID_158293
atgaaggtgagtgttcaccatgagcatactgccatgttggctgagcgcgggtgttggtgggtgggttattttgggttaacaaagcttcttcgtgcaagtgaaaccatggctggtgatgtcaagggtggttttgagtatggcctcgttggagatggcagtgacaaagtcaacgtcaatgctagcataacagtcaaagttggaccacgcttactgcagttcttgaggcccaagggtagattgaggttcaacatcatcggtaaagtcgcatgggctcgtatggtagataaagaagtgtcgacggttggagaacaacgaagggaagcgggttggaaattgccatcgtcgaagtacagaaagtatgggagggttgaaattcctgagtacgaccctgagattgaaagagctcgtcacaagaacaacaatgacacaaggaagagaaggatggttgaagcaaatgctggaaacagggggagaaacctcatgcataagatgactaatgcaacagtggacattggtaaagccatggcttccaatgcctataatggtactagcgataagaggatcctaaagaggcctatgggagttcatcaagtggtggtcaattcatccatcttagctcttgacaaaaagctggatgagacaggacatatgattggagcttgccctttttctcagcctttggaagatgtgaactatgctggaagaaggagcaatagttatgatccttactccaacacatacaattag

SEQ ID NO: 66609 - DNA, 279 bp, Glycine max
  Peptide Sequence Number=SeqID_158294
atgctagtggctcaccaccaagattctagtaatatccgtggtgttgcattgattttcttgggtgaaattgagggtgataggaaattggttttggaatatgtgagcatgtggataagtgacagtcgtgatgagtacactaaggagagattggatgccattaatgatgaattcaagctctatcgctgccacaccatattgaactgtgctcgagcctgcccaaaggggttaaacccaggaaagcaaatctcacatatcaagtcacttcagcctaaagcataa

SEQ ID NO: 66610 - DNA, 147 bp, Glycine max
  Peptide Sequence Number=SeqID_158295
atgtcacttaatgcttgtgcattccagctcttcacaactatcactgtcaatgaacctgctcctggtttgaaggctatttttagcttcaaagttcctgaccaaaggtctggaaagaatcactttcttcctcaagctaagaaagaatga

SEQ ID NO: 66611 - DNA, 348 bp, Glycine max
  Peptide Sequence Number=SeqID_158296
atgagatgtagagagaaaggaagtagggagaagagagaaagagaaatagggatgttgctaggtacacccagcattattgctgtgcttctgttgtcatcattgaggacgtctccaccgatctgtgtcgcttccgtcgttgagcggcgaaggcccacagcatctgcacgtaggcaatgggaagttgtcgctattgctgaggatgctcctcacgtggatgacacagttgaagaggtattccaacatgctgaagaagttgttgatgatgccgagggttttccaggcaggttgtgtgacccatcagtgttgactgcctatcttgatcatgttgcagtcattgtttggaattga

SEQ ID NO: 66612 - DNA, 135 bp, Glycine max
  Peptide Sequence Number=SeqID_158297
atgatggacgaagatcaatggatgtatgacaatataatgtttgaaaaagttgatatgaatgatgaaaatgaagacgaagctgacatgaatgaagaagaatatgctgattgttctgatgtgttcaatacttcttag

SEQ ID NO: 66613 - DNA, 615 bp, Glycine max
  Peptide Sequence Number=SeqID_158298
atggaaagaactatgattcctacttccaaggctttcgacatcaaactttggcttcacggtcaaagttacaaagaccatctcaccctcacattgacttctattcctaaggcaaactattctttacggataaagattgatacctggttgtgtagcatcctcaaattcactattaatccttcccaaaggccaatttttcgtgctcatgaaacttgcaaggctgatgtttgctttggtgtgttgcaaggagttggtttgtggaagtcgtgcaagctgcaaggattaggtttttgctcacaaggtaggaggaaagcttcaagactccgcgccattgttttagatctcactgccattgtcactgtttgggttcgagcaaagcttcatgatgaatcaagagtgattcaaagatgttttgatgataacaaagatgataacaaaagtgatgacaaaaagctcaaaggtcaatcaaagaatgagttcaagatgttcaagaacacttcaagattcaagaggaaagttgaattcaagaatcaagaatcaagattcaagagatcaaggttcaagactcaagattcaagaatcaagaaaaggctattcaagaatcaagaaaaagcttaa

SEQ ID NO: 66614 - DNA, 495 bp, Glycine max
  Peptide Sequence Number=SeqID_158299
atgcgagcacaaccagaggaggaggctatcgcgcagctactatgcatatcagggcaagatttcagccatgccactgcaaagagacgagtgcagatcatgcgcactaacatgaccactcttacacaaatatggatgacgttgctacttagcaacattctgcccagcaaccacaatgctgatctccccatacggaaggatcgcgcccataagacacccagtggacccggaggagtccaacagggccctggggtttccagcttttgttgtgggcctcagtcaatcctacagggtgcccgtcccccccagcaagggattgcgcccgcaagacacccagtggacccgaagaagtctaacagggtcctgggatttccagctctgattacgggcctttgtcagttctacggagtgcccgtcgcccccaacaaggtcatcaggccccctattaaccgggctttcatcaagaagtactgcgctccccaggcaagcgcagggtga

SEQ ID NO: 66615 - DNA, 201 bp, Glycine max
  Peptide Sequence Number=SeqID_158300
atggctaggagactccaagaagattgggctagagatgcaggagaaggccctagggtgctcatgagccttaggtggcatctccaatcagctttccttcttctccattctactgccattgatcttcaagaagcaaaggactccattgatgaagaagatccaaggcctacaagctctacatggagctacattagcagtaaatga

SEQ ID NO: 66616 - DNA, 269 bp, Glycine max
  Peptide Sequence Number=SeqID_158301
atggtccccagaaaggaagaatggggccaaaacaagttccgatgggcgttgtggggtagcaacaacgagcttaagcttcaaagggtcgagagagaccagtcaagagttgaaggcattatattggaagacgagttgaaggcttgtcaaaggtcaaagagatgtttgtctgaccaattgagcaagacggaagaaaacatgtgggccatcattgaccaatataaggagaagctaagtctagcggcaacccatgaacagaggctagaggacga

SEQ ID NO: 66617 - DNA, 387 bp, Glycine max
  Peptide Sequence Number=SeqID_158302
atgaggggaggaggttgcatgacagcttgcccaagcgagctacttgctttctccaaaagcaacctagctcacccaagcgagttgtttgcttcaccttcaagtttttcatgggcccaggcaaacaggactgaaataatcttgaaaacaataaaaatgaatgaccacgatggtctctgcatgccatcggacttgattgtctctggatcacaaaggggtgtggatgaccatgatggtctccgcatgccatcggacttgattgtctctggatggaaagcggatgaccataatttgtcttcacgtgccaacggacatgattgtctctggatgggtgcggatgaccatgatggtctccgcatgccatcggacttgattgtctctggatggtaa

SEQ ID NO: 66618 - DNA, 588 bp, Glycine max
  Peptide Sequence Number=SeqID_158303
atgagggaattgcttagggcaccaagcatttttgttggggcacccaacaattttcataaatgccgaaggtcggtttcgaagcgtatttggtctacggtggtgtacgcgcattgttcaagagtatactgtgaattttggtcggtttttgtcgccggagaagaagagatggacgaagaccagtggatgtatgatagtatgatgtctgaagaagttgatatcaatgttgaaaatgaggaagatgttggtgttaaagtagaacacgctgattgctctgatgcctttaatacttctcagttgtttgctagttgtgatgaagttttacaatgggctcaatcgctggctcatgacattggatttattgtcgttataatgaggttagacaccaatactggtgttcgaggaagagcctcatttctattgatagcttgtgaaaggagtggtgagtatagtcttaaggtaccgaagcatgatttcgtaatcatggtcatagaaagcctgtttcctgtgtgcaaattgttatccgccaattccacacaacatggacgagccggaaggatggatgtaaagcctggggtgcctaatgagtga

SEQ ID NO: 66619 - DNA, 741 bp, Glycine max
  Peptide Sequence Number=SeqID_158304
atggagaaggaagctcttgaagaagccatggtccaatctgtcattaaagcttctctcaatgagtctaaggacaacattattgagatagaccctggtgttgaacctatcagatcaaggccaatgtatcatgctaatggaagtcaaattgacattgtcttatctatagtagtgggagaagacaatgccagacgttttgaagccatatatggaccaccaacatttgatactatattagatgtacaagttggcttggaacgaaggaaaaggacatatagttttagaatggaaaacctgcaacaaagtctggagaaacaagatgaaccggtcttcaagacattccctccatggcagaccgttgctctcaatcccaatagtatgatcttcgagcatctacccacaaataaaaagactctgaaccacttctgcttcactcaagaaactcccttcaacatgatttgctcatggcaaagggatttctatgctacgtctaatgataccttatcttttatggtgatattactcttctctcggttctttttcacacatcatgtgaacccaatcattgaagaagttgaatttgatactgatgttgtagaggcaattgctccggacttgaaggatcgctcccatattgagaaggaggctcgcaaatggtctctaatcagtgacttcttttacaagaaagctattgagtggaaacctcctcactccctaacgccccaatattggggttttatttga

SEQ ID NO: 66620 - DNA, 933 bp, Glycine max
  Peptide Sequence Number=SeqID_158305
atggcatgttctccagacaaggtaaagaacatcgatggctcaaaagaaactcttaaacttgctgtgagaatcactgatctatggtttattgggacgcctaacaaatctgagctagctaagatggtttttgtggactccgatatttattacttattgttcaggccattgtgttgtaactttaacggaatccagggtgctgagatccatgctgtttgtaaacaagaccaactgaagtcttggaagatggacttgaaggaaaattgtacttatgtcatgcacaattttaaagtgctaaaaaacaacggtcaatacagagtctatgatcaccaatttaaattggtgtttattggggttactgttgtgaggcagtgtgttctagacgacctcccttttagaaaatacaggtttgctggatttacggatgttgtggctggccaatttgaacttggcctattggttgatgttattggtgttgtggaggaggttttcttttgccatgtttcaggaaaaggtagaagggtagtctttaaactaaaggacttgagccagcaattgctatcttgcactttgtgggacgattattgcttgcagtttttaaagttcttagatgatcatgaaggtcatggcccaattacagttctatcgacccatggtagaataaaggaagctcagggatcttatctgccatcggtcagcaattctttcaaggcttcaaagttagttattaaccaaccggtgatggagattcaagaattcaatgaagggcttgcagagttgggcattgaggcccggtcagtttttaaatcccatggtgaaggcagttcacagctttcaggttccatccaattatcatcaaaggaattattctttggaaaggctgaggcaaagactattgctgagattaacaccatctctgaagtaatcatcttatag

SEQ ID NO: 66621 - DNA, 129 bp, Glycine max
  Peptide Sequence Number=SeqID_158306
atgcatcgatgccagtgcttgattcacaggattcctgtgaatactcagaaattagctacaataaatgcacgggccagtgccaatgggcttgttggaggaagaaaagtgttccattttatgtctatttga

SEQ ID NO: 66622 - DNA, 429 bp, Glycine max
  Peptide Sequence Number=SeqID_158307
atggtagggaccaataacaatgttgtcatcgaggtcttcgacaaagaggattacgtcgtgtccctagccaaattagtgatcaatctctccaacaaattcactttcgaaagagggcctttcactatttaccagtatctttgtggctctaatattgaaggaggaggagaccaaggtgttgctatctatgcagttttcttacccattctcaaaggagatttcaaagcagttcttgagactgttgagaaacacttacagacctttgcacatcataagcaaaagaacaagtcaagatatgatagcaacaatagcacactagacagcacacctgaaggcttagaatataccagaccaacccgcaaccataacaggccaacacacttgaaggattatgtgcgaaggggccccagccgtagtgctcaattctgctag

SEQ ID NO: 66623 - DNA, 978 bp, Glycine max
  Peptide Sequence Number=SeqID_158308
atggctcctatgaagtgtcctccggtgctaggtcgtcccactgcaccaatacctattggggtgattatcggtactggaagaagggagtgtggaggtgtctgtgtgaatgggcctatgaagaggacggagtgtatggcggcctgcgaagtgattattgagtcaactgcatccactatcgaagagcatggaaggtataatggaagggaagatggtggtttgacatatataacttcaaacggagaaaaacccatgccgacgtgtacagaggactctattaaggacctcagtctagttgtcggtctatgggtggtatgttgtactcagatgaaggttagtgccactcaggcggaacaattctctccaacatgtactaatgaaaatggggtcgcgatcggaaaccaagctgtgtgggaagttgtggagcttgcaaatggtgtccaagaacaacactacaactttgtgagctatgaaatgttggggaagaggaccgagatgggtacccttcgaatatctatcaacaacgaccatgattgctgtgaaacattaggaaactgtttcatatttcacctgttggcagataacgcactagaccacataacgaagaatatccttacacatgcgaggccaaaagaaatggtgttgaatgcgacgaagtgttatggaaacacccatatgacctacaagaggggtttcatgaaatccgtccatgatttagttagtgaaatcatggccggaagggagccaaatcttatcattaaagaaaaggaggccctgattaatagtgaaaccggggatgatgaaagaatggcccagaaggtaatggcgccacttgcgtactgtatttgtaattgcatgaagctcatggacgctatggggtgggagttttgtaatagaactgctcctatagtggtgttggaggcatctgtttcaatggtgaatagaatgttaaattctagagtggcgcggacacgggcctga

SEQ ID NO: 66624 - DNA, 246 bp, Glycine max
  Peptide Sequence Number=SeqID_158309
atgtcagtgaaaaaccttgtcgggcgcctaggagtacatgacaagacaaaccacacactaggagaccagtcatggtcacagtattttgcgagaatgatccaatcatatgggatcaacataggcttaaaggagcactcaaatcgggtgacccccaaggcctacactccgaagagtccgtcagggcctctccctcctaattcaggtccaacccagaaaaacattttagcacacagactctatttatga

SEQ ID NO: 66625 - DNA, 1701 bp, Glycine max
  Peptide Sequence Number=SeqID_158310
atgaaagaccgtaggagacgcaacgccgtcgtttcatggagcgcgctcttttggtgcaccctcctcctcgtcttttccaccatcatcttcaccaccctaatcttctctcccttcatcaccaccttctctcacccattcaaatggatcaaaacaaccactaccaactctcgcgccacaatcacaatccgcgaaaccgttattctccccgaccaggctctgattttcctaaactaccctccatctttccgcttgtacaccaaacatgacctttcgtgtgtttacttctcccctgacgatgactcgtcgtctcgaggggtaactcagccgccgattcagcttcacctcgcgcgcctccgcgagcagatcgtgcggtgcacgctccctccacgtggcggcacggtgtcgcttctcatcaaatcgaacggcgttgtcattccgaggcaggactcgtcggggtccactcacgagtggaccccactggtctacgatgccctctttgaccgtgacaataccaccgtcgcgttcgtgaagggcctgaatctccgaccagagaaactcatggaaccgtccagatttcagtgcatctacggctgggatttcacaaagcccaagttccttttaaaatctgatgtcgtatccgctgcacaggaaattataaggtgcaaaacaccaaaaagcattttaataggtaaggcccaagcccaagacattaaagtgaccatccatgcgaaagacatgggagtattcccttctatcgccaggcccgggcttcgtctgcaacacaccacaccaaagcaaaaagcccatgagatgtgtatctgcaccatgcttcgcaaccaggccggtttcatgaaagagtgggtaatgtaccacgccaaaatcggagtccaacgttggttcatttacgacaacaacagcgatgatgacatagaaaacgtgatttctttcctacaaagcgttggttacaacatctcccaacacctttggccttgggttaagacccaagaagctgggtttgcgcattgcgccctacaggcccgatcctcgtgcgattgggttgggttcatcgacgtggatgaattcttcaatgtgaaaattaaagggggcatgcacggtgtgatttggcaccatgcaaagcccggaagcaatgtgggtgaaattaggacaccgtgttacagttttgggccttcgggcctacgagaagtgccgaaggaaggggtggcagtggggtacacgtgtcgattggcagcacgtgagaggcacaagagcatagtgaggcctgaggcgctgaaccaaagtttaatcaatgtggtgcaccattttcatctaggtgcaccatttgtgaccgtggatgtggagaaaagtgagatgatgattaaccattacaagtaccaagtgtggaaagtgtttaaggagaagttctataggagggtggcgacatatgtggcggattggcaggaagagcaaaatgtggggtccagggatagggttcccggtttggggaccaaaccggtcgaaccggctgattgggctaaccggttttgtgaagttagggataacgggttgaggaattgggttttgaggaatttagaagaccgacgcacccgtcttttgccttggcaatcagagtttgagcatcatcttagaaagaggcgaaggcgaaaggaaaaaaaaccttttatgatacaaccattattctaa

SEQ ID NO: 66626 - DNA, 459 bp, Glycine max
  Peptide Sequence Number=SeqID_158311
atggacgctcatccgtgtcaggatggcatacaccagctgacacctcggcagagggagatcggagttataatcactaggcaagacattgctgagcagcaacgtcatacacatctgggtcaaggtggtcatgctggtgcgcatgatccgcacccgtctcccggcagcggtccgggcgaaatccttccccaccatgggagtgaccagcgacgtccaatgtcggcgaactatctcttcctgaaaatccgtgtactcatcgtccctgagctggacgcgcctctctttgtggaacaaccatcctttcatggccccgaagcactgctggtgctcggcactctgaaacggtggctatcaaactcgagggtggcactggtcccttcagctgcggcgtctctcctagatctcttcgcggaaagcttttacggagccatttcctgcgaggacaaacatttggaaagttag

SEQ ID NO: 66627 - DNA, 171 bp, Glycine max
  Peptide Sequence Number=SeqID_158312
atggccgaccagcaagcgaccaagtccaaagccaaagaagcactactaggaggcaacctagaattggctaagaagaagctccccgcgaagcggtccaggaagggcaccattgaagaggattccagtgtggccccacaagacgacaccggctttgaaaaacaccgattatag

SEQ ID NO: 66628 - DNA, 360 bp, Glycine max
  Peptide Sequence Number=SeqID_158313
gaacatgaaatagaacttcaacgtctcaaccaaaatgaagagaccgacaaaaggaaaagaagcatagcaatcaaaacctactcctcaatgcaagaagaagaagaagaatctgatgatgaagaggacttctcactctttgtgaaaaagtttcataaatttgtcaaaaatagaagaatggagagaagccataacttcaacaatgggaagagatcccaagaagtttctcctacacttaaatgctacaagtgtaatcaacccaatcacataaaagcaaattgtccctcaaatgagtcatggcccgagaagaatgagaagaaaagctataaagaaagaagatccaagaaggcgtatattgcttga

SEQ ID NO: 66629 - DNA, 956 bp, Glycine max
  Peptide Sequence Number=SeqID_158314
ggcttcccatagaccctaagagaataaaggtcattcttgagtggcctactccaccaacaccacacattgagtgggtgaggaactatattctctcatgggaagatggccaggaaaggggtgttgaggaaagaatccatgagtttcaagaacccctggatttgaggtcaaatccttttcaagggggagggaatgatgcaatctctagcccaatcttcttggagtcttctatccaatgcccttgcggggcaatagccggactggacatgggtggagtccgcaagtttgaagaatctgcttatgggtacaacaagatgcaaaattacatagacatcatgttcaagagtcatcagttagtggattataagtttccatatgttgtgccagccttaagattcatcgactatttcaatgtctctaatgagatagtagatttcaccaaagcgtctagtgagataaccgaaaggcatctcaagaagcttggaatgagagctgaagctcagcaagagcctgtacaacaatggagtccttttgagtctcttatgattcagaaaatggatgccatgcttcacctccatcaagagcactcagttgatgttcatagtactttggaaaacaccacaactcggatggagaacctaggaactaggctaacccttagtaacctctttaaccccaatgaggatgaagcttatggtgagtgcgaaggtacatggtcgacgtgttggtcttcctactgggcgactgatgctactaaagatgttctctacctaacaatgttcctgtgttctatgttgtctcctggactactaaaccctgatgtctcatgcatgtttagcctaatcctagccaagcgtcatcctcagatccctcttgttggactaaacttgaccaaaactgcattaagacatacataccaacaactaggttaccgtaccccgatccctcgtgaaatatga

SEQ ID NO: 66630 - DNA, 315 bp, Glycine max
  Peptide Sequence Number=SeqID_158315
atggcgaacaatataatcaacagcaaggaaaatggaggaaccaccctggaaaccagttcaatagagatcaaggtggaccatccacaaggccacaacaacaaggacctaaagagcatagagtctgctataaagaattttgaggtccaagtgggacagcttgcaaagcaattggcagatagatcgtcaagaagttttacagctaatacagagaaaaatcccaaggaggaatgtaaagctgtgatgactagaagtagaatggcaatccaaggagatgatagtgaagctggaaagaagatggaggaacataaacaatag

SEQ ID NO: 66631 - DNA, 210 bp, Glycine max
  Peptide Sequence Number=SeqID_158316
atggtgattggaggaggtgttggtgtgacttgtgaaggggttagggttgccttttatagagagatagtggcgttctggttggctgaggttggtggcaggagtaatggagaggaatgtgatcaaggtttattccaaagtcttctagttgttgcttcatccagagactttgagcacaacaacatccaactgcaatatactcagcttatgtag

SEQ ID NO: 66632 - DNA, 318 bp, Glycine max
  Peptide Sequence Number=SeqID_158317
atgttagccattgtcaacaggtaccaagaagaactaaatctatccacggcccacgaccataaagtagtggacgagtatgcccgagtgtacgcaaaaaaggtggctagaggaagggtgatcgactcattacatcaagaggcaacaatctggatggaccgatttgctcttaccttgaacgggagtcaagaacttccccgaatgctagccaaggccaaagcaatggcggacacctactccgcccccgaggagatccacggacttctcagctattgtcagcatatgatagacttaatggcccatataattagaaaccgctag

SEQ ID NO: 66633 - DNA, 1098 bp, Glycine max
  Peptide Sequence Number=SeqID_158318
atggctccgaaaaagctttccacgaagaggtctaggagagacgtcgcggtggaagcgtccagtgtcgcccccaagtttgatagccaccgtttccggagcgccgagcaccaacagcgcttcgaggccatcaaaggatggttgttccatagagagaggcgcgtccacctcagggaggatgagtatacagattttcaggaggagatagcttgcagacattggacgtcgctggtgactcccatggctaagtttgaccctaaagtagtcctggagttttatgctaatgcttggcccacagaggagggagtgcgagacatgtgttcatgggtgagggatcagtggattccctttgacacagatgccctcagccagttcctaggtgacccactagtgttgggggaaggccagcagtgcgagttcagccagaggaggaacatggctgacgggttcgacgaggaggatttcacccggaccgctgcaaggaggcgggtgcaaatcatgcgcaccagcatgaccaccttgacccagacgtggatgacattgctgctcagcaatgtcttgcctagcgatcataactctgatctccctctgccaaagtgccagttggtgtatgccatcctgacacggatgagtgtccacgtggcccaggtgattgctgacgctatctatctatttggaggtatgtcgcccaccaagcaccctctagacccgaataagtttaacagggccctgggatttccggcattgatcacgggcctctgccagtcgtttggggttcccgtcacccccactaaggtgatccgaccgttgatcacccgggccttcatcgagaagtattgcacgcccaggcaagcgcaggacgcaccgccgccacctcatcagcccgatcccgctagatccctaggcatggagtgttatctacaacacttggttcgccagcaggcggccaaccactgggggcaggtcgcatggcccagagattggaccgaggcccaggcaagggaggagcccgcaggatcccccggtgcggcagaggaggcccgtatggatgaagaaatgacggacttgcttggtttcttgggaggaagcggagccacgtga

SEQ ID NO: 66634 - DNA, 270 bp, Glycine max
  Peptide Sequence Number=SeqID_158319
atggctatttatagaaaaacccatttagtgcaggggaaactcacccaggcgagctgcttgcttaagcctgaaggtattagctcgcccaggcgagtggcttgcatagggctaaagtttcctcttagcccaagtgagctagatgctagcctgggtgaatttcgggtcagaaaactttatgaaaagaccatttttcccttcctcgtggctttgtttctagatctaacaaacaaccatcaaaaccctaagcgaccccttggtcttgcattgtaa

SEQ ID NO: 66635 - DNA, 141 bp, Glycine max
  Peptide Sequence Number=SeqID_158320
atggtgactaatgaaaaagtggaagagaaagtgagctaccattgcatggcttggggacaggcctatttttcaggaggaggaaaagcatatgaggatgaagacatggaagatcctattgattattacattggaggagactga

SEQ ID NO: 66636 - DNA, 402 bp, Glycine max
  Peptide Sequence Number=SeqID_158321
atgacatccagcgaccaacgtggttgtctgcaccctttgtcgaagacacgacgcctatcgactgagactactttagtctctcctttgtcatccagagacggcaaatccgatgacacgcagagacaacatattatcatccgccatccttgtcatccagagacggcaagtccaatatcgtgtggagactcttcatggtcgtccgccacctttgctatccagagacaatccagtctgatagcacgtggagacaaattatgcctcttttgtcatccagagacaatcaagtccgatgatgtgcaaagactctcttttgctatccggaaacgatcaagtccgatagcatgcgaagaccatcacggttatccatctttatcgctttcaagacaccaaggcttttgctga

SEQ ID NO: 66637 - DNA, 580 bp, Glycine max
  Peptide Sequence Number=SeqID_158322
tcttgaatcaatcacttgggcttttggcatcatcaaaattgcttggttcatcatcatgaaacttgcttctacaaaagagactgagaagcttttggaaaaagagctcatcggtgcctctaactttgtgacttccccttctcctcttcgtggtgtgctttcggaaaaaggttttctagatttgggtgtacctctgcgagggagaaatgtggacttagaattaaagttaggtcatgttgtgaccaatgacgtggacatagacatgaatttcgattgtgataaaggacgtgttgtgggagatgaagccgtgtttggggggaacccacaccaatcttgttgggcaatcccagttgggagagtcattgaggagtcagtcctcaaagaaaaggatggttatacaatggcacatggtgatgctcaatcgatggagatggaatggaaagactacaacaaaacgcaaaggatgaggaggatacctcttgagcagacaaggtttgggaatcaaggtttcatgctaaggggagaagaagaagaagaagaagaagaagaagaagaagaagaagaagaagaagaagaagggtaa

SEQ ID NO: 66638 - DNA, 471 bp, Glycine max
  Peptide Sequence Number=SeqID_158323
atgggtgacgtagaggaagcacaagaacagatgaaagccgacatgtcggctttgaaagatcaaatggccttcatgatggaggccatgctaggtatgaaaagattaatagagagtaatgcagccacaactgccgccgccagcaccgccgctgaagtagactcggtccttccgtctacagcaaatctagcacatcaactcgccccggatatggtgggacgaggaagagacacattggggaataccaacaacccatatttggggtacaaccgaattgcttacccctatggtctaccccccaaatttacgccacttgccatgcatgagaacacggaccatgccgttccctttaccttcgaagggcagcccccccagcctgcagggggcgcccacgaagagcctcgagagcgtgcccaaggggacatcgactcatacccccctttcaccactaagggatcgggtttggaaaaatga

SEQ ID NO: 66639 - DNA, 810 bp, Glycine max
  Peptide Sequence Number=SeqID_158324
atggcgaaaaaggtggcgtttggtttcttgttcagcgaagtagtaccgtgtctgattttgtttttagttatagccgcggataagacccatggttggagcggtgactcttttgaccgctacaaggaatacaggtttaaggtggagtctaatgatggttcagctatagtagtcacacctgagacatactcatgttccttaaggctgaaaaacacagttgaagaagatgcaataaggttgcagcctggatctagtgaagtccatatgttttttccagatagccttggagatgatttgattgttgaatttcaagaatccaagggaaagcattttggtcgtgttcttgtccaagtggctactatagctgatgatccggctgacaaattacgctggtggcctatttatcgtgaaccaaaccatgagcttatgggcaagttacaactgtatgtaaattattcaacaagtgcagatgacaatagtcacctcaaggttattgcaatggaagtgccaaaaacttggttagccaaagtgcatccttccaaaggcaccccattgaatgccacactctttttggtgaggattgatgggatgcgccacaagcaaggtgtgatgcatcgggatcttaagccagagaactttttgtttgcaaataaaaaggaaactgcagctttgaaggctatagattttaggttgtcggtgttctttaaaccagtgcttgatgacttctgttttaacatatacattcaggttgaccgtaacactgccatgggctatggggcgttcgggttctactacaaaaagacatcattttga

SEQ ID NO: 66640 - DNA, 423 bp, Glycine max
  Peptide Sequence Number=SeqID_158325
atgattcttgatgccacaactagagttactatgatgtctaagagcctagaggaggcaattgtaatcattgactccattgcagccaatgattatcagagtcaccatgatatggctcgggttcaaagaatggccattgtccaacacttggaggttgccaacagaaagaggaggcccattatttgcaaaacaaaggcggacctcaacatatcttccaaggaaattaccaaggctacaagggtggatcaggctcaaatcagccttatggctagaggccacaaaataataatgcatattcaggtcccactgacacttcttttgcaggtccttctaacaactcttatgcaggtccttcaaataggggtccacaacaacaataacaacaagctcagccgaatagaatgtcaaagatggaagatactctaa

SEQ ID NO: 66641 - DNA, 306 bp, Glycine max
  Peptide Sequence Number=SeqID_158326
atggttgtggagacagagccctttggcagcgacgagaatggcaaagaggaggaggaagaaggggtggtggagatttgtgtccctgaccgtggcgaaacacacaatagaaagggagaagcggatgtcggagggatggatgccgtggctggaaggctttgtgtgggaccggagactggcggcagggagggggtcagaggagagggaggcggcatagtttttgctgttggtggaggcggcgttgtttttgctattggtggtggcttagcagaggaaaaagatgggttggttaccttgggaagctgttga

SEQ ID NO: 66642 - DNA, 261 bp, Glycine max
  Peptide Sequence Number=SeqID_158327
atgaatagccaatatatttgcttttatctcatgcctttcttcgttcatggttcgatattctggtgtcctaggcgtagaggaaccacaccaatccatcccgaacttggtgctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 66643 - DNA, 219 bp, Glycine max
  Peptide Sequence Number=SeqID_158328
atgcagacagcctcgacaccttcttggagacacttgtggtactggctgagggagaatccttacccgcttactccagatattgaaggatgcctattgatatcagagaaattaaggttgctttgccatcctgggaagatcctcaggaaagatctaacaactcttgctcaggaaaagaaagaacaagaatgtgaacttgcaattagaattgttagtcagtag

SEQ ID NO: 66644 - DNA, 444 bp, Glycine max
  Peptide Sequence Number=SeqID_158329
atgcataaggcattgaggtctagtgcacctctaccttaccctcagcttgtgactttgtttcttcgatattttgaaattcctttgaattctgagccttttgtgcaagttaaacattcctttgttattggtgccggtgcggtaacctcctttggctactgtaaggacatggatgggcaatggttgaagaaggatgtgcaacctccgcaagaagaacgtactccctctcctctgcctcaacgagatgactccttagccctcatgcatgaagttctttctgagttacgagacctccgcacctatgttggtgaacaatttgattccttggatggccgtatcgatgccattgatgctcgctttgaaggaatggatacccacatcactcagcttgaggaggatgtgagttatcttcgtcgatggttcgaccttccaccaccatcttcatag

SEQ ID NO: 66645 - DNA, 341 bp, Glycine max
  Peptide Sequence Number=SeqID_158330
atggctcaattgatttctgatgtcatctattgtttgcagggatcgcgcccacaagacgcccagtggacccgaagaagtccaacagggccctggggtttccagctctggttacgagcctctgtagtcctacagggtgcccgttccccccggcaagggatcgcgcccgcaagacacccagtggacccgaagaagtccaacaggttctatggagtgcttgtcgcccccagcaaggtcatctggccccctactaatcgagctttcatcaagaagtactgcgtccctaggcaggcgcagggcgaaacaccacagcagcctggggatggccggcgcaagctcagaag

SEQ ID NO: 66646 - DNA, 165 bp, Glycine max
  Peptide Sequence Number=SeqID_158331
aatcaagagttaagcaaagtttcaagcaaagattcaagattcaagaatcaagtttcaagattcaagattcaagaatcaagatttaagaatctagattcaagaaaaattaagatcaagattcaagactcaagactcaagaatcaagagaagactcaatcaagataa

SEQ ID NO: 66647 - DNA, 306 bp, Glycine max
  Peptide Sequence Number=SeqID_158332
atggtgttgtggagaggaaaaaatagatcccttggagaaggagctaaaactcttctaaatgaaacaaagctaccagagtacttttgggctaatgctgataaagattatgctcttgaaaatgaaaccagagttgaagtgcttgaacaaagcaaagaaatcactgccatgcctcctaaagacctccctagagaatggagaactcaaaaagacctctccttggacaacattattggagaaatatcaaagggagtttctactcactctagactcaggattttatgcaataacatggtttttgtttcttag

SEQ ID NO: 66648 - DNA, 229 bp, Glycine max
  Peptide Sequence Number=SeqID_158333
atgttggtgcgcatgattcgcactcgtctttttgcagcggcacgggtgaaatcttgccccggtatgcatactagatgcgtgatagcctccctctctggatgtgctcgcacagttggtcgccctccaatatcagggggtgtggatatggagctactgaaaatgaggacgcgtagccttctaaaggcgaaggtgcagccctctgcaggcgaggatgtgcagtcctctgatg

SEQ ID NO: 66649 - DNA, 768 bp, Glycine max
  Peptide Sequence Number=SeqID_158334
atggtttcaaggtatgctttaaatcagattgctcctgagtttgagcgtgtacattatgctggcaagaatccttccacttgtggttgtgtcatgagaatcacgcacggtcttccttgtgcatgtgagctagctaaatatgttgttggttgcatcccactagattcaatccatatgttctggaggagacttagtttttcagaccaagggttatttgggcccgaagtgaccatcaaggaagagatgaaaaccatatctaaaagatttgaagaacttgatgtttgtggtaagtttattctatgtgaacttcgggaaattgcatatctaaaaaacaaaaatggaagcataaacgcaaacgacaccacggggaaggagaagaggcttacctcgacggtcaacggtggagcagcccaatgcacgtcctcaatgccggacgagaagaaccttcaaagcacaacgaacacgccagtgcggaagaccaagaaaaaaggtgcacaagctgaagaagaaggggctgaagaagaagaagaagactcgcaatcgcggccaataatgctgggtgcacctagcatcacccccacaattaatacacctttagagccacatgttatccaatattccatctatcacccatgctccaccacataccatcatcccatcacttgtgaaactcgcatcatgcatgctcctatgttgacactccattgtgcaaaggagtactcaaaactatcgcataatgcagacaaccatgatcatgatataaacctctga

SEQ ID NO: 66650 - DNA, 210 bp, Glycine max
  Peptide Sequence Number=SeqID_158335
atgaaaagaaagaaatggaaaggaagaaatgaaaagaaagaaaagaaaaggaaaagaaggattcccgatcgaagatcggaagaaagattgccattcaaggtcgctcccgactggcgatgtcctgctccacataaacaaagaggaaaagaccgaaacacccaacttcctcttcaaaaacactaccctcgagaaaatcctattgatccgtga

SEQ ID NO: 66651 - DNA, 944 bp, Glycine max
  Peptide Sequence Number=SeqID_158336
gatcgtcatgccggcggatttccgtgataaacttcgcgcaggatctcgcgcgcgccgcgcgccagcagctcttccgccagctcaacgcccatccgttcggcctcggcggccgggccgcggcgctcgccgcgcaccatctggctgccgtccggcgcgccgaccaaggcacgcagccacaggctgtcgccatccagttcggcatagctgccgatcggcacgtggcagccgccttccagacgggtgttcatcgcccgttcggcgcgcacgcgggtttcggtggccgcatggttcagcggcgccagcagcgcgcgggtgacgctgtcgtcgagacggcattcaatgccgaccgcaccttggccgaccgccggcaggcactcttcggcgctcagcgggctgcggatgcgttgctccagccccaggcgtttcaggccggccaccgccagaataattgcgtcatagtcgccgttgtccaacttggccaggcgagtgccgacgttgccgcgcaggtcgcgcacgatcagatccgggcggcgttcacgcagctggcactggcggcgcaggctggaagtgccgaccacgctgccctgcggcagttgatcgagcgaggcgaaacggttggaaacaaaagcgtcgcgcggatcttcgcgttcgcaaatggtggtcaaacccaggccggcggggaaatcgaccggcacgtctttcatcgagtgcacggcgatgtcggcgcggccttccagcagcgccagctcgagttctttaacaaacaggcccttaccgccgactttcgccagcggcgtatccagaataacgtcgccgcgcgtcaccatcggcaccaactcgacctgcaggccgggatggcaggccatcagacgttgctgcacataatgtgcttgccagagtgcaagcgggctttgtcgggtggcaattcgaataattttgtctaa

SEQ ID NO: 66652 - DNA, 606 bp, Glycine max
  Peptide Sequence Number=SeqID_158337
atgaagctttgcttctacaccacctactctagattttgcaggttgaggtctaatcctttggagattgaagccaggctctgtattccccgcaaggggcttgttctgaatgctgagatccaaccatggaaactccttagaaaggatctggctacactagcccagacatggagtgtcttctcttactccaacttagctcccatatcccacacctcagatttgaacatggacagagacaggttggtttatggcttggtaacccacatggatatgaacattagtgccctgatctcaagtcaaatctcttctattgctcagagtaactcctctaggcttctatttccagccttgatgactgccctttacagagctagaggagttacctctgatagtttaacttatgagagcctgagcccgaccattaacttggcctacattaagaaaaactattggaatgtggatgatatgacaattaacttcagaggggcgaggaaggtaagggctcgaccagctgatgttccttcttcttctactccaccagctccttccacttctactactgtgacatcctggaatttctacttggaattttgtaagtattacatttaa

SEQ ID NO: 66653 - DNA, 279 bp, Glycine max
  Peptide Sequence Number=SeqID_158338
atggcttccatgatggatgccatgctaggaatgaggcaacttatggagaataacgtggccatctctgccgctgttagttcggctgtcgaagcaaacccaactctcctagctaccgcgcatcatcctctcctaaacgtgtccgacgaggttcacgaggattgtagagagtatgccctaggagacatcgatttctaccccccggtctccgtagaggggccggcacccaacacgctacctcatcctaacctcacgggagaacctcgaagcctcccagcatag

SEQ ID NO: 66654 - DNA, 261 bp, Glycine max
  Peptide Sequence Number=SeqID_158339
atggattcctttgcttcttggaagatgaatggcagcggaatggagaaggaagagagagagaggagacgccacttcaaggagaagatgagtctagaagaagctcaacaccataggaggccatggataagagcttggaggaacaaggagatgaatgaagggagaggaagagaagagcacgaaattttatgctctaaaagagctctgaaatctgaacccactaatccaagatcaattccaagattctccactaagtgtacttag

SEQ ID NO: 66655 - DNA, 168 bp, Glycine max
  Peptide Sequence Number=SeqID_158340
atgattttggttggtaatcaaagggagaagggcaaggtttatggtgagttgggactttggctcaaggcttgtagagcggatggacatgatatatgtcagggtgcagatctggttcagggatataagggaatgtcccacattatttccatgacacaaatgcaacaatga

SEQ ID NO: 66656 - DNA, 423 bp, Glycine max
  Peptide Sequence Number=SeqID_158341
atgaagatgaaagcaaacaaaacaagaaatgaattgaaagtctcgaattcaaacacttactggttgaagaacgaagaacggacgaagaacagtgaagaatggaggaaaatcttcacaaatttgctcacggaaacgtctcggaagcgttacggaagcacttcgactcgatttttcttcgcggaaacggaaaaagggaggtgctcgccgcccagaggcatcttgaggaagatttctaagcgcaccctagttactaagttcaccacccttttcgtactttacggaaaacttgtaggcctaggatcttcttcatcaatggattcctttgcttcttggaagatgaatggcagtggaatggagaaagaagagagagaggaaacgtcacttcaaggagaagacgagtctagaagaagctcaccaccatag

SEQ ID NO: 66657 - DNA, 413 bp, Glycine max
  Peptide Sequence Number=SeqID_158342
gcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcggggcactgcccctctttttggacccaaggtcggcttcggccggtcgatccgggcggaagacattgtcagtggggagtttggctggggcggcacatctgttaaaagatacgcagtgtcctag

SEQ ID NO: 66658 - DNA, 441 bp, Glycine max
  Peptide Sequence Number=SeqID_158343
atggaggccatgaaagagcaaatggccacaatgatggaggtcatgatgagcatgaagaagataatagaggtcaatgcggctgcagttgccgctaccaacactgttgctgaggaaaagagttgggaagtacgggcggccctattttgtgcaaacaagcatgccttcccgccatatggcttgcctcccaactacacaccacccaatgttgcacacgctcccgatgagaatgtcaataactccactcccatactcattgagagccaacaacctcattctaatcatgcacatatctctcaacccatgggggagacgcatgaaataccccaccataatctagccgactttgagtctcgcctcggatatgccactaaggggcaagaagatggtggtgtacccctgcctaacactttggagggccctcagtttcgcccacaaccataa

SEQ ID NO: 66659 - DNA, 417 bp, Glycine max
  Peptide Sequence Number=SeqID_158344
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggtttagggtttaggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 66660 - DNA, 822 bp, Glycine max
  Peptide Sequence Number=SeqID_158345
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtgggaacaggggaaaggggtcagatttatcttgacgggagcaagacgggtatggtaaaaaaatcatacgaaagaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 66661 - DNA, 378 bp, Glycine max
  Peptide Sequence Number=SeqID_158346
atgaaactaaccaaatacaggctaaaggcccaagtggagaaggacgaaggcccaagtggagaaggacaaagcccccgagtggagaaggatgaaggcccagaggcagagacactatcaagactattaattaaaactttagggcatttgataaaatttggtgagagtttctctctgggttccttgttgaaccaatatcatacttatcaaggtaatccttgtggcgtctacccagacttatcttccttcaccggaagtggcgtctaccctgacttatcttccttcactggaagtggcgtcatccaaatctctgtaacctgtatcaaacgatccgctcctactcaggttcacatcatctggtatcagagcttcagctcttga

SEQ ID NO: 66662 - DNA, 198 bp, Glycine max
  Peptide Sequence Number=SeqID_158347
atgttagaaaacgttattgatggactaacgagcggagtcgccaccaatgtttattggaggaaaacgttagaaaaaccaaaacgacaaaggtctgcgtattttgaaaatgagggtttgggagctgtttacgcatgggaaagggtgttgcccttgctcctacgtatcctcgagggcgatgaggaaatcagacctacgtag

SEQ ID NO: 66663 - DNA, 480 bp, Glycine max
  Peptide Sequence Number=SeqID_158348
atgaagtcaggtgacatgcggggttaccgtatggttacccgcacctttcgtcaaccaggggcaaatgagcccgttgatgcgaagagactaacatcgtcttatacaccttttgccatccagggacagcgagttaggtggcaggcggagataccttatggtcatccgcacctttcgtcaaccgaggggaatgaatttgacggtgtcaggatgatgttttactctcgtcgtccggaaacattcaagcccaatgacgtgcgagattcttctctactgggcaaggacgatagagtgcaatggcgtagggaagtgtcatggttgtccaactttgtcgctttcaagacactgaagggtgtgcaaatagcaaccaggcccacttgggccttccaggatgttccaacaaaaggcggtgtcttctggtggaagcaacccagctcgcctgggcgagctgagcggcaaccacctccctcttttcccctataa

SEQ ID NO: 66664 - DNA, 1539 bp, Glycine max
  Peptide Sequence Number=SeqID_158349
atgaaggtcggcgtccgcctgggcatcgcctttggtttagtggtggcactactggtggtgattggtattacctcaatcatgaagatcaacaacatcaagagcggcattacctcgattgtggaagatcgctatgtaaaagtgcggctcggctttgacgtgcgcgatggcgtcaacgatcagatcaaatacctgcgcggcatcgtcatcgataccacccgaccgcagttcaacgtgcagcgctttcagcagctggcagacgccaccgcccgcaccaacgcggcgatgaagaagatcgaagcgattcagattaccgccgtaggcaagaagaaaattgccagcctgctggctgccagtcagcagtttgaacagcagaaaaatgaggtgctggatttggtgcgggccggtaaagccgatgacgccagctactacgtgctgaaaaaaattaccgccgtgcagaatgcctacctcgacctggcggtggcgtttgctgattcccagtcctcgcagcttcagcaggaaggcgccggcattattgatgatggcaccacggcgattgaagtcacgctggtgttctccgcgctcgccattctcgctgccgtggtgatgggctggctgctgacccgttcgattgtgcatccgctgaatgaagcggtgaccatcgccagcaaagtggctgccggcgatctcagctcgcgcattgaaatacgcagcaaagatgaaacgggcgcgctgatgcaggctctgcaggcgatgaacgataacctgctgaccattgtttccgacgtacgcgccggatccgacaccatcgccgtggcgtccaaccagatctccagcggcaacatcgatctctcttcgcgcactgaacagcaggccagctcgctggaagagacggcgtccgcgatggagcagatgaccgctaccgtgaagcacaacgccgacaatgcgcgcgaagccaactcgctggtggcgaaaacctccggcgtcgccaaagaaggcggtgaagtgatggagcaggtgattgtgaagatggaggcgattgccctctcctcgaagaagattgtcgatatcatcagcgtgatcgactctatcgccttccagaccaatatcctgtcgctcaacgcggcggtcgaagcggcgcgcgctggtgaacagggtcgcggatttgccgtcgtcgccactgaagtgcgtaacctggcgcagcgttctgcctccgcggcgaaagagatcaaagtgctgattgaagactcagtggcgaaggtggatgaaggcagccgtctggtgacgcacgccggttcaaccattggtgaagtggtcaacagtgtaagcagcgtggcggagatcatgagcgaaatcaccatcgccagcagcgaacagagcagcggcatcagtgaaatcaatcaggccattacgcagatggaagcggtgacgcagcagaacgccgcgctggtgcaggaagcgtccgctgcgtctcaggcgctgcaggagcaggccgatcgtctggcgcagtcgatgagcgtgtttaaaaccgctgcggtttaa

SEQ ID NO: 66665 - DNA, 2844 bp, Glycine max
  Peptide Sequence Number=SeqID_158350
atgattttgcgcgatgcgtttcagcaaaatcacatcgctgcccatcagtgcgatggtctgaataaactgaaataccagcatggcgatggagataatgccaaaggtggtgggcccgacgtatttcgccacgtaggaggtgacaaagatcaggccgaataccgcaatcagcttttcggcaatcatccacatggacggtccggcggtgcaccagctgcggaaactgcggcgatagagcgtgatgtattcatcaatgaaggcgcggctcaggctgtcgctgtgcagccctttgtggatgtagttcatgacaaacagcaggtcttcgaaattggcgatctcttcgttgaaccgcagccggtgctgacgaatgacatcgccgcgaaacaccttgtcgcagataccgtggcgcgggtggtaatagagcagatcgttaatcgccgcagacaccgacagcgcgtgcgcctgttcacggttggcgggaaaatccagcggtgcgccgtccgggttgaacagccggccgcgcgaggcgcgaatgccccggttgcgtgccgccgagacgcccgcgttggcctggctgataaggtggaactgcggataaccggcgtagcgctgcaggatcgccagcgagtcatcgctggagccgtcattaataaaaatggcctcaaagcgaacctcatcctgctgcagcaggctgtcgatgcatctttccagataagctgcggcgttatacaccggcacaatgacgctaatcagcacgtcgttaacgggagtttatctggcgatttaaagggtaaaaaccgcaggctaccgcccctggcttacagcgaccagcgtgctggaattctctttggtgcattttcaggcgtaaagaaggggcgctgcactccgcagagttcagttatttatcagccagttagccccaacacctcctgcacagcaacgtatttattgcgttgctgccgggagaacgggaactgccgaccgcggttgaaaagtgagcccggaaatgatcagcctgcaaaccaatctgtctgccctcaacgccagcaagcaatctgccagaagtggcgcggcgctgggcgatgcgatccgccatttatcgtcggcgcgcgtgacgatgcggcaggtcaggcgattggtaaccgttttagcagccagcagaacggcctggcggtggcgcagcgtaataccggtgacggcctgtcactggtcgaaaccgcggaaagcgcgctggatgagatcaataaccgcctgcagcggattcgccagctggcggttcagggattaaacagcaccaattcgcagagcgactcagacgccattcaggcggagattaacctcaatctgaaagagattgaccggctcaacaccaccagcagctttaacggcatcaggctgctggatggcagcgccggtaagctgggattccaggttggcgctaatgacaacgagaaaatcagtctcgacctgtcggcacccggcttcagcgtggaggcactgggacttaaggatttggtgatcagcggcatcagcggcaaagtgaccaatgtcaccaccctcaccggcctcgccaccaatatggcgttcagcaacccggcgatcaccgtgaactatctgcccgccagcggctcaccgcagctggtacgcagcagtggtgataaccgccagtacgtgcagagcagcgacgccgacggcaagccggtctattatctggccgccgtcagtgcgcgctgggacaccgccacggctgccggtaacgtctcgattagccgcagcaatccggcgccgctgtacagcaacgtcagcagcattgcgtcgcgcaccatcccggcggttaattatcaggacagcagtggcagcgcgctgagcaccacgcccgcagccacgttaacgcaggataatggccagtattatattgagcagaacaacagctggtatccggccacgctcagctttggcagcagcggtgcggtaacggcacgcatgaccggcggtgccgccaaaaccgacagcgatttcgccaccctgccgaccacggtgaccgacacgccggcgatcgacaccagcaccgccagcctcagtttcagcgatgccagcggcaacgcggtgagcaatggccgtctgctgcgcagcggcgggcagtatgtaatggaagtggataacggcggcggtagctaccagtattacaacgccgccgtcagcgcgacctcggatggcaccagtaatgccctgagcatcgtcgcgaccagcgccagcagcattaacagcttcagtgcggtaaacagcgtgaccggcacctcttacatcagactcgatccggccaatgtggatgtgcgctataccgatgtcgacggcaacagcagtaatgatgtgctgaaactcgacgccgacggcaattactacatggatgtgccgaacggcaatctggataaaaccgccaccttcgtccgcagtgacagcagcggcaacctgatgctgaaaaccctgcagggcgtgggtgacgtgcagatttacttccaggcggctttgtcgtcagtgaccgatgcctccaccaactttacgacgctgcgcgtggccgagaccggttcagagatccgcctgaagcatccggacgatccgctcgccacgctggatcgcgccatcgggcaaatcgacagtcagcgtacccgcctgggcgccgttgctaaccggttgctctcggcgcaaacgctgcagggtaacgcgaccgccgccattgcggcatcgcgttcccgtattgaggatgcggattacgctacggaagtcctccagcctgtcgcgtcagcaaattctgcagcaggccagcagcgccctgctggcgcaggctaa

SEQ ID NO: 66666 - DNA, 246 bp, Glycine max
  Peptide Sequence Number=SeqID_158351
atgccgctgataaccgcacgggtagtagcggcgcaatttattgcgcattccgccacggtgcgggaaatgaaatgcgcgatgaatcgcgccgctacggatgccgctgataaccgcacgggtagtagcggcgcaatttattgcgcgatgcctttcaattgcgcgtctcaggtcaccataaatggtgaccctgcagtctctgcgcgtttttgtagggtgcgcaattttgcgcaccggcataggccgtga

SEQ ID NO: 66667 - DNA, 577 bp, Glycine max
  Peptide Sequence Number=SeqID_158352
catcctcgccttcagaggactacacgtcctcgcctttggtgggttgcacgccctcgcctttaaaggactacacgtccttgcgttcagaggactacacgtcctcaccttcagagggctgcacgccctcaccttcagaggactacacgtcctcgccttgagagggttgcacgccctcgccttcagagggctacatgtcctcctcctcagaggactacacgtcctcgccttcagaggactacacgcccttaccttccgaggactactcgtcctcacctttagaggactagcatgccctcgccttcagagggctgcacaggactacacgtccctccttcagaggactacacgtcctcgcctttggtgggttgcacgccctcgccttcagaggactgcacgtccttgtcttcagaggactgcacatcctcgccttcagagggctgcacgccctcgccttcaaaggcaacacgtcctcaacttcaaagggctgcacaccctcacctttagagggctacgcgtcctcacttttagtgggctccacagctacaccttaggagaatttaaggtcctctgcccttaa

SEQ ID NO: 66668 - DNA, 208 bp, Glycine max
  Peptide Sequence Number=SeqID_158353
atgtctgtcatactgacccgtgaagtcagggttaccttatggttacctgcacctttcgtcaaccaggggtcaaacgagcccgttcatgcgcagagactaacatcgtcttctgcaccttttgccatccagggacagcgagttaggtggcaggtgaagataccttatggtcattcgcacttttcgtcaaccgaggggaacaaattcgacg

SEQ ID NO: 66669 - DNA, 393 bp, Glycine max
  Peptide Sequence Number=SeqID_158354
atgcggggttaccatatggttacccgcacctttcgtcaacaaggggaaaatgagcccattgacgctcgaagactaacatcgtcttctacaccttttgtcgtcctgacccgtgaagtcaggggacatgcggggttaccttatggttacccgcacctttcgtcaaccaggggaaaacgagcccttgacgctcgaagactaacatcgttttctgcaccttttgtcatcctgacccgtcaagtcagtcaaccagggacaaacgagcccgttgacgcaaggagactaacatcgtcttctgcaccttttgtcgtcctgacccatgaagtcaggggacatacggggttaccttattgttacccacaccgttcgtcaaccatgggcaaacgagccaaatga

SEQ ID NO: 66670 - DNA, 1665 bp, Glycine max
  Peptide Sequence Number=SeqID_158355
atgttctccattctcctcctccttcttcctcctctaacaatcactcttttcaccgttttcctccaaatccaaaccacctcttctctctcctcttccctccaaacccctctcatattgcctcttaaaacacaaacactcccatatggcttagtttcacttccaacaccatcgtccacacgtaaggtctcattctaccacaacgtaaccttaaccgtttcactaaccgtaggcacgcccccacagagcgttaccatggtcctcgacacaggcagcgagctctcctggctccactgcaaaaaacaacaaaacattaactcagttttcaacccacatctatcttcctcctacaccccaataccatgcatgtctcctatctgcaagactcgaactcgagactttttgatacccgtttcgtgcgactcaaataacctctgccacgtcaccgtctcctacgccgacttcacctccttggagggcaacctcgcctcagacacgttcgccatatccgggtcgggtcaaccgggaattatattcgggagcatggattccgggttcagctccaacgcaaacgaagactccaaaacaaccgggttaatgggcatgaaccgagggtcgctctcgtttgtgacccaaatggggtttccgaaattctcgtactgcatctccggcaaagatgcttccggcgtgttactcttcggcgacgccacgttcaagtggcttggaccgttaaagtacactcctttggtgaaaatgaataccccattaccctacttcgaccgggtcgcgtacacggttcggttaatgggcattcgggtcgggtcaaaaccgctacaggttccaaaggaaatcttcgcgccagatcataccggggcgggtcagacaatggttgattcgggtactcgattcacttttcttctcggttcggtttacactgctttgaggaacgagtttgtggcgcagacgagaggggtgttgacccttttggaggatccgaatttcgtgtttgaaggggcgatggatctgtgctttagggttagaagagggggtgttgtgccggcggtgccggcggtgacgatggtgtttgaaggggcggagatgagtgtttccggtgagaggttactgtatcgggtggggggtgatggtgacgtggcgaaagggaatggtgacgtgtactgtttgacgtttgggaattcggacttgttagggattgaggcttacgtgattggacaccatcatcagcaaaacgtgtggatggagtttgacttggtcaactccagggttggatttgctgacaccaagtgtgaacttgccagtcgaagacttggtaagtggaggcagcagagaagtattaatggtaggcttctccgacgtgacgtcaacgccgcggcacgccgtcaccacgacgctcacgccctggttaacgatgtggatgcactcgaacacattcatcgagttgtcgtggttggcaatggtgatgtcgaacatgtaaatgtcgttcacgaggtggtacacgacgcagtagcgactctcgacatcgatgatgacctggctgctggacgccgccaggggatcgtcgccaatggactccgcggcataggcgtcgtcgggcgtggagtgcttaatggcggcgaaggcgcggcacgtctgacgaaaggcagagagtag

SEQ ID NO: 66671 - DNA, 330 bp, Glycine max
  Peptide Sequence Number=SeqID_158356
atggtttcttctaattgtgcacccacatgtagtaatggcactacaactgcaggcaataacaacaataacaacaacaacactgatcaaactactgccccacctttgtacttcagtaatagtgagaagttgaggttgccaaagaaagaaggccgttcctcaacaacttcttctcctctcatcaagaattcttcttcttcttcttccactcagagaaagtgtgcttttgctagaaagtgtgctaggctggtcaaagagcaaagggctcgtttctacatcatgaggcgctgtgtcataatgctcatatgctggcatgagtacaatgattcatga

SEQ ID NO: 66672 - DNA, 2049 bp, Glycine max
  Peptide Sequence Number=SeqID_158357
atggatggagagttctgtgatgatgcatctcaaaataaagatggcatgaatttagatgaaaaaggaaaaatatgcaacaaagttggtgaaatggatgttgatgagtgctatagcgaccataggttctcggaaaacagtagacttgtgaagaacattggaaaagttgttcttgatcttaggaatcttggatttacttccatggctgaagatgcttatgcttctgctatatttttactactgaaggcaaaagtacatgatgtagctggtgatgattttcggagttctgttttacaatctattaaaagctggatacaggctgttcctcttcagtttcttcatgcacttcttgtctatcttggtgatgtcgttagttatgagagtacttcatcaggtctgaaatcacctttggcaccacagccatcttcatgctgtcctggaattgatactccctctgaagggcttgtaaggtggaagttgcggctggaatattttgcatatgaaacactacaagatttaagaatagccaaattattcgagataattgttgattatcctgagagctctccggcaattgaagacttaaaattgtgtcttgaatacactggacaacattcaaagctggtggaatcatttatttcagcactgcgttatcgcttgcttactgcaggcgcgtcaaccaatgatatattgcaccaatatgtttcaactattaaagcccttaggacaatagaccctgcaggtgtttttcttgaggcagttggtgaacccataagggattatctaagaggaaggagagataccataaagtgcatagtaaccatgatgacagatgggactggtgcacattcaagttcatctggaaatcctggagatagccttcttgaagagttgaacagagatgaagagattcaagagaatgctggtgttgatgattttaacactgatgataggcaagcatggatcaatgccatgcgatggcaacctgaccctgtggaagcagatccattaaagggaagcagaaaccaaaggaaggttgacatacttgggatgattgttagcataattggttccaaagatcaattagttcatgaatatcgaactatgcttgccgagaaacttctaaataaatcagattacgatattgattcagagatacgtactctagaactcctcaagatacactttggagagagcagcctacagaaatgtgagattatgctcaatgatctaattggctcaaagagaaccaacagtaacattaaagctaccataaatcagccatctcagacaagtgttgaagtgggagacaatgcaatatccatggatgcaatttctgctactatcatatcttctaatttctggcctccaatacaggatgagccccttaacctgcctgagcctgttgaccagctcctatctgattatgcaaagagatttaatgaaatcaaaactccccgtaagctgcagtggaaaaaaagtcttggaaccatcaagctggagttgcagtttcaagatagggaaatacaattcacagtagcgcctgttcatgcatctatcattatgaaatttcaagatcaaccaaattggacctctaaaaaccttgcagctgctattgggatacctgcagatgttttaaatcggagaataaatttctggataagcaagggaatcattgcagagtcgcaaggggcagattcctctgaccatgtatacaccattgtggaaaacatggctgagacaagtaagaatggagctagtactggttgtgctcaggaacttctaggaggtgaagaggaggaagagagatctgtggcatcggtggaaaatcaacttcgtaaggaaatgactgtatatgagaaatttatcctggggatgctcacaaactttggtagcatggcattagaccgaattcacaatactctcaagatgttttgcattgccgatcccccatatgacaagtcactccagcaactacaaagctttttgtctggtctagtttctgaggagaagttagaacttcgggatggaatgtactttctaaagaagtag

SEQ ID NO: 66673 - DNA, 96 bp, Glycine max
  Peptide Sequence Number=SeqID_158358
atggagtttgaaatggtccggggaataagattggagctgtgtgctggaatttgtgggtggtcgacatcttggactcctgaggtattcataccttag

SEQ ID NO: 66674 - DNA, 822 bp, Glycine max
  Peptide Sequence Number=SeqID_158359
atggcatttggtggtggtggatttgcaatcagttatgcattagcaactcaactagcaaaaataatggatggttgtctaagtagatatttctttttttatggttctgatcaaagagtctgggcatgtattcatgaaattggggtgccccttaccagagaaaatggattccaccagtttgacataagagggaatccatatggttttctagcagcacaccccttggtaccacttgtatcactccatcaccttgaccaattgagctccttgtttcccaaccagactcaaataaactcaatgaaaaagctcatcagtgcataccacattgaccctgcgcggatagtgcagcaaatcatatgctatgatcataagcgcggatggtcgatatctatttcatggggttacactatacaaatctatacagcattgttgatagcagcagacttgcagatgccattgcagacatttcagacttggcgaagttcgatgaatggtcccttcatattcaatactcgacctatgagctctgatccgtgccagcagccaactatgtttttcctggaccaggctacaaaggtgggaaaaagtggaagtatcactatctacaagagacatgaaggcaatgaatcaaagtgcttgagatcaggcaccaataatttggaattgcaaagaattagagttactgccttgaagctggatccagaatattggaagaatgtaccgcgcaggcattgctgccaattattgggtggtggaagcataaagaatggcagtatggatatcaggattaagaagtgcagatctcacgaaacaattactatttaa

SEQ ID NO: 66675 - DNA, 3771 bp, Glycine max
  Peptide Sequence Number=SeqID_158360
atgggacgtctgaagctgcaagctggtatcaatgcaatagaggaagaggaacctgaggaatgtgatgctgcctatcctaacaaaactactttggcatgcatgatcaattcagagtttggtgctgttttggcggtcatgagaagaaatgtaagatggggaggtcgttatatgtctggcgatgatcagctggaacactctcttattcagtctttcaagacagtaaggagacaaatctttttgtggcaccaccatcagtggcaagctatcaacccttctttgtatctacagccatttttagatgtaattaggtctgatgaaactggtgccccaattactggtgttgctttgtcatctgtttacaagattttgactcttgatgtgatcgatcataatactgtcaatgttgaggatgccatgcacttggtggttgatgctgtcactagctgcagatttgaggtcactgatccttcttcagaagaagttgttttaatgaagatactacaagttctcctagcttgtatgaaaagtaaagcatctataatgctgagtaaccaacatgtttgcaccatagtgaatacttgtttccggattgttcaccaagcaggaagtaaagaggttggcaacacagaccatgcattggttaatgggagcactaatttgaaacaggagctggtggggaaaaaattcatacaaaggggaattggagcaggggagaggacaatacttttcataaccggaggcctagataatgagtatgcatttggaagtagacaattggagaatggcagcatgacttctgaatatgataatcagtcattatccacaaactctgctcccaatgatgcaagtgttgtgaaagcaactgtgatggacaaaaacacagcgataactattagtggcaaggagggtggaccatatgatatgcacctcatgactgaaccatatggtgttccttgcatggtggaaatatttcactttttgtgttctttgctgaatgttgtcgagcatacgggaatgggtcctagatcaaacacactagcatttgatgaagatgtgcctctctttgccttaaatttaattaattcagctatagaacttgcaggaccttctatttgtcgtcacccaaggttgctgaacttaattcaggatgaattgtttcataatctgatgcagtttggtttgtcaatgagtccccttatactttcgatggtgtgtagcattgttctcaacctgtatcgtcatcttcgtacagaactcaaattacagctagaagcatttttttcttgtgtcattttgagacttgcacaaagcagatatggggcttcataccagcagcaagaggtagccatggaggcccttgttgacttctgcaggcaaaagacatttatggtagatatgtatgctaattttgactgtgacataacttgcagtaatgtctttgaagaccttgctaatttattgtccaaaagtgcatttcctgtgaactgtccattgtctgccatgcatattcttgctttggatggtcttattgctgttatacagggaatggctgaaaggatagccaatggatctgtaagctcagaatattctccagttaatcttgaagagtatactccattctggatggttaaatgtgagaattataatgatccaaatcattgggttccttttgtccgccgaagaaagtacataaagagaagactgatgattggtgctgaccactttaatcgtgatcctaagaaaggtctagagtttctccaaggaacacatcttttgcctgacaaacttgatccccaaagtgttgcctgcttcttcagatacactgctgggttggataagaatcttgttggtgatttccttggaaatcatgatgaattctgtgttcaggttcttcatgaatttgctggaacatttgatttccaagacatgaacttagacacagctctgcgtctattcttagagactttcagactgcctggagaatcacaaaagatacatagggtgcttgaagctttctctgagagatattatgaacaatcaccacatatcctagctaacaaggatgctgctcttgtgttatcatactcaatgataatgcttaatacagatcagcacaatgtgcaagttaaaaagaagatgacagaagaggattttatccggaataataggcatataaatggtggcaatgatctgcctcgagaaatgctgacagagatttaccattcaatttgtaagaatgaaattcgcacaacccctgaacaaggtgttgggtttcctgaaatgacaccaagtcggtggattgatctaatgcataagtccaaaaaaactgctccatttattgtatctgattctaaggcttaccttgatcatgatatgtttgccataatgtcaggcccaacgattgctgccatctctgttgtatttgatcatgctgaacaggaagaggtataccaaacatgtatggatggattcttagctattgctaaaatttcagcttgccatcatcttgaagatgttcttgatgatctggtagtgtctctttgcaagttcactacacttttaaacccatcatcagttgaggaaccagtccttgcctttggagatgacatgaaagcaagactggcaactgtgacagtgttcactatagcaaacaggtatggggattacatacgcacaggttggagaaatattcttgattgcatcttaagactgcacaagcttggtcttcttcctgcccgtgttgccagtgatgcagctgacgaatcagaacattctgctgaaactgtgcatggaaagcctattatgaattctttatcctcagctcatatgcaatctattggcaccccaaggagatcttcaggattgatgggtagatttagtcaactcttatctcttgacactgaggaaccaagatcacaacctactgaacaacaacttgctgctcatcagcgcaccctacaaaccatacagaagtgtcatattgacagcatattcacagagagtaaatttctgcaagctgaatctctattgcagctagcaagagcactcatttgggctgcagggagaccacaaaaaggaaacagcacacctgaggatgaagatacagcagttttctgcctggagttgctgattgcaatcactttgaataacagggatagaattgggattctttggcagggtgtgtatgaacacatatccaatattgttcagtcaactgtaatgccctgtgccctggtagagaaggctgtttttggactcctgcggatttgccagcggttgcttccctacaaggagaacattgctgatgaacttctgaggtctttgcaactggtcttgaagcttgatgcccgggttgcagatgcatactgtgagcagattactcaggaggtcagtcgccttgtgaaagcaaatgcttctcatataagatctcagttaggatggcggacaattacatcactactttccatcacagctagacacatagaagcatctgaggctgggtttgatgcactattgttcataatgtctgacggtacccacttgcttccagctaactacgttctctgtgtagatactgccaggcagtttgctgagtctcgcgttggacaagcagagcgatctgtgcgggcactagatctcatggcagggtctgtcaattgcttggccctgtggactagtgaggctaaggaagcaatggaggaggaacaagtgtctaagttatctcaggatattggagaaatgtggttgagactagtacaaggtctaaggaag

SEQ ID NO: 66676 - DNA, 2496 bp, Glycine max
  Peptide Sequence Number=SeqID_158361
atggtagcagagtcacaacaaagcagtagcagtagcattaacagaggagcaagatggtctctcaatggaatgacggctcttgtcactggcggcacccgtggaatcgggcacgccatagtaaatgacttggctgcgtttggcgctgcagtgcacacttgttccaggaaccaaacagagctcaataagtgcttacaagaatggcaaagtcaaggcttcgaggtaacagggtcggtgtgtgacgtgtcctcaccaccgcagagagagaagcttattcaggaagcagcatccaccttcaatggaaaacttaacatctatgtaaaccattgccccattgtggtcaaaaacaaagtttatggttggggttctaaaccttttaggattctaaatggttggtttcaagatagaagattctttgaggtggtgaaggaagcttggaagaagcaagatgttgaacaaggggatttaaatgaagcacaattcaaattgaagctccaactccaagaggactcttggatagtagcaacattcaatgaatccttgcttctacaaaaatcaaggggtatgtatatggatggtatgtggctagaggagcccataaaggtgaaggaggaagtgaagaatttttttgaaaatagattcatggaagacaaatataagagacctaaacttgacggggttaatttcaaaagaatcttgaatgaagacaatggcatgctcttggaggagtttgaggaagatgaggagttttgggagatgatgaaacttaatattatgatattcttgaaggagtttcatagacatggagtacttccgagtggtacaaactcttcttttactgctttgatagccaaagttgctttggagttattggggtggagagccattgagaggtgtgctaatgtgttgaattgtaaagttctcactttgcctttcatttatcttggtttactaatcggtgctaatcataggagggatagtttgtggggtcaagttcttacttctaagtatgggggttggcatggtctaatgggaaatagtgctttatcttggaaatctctttggtggaaggatttgaagaaactttgtgggagtgaggtggacaatccatggtttgatgagaatattctgtggaagattggaagaggagacaagtgtaggttttggaaagatgtaaacaacgttggagtaaactacagaaagccaaccattgagtacagtgctgaagaatattcagagatgatgacagttaatttaaactcggcattccatctgtgccaacttgcatatcctcttctcaaagcatctggaaagggaagcattgtgttcctttcatctgttgctggtgtgaccagcatgggtactggatctgtctatgcagcaagcaaagctgcaattaatcagcttacaaaaaaccttgcttgtgaatgggcaaaagacaacataaggagcaactgtgttgtaccatggacaaccagaaccccacttatagaacatttgctccaaaatcaaacgtttgtggaagatgttatgtctcggaccccgcttaagcgcattgcagaacctgaagaagtgtcatcgttggtggctttcctttgcttgcctgctgcatcttacatcaccggacaagttatttgtgctgatggaggagtaactgaagaggaattggtgattgaagaaatggcagatgcagcgaagggtacctacagagcctcaagatggtcccttaacggaatgactgctcttgtgaccggtggaactcgtggaattgggcatgccatagtggaggacttatgtgggtttggtgccactgtccacacttgttccagaaaccaagctgaattggataagtgtttgacagaatggcgtagcaaaggttttttggtttctgggtctgtgtgtgatgtctcatctcaaccccacagagagaagttcattcaggaagtcacttccatcttcaatggcaagcttaacatctatgtgaacaatgttggagtaaactataggaagcccacaattgagtacactgctgaagtatattcacaaattatggcagtcaatttagactctgcttaccatctgtgccaacttgcatatcctcttctgaaagcatctggaatgggaagcattgtgttcatttcatctattgctggagtggtcagcttaggtactggatctgtctatgcagcatgtaaagctgcaaccaatcagcttacgaaatatcttgcttgtgaatgggctaaagacaacataaggagcaattgtgttgttcctgccactaccaatacaccacttgttgaacatctgcttcgcaacaagaagtatgtagaagaaatgttatctcgaactcctcttgggcgcatcgcagaacctgaagaagtttctgccttggtggcttacctttgtctgccagctgcctcttacatcacaggacaggttgttcttgttgatggaggattatcagttaatggatttcaaaccagcatgagaataacatga

SEQ ID NO: 66677 - DNA, 240 bp, Glycine max
  Peptide Sequence Number=SeqID_158362
atgggagtcaatgatgaagaacggtggaggccgatccaattgcttgtcaacaacaatggtggaggtggaggtggaagctcgcaacaggatactctagcaagcgacgatgacagaataggggatggagagcgagtagaagtgtgtgagagaagggaatggaattggagagagttgattcgcaaatggagtgaggaaaaggttagggttcatggaattgggggtgtacaaaaaggtaactga

SEQ ID NO: 66678 - DNA, 1308 bp, Glycine max
  Peptide Sequence Number=SeqID_158363
atggaatctgctataacagacactggtgaatgtcaacccctttatcattccatcagagactattatgaaggaatgaacatgaaaattgatcaacaagtaccaatgcttctcgttgggagagaagcacttaatgaagccattgttggggagaagaatggcttccatcacttaccagaaacaaggggcttatgcctttcagaagagcaaactgtcacaagtgtatatagatggccaagaattggaggccatcgattaataagcatgagatctcaagctcaaaggctgcctagaaaatgtgaagttacagctattcttgttctctatggtcttccaaggttactcacaggtgctatacttgcacatgagttgatgcatgcttggttacgcctcaaaggttaccaaaaccttagtcttgaagtagaggaaggtatttgtcaagttctttcttacatgtggcttgatgcagaagtcatgtcatgtgctagaaccacgccctcaacatcatcatcagcttcttcctcctcttactctaactcatcaaagaaaggtgtgaaatctcttgttgaaaataaattgggtgagtttttcatgaaccagattgccaatgattcttccccagcttatggtggtggattcagagcagccaatcaagctgtgaataaatatggtttacgttgcactttggagcatattcgtttgactggttggactgctatttcctcctgttatttcattccccagggggaatgtggtgttcctatatatgtatggatgtccatgtggcgttgggtggtggcatttgggtgcggcgatggtgttgggcggaggttttggggagagacaattaaggcttttgcttggaagatgaaggataaaatgggggatatttgccattttggtagtgcaccaaataaaaatggggcttctcccttcctccttcgtctcgaaaccgtgcatcctcgttcctgtgctcctttgtcattgaaggtcagcttcttcctttctagtgtggttgaggttggtttctggtggggttggggttgggttctggtgaagaatgagaaggacttctacgacgtcaagttggacttgctttgtacctccgatggctgtgggaagaagagttggagaagaagagaaaaacaaaaaaaaggtctagacttgcgttgtgggaagaagaggagaactggaagaagctgggactgcggagaaagaagaggaagaaaggaaattgaggaagaagataaaaggggtatgttagggtttctaaaaaaatgggaggtgcaggatacatttagggaggtgtag

SEQ ID NO: 66679 - DNA, 264 bp, Glycine max
  Peptide Sequence Number=SeqID_158364
atgaataggaagcggggcgggcgagggtctttcattaaaggggggaaaagaggggtggggccgccttgcgcagctttagaaaggagagattttcagaaagtcactctctccaaccttttctatctatccttagaagttgggcgagataaataccggacaatgaccctaacctcagagctcaagctcaaattctgtggttatatcccagaaattgtttcaaacatatatttacattattacatacaatttgttctaaaaacctaa

SEQ ID NO: 66680 - DNA, 210 bp, Glycine max
  Peptide Sequence Number=SeqID_158365
atggcaacgatagggaattgtgattgcgattttgggatcaacgtcgactttcttgaaggcgtgggaagagaagacagcatgcaaaaacagaagcccttatgtgctgaacttcccacatggaccacgttcctcatgttcaggatacccaacggccacagtgatcaaaagcagcaggagcaaccctacgaacttgctcatcttcgtaactaa

SEQ ID NO: 66681 - DNA, 87 bp, Glycine max
  Peptide Sequence Number=SeqID_158366
atggcttgccagggactagacaggaggaaaagcaagagaccaacgctaacaagaaagcgaatggaatttagatgggaatcaaattag

SEQ ID NO: 66682 - DNA, 235 bp, Glycine max
  Peptide Sequence Number=SeqID_158367
tgcttgtggttggtggtgttgggtgtttgacgcagtgcttgtggttggtggtgttgggtgtttgacgcagtgcttgtggttggtggtgttgggtggcggatctgatgcttggctgatggtggtggttcacggaggaggagggtggcggttctttgtaggctcggctgatggcggtggttcacggaggaggagggtggcggttctttgtaggcttggctgttctggcgctttgact

SEQ ID NO: 66683 - DNA, 330 bp, Glycine max
  Peptide Sequence Number=SeqID_158368
atggtggcagctttcatggacgagattgatggggttcagattcacctttctagactggatcatctcacttggagggctgatcctagtgggtcctattctacaaagtcagcatacaacctactcatggaagatggcagttctgattatgaagacaatgcctccaggattttgtggaacctgaaaattcctccaagagcagctgccttctcttggagaatttttaaaaacagattgcctactaaggcaaacctaagaaggaggcagtgtatatgcatatatgttcttggtaagggtaggaatagtgggggcaagatacgcgggttagactaa

SEQ ID NO: 66684 - DNA, 717 bp, Glycine max
  Peptide Sequence Number=SeqID_158369
atgttacttgttagtaaattcatttgcaaattgaaagtactaccccttggattgaaattgtctgtgctccttgagtcagcagtttctacaaacaattatgatccaccttacaaagtcaacggagatgataagatgaaaagtcaatcaataagagcagttgttcatcaagataacaagacaattaactacgagaaccgaactttgacaccaatacagacatcaagtgaccaaacccaagaagccctccatctctttgtctcccaatatcgttcgggtttatcccctgacaagtacaccatcccttgtattttgaatgtttgtgcttgttccgtcgatggaacaactagtgcacatgagcattttcagtgtgtcaagtctggacttgtgcgccatgttttggtaggaagcactcttgttgatatgtacatgaaaactgggaatgttagagatgagaggagagtttttgatgaaaagggtgacagagatgtggtgttttggacttccttgctcgcgggttattcgttgaatgggtttaatgatcaggtgtgggagttgttctctttggccaatcagtgcaagattgttgtaggaatgcaaatccatgcattggtcgtaaagcacagttttgaggtgaaaggacgtgtatgcatccctctaattacaatgctttcaaagtcagggatgataagagatatgcctttagtctattctccttga

SEQ ID NO: 66685 - DNA, 234 bp, Glycine max
  Peptide Sequence Number=SeqID_158370
atgctacaatgcgaagagttttcctctaagctcagatatgattttgaaattcccaacggtgagaatgttcgaaattgggttgcgaacatgatacttaaatttcacgacgatccaacggtgaacgggttcgagatcgtcgtttttctgagactggtttggtgggctgcgggaaaaagaaagggttttgagaggagaagggaaaaaacgaaaatgaggctaaaaggagacagctga

SEQ ID NO: 66686 - DNA, 426 bp, Glycine max
  Peptide Sequence Number=SeqID_158371
atgggtgaagtagaggaggtgcaagagcagatgaaggccgacacagaggccttgaaagagcaaatggccacaatgatggaggccatgatgagcataaaggagataatggaggtcaatgcggttgcaatagccgctacctgcaccattactgaggtggacctgaccccccatagggctcaaccaaataaatcatccaacctcaaatatgccaacttcgagccttgcctcggatatgccactgaagggcaagcagttggtgatatacccctgcaaaatattctggaggggcctcaatttcgcccccaaccacaacccttctatggaaaaatggtgggttacacaccttcaagctttgcggatttgatcttcgccggtgaaaagatcaaagtgggtctggaaagaggtaaatctgatcatccaccttag

SEQ ID NO: 66687 - DNA, 168 bp, Glycine max
  Peptide Sequence Number=SeqID_158372
atggatgaattcattgaactgatgaaagaacataacttggaaacgttgggtctgtctggaatcctcattccttccccgaagcaaaggatagcggaatctcctcaagggagagcgaatagaatgctaaaacccgatttcccaaagaaagggacgggaaaggagaagtga

SEQ ID NO: 66688 - DNA, 186 bp, Glycine max
  Peptide Sequence Number=SeqID_158373
atggctgaagacattgtcgtgttcgaaatgcattgtcgccttttgaagacattgtcgtcttcgaaatgtaaaggagcagatgaccttgattgtctttgcaagacaaaagactatgatagtctttggaaagtaaaggcagatgaccctgattgtctccgcaagacaaaagactatgatagtctttga

SEQ ID NO: 66689 - DNA, 198 bp, Glycine max
  Peptide Sequence Number=SeqID_158374
atggaaaacgccagcaacgcgcttttacggtctggctttgctggctttgctcacatgtcttctgcgttatccctgattctgtggataaccgtattaccgcctttgagtgagctgataccgctcgccgcagccgaacgaccgagcgcagcgagaaacagctatgaccatgattacgaattcgagctcggtaccctatag

SEQ ID NO: 66690 - DNA, 580 bp, Glycine max
  Peptide Sequence Number=SeqID_158375
tggctgctgccagtggcgataagtcgtgtctaccgggttggactcaagacgatagttaccgggataaggcgcagcgcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaattcgacctgcaggcaagcaagctatgaccatgattacgaattcgagctcggtaccccacttcaccagggacacagctccccaaagacctcaacacccctcgacagtgtcgggtgctaggcctatgtcgtttccttacgagaacagctgcgcagttccatggag

SEQ ID NO: 66691 - DNA, 393 bp, Glycine max
  Peptide Sequence Number=SeqID_158376
atgaatgttttgaatggtgtgaccctcttttgtaaaatcactcgtgcacccaacatcttcatgatttgtgtacatagggactcattaggtagcgatcaaggggttcccatgaaccctaagagaataaaggtcattcctgagtggcccactccaccaacaccactcattgagttggtgaggaaccatgttccttcatgggaagatgcccaggaaatgggttttcaaaccttaccttacttcaatataccaaacaccactaatatatatgcttttattctttttacaggtgttaaggaaaaaagcccagagtttctagaacctcgggatttgaggtcaaatccttttcaagggggagggaatgatgcaatcctaccccgcaagggcattggatag

SEQ ID NO: 66692 - DNA, 288 bp, Glycine max
  Peptide Sequence Number=SeqID_158377
atggcgaaaaggtgtgcggataaccataattttctccacatgtcatcgggctcgccgcctctggatgacaaaaggtgcagaatgaccattatttgtgtctgcgtgccaccggactcgatcgtctctggatgggataaaggatcgccgcctctggatgacaaaagggtgcaacttgacaataatttgtctctgcgtgccatcggactcaatcgtctctggatggcgaaaagttgtgcggattaccataatttgtctccgcatgtcatcgggctcgccgcctctggatga

SEQ ID NO: 66693 - DNA, 973 bp, Glycine max
  Peptide Sequence Number=SeqID_158378
atggtggaagagttggaagcatatgagcagttgtatgatatctttaaaggaccacaagttcaaggcaacttatctcaggtttggagaatgaagatccctctgaagttgggtgcatcaaatgttttctgtcctttatgtaattctgaatctgaatctgtgaaccatattctgtttcgtgcacaaaggttctacaaatatggcagaggcgtggaggaagatttcaatgattttgttatatgggttacaattaacgagtgcacagtttatggaatgacagaagtggttattgtgttatttggctgggatgatgaggctttctgtgtatttactaatcccattatgattgttatgatgagcatatgggagaccactggcggtgggtcttttctgaaaggggaaaagccacagggtattgcttttaattattggttagatgctttttgtgagattggtgtatatgctaaagatacgtttctccttccttggggtagtggggtttcaaatacacagactcatcaaattgctgctaggaaggaaaagcagatggaagcattgaaggctgctcttggcatagtctcatctgaagccaatgaaataaatgaagatgggactgatgggcttggaaatgatggaaaaaatggtcctaatgtggagggtaattcaaagcctgaacattcctttttggatagagatttcagtagaaagaaacaaatggttgaagatcaaaaggatgaaaatactaagaagaagagtgttaaagatacaaagcaccacaagaaggttgaaactcgtaagaaaaagtatgaggatgattcatctgattcagacagcagtttgtctgatgagaagagaggtacaaggaagcgtggtaaagagtatacaagcagtagtgatgaatctgattctgatagtgatgctaagaggaagctcaaggctgaaaagaagcggaagatacctaagcaccgcaagaaag

SEQ ID NO: 66694 - DNA, 192 bp, Glycine max
  Peptide Sequence Number=SeqID_158379
atgacagaagaaaattcacatgaaggcgaaagcctgaagaaagtttccggactttataaagactggtttctggactatgcttcttacgtgattttagatagagcgattccatcggtctacgatggattaaaacccgttcagcgaagaattatgcattccatgcgtgagctggaggacgggcggtacaataag

SEQ ID NO: 66695 - DNA, 345 bp, Glycine max
  Peptide Sequence Number=SeqID_158380
atgacgttagtctctgcatgctaccggactctgagtctgacggataacgaaagagtgtttatacggataacctacttgggtatctccgcctgtcacctaacttcacagcgaaagaatgtttatacagacaaccgcttgggtatctctgcctatcacctatcttcacgggttaggattaacagaaatcatttgtgcagacaatcacttgtgtatctccacacgtcacctgacttcatgggtcaggataacagaaagtgtggggtggtcgacaaaagtgaggctcttgctcctacgtatcctcaatttgtgatgaggaactcagacctacgtagttcgtttttgtga

SEQ ID NO: 66696 - DNA, 966 bp, Glycine max
  Peptide Sequence Number=SeqID_158381
gctgaatttgatatccctgaagcatttgatcagaggacaaaaaagaaaatacttcagactatgggggagcgagacccttcgtgggaggatgtgccgaaaaaggcacaagccatccagaagcaaaacactgccctcctcgtgttgtctcgtaggggttatgaatatttagaaaagaagatgatggatgagaagacaaagaaaaaactggaggaagctgctcaaaccggaagcattgacaccgtgattgatccttcttcttccatcagacaacacgtcaaatggaagatggcccgcataaagaaaattggccagatgacatctgaggcagcaaagcaaattgctgacaagattgattcgttggaggagcaggcgtcacagggttcctttgtcacccatggacgtcaggatatgcagtcccagtttcagtcacagaggcaatcacagggacttgcactgcctcctgagcctgaggttggtccttcagttgcttgtgtcagcataaaggagagttgtgttgatcccttagggaacgatctagacacaggaagagtttatgagggatccacaaccattcacaacatccctttgttgcatgatcaagtgaagttcggtattgaggaggttaaagatgcagatgctcccattcctatacccactgaagaggttaagttagtggggcatgcacttaacaccttccttgcttggccgacaaatctcgtcaagcgtttatcagaacagggagctgtgggaccgacaaaatctgcagataggccagatcatgaggtcgatgatcccctatatctaatgacattgatcatccaacagctttttttgaagccattgcaggttatgtgggatgctaccgtgtttggggtgtttaatgaagacttccccttgtacataaagcatgaagatctgtctgaaatagcacacagtggtcaatgtctcagcatctctgttatatag

SEQ ID NO: 66697 - DNA, 1117 bp, Glycine max
  Peptide Sequence Number=SeqID_158382
atgccggctgcagcagcagcgcaaacacctgctgcagccgctggccgtaatagccttcaaacgccacgtccagcgcatccaccacggtggtcgaacagttttttgccgtcagattatacaggctgtcaccacgtcggcaatctctgccgccagcgaggggagaaaacggccggggcgatcgttaatctgtccggccagcagcagatgcggcagctcgtgcggttgcggatcgatctcctgctgcggataaaggctgatgtagccgcactcgccaaagctcagtgccgcgtggccggtacaaaagtgcccttcaccgttaatcacgccgatgtaacggtcaatcacatagcgcttcggctgttgactggcttcagactgcgcctgccagacgtggacacagagaggaaatgccgcggcgaccggcggaaagcgggcctgctgccacggccggagccgcgcaatatgacgatggccgcgacaaaaccacggcagcagcgtaacggactgacccgccggcaggcgctgccactggcgccagacgcgccacaccgtcaggctgaacgaaagcagcaacagcaccagccagctgcccagcaacaggcaggtatgcaggttgtcattgaaaaacagcaccacgctaagaaccatctcgccgcagcccagcataaaatgccgcacccagcgctggcgctgaatcagcgccgcgctcaggcagcgaaacaggccgttaaacaacaggcagatttccatcaccgtcagcagcagtttcttcagttgcctttcgtcaccgtgccacagcgcgccggccagcagcgtaccgacaaaaatcagggaaaacagcagattgagccagcgctgcagcgacacctcgccgctcagcagattgatatgcccatcgaccagcacgtccgccacgatcatgccggccagcagcacgccgcacagcgccaggccataaatcagcagacgataacgcaccagcagctcgcgtccggccagcagcagcaagacggggcgagcctggctgcaaccggcacgccattgcgctggggtttaacacataggtggctaagtttctctgagttgcgcgctgcattcagaaaagacggattcaccg

SEQ ID NO: 66698 - DNA, 1890 bp, Glycine max
  Peptide Sequence Number=SeqID_158383
atgcaagagaactacaaaattctggtcgtcgatgatgatatgcgtctgcgcgcactgctcgaacgctatctcaccgaacagggctttcaggtgcgcagcgtcgccaacgccgagcagatggatcgtctgctgacccgcgaatcattccatttaatggtgctcgatttaatgctgccgggcgaagatggcctgtcaatttgccgtcgtctgcgtagccagagtaacccgatgccgatcattatggtcaccgcgaaaggtgaagaggtcgatcgtatcgtggggctggaaatcggcgccgatgactacattccaaaaccgttcaacccgcgtgagctgctggcgcgaattcgtgctgtgctgcgtcgtcaggccaatgagctgccgggcgcgccgtcgcaggaagaagccgtcatcgccttcggtaagttcaaactgaacctcggcacgcgcgaaatgttccgtgaagatgagccgatgccgctgaccagcggagagtttgccgtgctgaaagcgctggtgagccatccgcgtgagccgctgtcgcgcgataagctgatgaacctggcgcgcgggcgtgagtacagtgcgatggagcgttctatcgacgtgcagatctctcgtctgcgccgcatggtcgaagaagatccggcgcatccgcgctacatccagaccgcgattgcgcttctcaccccgcagttcgtttgcccgcaccctgttgttgatcgttaccttgctgttcgtcagcctggtaacgacctacctggtggtgctcaatttcgccattcttcccagcctgcagcagttcaacaaagtcctcgcctacgaagtgcgtatgctgatgaccgatcggctgcagctggaggatggtacgcagctggaagtgccgccggccttccggcgcgaaatttatctgaacagatggcgcagcagctgggcgggccgaccgacgtgcgggttgaggttaacaaaaactcgccggtggtctggctgaaaacctggctgtcgccggatatctgggtgcgcgtaccgactgaccgaaatccatcagggcgacttctcgccgctgttccgctataccctggcgataatgctgctggcgattggcggcgcctggctgtggggaaaggcattattccgccgccgctgcgcgaatacggtgcttcggaagtgcgttcggtgacgcgcgccttcaaccagatggcggcgggcgtgaagcagctggccgatgaccgtacgctgctgatggccggcgtcagccatgatctacgcacgccgctgacgcgcatccgtctcgccaccgagatgatgggcgaggaagatggctacctggccgagtcgatcaacaaagatatcgaagagtgcaacgccatcatcgagcagttcatcgattacctgcgcaccgggcaggagatgcaaaccgagcgtgccgatctgaatagcgtgctgggcgaagtggtggcggcggagagcggctacgagcgcgagattgagaatgcggtgatggacgcggagctgatgctggatattaatccgctgtcgattaaacgcgcggtggcgaatctggtggttaacgcggcgcgctacgggaacggctggatcaaggtcagcagcggtcaggaattaaatcgcgcgtggttccaggtggaggatgatggtccgggcattaagccggatcagttacagcatctgttccagccgtttgtacgcggcgacagcgcgcgcagcaccagcggcaccggtctgggcctggcgattgtgcagcgtattatcgatgcgcatgacggatcgctggagattggcgacagtgaacgcggcggattacgtatccgcgcgtggttaccgattccggaaaacagcgccacgacggcagtaagcagtactgttagttaa

SEQ ID NO: 66699 - DNA, 1062 bp, Glycine max
  Peptide Sequence Number=SeqID_158384
atgacgtcagcataccgaagcccgcagcattgtgcgacacgcagcgcgggtcatcatggtgacatacatttgcccactgccgctaacaacttcttgttatctgcacacatgagcactcttatcgtcattctggctgtcatgctggcctgttcgttagtggccggaatcggctactggtacgctatgcggcatcgtccgccgttggcgaaaccactgccgtttatcagtccgccctgccgtaaactcaccgatgaagaacgcgctgccgttgagaagtatattgcgtcgctgggtaaagcgcgtcagcacagcggcgggcgatcgacccgatcgtcacgggaacccgaagcgctggcgctgaccgcacagagcaataatgtttatcccgttacccgctccatcacccgttacggcctctccactgacgatccccacaaatggcgctactacctggatgaagtcgaggtgcatctgccgccgctgtgggagcagtacatcgctgaagaaaactacgtcgagctgatccgtacccagaccctgccgcttggtgatctcgctcaacggccactcgctggtgaactatgcggtggaacaaccggcgctgccaccgctggtgcggccgatgtcgaccaacgcttcgattccgagcgccatttgctgcgccttcctgctgtttttcctcagtctggtgctgcccggcagcctgatgctgtggattgcgctgcccgccggcgcgatcgttgctgtcagcctgtggagcagagcaacatctcgctcggcatcatcgacttaatctatccggcacactggcagccttatgtggcgcatgacctgggccaggtaacggatgtggatatctacctgaatcgtcaggtggtacgccaggggcgcttcctgtcgctgcaggatgaagtccgcaacttcccggtacagcgctggcgtaaaaacctggtgctggcgtgcggttcgctgctggtgctggtgatgctggtgagctggattccgctcagcatgccgatcaaacttagcctcgcctggttaaaagggactgagagcgtggaa

SEQ ID NO: 66700 - DNA, 369 bp, Glycine max
  Peptide Sequence Number=SeqID_158385
atgttgacgaagccaccatccagttcgtcgccatattcgattcttcattgtacccgcagagggaaggtgatgagaatcatgaaactggccaaatacaggctaaaggcccaagtggagaaggacaaaggcctaagtggagaaggacaaagcccccgagtggagaaggatgaaggcccaagtaatccttgtggcgtctacccagacttatcttccttcaccggaagtggcgtctacccagacttattgatgagaatcatgaaactggccaaatacaggctaaaggcccaagtggagaaggacaaaggcctaagtggagaaggacaaagcccccgagtggagaaggatgaaggcccaagtggagaaggatga

SEQ ID NO: 66701 - DNA, 159 bp, Glycine max
  Peptide Sequence Number=SeqID_158386
atgctccaaccatgtgggatcgacacaggcttaaaggagcactcaaactgggtgacgcccaagggctacactccgaagagtccgtcagggcctctccctcctgattcaaacacggttcatgaattatacaatacccacgacctcacactcgtgttttaa

SEQ ID NO: 66702 - DNA, 591 bp, Glycine max
  Peptide Sequence Number=SeqID_158387
atgaatatacctgattcagaagggaagaacttgcatcagtatctcaatttcaattcaaacatgggtttgattcacactccatgttctgagaaatatttaccatccgaaaaaaggaaaaaacggagtccttgtctaaaaaaatgccttgagaaagggcagatgtatagaacctttcaacaagatagtgttttttcaactctctcaaaatggaatctattccaaacatatataccatggttccttacctcgacaggggtcagatatattataggcgagatccacatctatgaattgaaaggtccgaataatccactctgtaatcagttattagaatcaataggtcttcaaatctttcatttgaaaaaatggaaacccttattattggatgaccaagatacttcccaaaaatcgaaattcttgatcaatggaggaacaatatcaccatttttgttcaataagataccaaagtggatgattgactcattccatactagaaagaatcgcaggaaatcttttgataacacagattcctatttctcaatgatatcccacgatccagacattgctgaatcccgtgaaaccatttcatag

SEQ ID NO: 66703 - DNA, 804 bp, Glycine max
  Peptide Sequence Number=SeqID_158388
atggctccgagaaagcttttcgcaaagagatctaggaaggacgccgcggctgaagggaccagtgccactcccgagtttgacaaccatcgtttcaggagcgctgagcaccagcagcgttttgaggccatcaaaggatggtcattccaccgagagagacgcgtccagctcagggacgatgattacacagattttcaggaagagatagctcgccggcgttggatgtcgctggtcactcccatggctaagtttgacccagatatagtcctagagttttacgctaatgcttggcccatggaggagagcgtgcgtcacatacggtcatgggtaaggggccagtggattccttttgatgcaaacgccatcagccagttcctgcgtgatccgctagtgttagaggagggccaggagggccaggagtgcgagtttagtcagagaaggagtcgggccgatcgatttgacgaggaggccatcgcccagctgttatgtatactgggtcaggattttgcccgaaccgctgccgggaggcgggtgcggatcatgcgcaccagcatgaccacattgactcagatgtggatgacgttgctgctcagcaacgtcctgcccagcgatcataactctgacctccctttgccaaagtgtccattggtgtatgccatcctgacacggatgagcgtccatgtggctcagttgatcgctgacgccgtttatttatttgcaggtatgccacctaccaggcaccctctagacccggataagtctaacagggccttggggtttccagcattgatcacgggtctctgctag

SEQ ID NO: 66704 - DNA, 498 bp, Glycine max
  Peptide Sequence Number=SeqID_158389
atgagtgaggtagaggaagttcaggagcagatgaaggctgacatggaggccaagaaggaccaaatggccaccatgatggaggccatgttgagtatgaagagaataatggaaagcaatgcgactgcagttgccactactagcgccaccgctgaggtggatccgacccacctatctggcataaatcaaatgagtcgtccagtcctaaacgtggtaggtcagggaggagaagcattaggaagtatgggcggtccccatgttgtgcaaagcaagaattctctcctactatacggcttgcctcccaactacacaccacccaatgttcgcgcatccatcgctaagcgtagcttcagcgctcttagcatggtagaagaatttggtagagcatcaatatcaaggccgcgcgctaagcgcgagatcagtgcactaagcgcaactattgtcttcagccaggctcagtgcatgactgacgctaagctcaaatccacttactcgcgctaa

SEQ ID NO: 66705 - DNA, 2490 bp, Glycine max
  Peptide Sequence Number=SeqID_158390
atggggaaggcgaaggggaagcaccgtttggacaagtactaccacctagcgaaagagcacggttacaggtctcgagcctcatggaagctggtccagctcaacaacaagttccacttcctggaatcggcgcgcgccgttctcgacctctgcgccgcccccggagggtggatgcaggtggcggtcaagagcatgcccgtgaaccaccttgtgatcggcgtggacctctcccccatcgcccccgtccgcggcgccatcgccatccaggaagacatcaccaggcccgagtgcaagtcccgcatcaagaagctcatgaacgaccacggctgccgcgctttcgacgtcatccttcacgacggttcccccaacgtcggcggcgcctgggcccaggaagccaccagccagaacgctctcgttattgatgctgtcaagttggccactcagttcttagcccccaagggcatctttgtaaccaaaattttcaggtcgcaagattacagttctgtggtgtattgcttgaagcagttgtttgagaaggttgaggtggataagcctgcggctagtcgttctgaatcagctgagatatatgttttggggcttaaatataaggcccctgccaaaattgatccgcggcttcttgatgtgaagcatctctttcagggatctgtggaaccgcagcctaaggtggtggatgtacttagagatagtaagcaaaaaaggcaccgtgatggctatgaagatggagacacaactttgaggaagctgtcttcagctgcaaatttcatttggtcaaattctcctctggagatccttggttcagtcacttccataacctttactgatccagctgattcaccaatcaaggatcatgacctaactactgaagaggtaaaatctctctgcgatgatttaagggttctggggaagcaagacttcaagcatcttctaaagtggaggattcaaattagaaaagctctttcaccaactcaaaagcctgattctaccaccacagaacagatgggaaatgagcctaaggtggatgaagaagatagaatactcaatgaaatggaggaattgacttatgtaatggaccgcaagaagaaacgtgcaaagaagcttcttgcaaaaagaagagccaaggacaaggcacgaaaagcaacagggatgcaaatggatgcaatagatgatggttatgtagatcaggagttgtttgctctttcctctatcaagggtaagaaggatctggtagctgttgacaacactgagtatgaaggtgatgaaggagaactagaagacagtgagaatgaagaaacccatgaaagcccagagcattcatccggtgacttagaagattctgatgaggaacgtaaaagatacaacgaacaaatggaagatttaatggataaagcttatgagcggtttgtgatcagaaaggaaggaagtgcaaaacagaggaagcgaattaaaaaatcttatgatgcaaaggaccaacttttggagggtggtgaggatgatgatattgttcaatccaagtatgattcagatgaagatcagggtgatcaagaagcaaatccattaatggtgccacttaatgatggggcagagctcacccaagaggaggtcatgaataagtggtttagtcaggatgtctttgctgaagctgcagaggaaggagactttgagaaggatgagagtaaagatgaaatggatatagatgagcctaaggagaagatatccattgccaaaaaggtcaaagaaaataaaacagcagctccagcagtggtagctcaccctcagcctcaaccatccaaagcagcggatgactttgaaatagttcctgcacctgatactgattcaagtgatgattcatcctctgatgaatgggaagaagatactgaagcaaaagctgagatattggcttatgctaagaagatgatgaggaaaaagcaacgggagcagatgctggatgatgcatacaacaagtacatgtttgatgatgaaggactgcccaagtggtttctagatgaggagaggagacatcgccaaccaataaagcctattaccaaagaggaaattgctgcaatgaaagcacagtttaaagaaattgatgctcgacctgcgaagaaggtggcagaggccaaagcacggaagaagcgtgttgcaatgaggaagcttgagaaggtacggaagaaggccaatgccatatcagatcagacagagatatctgatagttcgaagaggaagcaaattgaacaactatataaaagggctgttcccaagaggcctaaaaaggagtatgtagttgcaaagaaaggtgtccaggtaagggctggcaagggaaaagtccttgttgatcgcagaatgaagaaggatgctaggaaacatggaatgggtaaggctggaaaaggaggttctaagacgaagggcaaggctccaaagggcaaaggatcttcaaaggcctctgctaagaaagggaaacagagaactaaatga

SEQ ID NO: 66706 - DNA, 1968 bp, Glycine max
  Peptide Sequence Number=SeqID_158391
atgttgcattgtctcaacacttcggggaatctaggagccacctgttcggacatgacagtgttggaaagacaacgggaagcaaccatcaagtggcagcaacacctccagaacaaccaaccaccctacttaacggactttaacgttaacgttaacgccgtcttctcttcttcttcttcttcttctcagagtcagggcctggtcatgaatatttgcgctgattccgcgctcggcgaggtcctaactcactccgtcaaacccgacccgggtgtctggcccgaattcgacgccggattcggatcctcttccggttttctacccaccatttcgccaacttgtagcagaggcggagacttggtttcacccaaggaaaacatggccagtgcgaaagaaaacactaagaagagaaaacctcagaactccaaggttgttgcggcgagtgataataaacaggacaagagagtcaaagcaagtggtgaagaaggagaatccaaagtaacagagcaaaccagcaacaagaatggcaaatccaacgcaaataaaaacaacaacagagaaacaacctctgcggagacttccaaggataattcgaaaggctccgaggttcaaaatcagaagccagagtacattcatgtccgagcgcgtcgtggacaagccacggatagtcatagcttagctgaaagagttaggagggagaagattagtgagagaatgaagtatttgcaagatttagtaccgggttgcaacaaagttgcagggaaagctggaatgcttgatgaaattattaactatgttcagtctcttcaacgccaagttgagttcttgtcaatgaaattagcggctgtaaacccaaggcttgacttcaaccttgacgaactatttaccaaagaggtgtttccttcttgtgctcaaagttttccaaacattgggatgccattagatatgagtatgagtaacaacccttcgtatctaccatttaattcagcgcagcaacttgtatcgtgctgtggtggactaataaacaacatggggataagccctccaaacatgggactccgaaggaacattagtactagccctgtacctttgcccgaaacgtttcttgactcgtcctgtttcactcaaattctaccctcctcaaattgggaaggtggtgatttccaaagcctttacaacgttgcttttgatcaagggcgaacagcatcttttccttctcagccatttacaggtgaccatctatctaaacataacatctatgaaatgggtcttcgaaagcatccttctccttaccagatgaacatgtcattcgtcaggattggagatccagttagcaatttgcctcttcttcggtacgaggagattgtgaagtctatcctaggagtttctgagtgccttggaacaggcaagtatctggggatgccctctatggttgggaggaggaagcgggctgtcttcaactatctaaaagacagagagttcaggaaagtggataaattggttggggtgggatcggttagcagtgcagaaagaaaatggaaatttgtttttgatcaagatgctatggtgtctagagtcttcaaagccaaatatttacccaaaagggctgatcttgttgatgataggaccaaacattggaatctggagcttgctggtaatttgcttcagcagcgtgatctgggggatgatgctctagtgtggagtttggccaaggatgggagattctcagtaagggatgattctagttgttttattagtgcaaagtcagcacttttcctaagttctctaaaaccagtagaggcagaagcaatggcttttcttgaagctattaattggctgactgaaatggggtatgacaaagctattttagagtctgattgtcaagatatggtagaaggaatcctagcaaattgtatagcaaacattgaattaggggccattatcagcaaaggcggcacaatttattatcaatga

SEQ ID NO: 66707 - DNA, 519 bp, Glycine max
  Peptide Sequence Number=SeqID_158392
atggcctcaagctctctcagcaaacaaaaggcttctgactcctcttggacgccaaaacagaacaagctgtttgaaaaagcacttgcaaaatatgacaaggatacccctgagcgctggcagaatgtagccaaagcagtaggtggaaaatctgcagatgaagttaagagacactatgaaatcctcttggaggatctcagacacatagagtctggccgtgttcctcttcccaagtacaagtccacaggaagcagcaccaatgttgatgaagaagagagcttctgccaggtgacgtggatcgaggcttctagaatggctctgcacagatttcggaacacttcctctggctcaatttggtatgagttggcttacattgaggcaaagtgtaaggttaagaaggaaaaccgtatgtggcagattgcgtttgggagtgggttcaagtgtaacaatgcagtgtggaaggcagagttacttggttatcagtatagtgtctactgcaacctttattactacttgttataa

SEQ ID NO: 66708 - DNA, 543 bp, Glycine max
  Peptide Sequence Number=SeqID_158393
atggggagcagattcggcaaggggaggtcggttgcggtgttctgtggctccatcgctaagggctccactggtggcgacaaatttgttttgggtttgggatggtgggaaactaccattggaagtggggctgacatggggacatctgttggtagggattgtgcagaagaggaagacacagagagttggttgggtatcatgcttaaagtccatggaggcttaggttgtggccaagcggaattgagtggcagcgagtttgacaatgacaacctcgagacggtccaggttgacggaggaagagggagggatcctgcaagatcttgcaaccttgttgttgcactacatgaagttagcaaggaacttgggcttttgttgtacccgtttgggcttgtacctcacagagatcgagaagatggttggtttggaaagaaaataatgtgggtaaatataatgtacattcagcatacagagttattcagaggaatagcgtggagcaacaaaatgttgagatctttgagtcattatggaagattgatattccactga

SEQ ID NO: 66709 - DNA, 1194 bp, Glycine max
  Peptide Sequence Number=SeqID_158394
atggcctcatcctcacgtgcaaggagcagctcgccattctcgcaccgcaaaccctccactcctctctcctcagcttcctcttccacttcttccttcacgaacggacgcgtaatgcctcgctcctgttcctcttccacgtcatcgttttacaactccggtggtggtggtcgatccatgactccgagtcgcggtcacagcgagtcagtctgctacgattacggtaatccttcgccggtggagttcgggatggacgaggaggtgatcacggagcctgtggattcgtcccgagctcgggatagcatttctgtcacgattcggttcagaccgttgagtgaaagagagtaccagagaggagacgagatcgcgtggtatgcggacggtgataagattgtgaggaatgagtataatccagctactgcttatgcatttgatagagtgtttggaccgcatacgaattccgacgaggtgtatgaagtagctgctaaacctgtggtgaaggctgctatggaaggtgtaaatggaactgtgtttgcatacggtgtgacgagtagtggtaagacacatactatgcacggagaccaatattctcctggtatcataccgctggctatcaaagatgttttcagcattatccaagatactccaggaagagagttcttactccgtgtgtcatatctagaaatatacaatgaggtgataaatgacttgcttgacccaactggccaaaatttacgtgttagagaagatgcacagggaacttatgtggagggtatgaaggaagaagttgttttgtctcctggacatgccctttcctttattgctgctggagaagagcatcgtcatgttggatcaaacaattttaacctctttagcagcagaagtcacaccatttttacacttatgattgaaagcagtgcccatggtgaagattatgatggagtcatcttctctcagcttaacttgatcgatcttgctggatctgagagctcgaaaactgaaactactggattaagaagaaaagaaggatcttacataaacaaaagtcttctgacacttggaacagttattggaaaattgagtgaggggaaagcatctcatgttccatatcgtgactcaaagcttactcgcctcctgcagtcttcacttagtgggcatggccacgtttcagtgagtttggattctactgctctttga

SEQ ID NO: 66710 - DNA, 1161 bp, Glycine max
  Peptide Sequence Number=SeqID_158395
atggaaaaccaaacctcatcgatgcagtttctcatcctcgaacaagttcagttcttgaaggtgaacgacgattccctcttgcagtgggaactcgtcgacgttgttgacgccgaagaggagatcgatgggttcggttcttcatcggattcttcttccgtttcttggttcgaatccgattcttctcccatcgatgcctcaattgaagaaattcgccaacttcttcttcatcccgatgtgggtttacaagatcctcgtgaatcggaacaagaatcgggtttagaaaatcaccactaccgttatcatcaacatcactatcaccatgatgatgttgatgatgatgatgtgggtggtgataatgatgatggtgaggatgatgatgggtatggcttggatgatgagcttgttccatggaacgtgagcaacaagtttgagaggcagaggatgaggaaattagggaaaagggcattttcgaaaatgcacaattcgaagaaatcaccttatctgtttgtgaggcctgggtgtgtccgtggcaagcacggagataactataagatatggaaggagataattcttctacaattggggtggatgaacatagactatgctataaggaaagatgaatcacctgtaataactgatgaaagtagcccagctgctcatgaaaaggcccgatacttccttaagactattgatgatcagttcatcgcttcagataaagctttagtaagcaccctgatcatgaagttctcccctctccagttcaccagtgtgaaaagtgaagaagaaaagcttgcaatggagaggggtgagagtgcattgctaacaactgcttgtggaaaaaacaaagcaattaagtctcaagctaatgagaagggaaatggtaaaataccacctcaagctaatattaagaaggtgacaaagtatttcttttttaagaagaagggacacatgaagaagaattttcccagattccaaatatggtatgagaagaaagatgcaaagaaagtgatgaggtatcttcaaggaaccaaagattacatgcttatgtatagacagacagacaatctagatgtgataagtgttaagcagactttgactattacttctaccatgaaagctgagtttgtctcttgctttgaggcgacatcacgtggtgtatga

SEQ ID NO: 66711 - DNA, 1083 bp, Glycine max
  Peptide Sequence Number=SeqID_158396
atggcttgtttacagcctccatggttctcttcattgcgcgtcgtgtccccggcaaaactcgcagcaggcccgccgccttcaacaacgtacaagcccgccaagctgctcttttgggccgtgggcccagacaatgctgaatcttctgagcccgcctcccccgacgctccagagcccgccgcacccgttgatcccgtggagttggcgtttagcaaggccaacgcgtataaagctgattataataatgatgaaaattcggctgaagagagaaacgttggtgatgagaccccaaaggatttgccagattctgtgaagattgcaatcgagaaggccaaaaagtacaagcagaataaagccgttgcagctgttactgaaacaactcaaggatccctgggagtgagtgagaggagttcaggaaaaaataaggttggtaagaagggagaactttcagtttcaaggatggattttgcagggcttgactttgcagataagaagatgactaggggattgccacctggattggttcctatttcagaaccttactttgatggtgacttgcctgaggtggagcttattattggagatacaagcaagtttgatgatgcaacgactccagaacctgaacaaactaataaggaagacgaggctgaactttacaagccaaaagtttctacctggggtgtctttcctagacctggcaatatttcaaaaacatttggtggtggaagagttatacgtccaggagaggttctagagaccaaagaagaaaaagctgttaaagaagcacgcacaaagcagctacttgctgcctacaagaagaaaactggattgaatgttgatccaaagctgaaatctgagtgcgaggaggcattgaaggatggtgacttattaatgaatgtgggaaagctgaaggaagcattgccctactatgagaaggttatggataaattaaccttccagagtgagcttcatggattagctgctttgcagtggtcgatttgtcaagactccctcagtaggtatgttcagaaacttcatgacatatctgaacttctcaaggaaactaccagattgtgttctacatag

SEQ ID NO: 66712 - DNA, 1500 bp, Glycine max
  Peptide Sequence Number=SeqID_158397
atgtttcagaggcaaactgaaataattagattagcagccacaagggttgctaagtatcaggaggcaaatcctactgtgtatactgtagttacctttccatttctttttgctgtaatgtttggtgattgggggcatggaatatgtttactactggcggctctatatttcataatcagggagaagaaactttctagtcagcctatgctagtcatcaagacacttgaatgcaccttactcccctataattacgtaataagcttaagacaactggccaagtcaatactacctgagattaatgtgctgaagttaaggttgaatcgtttgggtactacccaagtgcaatccttggcagaaacaattcttgctcaggctttacttacctctcggctaaattttggattagttaggaagcttgatgacatcacggagatgacttttggaggtcgttatgttattttgttgatggcaatattctcaatctacactggctttatctataatgagttcttttctgtcccattcgcaatctttgctccctctgcgtatgattgtcgtgacctttcttgcagggatgctacaacagtgggcctgataaaagtgcgtgacacttatcctttcggagtggatcctgtatggcatggcacacgaagtgaactaccattcctaaactcattgaaaatgaaaatgtcaattcttcttggagttgctcaaatgaaccttggaattgtgatgagctatttcaatgccatattctttagaaacagcgtaaatgtgtggttccagttcattccccagatgatatttcttaacagtctatttggctatctatcccttcttattattgtcaagtgggccactggttctcaagctgatttgtaccatattttgatctacatgttcctgagcccaacagatgatttgggtgagaaccaactctttgctggtcagaaaaatctgcagcttgtgcttttgcttctggctgttatctctgtgccctggatgctattgccaaaaccttttattttgaagaagcaacatgaagctaggcacggggttgaatcctatgcaccacttcaaagtacagatgagagcttgcaagtggagtcaaaccatgattcacatggtcatgaggaatttgagttcagcgaagtctttgtacatcaactcatacataccatagaatttgtacttggagcagtctctaatacagcttcttacctccgtctatgggcccttagtcttgctcattcagagttatcaagtgtattctatgagaaggttctgatgatggcatgggggtacaataatgttattatcctgatagtgggtctcattgtcttcatttttgctaccgtcggagtgttacttgtcatggaaactctcagtgcctttttgcatgcgttacgtcttcactgggtggagtttcaaaacaagttttatgagggcgatgggtacaagttccaccctttctcgttctcgtggctggatgatgaggaatga

SEQ ID NO: 66713 - DNA, 195 bp, Glycine max
  Peptide Sequence Number=SeqID_158398
atgaaacatagccagaaaaaagatatagcaatgcaacatccgaatagtgaattagcattttccctcctttctctcaataaaattgccaacacaagacaagacatctttaatcttaaaacgcctgaaaaaacgacaataccatgtttcagtatgatgagcaaaatatcgaaacacaaacaagtgcctagaccttaa

SEQ ID NO: 66714 - DNA, 653 bp, Glycine max
  Peptide Sequence Number=SeqID_158399
atggactcgttcagtttcaacaacctacaagcagagaaagccaacgtgatcctaaagcatcgcaagcttcaaagggtcgcaagcttgtttagaatcattgaagtgtgtatcattttggtcttgatttcaagattctccatgcagctaccagtagcagtaaaaaactccagcgtgtacttaagggacttgtcactcttcatgaacagccctcgttttgttttcctcgttggaaacgtcataatcatcgcactcttcgctcagttctccactcagggtaataacgctccagagcctgatctttaccaagagttcgttcaaaacaccacaaaaaatcacagacacacagaaacagttgtggcagaatatagcaaaaagaaacagaggatgaaaacaggggaagtgaatattggtctgaagaaggattatagaagatgtgaaacagagattttaagcgaaaaaccacatcgtgtgttacgcaggtgtgagactgagaatggaaggaagagcatcgaacctgctactattcaagaagtggcgcaaatttcgtgccctgaagatgggatgagtaacgaagagtttcgtcaaactgtggaggctttcattgctaggcaacagaggatgcgaagagaagaagaggaagattattatttaat

SEQ ID NO: 66715 - DNA, 867 bp, Glycine max
  Peptide Sequence Number=SeqID_158400
atggaagcctctcaatctcatttccatgttcgttcaaacagcttgccctctagaccacaccctctcatcctacaatgcaacgagcacttggacaggttaaggtcttccaatgaaacctcctcttcctcttcatcccttagccataagctaggagggttgcaagatctgcatgaatgtgtcgaaaaattgttccatctttccctctcccaagaagcacttcaccatgagtgtcaagaaaaccgggtagatgagcttctgaatggatccttaaggctcttggatgtgtgcacagccgctaaagactctctattgcacacaaaagagtgcatgcgagaacttcaatcagttatgagaaggagaaagggaggtgaagtggagctcaaggcagaggttaagaagttcttgatttcaaggaaggtggtgaaaaaggccatctcaaaagccttggcaaatttgaagggtactagaaaaaattgcaacatctcatctgcaaacaaagacaatcaattggttagcttattagagagcgtggaagtgatcactctatcaacatttcagtcactacttcaattgatctcagggactacacaatcaaagtcaaacagctggagtttggtttccaagctaatgcagaccaagaaagtaggttgctcacaattggcagatgaaagtgaatttgcccaacttgatgaagaattgcaatcatgcatgtttgcccagacaagcaaatttgaaaacacgaataatctgcaaacccaattggagaaagtggagtctctttctcaagatcttgaagaagggcttgaatttctctttaggcgtttgatcaagactagagttgcccttcttaacattctcaatcactag

SEQ ID NO: 66716 - DNA, 1215 bp, Glycine max
  Peptide Sequence Number=SeqID_158401
atgacattcactccctttagcccaaaatctcatcaccaatctcgctcaaagagccttccctgcagacaacaccctcttattctacaatgcaatcaacacttgggaagtttagaggcttcgccttctgataattcaacttcctcttcgtcgtcattgttcaggcacaaactaactggcttgcagactttgcatgattgcatcgaaaagctggttcgactgcctcttactcaagaggtactagtccaagagcgtcaagagaagtgggtagatgagcttttggacggatcgttaaggctcctagatgtatgtactgtagcaaaggattctctacttcacatgaaggaatgcgcacgtgaacttcaatcaattatgagaagaaagaggggaggggaaatggaggtggcagctgaggtcagaaaatttttggcctctaggaaagtaataaagaaggcaatcctaaaagcattggagaatttgcaggcaactgtgaagaaagcaaaattccctccaagcaacaaggacaacccgaccgtgaccttggctagcttgttcaaagatgtgcaagtgatcactctttccatattggagtcactgctgaacttcatctctggaccagcacaatccaaacctagcaaatggtctttggtttccaaactaatgcataacaaaaaggttactactaccacacaagaatcagatccgaatgagttttccaatgtagatgctgcattgcaatcgtttgtgtttcacatgacaagaaaggcagacagtatcagtcatttgcagaaccaactggaagatctagagtcagtcattcagggctttgtggaaggacttgaaactctttttaaacccaaccacaggtcaggcattgaaacactctacgcattaccttctacccatctgtttcctaagaagaaaaaatggcagccattgaaaagaaaacacaaagctctctacatcttcgcagcaacagcttgccctcttgtatcacaacttgaggagcaattgcaaagattgaggtgttctgaagccacttcttcattgtcatcatcttcagtgtgccacaaacttaatgacacgttggatttgcatgactacaccgataagttgcttcaattgccaatcgaacaacaagtcttggcacaagagtgcaatgacaaatgtgttgatgacctactagaagggtctcttaggctcttggatatctgttag

SEQ ID NO: 66717 - DNA, 378 bp, Glycine max
  Peptide Sequence Number=SeqID_158402
atgtcttcccatgaaacctcctcttcctcttcattccttagccataagctaggaagattgcaagatttgcatgaatgtgttgaaaaattgtttcagcttccactcatccaagaagcacttcaccatgagcgtcaagagaagtgggtagatgagcttctgaatggatccttaaggctcttagatgggtgcacaaacgccaaagactctctactgcatacaaaagagtgcatgcgggaacttcaatcagttatgagaaggagaaacagaacagagttaaaaacctacctcgcgcgggaacaagaaagagcaaagggcacggaacgcgaacaagggacccaaaacgacagcgacaggcaaagcgatggcgggaggatgtag

SEQ ID NO: 66718 - DNA, 195 bp, Glycine max
  Peptide Sequence Number=SeqID_158403
acttatcaaggtaatccttgtggcttctaccctgacttatcttccttcaccggaagtggcgtctaccctgacttatcttccttcaccggaagtggcgtctaccctgacttatcttccttcactggaagtggcgtcatccaaatctctgtaacctgtatcaagcgatccactcctagtcaggttcacgtcatctga

SEQ ID NO: 66719 - DNA, 429 bp, Glycine max
  Peptide Sequence Number=SeqID_158404
atgtctccgagaaagctttccacaaagagatctaggagggacgtcgcggctgaggggaccagtgtcgctcccaagtttgacagccatcggttcaggagcgctgagcaccaacagcatttcgaggcaatcaaaggatggtcgttccaccgagagagacgcgtccagctcaaggacgatgagtacgcagattttcaggaagagatagctcgccgacgttggacgtcgctgggagtgcgggacatgcgatcatgggtgaggggtcagtggattcccttcgatgcagacgccctcagccagttcctgggtgacccgctagtgttagaggagggccaggagtgcgagtttagtcagagaaggaaccgggccgatggatttgacgaggaggccattgcccagctgttatgcataccgggtcaggattttgcctga

SEQ ID NO: 66720 - DNA, 282 bp, Glycine max
  Peptide Sequence Number=SeqID_158405
atggtgaccaaaggttggagctttgttgggcaacaatggtgggtgagaaaagaaggagaaagctacccacaagaagaagagaaaaatctgacctttgaaacgctaaaatcctgcctcggtttgcgtgccatttctctggttccagtccctcgcgtttctctgcacccgtcggggccagttttcgaaagtaagcaatatatatatcaaaacgctcagaatgaaaccccgagcatggttcagaggttggttttgttaaattttaagttgcacgcaaagcgatga

SEQ ID NO: 66721 - DNA, 184 bp, Glycine max
  Peptide Sequence Number=SeqID_158406
gaatttacaagatagtggaactctcaagcgggttgcttggggactggacgtaggcacaaggagttacactgacacttctaacttcactctacactgtggagtatgtcaaatgggagtaattggccagaagacggcagtggagaatgcacaagcaactggttgtaagaaactctcagagctgtaa

SEQ ID NO: 66722 - DNA, 63 bp, Glycine max
  Peptide Sequence Number=SeqID_158407
atgagattaccaatgacagatggagaagatgaatgtgcatataataacaaagggacccctaag

SEQ ID NO: 66723 - DNA, 360 bp, Glycine max
  Peptide Sequence Number=SeqID_158408
atgcataaggcattacgggtcaatgcacctctcgcccaccctcaattggtcactctgtttctccgtcattttcaaattccgcttgatgatgaaccttttgttcaagtcaagcattcctttgctattggtgctggtgcagtcacttcatttggataccgtaaggattgtaatggtcaatggctgaagaaagatgcacttcctccacaagatgagcgcactccttctccacctcctcagcgagatgactcagcccttatgactgaagttctttcagagttacggggtcttcgcacttatgttggtgaacattttgattctttggataatcgctttgcgggaatggatatccgtctcacatag

SEQ ID NO: 66724 - DNA, 444 bp, Glycine max
  Peptide Sequence Number=SeqID_158409
atggcgcctaccaggcaacctctggacccagataagtccaacagggccctggggtttccggcgctgatcacgggcctctaccagttagtcgaggttcccgtcacccccagtaaaaagtactgcacgcctaggcaggcacagggtgatgcacatcaggctgtagacgcaccaccacctcggcaggccgatcccgctggatcactaggcatggagcgttatctacagcatttggttcaccagcaagcggccaaccaccgtgggcaggggcagggttccactccttttgcatgccctactccagagcagtttggggctgaggtcgcatggctcgaggcccaggcaggggaggagcctgcaggatcccccggtgaggcagatgaatcccatatggatgaagagatgactgacctgctcggtttcttgggagggagcggcgccacatga

SEQ ID NO: 66725 - DNA, 210 bp, Glycine max
  Peptide Sequence Number=SeqID_158410
atgttaggattcacaagcgattctcctcaaatttcagctagaccgcatcaattagactttgcaccttacgctttgaggtcatacagtgctcaatggaatgtcccggaactcctccatgatatgcacatgttgcgttcgagtcgtatcctcagaaaatggaggttgaggaaacctagcgggggttatggctaccattgcattatcaagtag

SEQ ID NO: 66726 - DNA, 429 bp, Glycine max
  Peptide Sequence Number=SeqID_158411
atggaggtggtggtagcttccttcatcatgatgcaaaaaccggtagttgctcggtcagatctctataatagtagtagtggggttgcttcgatgccagttgcacagtactactccccaccacacctcatttcagacagagtggatgaagttagttgcgctagtagtgctgcccatatgaggaggaggaagaaggttatcgacgagaggttagttagtagtatagttgctaagagtctagtctttgcttttggtgctgctcttcttcttccttcctccgcatcacacaccttctacttcgtgctggaacaactaccaccctaccttcatcaagatatctctgccaacaactaccagcctccttttcttactgttgtgctgcttcttcacgagcagagtagagtgtgtggaggagagctaagccaagaagct

SEQ ID NO: 66727 - DNA, 963 bp, Glycine max
  Peptide Sequence Number=SeqID_158412
atggctgttggtatcataagtgactttgcttggaggccccttgggggcgaatctgctgttgagattgaccttgttaccggtgttgctgagggccctcttgagtcttcgtgtcttaaggcaagctacaaggttgacaccttgcctgaggccactcgtgctgctgaagttggtatgtcggctgcttcggttggttctgttgtggtgctttcgtccattgttgttgcacctttgatgagtgtcgatgtcgcgaccacaagtgcctccctcacccagtattatgatcagccgttgaggtgcttcacctttggggacttccagctatcacctatggtagaagaatttgaagagatcctaggatgccctctagagggaaggaaaccatacctcttctcagggttctatccctcattagctagaatttccaagatagtccaaatctcggcacaggaattagaccatatgaagcaagtcgaaaatggggtggttggaataccgagaaaatatttggaggcaaaagcaagaatcttggcaggtaaaggcaaatgggccccattcatagacattctcgcgctgttgatcttcggaggagtcctctttccgaatgtggatgggttgctggacctggcagcaatcgacgcttttctcgcctatcataaccacaatgaaagcccggttgttgctatgctagccgacctatatgacaccttcaaccgaagaagtgaaaagagaaatacaaggattgtttgttgtactccagctctttatgtatggttagtttcacaccttttttgccaagaggtgaggcatgcttggccgctagaaagccaccgttcatgcacagagaaaggaggggcaaattgggaccaactcttagcaagcaaagaacgagcatcagtcaactggttccctcgatggaaggaaggaagaaccggagttcatatttcatgcggaggatttccaaat

SEQ ID NO: 66728 - DNA, 252 bp, Glycine max
  Peptide Sequence Number=SeqID_158413
atgttaaccgataaaagcaaagaggaccgtttaaggcgttggaccttaaaacggtttttagtgatttttcggacaaaacttgatttgaaaaagggggaggaggttgccgcccagctcgcccaggcgaccttagctcgcctagcattacgggtgtcccagaagccccggaatcccatttttcaacaaaacggggggtgtggtggccatctagctcgcccaggcgggcgaggttacttcaaccttaagcaataa

SEQ ID NO: 66729 - DNA, 1440 bp, Glycine max
  Peptide Sequence Number=SeqID_158414
ttgtcgcgcccacgctggcggccccaactggcttcactcgaccatctacctacggccactggccgtgcatattatcagcggcggctcgacagcgaacagcgccgcgacggtgattttctcagcaaggctgaacgctatgcgcgcaccgacgaatttctcagcgtgctgaaacagagccttgagtcgccacagccttacgatcatcagggccggttttaccaggctgagcaggctttctctgccatcaaaccgctgcaacataagctgccgatctatttcggcggatcgtcaccggaggcgattgacgtggcggcgcggcatgccgatgtcttcgcgctgtggggcgaaccgttaaaaggcgcggccgagacggtacgtaatgtgcgtgcggcggcggccgcgcaggggcgccagattgcgtttaacatctccttccggcctattctgggtaacaccgaaaaagaagcctgggagcgcgccgaacatatccgcgccaccgcagagaagcagctagcggagagcggctatacctttggtttgccgaagccgcagagtgttggtgcgcagcgtctgctggcggcggcgcatgagagcgatcgccacgacaaagtgctgtggaccggcgtggcaaaactggtgcagggcggctacaactccaccgcgctggtcggcacgccggatcaggagcgcctgatgcgtctcgccgctctgtttgccggtgttgcgctggccctcgcgtcactccagccgctactggcggccgataaagtcacgctgcgcctcggcgatgtgaaaggcgatcgttttgccgccctgaaagcttcgggcgaactgaacaatctgccttacgattttaagctcaccgcttttgactccggcgcgccggtgcaggaagcgctcaatgccggggcgctcgatgttggctttaccggtgatttgccgtttctgtttgtctatgcggcaggcgcgccggtgaaagccgtgggtgcctggcagaataatccggacagcattgccctgctgacccgccccgacgccggcattcaccggctgcaggatttaaaaggtaagcagatcgcggtcaaccgcggcggctggggacactatctgctgcttggcttgctggagcgcgctggcctgacgccgcaggatgtcacgctgcgcttcctcggaccggtggatggtcgcgcggcgctgacgtccggtgcggtcgcggcctgggcgccgtgggagccctatatcgccacctcgaccgccatcgacggcacggtgcgcgtgccggacggcgggggtaaaggcattatgtctggttactcttacgcgctggcccgcaatgaagcgttgcaggacgccggcaagcgggcagcgattgccgacctgctggcgcgactggcgaaggcgcaaatctgggcgcaacaccatccgcaggaattcgccggc

SEQ ID NO: 66730 - DNA, 585 bp, Glycine max
  Peptide Sequence Number=SeqID_158415
atgaagattattatctcaatcccattaatgaactgtgatttagccagaggagagcagcataaagacagttgttatttttattctataaataaccatgaccgaagacaggaaccgatcatgtatgaataccttaaagaggaaagagtccttgatcttgagagtattttggcagacttcatgacataccaagacagctctaaaggatcttgttatggaatgcaacagcagggaactcaatttcaaaggaaccagtcttttgcaggctatcactgggagtcatgctggcaaccaaattatgatgataaagtagaaggagttattaatctggatgacctactaatgcaatttaaagatatagtagagtcaatgcaacattcttttagaagaactgcaactcagattagtaagttggtggatgacatggctaagactacggccagagaagaggaagaatgtatagagattgaaacgtaccaagaaagcatttttcaagttacctccatccatcatcagatcaccactgaagaggaaatgtctataatctccaatactctagaatactcctgctcggccgttactggctat

SEQ ID NO: 66731 - DNA, 511 bp, Glycine max
  Peptide Sequence Number=SeqID_158416
atgacattcttgggagaaacaagtagtcagatcattgctaacttgagattagccttcatttttccaaatggatcaatcactcacaaccaaactggtgtttattttcaaagttccactataaaaccaatgcgagttcctaatgacttttcttttgaaacactcaagagtaaaatgcacaacacccttcagctaaccaacgatcaattagtggttgaaatctactaccgactgtcattcatagatgcagaattattatgtaccatcaatagaacaccggatgatatactcaacttgcttcaatccactatcactcctactcatgatgtaattctgtattacaacgggaagtggaacataccacgccaaggtgggtttttgggttactccttcactaaaacaaatccaataagatttgacattcctttgggatgtagcatggataaactcaaggatttaatcaagcaagttgcacctatgggtttccccttatggaattcacaaatcacagatg

SEQ ID NO: 66732 - DNA, 129 bp, Glycine max
  Peptide Sequence Number=SeqID_158417
atgaactcgctaagcgagcatgctatgctgaacgaactcgctaagcgcgcctaccgcgctaagcgagttcatcttgtgaggatgaacactcatccgcctgttgagatacctttggctaagcgaggctga

SEQ ID NO: 66733 - DNA, 240 bp, Glycine max
  Peptide Sequence Number=SeqID_158418
atggagaattggcgaacagcgctacgcaataacttcacggggctccgaaaaatatggagaattggcgaacagcgctacgcaataacttcgcggggctccagactcgatgtgttaggcaataaattcatggggctccgaaaaaaaagtggagaatggagaattggcgaacagcgctacgcaataacttcgcggggctccagactcgaaggtggaggacacatgaacagcgctaggcaataa

SEQ ID NO: 66734 - DNA, 255 bp, Glycine max
  Peptide Sequence Number=SeqID_158419
atggagtcgccaactgtcgcaacctacccttcggcgggagggcgacgcggggctcacggatgcgtcttccaagaaaggaaaatgcgcggagttaccaccaacgtttattcgaggaaaacgtcagaaaaaccggaaaggtgtggtctacgaactttaagtgtgaaacgtttgggagttgtatttacgcacggggaagggtgtttcccttgctcctatgtattcctcaattgtgataaggaaatcagacctacgtag

SEQ ID NO: 66735 - DNA, 195 bp, Glycine max
  Peptide Sequence Number=SeqID_158420
atggcattagtcaacaacatcaatattttaatgttccttgtattcaacagtgctttgaaaggagttgacgatacttcacaacccaaatccatggctgcaggtgctaggtggattgttgttaaatattttaatgatgttagaccattggagtcagacacattgaaggcgcttcgcatccagtgggcaaactattag

SEQ ID NO: 66736 - DNA, 178 bp, Glycine max
  Peptide Sequence Number=SeqID_158421
atgggattgatggccatgtcgatgcggatgcaactagccctgatacaagtggtgttggtgattgtgccggcaagcatgggaactacagcagctaaccaaaccctgcttggctgcccaaggttttgtggaagtgttccaattccatatccatttggaataggcaaatcatctgaaaccg

SEQ ID NO: 66737 - DNA, 378 bp, Glycine max
  Peptide Sequence Number=SeqID_158422
atggcacacagatgcaccaatccaatgttgaacgtgatcctacaaaaacgaggggaagtagcagcttatgttgcatggccaactaggccaagggaccagtcaaatcttggccaagggggtgtcgatgacggttcagatgacttggttccgagaaaggaccattttgaaagtggtttggttgcgagccaaatcagactagatctggatgaggctttggagagtgcagttggggacaaagtgtttggtgttactatcggtgttgagccaacattggatgttgaactggtcgtaggtgactccagtggagaggctgataggggatttcatgatgttgagggagatagggcacttgaagaagctaggaacaattatgcatag

SEQ ID NO: 66738 - DNA, 267 bp, Glycine max
  Peptide Sequence Number=SeqID_158423
atgaaccacttcttccggaaagttcccggaagaggttttccgggagtcttccggaagaagtgttcttccggaagacgtttggttacttccggaagaacccctaacgggtcttccggaagactccgtctgcataacaaaaccaaagctaagaagaaggccacctacctcgaaagcaaatgggtccaagggctgtcggagaagctcgcggagaagaagcttgtcggggaagagagaagagaagaagcttttgcggaagagactcagtga

SEQ ID NO: 66739 - DNA, 489 bp, Glycine max
  Peptide Sequence Number=SeqID_158424
atgggaagcgcgttggaaacgctatgtggacaagcttacggagcggggcaagtgcacatgttgggagtgtacatgcagcgctcgtgggtgattgtgaacgccaccgcgatcctgctgtcgctcctctacatcttcgcggggcctatgcttagagctataaggcagacagaggcgatttcggcagcggggggggagttcgcggtgtggatgatcccgcagctgttcgcgtacgcggtgaactacccggcgcagaagttcctgcaggcgcagagcaggatcatggtgatggcgtggatcgcggcggcggcactgcgccgtcgtggtgctgaacgcgtcgtggtggttcatcgacattggacagctgcacactttttcttcaatcttatagaagacgacacaagttcgccatcagagcttgaagatgagagggcaaagagtgtttcttctctctcccgcgctcactatgacggcaatgaagagtcaggatag

SEQ ID NO: 66740 - DNA, 95 bp, Glycine max
  Peptide Sequence Number=SeqID_158425
atggatacggaatttgtgaaacgcttccgcaagagttcgagcagccaggcagggcttggtcagctgcttctgctagagcaatcagcaacagcatg

SEQ ID NO: 66741 - DNA, 150 bp, Glycine max
  Peptide Sequence Number=SeqID_158426
atgcgacgaggcgggtcgttacaaagcaaaacaaaaacccatgtgaatggagtgagaacgagaatagaagagaataagaaatggaaaaaatgtaggagagaaagagtggacggaactgaaatggaaaaaatccaggaaaacagagaatga

SEQ ID NO: 66742 - DNA, 384 bp, Glycine max
  Peptide Sequence Number=SeqID_158427
atgtgcaaggttggacagataactacaaaccttagtatgatagaccaacttgcaataaacaataggaaaggtcaagaagtcttgactgataccaaagaaagggatgttctaggagtgttctccgagaacctcagaatcctacaatcagagttgcttccttacaaagaagacctcataggtttctctagtcatcatataacaccattgggaaaagtaaagtttcacataacctttgggaaggcacgagaccagaaccatcatcatcaagttcattgtggtaatgctacaatcatcctacaacaccatactggccagaccaaccttgaatgccctgagagttgtgatttcgatagttcacttggccatgaagttcctcatcaatga

SEQ ID NO: 66743 - DNA, 156 bp, Glycine max
  Peptide Sequence Number=SeqID_158428
atggttgtacgagtagacaagaagaataagatagagagagaaaaagaaaaggaagagaaggaagctagcgagaaggaggagaagaagagaacgaaggagaaggagcaaagatctaaaaactcagggcctgaagctcatctctatgtgttctcgtag

SEQ ID NO: 66744 - DNA, 219 bp, Glycine max
  Peptide Sequence Number=SeqID_158429
atgatggatcgactgacggaaaacaaaagcaataatcattcattctcttcccattattttgctatgttattctatatgaatttcccaagacagaattcttcgtggacacctgtcagtgaaaaacaagatgagggaagaatacttggggattgtactcggttccgtaactatgaagcagattcaagaacactttcattttctattctgaaagtgagttaa

SEQ ID NO: 66745 - DNA, 468 bp, Glycine max
  Peptide Sequence Number=SeqID_158430
atgcattctgaagctgaaccactagaacataagaagaaaagagatacagccatcaaagtagttgtgtctccggcaaaaccacctccgaagcccgatccggaggtcgatgatccgctttatctgatgacattgaccatcccagagcttttcttgaggccttatcaggttagatgggatgccaccatgttcggggtctttaatccagatttccccctctacataaagcacgaagacctctccgaaatcatacacggtggtcaatgtctcagcatatcagtgttacaattgtggattctgcatctcactgaaacatgtatgcgagtggggaattctgatatttatggattcctcaagccacagtccattcagaggtctgggcaattgcagtttgagtctgaaagttacataaagagttggatacagagttcacaacgcgatgtctatcttggagcctacctaaatgggtaa

SEQ ID NO: 66746 - DNA, 330 bp, Glycine max
  Peptide Sequence Number=SeqID_158431
atgggagtggaagctaatatggaggaggaatttttttaccatgaaattgacatggtagcagctttcttggctgagattgagattgcccacatccttcaatccagcagggattttctattttggaaggctgaccctaatggtctttattctacaaaatctgcctataaagtgttgcaggaagctgataataatgttaatgaggacaaggcatccaagatcttatggagtctgaaaataccctcaagagcaagcattgaacaagaagagattctcataggcagtgatcaacaaagcactatcatcttgactgttgtgatagtcttagattag

SEQ ID NO: 66747 - DNA, 677 bp, Glycine max
  Peptide Sequence Number=SeqID_158432
atggaagaaccatcgaagaaacgaaagggggtggcgacttcatccgcagtcaccggaactcaaagccacggaacatccaaagctcaaacattcctccctccatatcatctcctatgttgttttgctcggaagaacaacaccagttcctcttctttgaactcactcaattatccagtgacggtgttccatttgagggtacacttgatgatgagtgcaagtttgattttttctgtttctgatggccgccagatggtttgtaccaaccaagcggatatgaccggaaggcttcttactggatcattggcattcgaatgccgcatcatgcactacttgattgtgtgcatcctactccctagatcttccaaccttgcacaggcccatcttgtgagatatcgcatgcataagacattgcgatcaaatgctccactcccacatccccatctgatcaccttgtttctacaacattttaatgtccctcttgactctaagccctttgtcaaagtcaagagatccttctctatcggtgtgaatgtagtctcctctttcggataccgcaaagagagggatggctcttgggtgaagaaggatgctccagtacaggctgctgaagaccgctctccatcaccacattctcagagagatgactcttcctctcttatgcacaacattcttgacaa

SEQ ID NO: 66748 - DNA, 945 bp, Glycine max
  Peptide Sequence Number=SeqID_158433
atggctcccaaagaactagagcagttgactcaacaaatgaaggaccagctggaggagttgatcacagaaaaagtgactcggcaactgatgttatccttcagccagatgcagtcccagtttcaatcacagatacaatcacatggacttgcactacctttggagcctgaggttgatcccttagctgcttgtgtcagtacaaaagggagttgtgttgatcccttaacgaccgatccagacacaagtgacacagacaaatgcgggttgtacatcgaagaaaatccttcccgcttggttgcccttggaagagtttatgagggatctgcagtcgttcacaacatccctttgttgcatggccaagtgaaggttggtgttaaggaggttaaagatgcagatgctcctgttcctatacccactgacgaggtagctgtgtctccagcaaaacctacagataggccggatcctgaggttatgtgggatgcttccccgttcgggccgtttaattcagacttccccttgcatctgattgagataagtatgcaagaggggaattccgatgtgtatggattcctcgagccacagtccattcagagatatgggcaatcacaatttgaatcagaaagttacatgaagagttggatgcagaattcaaagcgcgatgtctaccttggagcctacccgaatggtgctttgaaaggacttgatgatactccacaacctaaatccaaggctggtgctaggtggattattgttaagtgtaataaacaaaaagggagcactgagtgtggctatttcgtgatgcactggatgtccactataatcttaggaagtttcaggaataattgggaaacatattttaatgatattagaccattggaagtagagagattgaaggcgcttcgcatccagtgggcacaatattatctcaaagttagaaatgaaacttag

SEQ ID NO: 66749 - DNA, 735 bp, Glycine max
  Peptide Sequence Number=SeqID_158434
ggaggttgcagccccagggacagtgctactgattcttttcaaaccataaggggaatgattatgcttggtttttgcttgttggctcaaaacaatactgattcttcttccccaaccttgaaggataatgaaatctttcattctgataagaaatatcatgtagaagatgaatcaatggcagaagattcaaaaggtcaagttttattgagtagcaattcatattgttttggtgggtcagataatgagagcactgcttcagataaggggtcctatgagcaaagaccatcatcattttcccccaaagcctataagatggaaggctcttgcaactccaagattaacaataccaaaaacgacaacaacttgatgtccaattgttccaacaaagacatgttcctagacagctacaccactacattcgctaagcgcaacactcatgggctaagcacgaggaagactctggaagatgagctgtataggcttcttggttatggaaagctaaatcctctgttggatcttccctgtagggctaagttgtcgtactatcacgaggaattggggtgcgataatttagttgtgtatgtgtatctcaatgcggtcttggttgagtttagcccaacaagagaaatctacggacgatgcttgattaggattaggctaaactatcatgaggaattgagggagaggaaaggtattgcaaatctgtcaactgagtgggagaagaaaggtgtctcttga

SEQ ID NO: 66750 - DNA, 435 bp, Glycine max
  Peptide Sequence Number=SeqID_158435
atgagaacgcgagccctactattttcctcgcgctctatttttcttcttcttcctcgcttcttcttcttcgtgacctcacaatacaagcttttgttactgcacgttacccaggtggtcactgcaaggaggttcatgcttgcaagttacaaggtgctcaaggtggtggcttttagtccgttggttcgcaaggtgctcgtaaggtgcttcgtgctcccaagggagttgtggactgacgggtacttctcaattattgctgagattgttggaggagtgtggttgaggtggtggcttcaagctgctgctgcaatgtcaaacatggaaatttttgttgccgaaatgagcagtgactcattccagcttctagggatggcagagaggggcatgttacttgagttcttcggcaagagttcatgttacggaaccccatatacttga

SEQ ID NO: 66751 - DNA, 903 bp, Glycine max
  Peptide Sequence Number=SeqID_158436
atggcatcgttcagccagatgcagtcccagtttcagtcccagggtcctcgagtaagcacaaaggagagttgtgttgatccctcaggaaacgatcctgagacgggtgactcagagaggtgctgcttgtacatcgaagcacatcttgcccgcctagttgccttgggaagactttatgagggatccactattgttcataacactcctttgttgcctggccaagtaaaagtaggtgtggaggaggttaaagatccagatgctctcgttcatgtacccactgatgaggtttccttagtggggcaagcaattcacgccttccttgcttggccgacacatctggtcaagcctttatcacaacaggcagttgtgtctccagcaaaaccacctcaacagccggatccggaggtcgatgatctgctttatttgatgacattgaccatcccagagcttttcttgaggccttaccaggttacatgggatcccaccgtgttcggggtctttaatccagacttcccactctacataaagcatgaagacctctctgaaatcgcacacggtgatcaatgtctcagcatattagtgttacagttgtggattctgcatctaactaaaacaaagttcagaacgcgatgtctaccttggagcctacctgaatggtcatctccactacaacggacactggcagatggtggtcatcgtgcccaaggaacacctagttgtttgtgtaatatacaaaaaggaagcactgagtgcagctattatgtcatgcactggatgtccaccatcattttaggaagtttcaggaataactgggaagcgtttaacgatccattggagctagagagattaaaggcgcttcggatccagtgggcacagtattatctccgagttagagctcagagctag

SEQ ID NO: 66752 - DNA, 276 bp, Glycine max
  Peptide Sequence Number=SeqID_158437
atggtagatctgaagaagctcacttatcagaatgagcctttcaacattgcagaacaagctaaacaggtattttatgttcaagattcttgtgatgaaagatggtcagtggttcttggtcgacagctggcaagtgcaccgaatcgctcaagtagtataaaaggcctaatcctaatcaagcgtcgtccacagatgtctcttgttggactaaacttgaccataacagcattaagacataacatatcaaaaactaagttatcgtaccccgatgtcttgtga

SEQ ID NO: 66753 - DNA, 525 bp, Glycine max
  Peptide Sequence Number=SeqID_158438
atggtcccccgcccaatagttggggtcatacccggggaagctctcacccttttaggagatcgtatcaatgtcatgcctgcatttgatcttctttatgtggagacaatggcttcgagctcgttgagcgttaaggtagggaacttcatcttcagatgtagtgtggaaacaatgatctctcctgttaaggtggggaacttcatcttcagatgcggtatggagaccatggctctgagctcgttgagcgttttcctgcaaatcaaagaaaaggcattgggctgcgaggctcccaacacagggggtttagcctctcatgacaatgagaggctttatactttaggggctgatgtggatagaagaatggacatagatagaggtttttccctatttgagatactcgggcttaagatatattcattagagagctatgagtctccaaggttgtctagggattggtatcccgatgtgtatctctcctttgcttcctactccttttataggcctaaggtagcttacttttcacgctga

SEQ ID NO: 66754 - DNA, 435 bp, Glycine max
  Peptide Sequence Number=SeqID_158439
atgaacccgggtatagggccccttttttactcaaacccgtgggtgcttagaatgcagtgtaaagaatgtgaaatagacaacagttatttacattttacacagttcaacaaaatgcacacacaaagcttcacatttccacaattattaaaaataggcctaactcccaaaaaggtccccagtggagtcgccaactgtcgcaacgtgcccttttgcgggcgagcgaggcgacgctcacgggtgcgctttccaaaggaggaaaaatgcgcggagtcgccaccaacgtttatttgtggaaaacgtcggaaaaaccaaaggaaaccaatcgaaacgaaaattctaagttcgggagttgtatttacgtttgaggaaggtcgacaaaagcggggcttttgctcctacataccctccatcgaagaggaaatcagacctacgtag

SEQ ID NO: 66755 - DNA, 1434 bp, Glycine max
  Peptide Sequence Number=SeqID_158440
atgacccaattacttgttttccttgtattggtggtgttggttgctactttctcttcttttgtctctgcatatcatttgctttcaaaacctcttcttagagatgatggaagaatctacgtttgttctcatgacaacttttttgcatttgaaagcaatggtaccattgcatggatcatgcatttagactacaaatgcaaccttggtactgccccagttcatggaggtcatggcaagatatacttggtagctgataacagaatattggtgattagttatggaaacattggaacttctgagcctgaagcagaagttttcttcggtccgggaccaggtcatgtggcagaggctgaaattattgggctctcagtgagcacattaggctcaactatttatatcaatgtcaagaacagaggactctttgcatatcagtcacgtggacatttgctttggagtgtggaacctgtgctttaccaattcggctaccgtcaaggatgcaggaaaaatcttacaaattgttactttgcttcagttcctttgcttgatcattgtgagggtagtatatatatctcaaacacagagggtgaactctattgtttgtcagttcgtagccgttactttagatggattcaagattttagttcattagacaaaaatttcaccatcactctaggaaacaatggtcatctgtatgtaacagttccagccaaggctcttgttctggctctagatgtcttttcaggtaatgtgttgtggcagagaagtattgggccattaagcaaagttgactctgcacctgtagtggactctaatggatggatatctattggttcgttggatgggttcttatactcgttttctccaactggggttcttaagaaattctcaagaatgaatgcagaaaactctataattcaagttggtccttttcttgattgctctggatttgcaatctacagttcacaaatagagatggaaggaaaaattagccacacaattggtgaatacactgtagtttcagcaattcaaccaaaagctgcattgttcactatgttggttcctgcaactggatcaatatattggtctgaaagctatcctggtcatgtttctactttattttctaagagtgatctaagtcaatttgtcatgaatgaggagattcttcttgctttccttgctgcttcaaagattggcactccgctgcaatgtcgtactataggtcagaagcttgcatcaagctgctctcaggaaagaaccaagcttgtcagtgtctacacaggtaacgaaagggcaatagtcttgtttctgctctttgagtctgctctcttgttgatactaattggacttgtaagattctgctgtacattctgggcaaaagagaagcttaaagatcaaggccttggaagcttccttgacaatagagttagttcaaaatag

SEQ ID NO: 66756 - DNA, 420 bp, Glycine max
  Peptide Sequence Number=SeqID_158441
atgttccatgacattccacattcgttgctccactctcgagattcaaacctgaacccgtcgatctccactaccattgaacgaatcgctaagaagtttcacagcctcggcatcaccaaaccccttacctcctcctctgaaattcacgttctgttcccacatgatctctcgaagcggcaaatggggcacaccttcgagccgagctggagcacaccactgaaaccgatgtcggttccagggaccggcatcgcggcactgagcaagagcgaggtgaggaggcagaacaaactgcgggcagaggagttgaggaggaaagaattggtgccgaccctggtggagctgagcctctcgaactcagagattcggcacctgaccacgctagggtttgtgacaaagaaaaagggagatacaaggcaacaatga

SEQ ID NO: 66757 - DNA, 438 bp, Glycine max
  Peptide Sequence Number=SeqID_158442
atgaaaagattgtatgaccaagtggaggtgcaaattgaaaagaagaatgaaagttatgctaagcaagccaacaagaaaagaaagaaagtggtacttgaacccggtgatgatcttggacatttgagggcaaatgttttccaagaaggagggaatgatgagaatcctaaaattgtccaaatacagggacctatgaccaggagtagaaccaaacagtcacaagacccaagtagagaaggacaaaagcccaaattgagaaggacgaaggccgaaggccgaagtggaaaaggaagaagccccaactggagaaggatgaaggcccaagtggagaaggacgaaggcccaactggagaaggacgaaagacccaagtggagaaggatgaaggcccaaaagcaaaggcactactaagcatattaatcgttgctgaaggcctagattaa

SEQ ID NO: 66758 - DNA, 213 bp, Glycine max
  Peptide Sequence Number=SeqID_158443
atggacctgggagatgcaagagtgagatacccgattttgaagtcttgcatcaaatcagaagtggtggatacaatgctcatcatgacaccacatgatgtaaggccaacaatgatgcctccatgctcaaggccaatgcatgaactgaatataatgattgcaagttttccatattttgatgccaaagaccaattagtgaggaataagatgcaataa

SEQ ID NO: 66759 - DNA, 153 bp, Glycine max
  Peptide Sequence Number=SeqID_158444
atggataaatgcttgaaggtagaagaagatgagtggagggagagggagagaaggagcaccaaattttgtgcctcaaatgagcccactaatccaacatcaagtccaagattctccactaagtgtgctaggtgtcatgaggcgtgtaaagcatga

SEQ ID NO: 66760 - DNA, 279 bp, Glycine max
  Peptide Sequence Number=SeqID_158445
atgtctcctccacctctaggaatctcacaatctctccaaaactcactaatctccctaaaagatgaaaacttggccccttgctctgctctgtgctctctgatattcacactcttcaggcctctgacggtttttcagctcctggctctctcctttaattttgtgcaaatcaagcttaaaaagggcttcctgatcttgtcgtcgtgcttagcgggagttagtgaatttgagcttagcgccaatctcgcgctaagcttggaaagtgacagacgactcgcttag

SEQ ID NO: 66761 - DNA, 742 bp, Glycine max
  Peptide Sequence Number=SeqID_158446
aaagagaaagagcattggtacaaggcccacaactcaatatgacacaagaagattccactccttcgaggcctggaccagatacacagataatgtgctaggaaggcatatactagctgagaggaaggtagaaatataccatacgaagttggatgagttcaaggctgaattagagaggcgtaacttccataagcgcctcaccaatttagctgacagcagcattgacctagccttggtgaaggagttctatgccaacctctacagtcccgaggggccttcaccaaaacaagtcagaatccaaggccacttgataaaaattgatgcagacagcctcaacaccttcctggagacacctgtggtactggctgagggagaatccttacccgcttactccagatactgcaggatgcccattgatattagagagattgaggctgctttgtgtatacccgtccgagggtttgttttaaatgctgaaggccatcctgggaagatcctcaagaaagatctgacaactcttgctcaggagctctcatctctggcccagtctaactcctctagacttgggttccctactcttatcacagctctatgtaggtccagagggtttgcttttgacagcctagtcttcaaacgcttgagcccgatcattaacttggcctatatcaggaagaactgttggaaccctactgatctgacaattactattagaggggctaggagagtgagggaaaggccgtcttga

SEQ ID NO: 66762 - DNA, 50 bp, Glycine max
  Peptide Sequence Number=SeqID_158447
atgtgggatactctccaattaacccatgaaggaaccacagatgttaaaag

SEQ ID NO: 66763 - DNA, 534 bp, Glycine max
  Peptide Sequence Number=SeqID_158448
atgatgaacatgtccacgaccatggtggactctcatacatgcacaacgacatcattgggatgtgcacgagacaacaacgacgatgcaaataagtctatggtaggcaatggcaacgaccaaaagagtttgaagaggaggatgatacgtattccgcaagaggaatggagagatagagagatcttaacggggtgttgtcggtttggattgagaggggggtcgatgaaggtgaggcattttggagctggtgatagggtagagcaaaaaacaattacgggcaaggaaacatggtggttgggaatgttggaaaagggtgggttgttgtacatggttttgatacccaccattaagggtccaatggtagaaaaaagaatccatggaggtgcaaagggaacgagtgtgattgtggatgggggttgtggtatggttgtgattgtgggtgataaactttgtatggttggtggcatgggtctaccatttgcggtggtggcagtggctggggagggtaatataaatggccatatgttgtggtggtag

SEQ ID NO: 66764 - DNA, 546 bp, Glycine max
  Peptide Sequence Number=SeqID_158449
atgtgtagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagagaatctcctctatcccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 66765 - DNA, 1014 bp, Glycine max
  Peptide Sequence Number=SeqID_158450
atgaagaagttgcgtgtgggggctgtcgtggccgtcgccggcgtcgcggtggcgatgaccggctgcgcgagcagcggcggctccggaggttccgccgacggcgacacgatcgtggtcgacatgtgggcgggcagcgaggccgacgtcgaggcgctcgaggcgcaggtcgcgttcgcgcaggagcagaaccccgacatcaccatcaaactgcagacgtcgccgtggagcgacttcttcacgaagctcaccaccaacatggccagcggcaacatggcctgcgtgaccggcatgagcggcgcgcagctgggcggctacaccggcggcttccgcgagctcagcgccgacgacctgaagacggccggcatcgactgggcggacttcaacccgagcgccgacggcatcctcagcttcgagggcaaggtctacggcgtgcccttcgacgtcgccacgatgctcgtctactacaaccaggacatgctgacggccgccggtgcggcgacgccggagatcggctggacgttcgacgacttcgacgccatcgccgcggacgccacgaaggacggcaagtacggcttcggcatgggcatgggcggctaccagtggatgtcgatgccgatcgcctactcggcgaagcagccggcatcggaagacggtgcgctgcacatcgacgacgaggacttcgtcgacgccgcctcctggtacgcgggtctggtcaccgacaagaaggtcgccgctcccgtggcctcggcctccgacaccggctggggcgagaaccagtacaccggcggcaacgcggcgatggccgtcgacggcacctggaacgcggtcagctacctgaacaacgagtcgggcttcgccgcaggcatggtgccgctgcccgcaggagtcgacggcaacccgggaccgatcctcggctccggctacggcatctccgcgaactgcaagaacccggaggccgcgctcaaggtcatgggctcgctgcatcgaattcctgcagcccgggggatccactag

SEQ ID NO: 66766 - DNA, 354 bp, Glycine max
  Peptide Sequence Number=SeqID_158451
atgtctcttggaaattattttctgaaaatcccctctggtaatcaattacaagacttatgtaatcgattacagctgaaaaatccttcaactatttctcgtccttggaaaattctttttgcaagaatcaattgcgtctttcattcttcctcactacgaggttgtgaaaacaagacaacaattggtacctctaagccctacactggggcaatgaaaggccccatgcataaacctcaaacgaacctagggcagattagaagttctcactcaataggtccccgctacaaggtcatgacgaaagacaacgattggtacctcaaagccttacactggggcaatgaggggcaccgtgcatga

SEQ ID NO: 66767 - DNA, 130 bp, Glycine max
  Peptide Sequence Number=SeqID_158452
gttaattaggcaagtttgtgaagtgctgattatgatctactcgctaagccaatctgccggcttagcgagccgtccgctgagcacaccactcttgcggctgagcgcgaggaagaatttggaagaaggatga

SEQ ID NO: 66768 - DNA, 612 bp, Glycine max
  Peptide Sequence Number=SeqID_158453
atgcgttcatgggtgaggggtcagtggattccctttgaggcagatgccctcagccagttcctgggtgacccgctagttttggaggaaggccagcaatgtgagttcagccagaggaggaacagggccgacgggttcgacgaggaggccattgcccagctgttatgcacaccgaggcaggtgcggatcatgcgtaccaacatgaccactttgacccagacgtggatgacgctgctgctaagcaatgtcttgcctagagatcataactctgatctccctctacctaagtgccagttggtgtatgccatcctgacactgatgagcgtccacgtggcccaggtgattgctgacgccatctatttgtttgtaggtatgccaccaactaggcaccctctggaccaggataagtctaatagggccctggggtttctggcgctgatcacaggcctctgccagtcattcggggttcccatcacccccagtaaagtgatcagaccgccgatcacccaggccttcatcgagaagtactgcacgcctagcaggcgcagggtgatgcacatcaggccgcagacgcaccgccaccacctcgacaggccgatcccgctggatcactag

SEQ ID NO: 66769 - DNA, 579 bp, Glycine max
  Peptide Sequence Number=SeqID_158454
atgaaggcaaagatattagagaatgttataatcatgtctagactattgcgctctttttcccatatctcttttcgatcaaattcttcctcatcatcttctccaagaaattccaatttattaagtgatcaagataaccaaacccacgaggtcgcccccaaacacaatctcttcgataaggaagtccgattcgaagatatcgtacaaaacatggatgactggaacattccagaaatccctcaggatcaactatatgttcctgaaacaattaaggacaaacataactttgattacataatcaaaacagtagaaaacaatattcctctaggacaagatataggggaagaatttcatttactttcaaaaaattcaatttatgaacatagccgtaagtataaatatctacacatcggctgtgtacaagtagccatcaagcccttaattgacatgggcatagatgcaacagttttaatgtgtctaagagatattaggcataataaatttgaggactccttaattggaacagtcgaaaccagtttaggacaaggtccagtatatttcaattgttatccgactaagaca

SEQ ID NO: 66770 - DNA, 207 bp, Glycine max
  Peptide Sequence Number=SeqID_158455
atggataaagctatctctagaatatgtccattggatttaatgatgaaatttgtgcaatttcagtgggctaagtgcgcatccatcgctaagcgcaaattcagcatgcttagcgcgatagaagaatcgggcagggcatcaatatcaaagtcgcatgctaagcgcgagatcagtgtgctaagcgcagtagttgtcttcggccaagcttag

SEQ ID NO: 66771 - DNA, 96 bp, Glycine max
  Peptide Sequence Number=SeqID_158456
atgggggaactgcttcaagctcaggcgaagaaggtggattcaccattggagattatgggcagagcagcctcgttgggtctcaacaatggaagttga

SEQ ID NO: 66772 - DNA, 436 bp, Glycine max
  Peptide Sequence Number=SeqID_158457
gggcttagctggtgatccgggctgtttccctctcgacgatgaagcttatcccccatcgtctcactggccgaccttgacccttgttattttgagtcaactgctgcgcctcaacgcatttcggggagaaccagctagctctgggttcgagtggcatttcacccctaaccacaactcatccgctgattcttcaacatcagtcggttcggacctccacttagtttcacccaagcttcatcctgccactgcctatgagtcgccggctcattcttcaacaggcacgcggtcagagtcccgagcctcctcccactgcttgggagcttacggtttcatgttctatttcactccccgatgggggttcttttcacccttccctcacggtactacttcactatcggtcacccaggagtatttagccttgcaaggtggtccttgctga

SEQ ID NO: 66773 - DNA, 1299 bp, Glycine max
  Peptide Sequence Number=SeqID_158458
tgcagtttcgtgaatgccagctcgccggcggcgctgcgcgagcaggcgcagcgtctgcgccacgcggcggtggcggcgggtcgtcaggcggacgacttacgcatctttatgggcgtcagcgtgatcgtcgccgtcagcgaacgcgaagcgcaggagaagcaccgcagctatctggaatacgccagtgccgaagccggcattgcgcacttctccagctcaattggcgtcgatctcgccgcgtttggcctcgatgaaccgattcacagcggcgacacgcgcgccattgaatcggtgagcaaagcctataacggctggacgcgtcgccagctgctggagcagcacgcgcttggcagccgctacccggtgattgtcggcaacccgtcccaggtcgccgaccagttgatccgctggattgatgaaggtgacatcgacggcttcaatctgacgcgcatcctgaatccgcaaagctaccgcgattttattgagctgggagtcaggatgaaatttgcctcattagtggtgctgagcgccgcaatattaaccgccagcgcgtttgccgccggtgactacagcggcgccctcaaagtcggtaccacggcggctttcgcgccgccgctggaaaccgccgtggctgaagcgaaaaagcagggactgcaggtggagctggtggagttcaccgactggactgcgccgaacgtgagcgtggaaaatggcgacattgacgtcaacctgttccagcacaagccgtttcttgacaatgccaaccgcgagggcggtttccatctggtgccgtatgcgcccgccatcatcaataacatcgggctgtattcgaagaagcatacggcaatcgatcagattccggacggcggcacggtggcgattgccaatgacccgattaacggtgcgcgcggattgctgctgttgcaaaaagcgcagctgattacgttaaaaccgggcagcgggctgaaatccaccgtggatgatatcgccagcaatccccaacacctgaaaatcatcgaagtggaggcagtgcagttgtcgcgctcgcttgatgaggtcgacctggcgcagggatatccgcactatctgcgtttgtcgaagaccatcgaccccaacaaggccctgttatttgatggccttgagcatccggaatatgtgattcagttcgtgattcgcgatggacatcaggacgatccgcgtctcaaaaagtttgttgatatctatcagcactcgccggtggtgcgcgcgaagctggatgagttctacggcaagctgtatcagccgggctggagccagtaa

SEQ ID NO: 66774 - DNA, 300 bp, Glycine max
  Peptide Sequence Number=SeqID_158459
atgtcactacatgttgatgggttaaccaaggtaactacggataagtggatggatataatagaaatgggacatgtcattgcatcaagatataatgtaatcgttgtatccttgtctatgacattctttcctcttagaagtcaaccgctgacaaattcttcattgcatcgtataatttgtatcggtcatgtgtatgacattcattttgttgagcattgttatggtctagcaattgtcatcctcaggcgaagccgtgaccaactccatatattagcagaatacagcattacaagagcttcgtga

SEQ ID NO: 66775 - DNA, 303 bp, Glycine max
  Peptide Sequence Number=SeqID_158460
atggttgctgttggaggaggtgggttggatgatgaagggatgtcttcagctcttgctctctttcttgaggccatcgtaaaattttcacaaattctactaagttatgggagcttagcgaaatgggtcgtcagctcaatcactatcgtaaagaacttcgctaggcacaaggatacaggctcagcgcacgactattatgacaaaaaagaaattctaagttgcttgggcttggtgaatcagcctcgcttagccacaagtacttatccaaaggatgagtattcatcctctatagatccaatcgcttag

SEQ ID NO: 66776 - DNA, 537 bp, Glycine max
  Peptide Sequence Number=SeqID_158461
atggcatcaagaaagagggctagaaccgacgacatcccttcatcatccatcccagctcttcagtcaatcgccatagaaccagatgtccaacacccgcaaactttagtccctatgctacagagcctattcagaggacagctgattatcatgcacagcctgcgagagttggctcagaacaggccaattgtacctctggaatattttcttgagaaagtagcctggcctgaagctcaacttccattggtgagaaccgatgaggttgctccttcggagcccacactggcacgggttgaaccaatgccagccgagccacgaactctagtggtgaatccacctccttcttctgagcttgaagtagttcccccatctccacctctgattatcatctcttatgcatcatcagatgaagctgttgcccctactgattcaccagctgaagaaacagttgacccccttgcttccctagttagaggaattgttgatctttcttattcgtcatctagagaagttgttgctctcactaattccccagtgtag

SEQ ID NO: 66777 - DNA, 228 bp, Glycine max
  Peptide Sequence Number=SeqID_158462
atggttaggactagaggattaggtcgtgccttaggtcaggttactggcagaggtgtgggcagaggagatcgtgatgattctgatgatgcttcgcagcgtcgacggcctactgcatccgcacggaggcaacgagtcgctgtgactgtggcgcacgatgagtcagtcatccctgcgccagatgttcaggatgacccgatggaggcaccagctgctgtagaggacattgtg

SEQ ID NO: 66778 - DNA, 405 bp, Glycine max
  Peptide Sequence Number=SeqID_158463
atgcttacggatcacctgatccgtaaacaactccaagcttccctactccgacatcaatggcggaaaatgattgaaatgcttacctcaacggccgacgctgacgatgctcgacggtggacgctggttcatggttcgtggctcctcctgacggcaacacggctcccttcacggtggttcgtggccgaggaagaagacgaagatggtagcgcgaggaagaagaatggctgcaaggagaatgcgaggaagaagaatggctttgtggggggaaagaagaagaatgcaaggaagaagatgaacgcgaggaagaagaagagtgctgggtgcgcgaggaggagagagagagtagcgggagagagagagagtcagacgtttttttttttaaaattaaccgaggggcataaatga

SEQ ID NO: 66779 - DNA, 441 bp, Glycine max
  Peptide Sequence Number=SeqID_158464
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaagacatgcaaaagcaccactgcagcagccactg

SEQ ID NO: 66780 - DNA, 558 bp, Glycine max
  Peptide Sequence Number=SeqID_158465
atgcagctactatgcgtattcggggcaagatttcacccagaccgccatagggagacgaagtgcggatcatgcgcaccaccacaactccgttctccccctaccgaaaggatcgcgcccataagacacccagtggacccggagaagtccaacaggactctgggttttccaactttggttacgagcctctgtcagtcctacaaggtgcccgtcccctcagcaaggtcatgccattgtgacatagggatcgcacccgcaagacacccagtggacccgaagaagtccaacagggtcctggggtttccaactctgattacgagcctccgtcagttctacggagtgcccgtcacccccagcagggtcatcaagcccctattaacagggctttcatcgagaagtactgtgtccccaggtaggcacagggcgaggcatcacagtagtgagcaacagacgcactgccaccagctccagagttcacctcagctcatccacaaaaagactgaagcgttgcctacgacacatggccgaccagtaggtgaccaagtccaaagccaaaggtaa

SEQ ID NO: 66781 - DNA, 207 bp, Glycine max
  Peptide Sequence Number=SeqID_158466
atgtcacctgacttgggtatttccgcctgccccctaacttcacggcaaaagaatgtttatacggataaccacttgggtattttcgcctgccccctaacttcacgggttagtattgacaaagattgtggggcagccgacaaaagcgaggctcttgctcctacgtatcctcaatttgtgatgaggaactcagacttacgtagttcttga

SEQ ID NO: 66782 - DNA, 315 bp, Glycine max
  Peptide Sequence Number=SeqID_158467
atggtacatctcttgtggatcagttcaagtggagggtacatccacttggttgttcaaagagaacaaggaagggtacatcccttgtggatctttgcttgtaaaggattttacaacgttgaaagaaatctcaaggaccgcaggtcgcttgggaattggatgccacttgatccaacactttttgatgtaatcctcccaaggaagggacccatcaccagagccatggctaggagacttcaagaagattgggccagagatgcaggagaaggccctagggttctcatgaaccttagggtagattttggacccatgggctaa

SEQ ID NO: 66783 - DNA, 465 bp, Glycine max
  Peptide Sequence Number=SeqID_158468
atgccagattccaccaagtatacaaatggaacccaaccatacatgccccccaattatatcttccaaatcgtccacactaacaatccacccttctcccccaaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 66784 - DNA, 747 bp, Glycine max
  Peptide Sequence Number=SeqID_158469
atgccatcgcgtggtggtagaccatatcagagcagtttctttgctatgcagatggacagcttccttctaacggaggagccgggaatgaaagaacctttccttttcgaattggttgctgttcttaaagatcagatgggaccattcttcccggagctggaaaaacagggaaatcttgttacggaggttatcaaaagcgaagaagaatcatttttaaaaactattgaaagcggccttgtacgcgttgaaagactgattcagcaaaccatttcggatggttcgaaggtgctgccttctgtagaagtttttgaactgtatgatacttatggtttcccggatgatctgacaagaattattgcggaagaaaagggattgaccatcgatgaggtgggtttccaggcagaaatggagaaacaaaaacagcgttctaagaaagactctgcttctaaagtatatgactgggtggttctggaagaaaagccggaaacttttgtaggctatgaccagcttgaagctgaaacctatattacccgatacagaaaggtagaaaataaagacggggaattctatcaggtggttcttagcaactctcctttctaccctgaaggaggtggacaggttggcgataaaggagtcctggaaaatgctgcggaaagctttgaagtattggaaacgaaaaaggaaaacggattgatcatttcattgatcaatggtcttccaaaagatgcaggagctgttttctatgctaaa

SEQ ID NO: 66785 - DNA, 135 bp, Glycine max
  Peptide Sequence Number=SeqID_158470
atgccttcatgggttttactgcttggatttgcactagtggccagtcggatggatggcagcggaatggagaaggaagagagagaggaaatgccacttcaaggagaagatgagtctagaagaagctcaccaccatag

SEQ ID NO: 66786 - DNA, 513 bp, Glycine max
  Peptide Sequence Number=SeqID_158471
atgaccattattgtcaatgcggaagcttgtggttacgtgagcatgtactactaccaatatatagatgttgtttacacgaatgagcacatcttaaaagcatactccgcacagtggtggcctcttgggaatgaagcgacaattcctccttttgatgatgcatggacacttatccctgacccaactacaattcatgcgaaagttctgcaacgttacggaaaaagaatcagcataaaaggcaaaagggggagtgtatttagtaaaaagggatgcacaaatagcaaccaagcccacttgggccttctagggtgttccaacagaaggcggtgccttctagtggaagcaacccagctcgcctgggcgagctgggcggcaaatgagaaaaattgtttccgtgaagaaaattcaagccgaggcgcttccgtaatgcttccaagacgtttccgtgagcaatttcgtgaagattatccactgttcttcatcgttcttcgtcgttcttcggtcttcaaccggtaa

SEQ ID NO: 66787 - DNA, 246 bp, Glycine max
  Peptide Sequence Number=SeqID_158472
atggagtggttctacctaatctcacatccattcatgaggcagactgataatctgagaagcatctatgtgctcagcatgtcatcagtttgctcaacgaggcgtttgtctcttcctgcgctaagcgtgcccagctcgctcagcggatattcactaactcgtgctaagcgtgccttcgaggacagaaagccctttttaaggatgaagttggaaaaatcaagcattcggctgaaagagagcatggattag

SEQ ID NO: 66788 - DNA, 90 bp, Glycine max
  Peptide Sequence Number=SeqID_158473
atggatgaagaacactggaggtatgatactatcatgtctgaagaagttgatatgaatgttgaaaatgaggaagatgttggcgtgaaataa

SEQ ID NO: 66789 - DNA, 1311 bp, Glycine max
  Peptide Sequence Number=SeqID_158474
atggaatcagctacgaatttgagggttagggatttcatagcaaaggaagttgctgattgggacgacgaattgattgcagttgctcgattcaaagccttttccggtcaaagatgcgattgggaacccaccttccgcttctggaaacacttcatcatcaaaatcgccacccattttggcctcctcctcattcgaccctcccaggtcaagaatgattggtttaatcgaggagggttaacccctttgtgtcttgacgatgtactgtctctaatgtataatgaaggtgacatcacaagaactgtggatcttgaggatccaacgagcgggcgattctcccaactagtcagaagagtgggtaacttgataacaaggccaccgactccagatattatggctgaacaatgtgttatcgtaactgctatgcttaaggataaggctgctgaagttgtcaaacatctatctgaaagtcactggaattcatcttgtatcgttacaatgaagaaatttcaggacatgtgtggaggaccggatgaggcatctgtaatgttgaggtatctgtctgggtgtagaacagcacagtatctatcagtgaataagaaagattttttagagggggtaaaagtttctctctcagcaggagcattatctagtatcactaatttagattatgatgtactgcacttgatttggaccactgagaagcttcagctacaactggatgtgactgataggcgttatgaattgttgagaaaatcagcattggcttctctacaatctgggaacaaaaaattggcccttaactatgcaagggagctgaagttagtcacccagagtagagaaaaatgttcatcacttttgaacagagtagaggaagtacttagcgttattgccgatgccgagtcaacaaaaaaggttactgaagctatgcagattggagcccgggctattaaagaaaataagatcagcgtggaagatgttgatctttgtttaagagatatccaagagagcattgattcacacaaggaagttgagaatgccctagaacgaatgccgtcatatgtggatattgaggatgaagatattgaagaggaattcaagaagttggagctggctgttgggcaagatgctcaagttcctgcactggagaaggcattcaatgaagaaggaagaatggcttcagaagctgctgattttattagtgacactttctcaaatctcaagctttcagatcgtccagctgagaagccaggaatcactcaggcagtgtcagagggagacaaaataacaaaaaaattagaaatggaagcggtgtaa

SEQ ID NO: 66790 - DNA, 444 bp, Glycine max
  Peptide Sequence Number=SeqID_158475
atggatgattttgctaagagtttgtgtggatggagttgggaggagaacaagttgtttgagctagctttggcagcggtggatgagcaacaccctgaacggtgggaagtggttgcagccatggttggaggagaaaaaagtgctggagatgttcaagaacattatgtgatccttctggaggatttactcgttatagaatctggaaaattggacaatacacttggagaagttatgcctgttgtccttgttgagtgtaaggagtccatgtgcttgtcccatgatgatacaagctcgaaagagacagagccagggaagaggcagtgcatgagcgtagccctaacagatctctctctttctctcctctcatttctcacttctccattttctgttgatagctccattcgtgctctgcctgttcccagcctttgccctgtctcttcctcttaa

SEQ ID NO: 66791 - DNA, 1263 bp, Glycine max
  Peptide Sequence Number=SeqID_158476
atgaaaggaaaaaagcaaagcacagaagaggagctgcggaattcttcacttcatctcagcgagacagatagaaaaagcattaacgatgaggtttcgcggaacctttgttattattttccgttatctttatcggctgcgaaaccatttcaattcaaactcctgaatttccggcatcgagcttcattcttcctccgttcttactctgccgaggtgcaagctcaactgtccccggagctcttaaacataatggaacaaagactctccgctattgagtacatgactgcttcttttaacaattttctaaatcaggaaattgatggcttgaagtcactaatagctgaatgttctgaggataaggacatgcttaatatggctacagaggaaattggtcaggcagtggaagaagaaagaagactgcaaaattttctgttgaagtcattacttcctaaggatgatgctgatgatagggattgcattttggaggtgcgaccaggcactggtggggaggaggcttccttgtttgcgatggatatctttagaatgtatgagaagtatgctctcaagaatggctggaagtttgaagtagtagatatagctcaatctgatcttaaaggatacaatgaggctagtgcagcaattgctggagtcggtgtttttgggaaactaaaatttgagagtggaattcatagagtccagagtttacgaattcttgtgacagaaaagtcgggatgtattaataccaatgctgtttctgttgcaatccttcctcaggctgatgaggttgatgaatggaattacaaagaccaggtagatgttcaattgaagcatgaagacttaagaattgatacctatagatctggtggttcaggtggtcagcatgcaaatacaaccaacagtgctgttagagtaacccacattccaacagggactatgattactatacaagatgagtgttctcaacatatggctagtgtttcaaaatatttggcaagtagttgtgcttttcacctgacatggatgaagccattagcacgtttccaattaagtgaattgcatgccacatttgttttctcagttgaggcagggaggcagcttaaatttggaggccgtgtaactgatcatacagttggtatcacttatcactcggtagatgatgtgatgcaaggtgaaaatcttgattcattgatgctcttctattgcaagaagaaatggatgcaatggccacttttagctcgtctcagtaaaacctgtggattcaattaa

SEQ ID NO: 66792 - DNA, 445 bp, Glycine max
  Peptide Sequence Number=SeqID_158477
ggcgaaacacaatgaggttctgagtaacaaaaatggcaaggttgcaggtgcaaaggaggaagatggatgggaaaagaagaaacaattctgggagatttttcgaagatatggtgcggttaaggagattttaattgcagtaaagagaaaccgttggggtagacagtacggttttttacgctttgtggatgtgaaaaatccgaagcgtctggatacaagggagatgggatctagcaaacataacagaaattctgggatggaggatgaaaatcaaacaaaacctaagagtgggagaaagggcaaagctacaagacataaattcgctgggattaacatgcgatgtattggagatgatatgatcctaatatcggggattggagaaaaggatgctagggagatgattgacaaaggaagagataatttgttgtccgtcttccaagcatcgtga

SEQ ID NO: 66793 - DNA, 336 bp, Glycine max
  Peptide Sequence Number=SeqID_158478
atggcgaaacccaccatgctggccaaggagcctttgaaaacacgtatcgtggtgcccgcatgttcacctcaaccaagatctgatgccactattgtttccttcaccgttgcctccgtcattccttccctcgtcctcgcctacgatcagcgcattgagtttgtcctagagctcccccttgttgttagtgactccgctgaaggcgtcgagaagacaaaagaagcaatcaaagttctcaaacagatcagagcattcccggatgtcgagaaggcgaaagacagccacaacatttgtctttacaagggaaaaatgcataatcgccgctacatctctcactag

SEQ ID NO: 66794 - DNA, 1350 bp, Glycine max
  Peptide Sequence Number=SeqID_158479
atggtgtccgaaggcactctcctgggcatgggtaaccctctcctcgacatctccgccgtcgtcgatgaagacttcttaaaaaagtatcaccgcactctctttaatttccatgccgttttgctccattctcctcgtcgtttcgttactttagagaacaccgttccatatgatatcacctcgaacaatgcgattcttgcggaggacaagcacaagcctatgtatcaagaattggctgagaaatataatgtggagtacattgctggaggtgccactcagaattcaatcaaggttgctcaatggatgctccaagttcctggtgcaacaagttacatgggtggcataggaaaggataagtttggggaagagatgaagaagaactcaaagcttgctggtgtaaatgttcactattatgaagatgaaactacacctactggaacttgtgctgtttgtatagttggtggtgaaaggtctcttgtggcgaacttagcagctgccaattgctacaagtctgatcatttgaagagaccagaaaattgggcactagttgaaaaggccaagtatatttatattgccggctttttcctcactgtatcaccagattccatccagttagttgctgagcattctgctgcaaataacaagatcttctcaatgaacctttctgctccttttatctgtgagtttttcagggatgtacaggagaaagctctaccgtatacggactttgttttcggaaatgagactgaagcaagaacattttctaaagttcatggctgggagactgataatgtcgaggagatagctgtaaagatttcccaatggccaaaggcatcaggaacacacaaaaggataacagttatcacacagggtgcggatcctatttgtgttgctgaggatgggaaggtgaaaaagttccctgtgaaacttttgcctaaagagaaactagttgatacaaatggagcagaaaaaaaaaaaccagaacatgtgcacactttcgccgttgccgccgccctccgtttgtcatgtgcttgcttccgtggtgctcgcgtgcgtggtggtgccgctgctgtcgtcgcgccgctgtgtgtcatgctggagactgctgttgctattcatgctgttgctgtgcgtcgtgcaggggtctccttttgcaggtggcattcgggtagggttggcttgggtcggggtgtcaagctaggtaaccacatgcaacatgcaacgagagcaccgatcattgttgaaatcgccgcagcactggaagaggttgtagatggcatcgaaggaggcagggacaaagaagttgttgtgattggcgaagacaatggagttgacgagggaggtgaggagtga

SEQ ID NO: 66795 - DNA, 1140 bp, Glycine max
  Peptide Sequence Number=SeqID_158480
atgcaatacacgaaaccagcgtttcgaaacgcggctttctactgccacgtcttctctcgctccttaaccttaaaccctaaccctctgctcctcgtttccccgtttcggaaacccgaaacgtttcgcctcgcttcacccgtttcgtgcttatcctcctcctcaatggcggtgcctccgtcttcgctggagaagcaattcgatgactttagggttcagctggaagaatctggaaccttgcgcgaacgaattcgaagcgtcgtttcggagattgagtcctccactaggctcatctatgccacacttcttctcgttcaccagtctcgtcccactcccgagcttttagagaaggccaagtctcatgttaatgtgttaaagaagcagtataagcaacttgctgaagttgttggaggatgccctgggcaatactataggtaccatggtgattggaagagtgagacacagtctgtagtttcaatgcttacatttatgcactggcttgaaacaggaagccttctcgagcacaaagaggctgaggaaaaacttgggtcttctgcatgcaatgctggtagtgtttcgtccctaggcaaagtattgaaggacttgaatgtgaatagttcagaatttggcctagacgttgaagattacttaataggtgagtcttctaaacatgctagcttccttcaggaagtgttgactaatttaaatatgattgtcattttgaagaacatgggtgtggcagttagaatcagtagggtttccaaggcaaaggagctcaataaccaaatgcgttatccaaggtatgtggtgaatcaagtgacagctggggactatgattgtccaaggaaggtcttaaagttcttaacagatctccatgctgcattccgcatgcttaatctacgaaatgattttttgcgaaagaagtttgatgataatggtactgacgttgcattcccaatgttgtcacaaatatttatcatcctaaagcaagattggtctactaactatagcatgaagtatgacttaagaaaagtcgaagaagtttactatgatgttaagattcggggtttgacaccgaatggtgagccagttggagacttggagatcaaggaatcgcaggacaatcttaatcttaagttgtga

SEQ ID NO: 66796 - DNA, 318 bp, Glycine max
  Peptide Sequence Number=SeqID_158481
atgatgaggaaagtttccaaggatagtgttgatcccaagaggagaaaagtgtccaaggataatgttgatcctaactggaggaaattcacgacgaataaatttgatcccaagaggaggaaggtgcccaatgatgatgctgattctaagggcaggaaagtgtacaagaatattgttgattccaaatatcggaaaacaaggttgaagagcaagaagaatccaagtgttgttgtcaatagagcaaaacctttaagcggacgactccccaagttggtgcaagtgcatttcctagtgactcctggttcaaaccttcaacaatga

SEQ ID NO: 66797 - DNA, 282 bp, Glycine max
  Peptide Sequence Number=SeqID_158482
atgacttccgtcgtcgaagacgtactccgccgccatttataccatcacgaaactaacgctctaatagtggttgttcaaattcataccaccaatctctctttgtcacatggttggaagagggcggcaaaggttaatccagatctgcaagttgttgtcgaggacatagaaaccattgtagaaccagactacggcgacgccggtgaggatgagtgtgatggtgccgaggagaaggagtgtgacgatgccggcgagaagaaggaaacagatcgaaccttcgactga

SEQ ID NO: 66798 - DNA, 1050 bp, Glycine max
  Peptide Sequence Number=SeqID_158483
atggtgttagcagcactgagttactatcttcaattctctatgtgtaggactacgtgtccaatttccagtttctacggaggaattacaattgcaaaagataatcaacggaacagtgatggatgttattgtaacagtgaaggattatttgtcgacgccgctggtttgctcgattttatggggggattgcacacacgatggagggaggtagcagcggtcgggtggtgcggaggtgactcagtgaagggattgagtggattgattagaaaagcggaatggaaaggtctcttccttaaagatgacttgaaagagacaagtccttttgtctatttggggttgtcagtgggtgtgggtgctaggaaattaagtacttggcaacaggtgattaacaagatgaggaagaaattgacaccttttggaggaggaagcacttatcttttgggggaggatttgcttggattcaaagaagctttttgtgggatgttaagggggtttaatatggcactattgggaaaatgggcttggagattgttgagtgacaaggagtgcctttggagagatgttttagtgagcaagtatgagttgagagttgtggggacgggtagtgaagtgagcttttggaatgctttgtgggttggtggaacttatcatggaggagggcatcatttggtcaacaaattgtgggaaaccataggggaatttcggccaaatcataatacacaagatggatgggagtggaaatctaaggagtatatgtggttagagaagtctacacaaggtgctatcaatggtggggtgacattatgggcaaataccatagcacacttttggcaacactttgggatgatcaaaggaaggaagaaacaaatggcatggtgggtggcttgggttactgtgatttggtctatttggaagctaaagaacgatattttttcaaacagttcatgcgatctggaagagctgctggaagctatcaaatttcgatcatggagctggagcagatcatttgtcgaaggtctggatatagaggaatgcttaagacatttagcatag

SEQ ID NO: 66799 - DNA, 1548 bp, Glycine max
  Peptide Sequence Number=SeqID_158484
atgacgatgatgcgccttcacaatcacatcacagatcgcaacttcactggcttcgcatttgcggcatcgctgtgtcctttttatatcttcactagatctactacactcccaactccacacttcttcttcttcttcttcttcttcttcattgcacagtgcatccataaacatgaagtaatgagctccatcgccaggcgcgtgctccttcgcacaatcctactcgcgtgcgctgtctcgtttgtctctctgtaccgcgccctatccctcttcgatttcggaaccctcgctcccatcgccacctacttcgactgcgtctccggcttccagagcgtcaccttccgccccggttcccccttactccgaacccggttcggggtctccgccaattgcgagaaagacgccaatttgaccctcactgtggtcaccgagctaaccggtagccggttactccaccccggagctaaaagcctctgcgtcggagaaggctcctcaatggccgtcacggcaatgaaacagttaggttttttctccagcgtcagcgccgtccaaacgcaccgtttcgagcagaggaacgtcctgtacgaggataattccttcgatttcgtgttctcgagagacctagacaaggtttctgtcccggcattgctggttctcgaggttgagcgtgtccttaagccaggtggcgttggtgtcttccttgtaggcaccacaagttctcaccccaatgacatgataagagcagccacacctgtgtcctcgttattaaggtcttccaatgttgtgcatgttggttctgtcaacgaccataaccttgttgttttcaagaaacgagttgaaaacgctactttgttttaccaacatggtttacccgctgattgtcccagtgtcaccttcaccaaaccccttatagagttaatggagcctctcgtgagtgagaaacaacaacaaccaccgattgagtttcacaagaggaatattccctatttgcctaagtttgtggatgtttccactaggaagaggttggtgtatattgacattggggtaggggagcttcttgatgccaatgttagtgattgttggttcctaccatcgtaccccattgatcagaaggatttcaatgtttattttgttcactacaacacttcgattatgttgtcctatgtgaagcgacctggtattacctttgtttaccaccctggcttggctggtattgataaggtcaatgctaagcttggtagtgatgatgatgatgacatggatcctttacttggggaggaggagaagtttgatttccctgcgtggttcaaagaaactgtgcaatatgctgattttgtggtcctcaagatgaacgcaggaagtgttgagctcaagttcctctcggacatatttgagaatggagctatatgctttgttgatgagttgtttctcaagtgtcccgagaggaggggaggtgatgagaaaagtgtaaccagcaaggaaagttgcatggatatttacaaggctctccgaagcaatggtgtctatgtgcatcaatggtggggagactga

SEQ ID NO: 66800 - DNA, 600 bp, Glycine max
  Peptide Sequence Number=SeqID_158485
atgaagatggtaactgctttcaacggcaacatgaagaaagctgctgctggacttagacgcattaatcttgatggtcttcgatggagggtttttgacgcaaagggccaggttcttgggaggttagcatctcaaatagctactgtagttcaaggaaaggataaaccaacttacacacctaatcgtgatgatggggatatgtgcattgttcttaatgcaaaagatatttgtgtgactgggagaaaacttacagacaaggtctactactggcatacagggcaatattatccagtctattttgacataagtcatggtatcatcaattcttttacaatatctaacccacacagtcccattatcattagaagccaaagtgtagatggaaaggacagggatcgaaaattaaggatctttcctggcagtgagcacccttttgttgatcgcccacttgaaccgtatgtgatgcctcctagaagcgtacgggaaatgaggccgcgagcaaggcgtgccatgattcgagcacagaagaaggcagagcagcaacaacagaaggctgatggaatgaagggcaaaaatggtgaagcacaggaagaaagtgcatga

SEQ ID NO: 66801 - DNA, 795 bp, Glycine max
  Peptide Sequence Number=SeqID_158486
atggctgaagcaagcaagaaagaagctgttggagttcatagttgttacaggctggacggtgtaagagtcttagttgattccatttgcaaaaagtacgacaaatacgacgtcgaaaagcaaagggactccaatctctccgccgacgatgcattcgccaaactctacgcctccgtcgacgccgacatcgaggccttacttcagaaagcagaaaccgctgacaaggagaaaagtaaggcatccactgtagcgatcaatgccgagattcgtcgaaccaaggctagattgttggaggaggttcccaagttgcagagattggctatgaaaaaggtaaaggggctttcatcacaagaatttgctgcccgaaatgatttggctcttgcattgccggataggattcaagctatcccagatggggcccctgcagcacccaaacaaactggaagttgggcagcttcagcttcacgtcctggaattaaatttgattcagatgggaaatttgatgatgaatacttccaacaaactgaagaatcaagtcgattcaggcaagagtacgaaatgcgtaaaatgaaacaggcaaaaggattggatactttgaaaaacatggcacatgatatgaatgaggaactggatagacaagttccactgatggatgagatcgatactaaggtggacagggcatcttctgaccttaaaaataccaatgttagacttagagacacagtgaaccagataaaaatatatgctagtctctactcccttctcttgtgtggatttatagctcagttcatattctag

SEQ ID NO: 66802 - DNA, 678 bp, Glycine max
  Peptide Sequence Number=SeqID_158487
atgacgctttttgttggcaaattgacccttttaacgttcatggttgacaatcagaccctaatagattcagatatacaaggcaaacaacatttggaagacggcacatatctactcgctcacttttcagctaggaacaacgacttcgatttccaaaattacattgaacagtcacttgaggaagatttcagaatcataccctgtgatgtggttcactgttgttatttttttgctggtggacgtacatggatttgtgttaacactcctacattacactttattcgtggtaaaccttcttctataatgcattcgagcttgccttctttatatgggtatcaggtagccgttcaagtcctatgcagctatgttactctccccctctatgcactagtggcacagatgggttcagaagtgaagagcaaagcattggctaaaatgctgaagcagtggcatcttgaggttagggagagaaggaggaaccgagaacaactcaagtcttttagttttaggcacacaaatatgtcctcagaatggagccaagaaaataagagtgcccctgatttttcttccacactttgtgaaagcattcgttcctctgatgaaggagaaattgtagaagaattggagcatatggagaaaacaaaggcgagctcatcaagtgatccaccatgtgttgtttaa

SEQ ID NO: 66803 - DNA, 2946 bp, Glycine max
  Peptide Sequence Number=SeqID_158488
atggaagaattggagatcataaacattggaaaggccagcaaagtgtacaatgccgttgagcctgtggtgctcaatgtgcttaagtgcaagattcctctgttctgtggaattggttttagcttccacaacaatccacagcaatggttgaggaaccagctttatagtatttgccaaccttctcaaaaacactgcttggtggggattctaggcttcacgggcatggtatctggcattggagctatccaaattctattgacatttgttgtgaggtttgacatttcactaggttgtggtgcaaattctgtcctatttgagacagcaactttggtggaaaagagagaagatttacctgttggagctaagcctgtgaaaacccccatcaaaaaacatagggaaaaatggagcatggccttcttccatagaagaactttcttctttgatctttctagtgaacccatcttctttgaaccacctgaagcacaatcttcaggaaacacgctcgtctacacgatcctgcgatccaacgcggcgtgtccagtgattccgctctccgtcgagtctgctcatggtgaagaatcacgaggccatccgccggtgaagaatcacgaggccatccgccgagattcaaccacgattcaggaacaaaaaccagacaagctccgattcatattggtagctgctggaatcgtatacaatcgtgcgatgcgtatggtgaatcgtacgatactaactaccatggaggagttatcaaccaacagttacatcaacttgatgtgcaagcaacagcattacagagaagcacttgatacattcaatttccatctaaagaattcaagtatccagctagaaccaagcacctatgtgaatttaattttggcctgcaccaacgttagatctcttaaatacggcaaaagaatccatgatcacattttaaagtcaaactgtcaaccagaccttgttctccaaaatcatattcttaatatgtatggaaaatgtggttctttgaaagatgctagaaaagcttttgacacaatgcagctgcgaagtgtggtctcttggactataatgatctctggatactcgcagaatggtcaagagaatgatgccatcatcatgtatattcaaatgctgcgatcaggttatttcccggaccagttaacctttggaagcataattaaggcttgctgcattgcgggggatatagatttaggtgggcagctgcatggtcatgtcattaaatcagggtatgatcatcacttgattgcacaaaatgctcttatatcaatgtatacaaagtttggacaaattgcacatgcctcagatgtgtttactatgatttctacaaaggatttaatatcctgggcttccatgattacggggtttacccaacttggttatgagatagaagctttatatcttttcagagatatgttcaggcaaggtgtttatcaaccaaatgagtttatattcggcagtgtattcagtgcttgcagaagccttctcaaaccagaatttggaaggcaaatacaaggaatgtgtgctaaatttggtttagggagaaacgtttttgctggctgctccctctgtgacatgtatgcaaaatttggattcttaccttcagcaaaaagggcattttatcagattgaaagccctgatttagtgtcatggaatgcaattattgcagcacttgctaacagtgatgttaatgaagccatatattttttctgtcagatgattcatatgggattgatgccagatgacattacttttcttaacttactctgtgcttgtgggagccccatgacactcaaccaaggcatgcaaatacattcttacattatcaaaatgggtctggataaggtagcagccgtatgcaactctctgctgaccatgtacacaaagtgttcaaatctacatgatgcattcaatgttttcaaagatataagtgaaaatggcaatttagtttcttggaatgcaattctatcagcatgctcgcagcacaaacaaccaggagaggctttcagattatttaagctaatgcttttttctgaaaataagcctgacaatatcaccataactaccatattaggaacttgtgcagaattggtatctctagaagttggcaatcaagtccattgctttagtgttaaaagtgggcttgtggttgatgtttctgtcagcaatagattgattgacatgtatgcaaagtgtggattacttaaacatgctcgatatgtttttgattcaacccagaacccagatattgtctcatggagtagtttaattgttggttatgctcagtttggacttggacaagaagctcttaatctctttagaatgatgaggaatcttggtgtccagcctaatgaggtcacatatctgggggttctcagtgcatgcagtcacattggattggtagaggaaggctggcacttgtataacaccatggaaatagaactagggattccaccaacaagagagcacgtttcttgcatggttgatttgcttgctcgtgctggatgcttgtatgaagcagagaattttattaagaaaacaggttttgacccagacattactatgtggaaaactctacttgcttcttgtaaaactcatggtaatgttgacattgcagagcgggctgcagagaatatactaaaacttgatccttccaattctgctgctctggtgctactttctaatatacatgcttctgctggcaattggaaagaagttgcccgattaaggaacttgatgaaacaaatgggtgtacagaaggttcctggtcaaagttggatagaagttaaggatcagatccatgtgttcttctcagaagatagttcccatccacagaggggcaacatctacacaatgcttgaagatttgtggttacagatgctggatgatggttatgatccttgtcagaggttagacattagcatttggtag

SEQ ID NO: 66804 - DNA, 717 bp, Glycine max
  Peptide Sequence Number=SeqID_158489
atggggagagagaaggtgggagacacagggaagggaaagaaggaaaagggagggttgaagaaatttgaagttgggacaaaaggatattttgacaataaggtagggatcaatagtagcacccttataaataaagtctacgtttatgaatctcttgaacccaacttggttataacaaggatgccaaggacaacacccattaggttagggttttacactgcggcagctacttcggctccatcttcttcgatctctcaaactctatcggcgcagaaccaatcctatatcactatggggaagacacatggaatgggagctgcccgcaagctgaagtctcaccgtaggagacaaaggtgggctgacaagtcatacaaaaagtctcatcttggaaatgaatggaagaagccttttgctggttcatcccatgcaaagggtattgttcttgaaaagataggtattgaggctaagcagcccaactctgccattcgaaaatgtgccagggttcaactcatcaaaaatgggaagaagattgctgcattcgtgccaaatgatggttgcttaaattacattgaagagaatgatgaagtcttgatagctggatttggacgaaagggtcatgccgtgggtgatattcctggagtcagattcaaggtcgtgaaggtttctggtgtgtctctcctggctctcttcaaggagaagaaagagaagcctaggtcttag

SEQ ID NO: 66805 - DNA, 363 bp, Glycine max
  Peptide Sequence Number=SeqID_158490
atgttgttggaaaatggaggggtactagggagatctccaacccaagacttaaaactcaaaggtatgaagtttggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 66806 - DNA, 1206 bp, Glycine max
  Peptide Sequence Number=SeqID_158491
atggcagcagcagctcgccctctcgtctccgtccaaaccctagagggcgatgcagcccccaccgtccctctccccgacgtcatgaaggcctccattcgtcctgacatcgtcaatttcgttcattccaacatttctcgcaacagccgccaaccctacgccgtcagcaagcgcgccggccaccaaacctccgccgagtcctggggcaccggccgcgccgtctcacgtattccgcgagtccccggcggaggaacccaccgtgccggccagggagccttcggaaacatgtgccgcggcggccgcatgttcgccccgaccaagatctggcgccgctggcaccgcaagatcaacgtccagcagaagcgccacgccgtcgtctccgccattgccgcctccgcaatcccctccctggtccaggctcgcggccaccgcatcgagtccgtccctgaactccccctcgtcgtcagcgacaccgtcgaaagcgtcgagaaatccaaagaagccgtgaaaattctccagaaaatcggcgcattccccgacgcggagaaagcgaaactgagccacggaattcgtcccgggaagggaaaaatgaggaaccgcaggcacatttcacggaagggtcctcttatcgtgtacggaacagaaggtgctaaggtcgttaaagccttcaggaacattcctggtgttgaggtggcaaatgttgataggctcaaccttctgaagctggcacccggaggccacctcgggaggttcattatttggaccaagtccgcgtttgagaaattggactctatctatggatccttccataaggcttctgagaagaaaaagggctacctgcttcctaggcccagaatggttaactcggacttggcccgcatcattaactccgatgaggtccagtccgtggtcaggcccattaagaaagatgttaagagagctcctctcaagaagaaccctctcaccaacctcaatgcgatgttgaagctcaatccctatgccaagaccgctaagagaatggctcttctcgctgagaagcagcgcattgtggcaaagaaggagaagcttgataagaagcgcaacattgtctccaaggaggaggcttctgctatcaagtctgctggaaaatcgtggtatcaaactatggtgtctgactctgattatgcagattttgacaacttctctaagtggctaggtgtttcccagtaa

SEQ ID NO: 66807 - DNA, 1170 bp, Glycine max
  Peptide Sequence Number=SeqID_158492
atgttgacgacgatgaatcttcctctgcacacttcggtttgggtaaagtcccggcggagttggtgttgctacgcctcactttcgcagcccgataggaaagagatccgtctcggtttgcccagcaaaggtcgcatgtccgctgacaccctccaacttctccaggtcattccaatttctattcaattcgccattgttactgttatcttctacagtactaactctcactcactctgcattctgtgtgaagaattgtcaattgtcagtgaagcaggtcaatcctcgacactatccaacctcgacgtttggtttcagaggcccaaagacatagtaagaaaattgttatctggagatcttgaccttggtattgtgggactcgatactttcagtgaacatggccagggtaatgatgatcttatcattgtccacgaggctctggagtatggtgattgccgtttatcccttgcgattccccaatatggaatatttgaaaatgtaaattcactggacgagcttgcaaaaatgcctcaatggacagaagaaaagcctctacgagttgctactggtttcacctacctggggcctaaatttatgaaagagaatggacttaagcatgtgacattttcaactgctgatggagcactggaggcagctcctgcgatggggatagccgatgctatcttggaccttgtaagtagtggaaccacactgagagaaaacaacttgaaggaaatcaaaggtggagttgttttggaaagccaggctgtctttattacaagcaggaaatcagtgatccaacggaaaggagtacttgaaacaacacatgagatgcttgagagattggaagcacatctcagggccattgggcagttcacggttactgcaaacatgaggggaagcagtgcagaggaagtggctgagagaatactgagtcaaccatcattaatgggtttgcagggacccactgtaagtcctgttttctgcaagcgtgatgggaaggtaacagcagactattatgccatagtcatatgtgtgcctcagaaggcactatacaagtctatacaacaactgagagcgattggaggcagtggagttcttatatcacccttgacctatatttttgatgaagaaactccaagatggcgtcagctcctatctaaacttgggctatag

SEQ ID NO: 66808 - DNA, 804 bp, Glycine max
  Peptide Sequence Number=SeqID_158493
atggttgtgccttctccttctccaacttctatcaagacaagttacaagaaaaagaagacgataataaaaattccaacgatagacctatccatggaaaggacagagttgtcggaaacagtggtgaaagcctgcgaggaatacggcttcttcaaggttgttaaccacaatgttccgaaggaggttattgcaagaatggaagaagagggtgcagagttttttggcaaagccacctacgagaagcgtggagctggcccagcaagtcctttcggttatggcttcagcaatatcgggcccaacggagatatgggtgacctagagtatcttctgcttcatgctaaccctctttccgtctctgagagatccaaaaccatcgctaatgactccaccaagttcagttgtgttgtgaatgattatgtagaagcagtaaaagaagtaacgtgcgagattttagatctggtggttgagggattaggggtcccagacaagttcgcactaagcaggctcattagagatgtgaatagtgattcagttctgaggatcaatcactaccctccattgaaccagaaggtgaagggcaacaagaatagcattggttttggggcgcattctgaccctcagatcttgaccatcatgcggtccaatgacgtgggtgggcttcaaatttacacccgtgatgggttgtggattcctgtccctcctgaccccaatcaattctttgtcatggtgggtgatgtcttccagggcattaaccaacacattgaaggcaaggatgtcaatgatgtactttgcagcaccaccacttga

SEQ ID NO: 66809 - DNA, 1338 bp, Glycine max
  Peptide Sequence Number=SeqID_158494
atggacgcgaaggatatcctgggattgcccaaaaactcattcccaactctcgagaagaagtctcgtcctcccaaagagtctcaaagaaaaccagatggcatttcacgcgaggtgtatgcgcttacgggtggattggcccctctcatgcctgcaactgaagcctctcagttgaagaaaaagcctcctcctctggaaaagatcacttggcagtggcttcctttcaccagttctgctcgtaaagataatcttcatctttaccattgggtacgagtcgttaatggtgttcctcccacaggggactattcttttgccaagtataacaagtccgttgatgttatcaaatacacagatgaggagtatgacaagtatttgacagatcctccttataggggaggagtgatcttcatgtattcaggattccttttggcttctagctttggcagggatagttttctctgtggagcacttgctttgttgggggagatgtggaccaaagaggagacggatcaactatttgacttatgtgagagatttgatctccgatttattgtaatagctgataggtttccatcctctcggactgtagaggaattaaaggatagatattatagtgtttcccgggctatattgattgctagggctccatcttctggggatgtcgcagcacatcctattgttaaggaaacatataattttgcacaagaaatggaacgaaaacgagcactgtccatggtcctctctcaaacaaggcaacaagaacgaagagatgaagaggttcttgttgaagcaaaaaaaatagcggaaaaacgcctacctcccaaggttgctgaacagtctcagttggttgcttctaatgctggtgcagaagctacagagagggctgtccctggtgaaaccatatctccatcaaatgtgcaaattccaatggctgttccagataatgcatctactctagcttctcttcgtatgcttcgtgtatatttgagaacatatgcacttgagcaaatggtgcaagctgcgaacgcatctgctggacttcggactatcaaacgggttgaacaaactttgcaagatcttggggtcaatttgaagccaagggttccaacgaaagctgtttgtgcagagcatcttgaattaagaaaagaaatactaacttggcttaatctccagaagcaggtgcaatataaagaggctgaaggttcctcttttcgtgatgggtcatatggtgaaaggaacaccaaagtggaaagggttggcaaaaaggaccaaaagcgcaaggcacctggagctccatcagctcataaaagacctagaaaactaaaggcctcagatctttag

SEQ ID NO: 66810 - DNA, 1302 bp, Glycine max
  Peptide Sequence Number=SeqID_158495
atggcagttatgggaagaacatgggaggcttgtcgactacccactaatctgatttcttgttattccgtttcggctcttttcagaacaactccaaagcctgcaccacctcctagccctccacataatgagaactataacaatgcctctggcattcttgatgtacgaaaatttggagcaataggagatggagaaacagatgatacaggatcattcaagatggcatgggacagtgcctgccaaagtgaatcagcagttaatgttatccttgtaccacaaggtttctcctttctcattcagtccactatcttcactggtccttgtcaaggtgtcttggtattgaaggttgatggaactcttatgccacctgatggacctgaatcttggcctaagaacaacagtaggcatcaatggctggtcttttatagaatcaatggaatgtcactggaaggaagtggtttaatagatgggagaggagaaaaatggtgggaccttccctgtaagcctcacaaggccataaggtttttcatgagttccaacttgactgtgcaaggacttaggataaagaacagtccccagttccatttcagatttgatggctgcaaaaacgtccatatagaatcaatctacataacagctccaaaactaagccccaacactgatggaattcacatagaaaataccaatgacatgaaaatatacaattctgttatttctaatggtgatgactgtgtatccattggatccggctgcaacgatgtcgatattaagaacattacatgtggacctggtcatggaattagcattggtagtctgggaaatcacaactctcgagcctgtgtttcaaatattatggtgagagactccttcataaaagtgacagataatggggttaggatcaagacttggcaaggtggatcaggatcagtatctggagtaacattcagcaatatccacatggttagtgtaagaaatcccatcataattgaccagttctactgcctcactaaggagtgcaccaacaagacctccgcagtatctgtttcaaatatcatttacacaaacataaagggcacttatgatataaggagtccacctatgcgttttgcttgcagtgactctgtcccatgcaccaacttaacactctcagatattgagcttcttccttctcaaggagatattgtgcatgaccccttctgttggaatgcttatggagatttggagacactaaccattccaccggtttcttgcttgcttgagggcactcctcagtcagtgttagactatgacataactcgttgctga

SEQ ID NO: 66811 - DNA, 393 bp, Glycine max
  Peptide Sequence Number=SeqID_158496
atggacaatagggtgggggtgacagaggaaggtgtggtggtaggtcaaaaacaaagggtatgggtgacaaaggacaagatgttacaagttggagagaaggagctggagggtaccttcgttggagcacaaaggaaaggtttaaggagaaagtcttcatttgataagattatagatgccaactttgaaggggcacctctatttcccactgatcctgccaagagagaatttgtggcataccctacatttaaagaggatcctgtacaacaaaccagtaatgcttttgattaccttgagaatgctctgggtaaatttgaagatggaccgttctttcttggccaatcttgtttggaaagtattgaaattctcatcaatcttggaatcttgtcaacttaa

SEQ ID NO: 66812 - DNA, 2076 bp, Glycine max
  Peptide Sequence Number=SeqID_158497
atgaaaggtcaatacagttccaagcatccattctctccctcagcaaaacattccaagttccatagttggaaccctgaaagcaaaacattaggtcattttgatcgagttgcaaacatgagaaagttgtgttttaacccccaaacagagtcgtttgcgttggcccgcagttctccttcttcaccactatccttaacctcaagcccaactcctccgaggctgagcttttccgaagctgaggcactgatactgaaatggaaccctgacacttccgcttacgccaaagtcacttccctcttctacgaggacaaaaccgaagccaaacactacattgactccgttaaccagcttcagaaatccatgcattccttgctctctcagaacccttcctctgagaaactcattctcgctcataacctaatgcagatggctatgaagaggctcaagaaagagttctaccagatcttatccatgaaccgcgcacaccttgatccagaatccgtctccgccagatcctctcgcacctccgccaactccagcgcctccgattacgacgacgacttcgctgctgaggacgacgatatccgcgccgccggcgactctatctccgaagtcgagcaggtttcttccggcgccatggcagatctgaaactaatcgctgactgcatggtatcttccggttatgccaaagaatgcgtcagcgtttacatcttaatacggaaatccataatcgacgaaggaatctaccgcctcggcgtggagaaactgagctcctcgcgcgccaacaagatggattggaatgtgcttgatttgaagatcaagagttggttagaggcgataaggatttccgttagaacgctcttcaacggagagagaatcctctgcgaccacgtcttcagttactcagattctgtcagagaatcctgcttcgccgagatttcgagagacggtgcctctctccttttcggattccctgaactcgttgccaaaacgaagaaatcatcgctggagaagctgttccgagtgctcgatatgcatgctgtggtttccgaactgtggccggagatcgagtctatcttctcctccgattacaactccggcgctcgttctcaagtcctggtttcgcttcaacgactcaccgagtccgcgcaaatcttgctcgcggagttcgagtccacgatccagaaagactcttccaagtcggcggtgaacggcggtggcgtgcacccgctcacgattcagacgatgaattacctttcagtcctcgccgattacatcaacgtgctctctgatatattcccgcgcgactggcttccgccgccaaagtcttcgtcgctgccggaatcttatttatacagtccggagtctgattactcggcgtcgaagccggcgctgacggcgcgttttgcgtggctaattctcgtcctcctttgcaagctcgacggcaaggcgaagcattgcaaggacgtttcgctgtcttacctctttctcgctaacaatctctggtacgttgtcgccagagtgcgaagctcgaacctgcagtacgtgcttggcgacgattggatccttaagcacgaagctaaagcgaagaggttcgtcgcgaactacgagaaggtggcgtggggagaagtggtttcgtcattgccggaaaatccagccgcggcggaggcgagggaggtgttcgagagcttcaaccgcaaattcgaggaagggtatcggaaacagaactcattcgtcgtagctgaccgcgaattacgagacgaaataaaaggttcgatcgcgagaagcatagtgccaagatatcgcgagtggtataatgttgttcttgctacggtgggaacagtgagggatttgacggcgacggagtacgtgacctttacccctgaggatattgaaaattacctgtgctgtatcgtcctcgcctctccggcgttggagctaagtgcacagtttgaacggcgagttttctacgccgttatttttcttggttgtagtaatagttttgacatagccaacaaaagcgataacgtctttttcagttttctgcgtggtacacgtaagcatgacttcatcgcgtag

SEQ ID NO: 66813 - DNA, 726 bp, Glycine max
  Peptide Sequence Number=SeqID_158498
atggccaaaatggtgatgatgagtacgtttttcttcaaatctattttcatcttttggtaccgttttttcttcaggccactcaaaaacctccaaagaagtgttagcaatatgatcacatttgcagcccatcaattcaaataccaggggtacgactctttacttcatcgtaattcaaacctcaatgaccacgctctcctctttgatgtagaaggtgcattgttgaaatcttcttcagtgttcccatacttcatgctcgttgcgtttgaagcaggagggctcttaagagccatagttctgcttttggggtacccttttgtttgtttagttggtgatgaaatggggttgaagattatggttatggtatgcttctttgggattaaagcagagaggtttagagtgggaaggaccgttttgccgaagtatttgttggaggatgttgggttagaaatgtatgaggtggtgaaaagaggtggcaaaaaagtggggttgagcaagttgccaagagtgatggtggaaagcttcttgaaggagtatttggagattgattttgttgtggggagggagctgaaagtgttcaatggcttctacgtggggttgatggaggagaccaaaaccatgcatgctaatttggagctgctggttcgtgaagggaaaggaaactgttcccatatgattggaatttcaggatttcataatcttgaccattccttcttctctatatgcaag

SEQ ID NO: 66814 - DNA, 2556 bp, Glycine max
  Peptide Sequence Number=SeqID_158499
atggctcctccaaacaatccagtgaattccaccttgggatttaagtcactggaaaaggtttttgatttatgtgacgggaaattcaccgtgagaggtgtgccattactctctcaggtacccaataacgtcactttcagttccttctcctcaatctgtgaaccccgtgacgccccaccttccatccttcaacgtgtcattgccgtgtcacacaaaggtggcttcttcggattctcccaggtttctccctccgacagattaacaaactccttaggtagtttcagtggcagaaacttccttagcatcttcaggttcaaaacatggtggtctacccagtgggtaggaaattccggttcagaccttcaaatggaaacccagtgggtcctcatagaaatccccgaaataaaatcctatgttgtaatcattcccatcattgaaaaatctttcaggtccgcacttcaccctggctctgatggccatgtcatgatttgtgctgagagtggttcaactcaagtgaaagcatcgagtttcggtgcaattgcttatgtccacgtttctgagaacccttacaacgtgatgaaagaagcctatagtgttctcagggttcacctcgattcgttcaggttgttggaggagaaaacggtgccaaaaattgctgacaagttcggttggtgcacttgggatgcgttctacttaaccgtgaaccctgttggggtttggcatgggcttaaggattttgccgagggtggggtggctccgaggtttgttatcattgatgatggctggcaaagtgtgaattttgatggtgatgaccccaacgtggatgctaagaatcttgttcttggcggggaacaaatgactgcgaggcttcatagatttgaagaatgtgacaagtttggaagttaccaaaaggggctccttttgggtcctaatgctccttcttttaacccaaagacggttaaggagttgattgcgaaggggatagaagttgagcgtttggggaagctgcgtgatgaggctgtttcgtctggggtttctgatttgagtttgaccgagattgagtcgaggattgtgaaggtgaaaaaggaaattgatgatctctttggtggggagggaaaggagaacaaagaattatgtggagggtgttgttgcaaagcaaatgagtgtggtgggattaaggctttcataagggacttgaggactgaattcaaaggtttggatgatgtctatgtgtggcatgccctttgtggctcgtggggtggtgtgaggccaggagccacacacttgaattccaaaataacaccttgcaaactctcccctggccttgatgggaccatgcaagatcttgctgtggttaaaatagtggaaggttccataggacttgttcatcctgatcaagctaatgacttgtacgattccatgcactcttatcttgcccaatctggtgttaccggagtcaaaattgacgtctttcatagtcttgaatatgtgtgcgaggaatatggaggcagagtcgagcttgcaaaggcttattacgatgggttgacaaactctattgtcaagaattttaatggaagtggaatcatcgctagcatgcagcagtgcaacgactttttcttccttggaaccaagcaaattcccatgggaagagttggggatgacttttggttccaagaccccaatggggacccaatgggagtgttctggttacaaggggtgcacatgattcactgtgcctacaacagtttgtggatggggcagatgattcagcccgattgggacatgttccaatcggatcatgtgtgtgccaaatttcatgcgggttcgagggctatttgtggcggtcctgtctatgtaagtgacagtgtgggctctcatgactttgatctcattaagatgcttgtgttccctgatggtaccgtgcccaaatgcatacattttgcacttccaacaagagattgccttttcaagaaccctctctttgaccaaaaaaccgttctcaaaatttggaacttcaacaagtatggaggagttattggtgctttcaactgtcaaggggctggttgggaccctaagatgaagaagatcaagggtttctctgaatgctacaggccaatttcttgtactgtgcatgtaactgaggttgaatgggaccaaaagaaagaagcagttcacatgggtaaggcagaggagtatgtcgtgtatctcaatcaggctgaggaactgcatttcatgaccccaaagtctgaaccactccaatttactattcaaccttccacttttgagatctacaactttgtcccagttgaaaagctaggtggcagcatcaaatttgcaccaattgggctcacaaacatgttcaacagtggagggacaattcaagaattggagtgtgttgagaagggtgcaaaggttaaggttaagggtgatgggagattccttgcttactcaagtgaatctccaaagaagttccaactgaatggttctgatgttgcttttgagtggctccctgatggaaaactcactctcaaccttgcttggattgaagagaatggcggg

SEQ ID NO: 66815 - DNA, 2061 bp, Glycine max
  Peptide Sequence Number=SeqID_158500
atgagcaccaaggacctcaatttcgatgcagacacagctctggcgaaggatttcctttccaactttgcagacgccaatggcgaagccaaatacatgaacatcctgcaagatgttgcaaaccacaaaactcgagcagtccagatcgaccttgaggacttatttaattacaaagatctagatgaggaatttctgagccgtgttactgataatactcgaaggtatattgggattttttccaatgcaattgatgaactcatgccggagcccaccgaggacttcacagatgatgatcatgacatattgatgactcagagatctgatgaaggagcagaaggcaccgacggttccgatccacgtcagaagatgcctgctgaaatcaagcgttactatgagctttatattaaagcatcttcaaaaggacgaccctctacaatcagggaggttaaagctttgaacattggtcagcttgtaagaatttctggtattgtgacacgatgttctgatgttaaaccattgatgaaagtggctgtatacacatgcgaggattgtggatttgaaatttaccaggccaaaattcaagaattagctgaacatgtcccaaaaggccatattccacgaacaatgactgttcatttaagaggagaactcacgagaaaggtggctccaggtgatgtggttgaattatctgggatttttcttcctataccttacactggttttcgagcaatgcgtgcgggcttagttgctgacacttacttagaggccatgtctgtaactcatttcaagaaaaaatatgaagaatatgagtttagaggagatgaggaagagcagattgcacgattagcagaggatggtgacatctacaataaattgtcacgatcacttgctcctgaaatatttggacatgacgacattaaaaaagcactgcttcttctccttgttggtgctccccatcgtacgttgaacgatggaatgaagattagaggagatttacatatatgtttgatgggtgatcctggtgttgccaagagtcagctccttaaacacataatcaatgtagcacccagaggggtgtacactactggcagaggaagtagtggagttggtctaactgctgctgttcagaaagatccagtgacaaatgagatggttcttgaaggtggagcattggtaatggaagcctcctttcttaagtacaacagttccttccatccttattgtgctgggatatcggatatgggcatatgtgccattgatgaatttgacaagatggacgaatccgatcgtacggctatacatgaagttatggaacaacagactgttagcattgccaaggctgggatcactacatcgctgaatgcaagaaccgctgtccttgctgctgctaatccagcttggggaagatatgatctgagaagaactccagctgaaaatattaatcttcctcatgccctcctatcaaggtttgatcttctgtggttaatccttgatcgagctgatatggataatgatcttgaaatggctaggcatgttgtatatgttcaccaaaataaggagtctcctgctctaggattcactcctcttgaaccatctgttctacgtgcatacatatcagctgcaagaagattgtctcctagtgtccccagggaacttgaagagtatattgctactgcctactcctgcattcgtcaagaagaagcaaggtccaatgctccacattcctatactactgtcaggacattgctcagtattctccgcatatcagctgcactagcaagactccgtttttccgagactgttgctcagagtgacgtggacgaagcactgaggttaatgcagatgtcaaaattctctttgtactccgaagatcgtcaaaaatctggtctggatgccatatctgatatctattccatactgcgagatgaagcagctagaggtaaccgaatggacgtcagctatgcccatgcactgaactggatatctaggaagaacggtctagattcaagtttgactgatgaaactgaggaactcaacaatcaaaaaagatcatggaacaattaa

SEQ ID NO: 66816 - DNA, 387 bp, Glycine max
  Peptide Sequence Number=SeqID_158501
atcgagccacacatcggaagcgttatccatgaaaacgatggatcgggaaatggaaggttcaacggagttgagaatccagctatgaatcaacatattgcagcgattccaagctcggaacgacggatcgaaggcatcaaccggcatcggaattgttccgtcaagaaattcgaacttgagtttggctccgagagcgcgtcgcagagacctcgcccaagaatggtagttggaaccatcgaggagtggtgtgaccttgacggaggagggaccgtcgctaggatgaacaaagaacggactagtaggatcagtagagggatccgccggtggcggtggtgctatacgcggtggcatagtggcggaagcaaaaggaatggatcgttaggtcgatga

SEQ ID NO: 66817 - DNA, 783 bp, Glycine max
  Peptide Sequence Number=SeqID_158502
atgcccaacgttagcccctcagttatcctccgcaacaacaaaacacgccacttggttacaggcaatgacaatttaattgagtttcgtcgtaaattagatgtcatgaaacgcgacgagggtgaaatcgccgaaacactacattttatgatgtcgcctgttgggagaagggtttgtacttttgacgatttactgccatgtatcgagaacatcacttttttgtctgaggaaaaggataggatacttgaggcacatgaagatgctcccccttctcagccacaatttgaacatcaacagtttaatatactacagcaaagtgtggagactcgagccttagcgcgacgtcggaaaactgttgatgcagcaacgtatagtttgcctccgatgccagaacgacaacatggaatgtattacacaccgccggcattcacccaagaaccgtctcagatgccgccgatgtattcatacccccatgattttcaaccagggtatagttttgcaggtatatttgggttctctcctccttcaacgggaactccttcatttacccaaagtggtcaagtatcgaccccaaatgccccacttgctggtctgtggaatgtacttggagatatacccgacatggacgacttattaggggtcaatttacatcatgatttctctgtcgaggctgaccaagtggatgaaagggcgagtcctagaagaagaaatcctgatagggcagctagaaattgggaccgaccatgtgggacttcgtcgcggcatcacagacatagtgatgattga

SEQ ID NO: 66818 - DNA, 342 bp, Glycine max
  Peptide Sequence Number=SeqID_158503
atggtaagggctccttgttgtgagaaagtgggattgaagaagggaaggtggacaacggaggaggatgaaattttgaccaagtacattatggccaatggagaaggttcgtggagatcattgccgaaaaatgcaggattgttgagatgcgggaagagttgcaggctaaggtggattaactatctaagagctgatctcaaaagaggaaacttttctgttgaggaggaaagtaccattctgaagttgcatgcttcgtttggcagcagaggatgtaactctttccgacgacctgacaagggcagcaataccgggtcaaacagccttcaatattgccgggctatttaa

SEQ ID NO: 66819 - DNA, 810 bp, Glycine max
  Peptide Sequence Number=SeqID_158504
atgaataactggtcgttgatagcaagtcatttacctggaagaacagacaacgagataaaaaactactggaactctcatttgagcagaaaaatttacactttccatgggaaaacaacttctaaaggcatcatcaccctacctcctcggcgcaaacgtggtagaaccagccgctgggccatgaagaacaaaaaccaaaagggtagtagtagtacacaacaacaacaacaacaaattcatcatcatctcaataatgaagtagcagttcctctccctccaaaacccccacttgagaccgagaaatatttgtccaccaatataatattaatggaggagcaagttgatgggtcgagcactgctagtacaataaccaatgatcataaacatgaaaacactactactatgtgtgttgaaggcgagaaagaagaaatattaaatgacgacatatgggggccgtatgttgaggaagttattaacgggggagagttagtgttaaattttgatgatttcatggaccattgctggcaggaagcaagtggggtttggaccatttctgatgaacaaagagagagcaatatcaatattgtggttgggaatgaaaaagttgatgacgacatgtgtacgaacgtaattatgtcgagtggggatcatgatcggttgcattcttcctcttccattgcttcggacttggatcaaaacctcctcacttggctgtgggaagatgaagattgggagaaggatcttcagagccttggagagattcatagtgacaaattaaaagctatggttgattggtttctctcttcaagttaa

SEQ ID NO: 66820 - DNA, 477 bp, Glycine max
  Peptide Sequence Number=SeqID_158505
atggctagttcgttgcctttgcaatcttccttgttcattctcttccttgcatctactgtttttgctatcaataatatcacccatgccacttcagtggcaaaagccttagttccatgcacaatgtgcactgagtgtgagaacccatgccaacccctgctgccacctccaccgccacccgtggtagagtgcccgccaccaccatcacctccaccgccaccagcggtcaatgaatgccctccaccaccaaagtcaccatgcccagataattgtgaagtgccacaaggaccagtgccccggccaccgtacccaccggtattgtactttccaacgggaacgccgtatccaaactatgtgccagataatatcaacaacagcggtggaaagatgaagccttactcgatctatttcacaaagtccttgattatttatgtggcatgtctttaccttattacttgtttatttagtgaattgttttga

SEQ ID NO: 66821 - DNA, 342 bp, Glycine max
  Peptide Sequence Number=SeqID_158506
atggagagttacggttcaggtcaccgtccgtacggaggtggccggaggatggaggttgtgagcggcaaaagccacggttggagttcgactcagtcgccggattcaactcaggcgagtgaaaagccatggagattcggcgatcctgaagcgaagagaaagaaaaggatagcgaaatacaaggtttacggcgtagaagggaaggttaaggctacgctcaaaaaaggtcttagatggatcaagaaaaagtgttctcagatcgcccatgtcgaacgactttgtgcattgatagaggatttctatcctgttgtttgtatgatcacaaggggcttccatgaaatatga

SEQ ID NO: 66822 - DNA, 231 bp, Glycine max
  Peptide Sequence Number=SeqID_158507
atgaaatatcgatccatctccggtttccaaattgttctgaggcgttcactagcatcgcctaaacccattttgtttacctacaatcaaaaggagcaccttggtaggagtttgaagttggctatggtggatggggataagatttccgggacaaggttgaatctgctccgtcgagggaatacgattgtaccccctaacctttttagggttatcactcggtcaggctgcttgtaa

SEQ ID NO: 66823 - DNA, 246 bp, Glycine max
  Peptide Sequence Number=SeqID_158508
atgccgctgcacattatagttggaggattgactgacgagaagactacatcgtctgcacttcttcttctcgtcaatccttacctcaaatcggagcctgccgggattccagatttcacttcctcgctacggcgacaagcaatggaattaatttctctcacagcaccgcatcgagctctcaccgtcgaggatttgcggcttggtgaggtgtgtcctcgtgccggtatcaccgggagccgacgtgtttga

SEQ ID NO: 66824 - DNA, 1044 bp, Glycine max
  Peptide Sequence Number=SeqID_158509
atggaggaaaaaaggacagcaatcacaaacaggcaaggattaaagaagaaaatgcacccattaattagcagcttaagcattggcggcgatggtgggattgccgggctttttgtgttcggtggagccttggcccttgcgggtttcatggcagttggttcttttgcgagcaaaaaacataaggcaaagggcacccatgatgatcaccaacctaagcctaaacctaaaccccaacaattgttattggaggaacacgggtgtaagactgatcatgaagaagatcgtgacaccacccaaagtctcacctctcttattcagcatggggatgccgcatgctgttgggcatccaatatgagaatcaaccaagttagtgattcctccgagttgctgtctgctcaatccttgattttggaggataaaagtgagcttaaaccaagaagtgtagaggagagcccaaccgactttcaccatcaggaaattgtgttttctgactcttcgcacccagaaagcgcggcatcgtcgaacgaaggtggggttgcggaagaatgcatgatgtcattgttaaacagccccagtggccagaatgaagaacctcaagatgacttaacatcctcagaaacagaaacagagaccgaggacgatgatatcgatgttgacgacgacatgctgtcccatgatgtttcagagattggcgaagaagatggctcaaaattagcagcaacagggactacctccccggagccaatttggcctgtggagctgatagaacatgcaaagcaaaaattgaagggagatagccatgtttgctgcgattctgatatggatggctccgacttggatgacgaggccatcatgactgtggcaaaccaagcaactatgaaccaaaatctaaacttctttatggtgccaaataatcaaccattaaccacctgggtttttcccttcctgttgctagcgctgctgttgagcttagttctactcactcgtcgcccacaagaatcattttatgtcctagacgagggtacttcagtagtgacgcgaatttag

SEQ ID NO: 66825 - DNA, 1251 bp, Glycine max
  Peptide Sequence Number=SeqID_158510
atgaccttttcttgtctctttttccttctttctgtcttttccaccactctgctcctcccttgtcattctcaccaccacccccactctgccacgcacaactacagagatgctctcaccaaatccatcatcttctttgagggccagaggtcagggaagctcccttctaaccagaggatgccttggaggagagactctggtctctctgatggctcagccatgcatgttgatttggttggagggtactacgatgttggggacaatgtcaagtttgggtttcccatggccttcaccaccaccatgctttcgtggagtgttattgagtttggtggggtgatgaaagaaactgctgcggctcttgcagttgcttctctggttttcaaaaaaactgatcccacctattccaaaactttgattaggagggctatccgtgttttccagtttgctgataaatataggggaccctacagcaatggcttgaagcccattgtgtgccccttctattgttcttactctggctatcaagatgagctgttgtggggtgctacttggcttcacaaggctactaagaacccaatgtacctaaactacattaaggttaatggaaagacccttggggttgcagattctgacaacacctttggatgggataacaagcatgttggagcaaggatactgctctctaaggaatttcttgttcggaaggtgcaaaccctgcatgactacaagggtcacgcggacaattttatctgttctgttatccctggctcctcttcttcccaattcagcccaggtggtcttctattcaagatgggtgatagcaacatgcaatacgtcacttccacctccttcatactcttagcttatgctaaatacctgacgaaagcccatgtggttgtgaactgtggtggatcaatagtaactccaaagagacttcgagctatagccaaaaaacaggtggattacttgctaggagacaaccctttgaagatgtcttatatggtggggggctcatcgctgccgtccgtttctgttcaccctggcaagatccaatgctcagcaggattcagtgtgatgaagtcgcaatcacccaaccccaacattctagtgggtgccgttgttggagggccggatctgcatgatgggttcccagatgaacggtcagattatgagcaatcagaaccggctacttatattaacgcacctcttgtaggagcacttgcttatctggcacactcctttgcccaactctag

SEQ ID NO: 66826 - DNA, 2673 bp, Glycine max
  Peptide Sequence Number=SeqID_158511
atgacagagaagaagcggaaggagagggacgaaggcaaccgccaaagactgaagccgaagaagaagccaaacactcaatggaagaagagaggccctcgtttgccctcatctcttcagaaacagctccaccgtttaaaccccaccacttccttcgacagcgtcgattccgatgacgacaatgacgtttacgagtacgaggaagaacgggctgaggaggagtccaagaaaaacaagcgttacgaccctgcatccgtcgacgatgaccttgctcaagatattgaggatgagaatgtgcaatctgatgatgaaagtgaggatgatgattacaccgggacaaagaggaatgaaaatgctccaagtgacgattctggagaggaagacgatgataggcatgcaaggatgctacaagcaattactggcatgccgagtgaggcttttgaagagaataagaagaaaaagaaggtgatgaaggacactgttataccagagctatatccagagtctgaatataatcctagtcgtgatgttgtggatggtgacggacgcattagcatagaagacctactgaatcctcttcgtgaaaaatctggttatggaaaacttaggaagagatatcaacaaattgagaagaatgctaaaattattcatgtgccactttcaaaggcagttcaagctaaggtagagaggaaggcagcatatgaaatatcaaagaaagatgtcaccaagtggcagcatattattcagagaaatagagaggccccaactattttctttgatgaaaatgtaaatttagggttttcaactgtaggagcaatagcttctgaatttgaacccagaactgaatttgagaagaaaattgctgcactagtttatgatgaggaagttatggaagctcataaaaaggatggttctaagcttcttgaaatgaacaaggtctctattgaagatgagaaggataggcaaaatcggattgctaaaatgcggagccttctttttcgtcatgaaatgaaggcaaagcatattaaaaagattaagtctagaacatttcatcgtttgttgaagaaagatagattaaaggcagaagcttctcagatgcaaatggaccctgaagctgctaaagaatatgccatgaaacaagagcgtcaaagggctgaggaacgcatgacgctgaaacacaaaaaccataatccgtgggctgcacgtattatccagcgtggtttacataaccaagatgaaggaactcgtgctgccatacatgaacaacttcaaaggcatgctgaattgactagaaaaatgaagtctatgaagggtagcagcagtagcagtgaagatagcagtgatgaggatgaggatgacaactctgctggttctgatcaggatagggattacaagattttgggaaaagctaaagaaaaaacagtgaaagtgttggaggaagaggatgaagttcccaaatcaggattgctttctttgccttttatgaggcgtggattggagaaaagaaaagaggcagctgttgaagaagccaaccttgctttccacgaatatgaagattccttgaagaagttggagaatactggtggctcagaagatctgaaagctgcttctaccagtggcagaagagtatttggaatggctaaagcccagatgtctgataccagtaataaggtaaaatcagataattgctatgatggcagtgatagtgaggatgacttggggatcagcaaaagtggcaatatagagaatgagggaagcgaccttttgcatacggatgtaaacaaggatttggttgtaattcaagatgacactgatactcaccgggaatcagtttttaagaatattgatgagattattaaaaatcctgggccaaaaactacatatgatgtttccatatttgtttcagatacatggaaaaaggcaaaaaacaaaaatgaagacatgactatcaagaagtctccgaagcttacagaactagatatgcaagctataaaagttactgaaaaggaatttggagaggatagtgatacagattgtgaaggacagatggtggatggaattctgtcttctgtttctaaagtaccttatgaacttccttctcaagaggagctcattcggcaagcttttgctggggatgatgtagatgatgattttgaaaaagataagcaggagatcctcaacgaagaaaatcctgagccagagaagcctctattacttcctggctggggccagtggacacatgtacagcaaaagaaaggtttaccatcttggatgctgaaaaaacatgaagatgcccagaaaaaaagggcagaagccctcaaaaaaaggaaggatgctcagctaaaaaatgtgattatatctgagaagatagacaagaaggctgagaaactacatactaaatcattgccatacccttttacttcccaagaggtctttgaacagagcatgcgtgtgcccatcggacctgaatttaatccagcaactgcaattggtcctcttaaccggccggaagtggtgaagagaccaggtgttattataaaaccaatagagttcgaagaagtgaatcctcatgaaaaaacagagcaacggagtggaggagataagcgtaagtttaagaaaaataaagtcaatgctgacaatcccatgaaaaaggggaaggtgggacgaaaaagttaa

SEQ ID NO: 66827 - DNA, 519 bp, Glycine max
  Peptide Sequence Number=SeqID_158512
gtgagaatagctaggattttcaacacctacgggccacgaatgtgcttagatgatggtcgcgttgttagtaacttcgttgctcaggcactgaggaaggaacctttgaccgtttatggggatgggaagcagactaggagtttccaatatgtttctgacttgggccgaaggctacaccgtgtgttaaggcctagatcagtaccagtgagattactggtggaggggctgatgcgccttatggaaggagaacatgtgggacctttcaatcttggaaatccgggtgaattcaccatgcttgaacttgccaaggtggtccaagaaacaatagatccagaggctaagatagagtacaggcccaacactgaggatgacccgcacaagagaaagcctgatattagtagggccaaggagcaactgggttgggaacccaaggtggacctacgcaagggactccctctaatggtttctgacttccgacaacgcatttttggggaccaaaaggaaggaacaacctctgcctaa

SEQ ID NO: 66828 - DNA, 1161 bp, Glycine max
  Peptide Sequence Number=SeqID_158513
atgaaaaatgtagttaaaacaactcaagtgaatgatgttttgccaagtcaggagggacctatgaagcaccaacaccgacacggacactggacacgacacggacacgtggacacctgtaatgtccaaaatatagaacgtagtacgggtgtcgtgtcggacactgacacggacgcgtgtcggacacagacacggcaagggactggagttcaagggactaaagtgattgtgggcttaagtgatcaatgcttacggttaaggtggtgggttaaaattaagtacggacacataacacacatcgacctaaaggttcccccaagaccacctggttatgcatttgtagagtttgaagatgctcaagatgctgaggatgcaattcgtggtcgtgatggctatgattttgatggccaccgactgcacaatagtggttatcctggtatagcgtatttagggtggccaattagtaagatgactgaaaataactcaccaagactgtttaacttgaatctttataggtggagcctgcccatggtgggcgtggtcattcatcctcaaaagatcggcacaatagtcacagcaatggccgaggtggacgtggggtatctaggcgctctgaatatcgtggatcacatgcgcaaggcaggggatgtttgcttttctcaagtttttcatgatggaaggggtactaccggtattgtggattacacaaattatgatgatatgaaatatgctattaagaagcttgatgactctgagttccggaatgcattttccaagggatatgttcgggtgagggaatatgattcaaggcgggattcttctagaagtcctagtcatggcccatctcattctagaggaaggagctatagccgcagtcgtagccgtagccatagttacagtcgggaccggagccaaagcaaatctccaaaaggaaagtcttcacagcgttcacctgctaaatctccaaaaggaaagtcttcacagcgttcacctgctaaatctccatcaagatctccctctcgttctcgctcaagatatggaaacttgcagcatactggaaattggaaattaggatcttggtgggatttggttcaattgtctgcaactcattttgttgtggagatcacggtccaggtccaggtctccattgcctccggtgagtga

SEQ ID NO: 66829 - DNA, 1610 bp, Glycine max
  Peptide Sequence Number=SeqID_158514
atgtcattggcatcatcttcaacctggttaacatccctctcatgtgcattccctgagaaacaaacctcagggtacacgtttgtctcaactctgcttcaatggtttgagtttattttcctctcaccttgtcctcagagagctatattgtctttcattgatgtcgtcctcctcttctttctctttgtctttgctgtcaccaagttctggaaaaggtccaccaacctcaacgaaccactcatcagaaataacaataacatatccattttcttgactacgtggtttaagctaaccttaactgtggcgattctgttgactctagtttacacggttgctagtgttcttgctttcagcagttcctctgaggtgccgtggaaccaagttgatgaggtgttttggttagtccagaccataacacacgcggtgcttgtcgtcttgatcattcacgagaaaagatttgaagccgttaaacaccctctgttggtgagactttattggattgcgaatttctttgttatttctctgttcgctgtttctgcggttatacgtttggtctccgtggacgtggatggaaccataaactttaaggtgaatgacgtggtgtctttcatttcactccctctgtccttgtttcttctttttgttgcggttaaaggatccactggcattgttattccgacagaagaaacacgaccacttcttgaggaggaaactaagttatacgatggtggtgatgagacagaatccgaggttactggcttcgcttcagcttctatattatccaaggcattttggagttggataaaccccttgttgcgtaaagggtacaagtccgcgctgaagattgatgagattccaacgctttctccagagcatagagctgagagaatgtcatctatttttgaatcgaagtggcctaaatcaaacgagaggtcgaagcatccggttagaatcactttgcttcggtgcttttggaaggagttagccttcaatgctttccttgcaattattaggctctgcgtcatgtttgtggggccggttctcatacaaagttttgttgatttcacatcagggaagagaagctctgaatacgaaggatattacctcgtgttgattcttctcgtttctaagttcattgaagtcttggctactcatcatttaaacttccaagctcagaagctagggacgcttttacggtcaactcttatcccttctttgtataaaaaggggttaatgctatcattctctgctcggcaggatcatgggatagggactattgtgaattacatggctgttgatacccagcaactctcggacatgatgcttcagttcaatgctgtgtggatcatgccgtttcaagttgccattggcatgtttctgctttacaattgtctaggtgcctcatccgtcaccgcgtttctcggtcttcttggtgtttttgtgtttgctgtgattggtacccgtaggaacaaccacttccaatacaatgtcatgaggaaccgtgattctagaatgaaggctgtgaatgagatgcttaattacatgcgtgtgatcaagttccaggcctgggaggaacatttcagccagagaatcatgggattccgtgagaccga

SEQ ID NO: 66830 - DNA, 252 bp, Glycine max
  Peptide Sequence Number=SeqID_158515
atgggatctttgttagcaataagatgttcatctcagtgtgatttttgcgtttgtggtagttgtgaaggtggcgtaaagggggatgaaggatggttttgttggtcaaaggaggggtcttctgcatcaaggttattgtatgaagacactggattattgaggtctatgttgttgtacgataactgttgtggaggcggtaactgtagttgtgtggacatgagggttctggagacgatggttgtggttgaggaataa

SEQ ID NO: 66831 - DNA, 744 bp, Glycine max
  Peptide Sequence Number=SeqID_158516
atggatgtcgaggagcaaccttcacccaacgcaagcgacgttaaacgcttcggccttaaaaactctattcaaaccaacttcggcgacgactatgttttccaaatcgtcccaaacgatgattggagtgcaatggcggtgtcactgtcaacgaacgcagtgaaactgtattcacctgtggcgggtcagtattatggagaatgcaagggtcactctgaaaccatcaatcagattttgttttcgggtccttcaaatccccatgttttgtgttcctgttcttctgatggcaccattagagcttgggacataaggacttttcagcaggtttcttccatcaatgccggtccttctcaagaggttttcagcttctgtattggagggactggtggaaatttagtagccgccgggtgtaaatcgcagtggtatgtaagctttgtcctcaagtatgattttgttcagatactgttctgggattggagaaatatgaagcaagttgcatgcctggaggactctcatgtggatgatgtcactcaggttcattttgtccctaatgaacaaggcaagctgatttctgcttcagtagatgggttgatctgcacatttgatgctactggagatatcaatgatgatgatcatctagaatcagtgattaacatggggacttcaattgcaaaggtggggatttttggagagaattatcagaagctttggtgcttaacacatattgaaaccctggggtacagttaa

SEQ ID NO: 66832 - DNA, 222 bp, Glycine max
  Peptide Sequence Number=SeqID_158517
atgaaacctcacgtttctggtgaaagctctaatttggccaaggagtctagcagatccgtcggagagaagctccaccaggtttgtaaggctgccatggtggcaatcaccaccgatggatccaaccaacgtagtagtaggcttctccccaatcaaagggagtggcgtaaaaatcttataagcttccatagcctgatatatatataccatacggcagcaacctaa

SEQ ID NO: 66833 - DNA, 177 bp, Glycine max
  Peptide Sequence Number=SeqID_158518
atggcagcaaagccagctgaagaagctcctcaaggagaaaccctcaagtaccagtcgtgggttttgaaagtattgatccactgcgatggctgcaaaaggagagtcaagaaaattcttcagggaattgatggtatatatcactctctgcatttatacttcttttggcacatgacatag

SEQ ID NO: 66834 - DNA, 1112 bp, Glycine max
  Peptide Sequence Number=SeqID_158519
cgggagagggaagctgaagagaatattttcgttttcgaaatccaccgatctctctcattcttcaatggccaccctttccgcatgcgcttcccctccatggccaaaccctaattctcccaattcaaatccagaccctaatttcctccccgatcaatcccaaaccctcgacttcgactccctcatgcctccgcaacccgaatctccaccgccccaccaccaccactcccccgacgcatcgccgccggaatcctccccatcgctcccgccgccgtcgctcctctacctctccttcaaccaggaccaggcctgcttcgccgccgccgccgacagcggcttccgcatctacaactgcgaccccttccgcgagctcttccggcgcgatttcgacggcggcggaatcggccacgtggagatgctcttcctctgcaacatcttcgccctcgtcggcggcgggcctaaccctcagtacccgcccaacaaggtcatgatctgggacgaccaccagggccactgcatcggcgagctctccttccgcgccgccgtgcgcggcgtccgcctccgccgcgaccgcatcattgtcgtcgtcgaacagaagatctttgtctacaacttcgcggacctcaagctcgtgcaccagattgagaccgttccaaaccctaaggggctctgtgcggtttcgcagctgtccgattctctcgttctcgcgtgccccggtttgcacaagggtcagattcgcgtggaacactacgcgcagaagaagaccaagttcatctcagcgcatgattccagaatcgcttgcttcgctctcacgcttgatggacagttaatcgccaccgccagcaccaagggtacgctgattcggattttcgacacagatcacggcacgcttcttcaggaagtgagaaggggtgcgaatactgctgagatttgtagtttggcattctcttctactgctcagtggctagcggtctcaagtgataagggtactgtccatgtattcagccttaagaaacattctaacatccccgagctggaaaagacacaaagttcatccaattcagaggctgccgttaccctatctaactcatctcgctccttcattaaattgaaag

SEQ ID NO: 66835 - DNA, 4887 bp, Glycine max
  Peptide Sequence Number=SeqID_158520
gatgaaaaacttcaagatgttctgggacactttcagaaggattttgagggtggggtgtctgcagagaatctgggggcaaaatttggtggctatggatcatttttgcccacctatcagcgctctcctgtttggtctcatccaaggactccacacaaaaattatagtcaaaatacgcccagatctcccaataatttgcaaccggagggtgggcagggggatggtgtacaatgttcaactggaactcagtcatcaagacttggcccaggttctggtaactcctcgaggatggctgcaaacaagggtctctctttagatgatggaactaatcaagaaaaatacatgacagccactaaggctgacacatccacttctaagcaggagtctctaaacaaaaaaatttctagcacatcagaccagaagacactgaaggttcgaatcaaaatgggtcctgatagtttatcaacaaggaaaaatgctgcaatatacagtgaaattgggcttgatgtgtcaccatcatcatcactagatgacagcccctctgaaagtgaaggaatttctcgtggtcctcaagatgctccttttgaatctccaaccattatccttcagattatgacagacctccctcagctattgtcacctattcccgatgataccattgagttaactgtaaaggaaacacatgctagagatagcatccctggtcctgttcatatggatgacttagaaagttttgacatgtacgaatctaataatgtaaagggagacagaaagttgttaggtgggagtgggaggaaaatgaaatctctggagggttgtgaatcctcaatggaagtcaagggctctacaaagaagaatgctcggaatgatgttggagtgctgtcaagaaaggaacaaagtacagatgcattgactatggaggagctagtttcaaaaactatgaagcttccacttttatccagttcatattctttcagtgatgacttggttaaggctgtggatgggcaatgtgattcattgaaggaagccaacaaagttatagtgagggagaaaaccttctctgatcagggacaaaaggaacggatggagtcaacgtctactgaggtgaatggttttgctgagaaggcaaagggaagttcaggaagaaaagttgtgggagataaggtttctcttgatgactacccagtaaaggaaaatcaccagggagataaaaatttcaactcaatgatagttgaaaataatgtttccaaagttaggacagaaccaaacactgaagagccacctaagaaggctaatcagagaggtaacctctctgaacaagatggtgtagaacatccatttccagggggtaagaaaaagccaaagggaagtcatggcaccatggttatggagagggaaaaagaaaacttgaaggttggatcctctttggttcctaaaataaaaaagagttctgatgatagttctgcatcaagaaatgaaactgaagatgccagaatacaaaaaagtcttggaaagactagagatacttacaaagatttctttggggaattggaagatgaggaggatagactggattcattggagaccccttatggagaaaaactgaaggaatctgaggtggtcgagaggagtgcacctacgactagttatggagcaaaggagagatctggtggtaagaaagttgataagccattcacagctgaaatataccctaaaacagccacaaatatctcatgcactggaaatgccaatggcactgacctagagaatggtaaagggattcctgtaatgatacctcctgttgagatggacgataagtgggtacagtgtgatcggtgtcagaaatggcgtcttcttcccgttggaacaaatcttgacagcctacctgaaaagtggctatgtagtatgcttgattggctgcctgacatgaatcgatgtagctttagtgaggatgaaaccactaaagcacgtattgcattatatcaagggcctcctcttgatagtcaaagtaacctgcagaatgtctccggcagtgttatgctgggaggaaccatggcaatgtcccagcatccttaccaacaccaactaaataatgatatgcatgcagcacctgggggcaagaaaaagcttatgaaagagagatcaaattctataaataaagacagcttttctcaatcatcatattctattaagaaaaactggcagtcagcagtgaaaagtaggagcttaaatgatgtgaacaaatctcctgttgtgagtgaggctgatgttccagcagacaaacacaaaaataagcattggatgctggagcacaattctgatagaggtaacttgaaccacatattcattgtgcttatctcctctgtattaactaatgtgcagatgttcaaagacctgttaaatttatatgatgttatgttcatttctggaaatctgttctcaggtgatacgaagaatatgaaagtcaaaagcaggaaggaccctgatcaagatagttctaggccatccaagaaatctaagagtgacaaggttcattctaccaatgaagagtggattgtagaacagagtgggactactaggaaggtgggtgatcatagctcaaatagcacttttccaaatacctcagttggcaaagatcgacatagacagaaagacccctcctctttgcgggactccaaatcaggaaaagacaggctgccagtttctgctgaaacgacaaaagataaaggtcagggttccttggatgagggatccctggatctggggaattgtgattcaattggtagtgtgaaaaagaggaaactgaaggggtatcaggatgctcaaacttacagccctggtaaccctcgcctacaggagagcaaaacttctgagcacgagtttagtaattccaggaaggaaaagaaggcaaaaaattcaaaatatgaaggtaaagaatcaagtgccagtaaaggcagtggtagatctgacaaaaaagttagtcatacaaagacccagaaattcaggcaaaagcctgagagcagtttgtcacaccggagcttggatggaatggactgttcaaaaagggacttggggtctgtacatgcttctgttgctgccacttcaagctcttctaaggtttctggctctcataaaaccaaagccagcttccaggaagtgaaaggctcacctgtggaatcagtttcttcatcacctataagaatttcaaatgcagataagtttacaaacaaggaaattattgggaaagatgatcctcatgatattgctgctgtggatagtccaagaagatgctcagatcatgaggatgatggtgggagtgatcgatctggaacagctaagaaggataaatctttcaccattgcccataggtcagattttcaggacaagggtgttaatcacatgtcagatactaaacttaaagctcaaacaaccagctattgtaccaatgggggtgtggacactatagtcctagatgggacacatccaggcacagagcagattaatcatcctggtgaagacaagattgatgtttattatgctactacatctcaagcaaggaaaaatggcatagaatcaggtttggaggacaacaatgtcaatgacagctgtaagtcagagtcccatgcagataaggtcaagagtactagttctccatgtcaactgaaagatcagtctcctctacatgaggcaaaacataaggatggaaaaattaagttgcaggagaagtttgggttcaagcctgaccaaaatgagattatacatgctggcaagaaagattatacaggaaaaaatgagagcaggaataaggagaatcactcgaatcggggtcacgactttcaggatgttagtacagatgccccatgcaaacaggaggtatttcatgctcctattcagaatcagtttccggactgtgatactgaaagatccacaaagaggtctcttttggaaagaactgatcaagaagtacatggaaaagggaagccattgtcatcattgccatatgaaggatctcaagttgagatattaggtcgttgcccacgaccagttggcttacttaaaggaaatggagatatggaagttgatccttccaaagttgatgatgtgtcaaagttacaaaagaagcaattgaaaaagactgaccatcaaaatggaaatctgcaaattggttcaagaaatcccatacttaatggtcacaagtccaaggagcttgatgcccctagtccagctagaagggattcttcctcccatgctgctaacaatgctctgaaagaagctaaagatctaaaacatctggctgatcgtcttaagaatactggatccagcgttgagggcactagtctttacttcgaggcagccctcaaatttcttcatggagcctctctgttagaatctggcaacaatgataatgctaaacacaatgagatgattcaatcaatgcaaatttatagtagtacagcaaaattgtgcgagttttgtgctcatgaatacgagaaatcaaaagacatggcttcagctgctcttgcctacaaatgcatggaggtagcatatatgagggtagtatattcttcacacactagtgcaagcagagatcggcatgagttgcagacagcactgcaaatggctcctcttggcgagtctccatcatcatctgcctctgatgtagacaatgctaacaactctacagcggccgacaaggctcaggatgttaattttgccatggaagccgcaaggaaatcacggaatgcttttgcagctgctaattcaagcctggctgtggacaagaatgcagatggtatctcctctatcaagaaggctcttgattttagctttcaagatgtggaggagttactacgtttggtaaaagttgctgtggaggccattaatcgttaa

SEQ ID NO: 66836 - DNA, 1383 bp, Glycine max
  Peptide Sequence Number=SeqID_158521
atgtcagtgaaggtggagaagaatgctgaaaagacaagtgggcatcaggtcctattgattgctgctgcagacagttcagaaggtctgccttcgactatcagacgctgttttagccacgaaataagcatgggggctttgactgaagagcaaagggctgaaatgctattccagtcactgcaaagtgtttccggactcctctctaatactaattcagaagctttagtaaaagaaatagttgggcagacatctggttacatgcccagggatatatgtgctttaattgctgatgctggtgccaacttatttcccagaaacaatgctaaagtagacaaagatgtacatgatgatgtaggtagttcccttagttccaagatggcagaggacaacaatcacgggaaagtttcacctcagattactggaaaagaagacttgttgaatgctttggaacgatcaaagaaaagaaatgcatcagcattgggtactccaaaggttccgaatgtgaaatgggaggatgttggtgggcttgaagatgtcaaaaaatcaattctggatactgttcagttacctctcctgcataaagatctattttcatctggattacgtaagcgatctggtgttcttttgtatggtccccctggaactggcaaaacattattagcaaaagctgttgctacagagtgctccttaaattttcttagtgtgaaaggtcctgaactgatcaacatgtacattggagagtctgaaaagaatgttcgagacattttccagaaggccagatcagcacgtccatgtgtcatcttctttgatgagcttgattctcttgcaccagctcgaggtgcctctggagattctgggggtgttatggacagagtggtttctcagatgcttgcagagattgatgggttaagtgattccacacaggatctgtttattataggtgcaagtaatagaccagatttgatagacccagcacttctgcgccctggtcgatttgacaaactgctatatgtcggagttaactccgatgcatcttacagggagcgggtcctgaaagctcttacccgaaagttcaaattgcatgaagatgtctcactttactccatagcaaaaaaatgtccaccaaacttcactggtgcagacatgtatgctttgtgtgcagatgcttggttccatgctgcaaagcgcaaaaggagattgcatcctgtatttactgtcacaagcaacgccagcattcagatttcagaaaccttaatgttgtacaaaaccatacataaactattatgtgatttagaggtcttagaagagctgtcgccttccctctccatggctgagctcaacaagtacgagcaactgagagatcagtttgaaggcacctctaaatga

SEQ ID NO: 66837 - DNA, 1119 bp, Glycine max
  Peptide Sequence Number=SeqID_158522
atgagtggtgctgaagcgcgaccttgtgactactgtggcaactccacagcacttctctattgcagagccgattcagcaaaactctgtttctcgtgcgatcgcgaagttcactccaccaaccagctcttctccaagcacacgcgcacgctgctctgcgacgcatgcgatgattcccctgcgaccatactctgttcaaccgacacctctgttctgtgccagaactgcgactgggagaaccacaaccctgcgctctccgattcccttcacgagcgaaggcccctcgaaggcttcactgggtgcccttccgtctccgaactcttgtccatcgtggggttttcggatatcagcaaaaaatctctgcttttttcgcctcagggaagtgtcgctgatgggttcttcggcgccagcgagattgaagggctttcggatatgttcgtgtgggatgcgccttcttttgttacgcttgatgatttgatttcttcctctccttcttctcatagctttcaggccatgaaggttcctcctctgcccaagaatcgaaaggctgcttgtgggcaacacaaagaagagattcttagtcagcttcgggaattggccaagtctgagcctttggaccttgaaccatatgtgcaatcgggtaacttgtccttgggttttgaacgtgacccggaggctgatatctttccttctcatgagctggggctgatgcctgatgatgggttatttgttttttccaaccattggcatagagaaagcagcgagcctatgcatcaagttgtgcctcctgacccatcaatgggaacttatactgaagaaattccagttaaacattctacttctgctgttggggaaaatcacacctatggtgacaatgaagggaaaccatccatttctctcaagtctgaaaccctatcaactactcccaaagctgcagcatgtgagttaacaagccaagaaagagattctgcattattacggtacaagcagaagaagaaaacaaggagatttgacaagcacataaggtatgaatcacgaaaagttcgggctgaaagcaggacttctgtaaatcagaagcaaatttactggggtctaggatcatgtttggagagtatcttgtga

SEQ ID NO: 66838 - DNA, 324 bp, Glycine max
  Peptide Sequence Number=SeqID_158523
atggatagagttaaggacttggcatcaaagaaggctgctgttatatttaccaagagttcatgttgcatgtgtcacagcataaagcaacttttctatgagcttggagcaagcccagcagttcatgagcttgacaatgattcctatgggaaggaaatggagtgggctttgaggggtatgggttgtaacccttcagtcccagcagtgttcataggtggaaaatttgtgggctcatccaaagatgttatatccctccatgttgatggctccctcaaacaattgctcatggatgcaaaagccatctgggacactcctgctttttcttga

SEQ ID NO: 66839 - DNA, 420 bp, Glycine max
  Peptide Sequence Number=SeqID_158524
atgtcgatggtgatgtcggtggtgacaatgatgataatggtagttgtgcaccaagagtgttttgtgtgtagtgacagtgacgaaagtagtggtgatagtgaaatgttggtgataacgataataataatcatgatggttatagtgacaatcagtaatagagatggtattattgataatgatagtggtggtgacaataacggtgacattgatggtagtggtggtgatggcaacgatggtgacagtgacagtggtggttgtgttagcggtgttggtgacgaagtgacaattagttacagtgacaacgatggtgatggtagtatcgatggtgatagtgacaataactatggtggtggtgatagtaacgatgataacaaaaagtatcattatcaaattgggaaaagtgtgtgttttttaaactaa

SEQ ID NO: 66840 - DNA, 933 bp, Glycine max
  Peptide Sequence Number=SeqID_158525
atgaagatgagatttttccttgtagcttgtttggcaatgttctgcatcctagaggtttgccaaggaggcaacctcagaaagcaattctacaagaaaacctgtcctcaagccgagcagatggttagaacaaaaatccaggaacatgtctctggaaggtctgatttgcctgccaagttgattagaatgcattttcatgactgttttgtcaggggttgtgatggttcggttttgctggactccactgccaccaacactgcagagaaggatgccattcccaatttatctttggctggctttgatgtcatagatgaaataaaagaagcattggaggcaaaaatgtctcggagctctagggacgctgttgccgtcaaatttaataagccaatgtgggaagtgcttaccggtagaagagatggcagagtatccataagtggtgaaaccttagccaatctgccagcacctttcttcaatttcacccagctcaaacaaagctttgctagtaaagggcttactgtgcatgacttggttgtgttatcaggagcacacgcaattgggataggtcattgtaacttattcagtaacaggcttttcaacttcactggaaaaggtgatcaagatccttctttgaatcctacttatgccaactttttgaagacaaaatgccaaggtctcagtgacaccaccacaacaatagagatggatcctaacagctcaaacacctttgaccgtgactattattctatccttcgccagaacaagggtctattccaatcagatgctgcccttttaacaactaagatatcaagaaacattgtcaacgaattgtgttcacgccaatactcggagtgcatgcactatttttgcatcagggttcacttaatctgtgtcatagtgttaagagggggtgggggaaccttaaacaaaaccatgtag

SEQ ID NO: 66841 - DNA, 699 bp, Glycine max
  Peptide Sequence Number=SeqID_158526
atgccggctggtcatggtttgagatcccgcaccagagattccttctctcgtcctttcaggaagaagggaaccatcgccctcaccacatacctgagaacctaccacgtcggcgactatgttgacgtcaaggttaacggtgccgttcacaagggaatgccccacaaattctaccatggccgcaccggacgcgtctggaatgtcaccaaacgtgctgttggcgtcgaagtcaacaagcaggttggcaacagaattataaggaagaggattcatgtgcgggtagagcatgttatgccttcaaggtgcactgaggagttccgcctcaggaagattaagaatgatcagctaaaggccgaagccaaggtcaagggtgagaagatcagcaccaagagacagcctcagggtcccaaacccggtttcatggtggagggtgcgacccttgagacagttacccccatcccatatgatgttgtcaatgacctcaagggagagcctcgaagaagcgttgttatacttgcctatgcccttcaccgcaacgatgtgcgtgatggtggccttgttggggaggatgccaagggcgaacatgtgaagggctacgggtttgagagaagggtcgacaacagagttggagtagaggtagatgagggtgttgaagtggtgttgcttgaggcagttattattcgaaacgacgatgtcgtaacg

SEQ ID NO: 66842 - DNA, 633 bp, Glycine max
  Peptide Sequence Number=SeqID_158527
atgacgacccttgagcgagacttgactatgaattgtttcaacttctttttgttaaataataatacgaggaatgagcaatggcggggcatgagaattgagagggggggactggaccctttggcagtgtctgctgtattctctgcagcacaatacatgggagagaaacaaatctcaggcatcgattgtttcgttctaaagctgtcacctgatcagaaggacctcgttgaccgaagtgacaacactgctgagatgatcaagcacgttgcatttggctacttcagccagagaaatggtctattggtgcaccttgaggactcttaccttactagaatccaatcccctgggacacaccccacgtactgggagaccacaatgtcaacgaaaattgaggattacaaaatggtggatggtgtgatgattgcacatgctggccattcaaccgtgatcatcacaaggtttggggacaatcttaaaacaggacctgccatcacacggttggaagaatcatggaccattgatgatgttgcattcaacgttcaaggcctttccatggactgcttcataccccctaaggaactccacaaggactacccacaagaagatctagattggagatcacccttgcatagatga

SEQ ID NO: 66843 - DNA, 275 bp, Glycine max
  Peptide Sequence Number=SeqID_158528
atggtggaattaggcacacgaactagtggcagaacccatctgaggtcacttaaaaacactgttttagctacacttagtgcaacttctggtttgatcattcttagcagactgcgttcaaattcagcaactgctgctggattgtttgtgctaatagcgtttggagcaaagctgtgtgcccaccctgaaaagttttgctttattgattcaaagattgtgtccagttctgatctagtgaagcctccttcgtacccttcttcattcaagtacctaaacaa

SEQ ID NO: 66844 - DNA, 1233 bp, Glycine max
  Peptide Sequence Number=SeqID_158529
atggagaaccagcaggtgaagggtgttgctttggagaaattcacatggaaggttgaaggtttcaccaaattgaataccaagaaacagtcctccaaggctttcaaagttggcggttataaatggaagattgttttgtatcctaaggggaggaatgtggagtatttgtccttgtatatgaaggttgctgattctctaccaccatatggatggagcagatttgtatatttcaggttggctcttattaaccaggtggatagcaagaagtcaattgtaaaggaaacccagcagaagtttaatgctggaaacagtgcttggggttctccatctttcattcctctcagtgaattccatgaccttgctcaaggttatcttgtgaaagatgcatgtataattgaagctcaagttttagtctctaaggtcgcatttaacattccaggcagcttagcccaaagcattacgacaattcatgaacctaatggagatcaagctaggctaacagaagtggaaatgacaccttcagatttgacatcaagtcctacaagtacccaaggttctaaagatgatcacgtaaatgaaatagaactgcaactcatacactcagaagatcaagaaataggaccctcagcctcagatttcactccaagtcctaaacaagttcaatttgctcctagtgctccccctatgtatccttctttatttgatgaatctgagcaagtgatcttaacccctctaagtgaccttatagatttcaatagtgtagaggcagaagaagcatcctttattccattatgggaggaggtatgttcatggcatccatcactaatagagaatcaaagaaggagaagtcccaggttcatattgtgggcattcattgccttgggacgagtgctacatttccttaagactaagacaattagggatatgggtaatgatgattgtatgatgcaccttcaagttctatgggaagaacttcaaccctttggatttgacttgacatggctagagccccatgttcaatcagcaatgagtgcaaaagcttattttgaaagaggagagtacgtgaaaagtataagggtcaatatagcttctttagagatagaattgaagaagctgaagactaaactggctgttgcagaacttgaccttgaggttgcaaggagagacttggcagaggtagaaaatgatttccaggagagggacatggatgctgaacttggttatgggataccatag

SEQ ID NO: 66845 - DNA, 1743 bp, Glycine max
  Peptide Sequence Number=SeqID_158530
atgggccacggcaagagacttaatgtgcagaagtttcatttagagggcactccacggaaggtcttgtatcatgatgaaagcaagatgttgcttgtgatgaggactgaactgaattgtggtccatgtttgtctgacatatgttgtgtggattccctaagtgggtcagtactgtcatcttttagacttgaacttggagaaacaggaaaatctatggaattagtaagagttggaagtgagcaggtgcttgttgttggaactagtctgtcttctggtccgcacacaatgcccactggtgaagctgaaagttgcaagggtcgtcttcttgttctctgtcttgatcatgtgcaaaattcagatagtggttcaatgacattctgttcaaaggcagggtcatcatctcaaaaaacttcaccattccatgaaattgttacatatgctcctgaactgttatcgagcagtagccttggcagcagtccggatgataatagttctgatggcatcaaacttcatgaaaatgaagtatggcagttccgattggcttatgcaactaaatggccaggagttgtacttaaaatctgtccttatcttgatcgttacttcttggcaacagctggcaatgctgtaagtagcaaaactgttgcattttctccattcattctgtcacttgctcactgtcccatcctttcccaaattctctatccaaatcagaagttctatgtttgtggtttccctaatgacaatcctcaaagagtgagaaggtatgctatgggaaggacgcgctacatgataacatctttgactgcacatttgactagaattgcagttggtgattgtcgtgatggtatccttttatattcttatcatgaggaagcaaaaaaattggagctactttacaatgacccatcacaaaggatagttgctgattgcattctcatggatgctgatactgctgttgtttcggatcgtaaaggaagcattgctgttttatgttcagatcacttggaagcatcagacaatgcaggtgcacaatgcaacatgacactaagctgcgcttatttcatggctgagatagctatgagcatcaagaaggcttttctttatgtgatctatgcatcaaacgtgaatgttctacggctttctgattctacagtaatggaaatgatgggctcatattcatacagacttccagctgatgatgttttggaaggtggaaatggccccaagacaaatgttgattcattacaaaatactattattgccagtaccctgttaggaagcataatgatcttcattcctttatcaagaactgaaatggcagttgtaaatctgcctggacttgttagccaccctcctctaaatactccgaggagcagagaatcagaacccttaatgggcatgacttgcattaactacctgcctgtgtggcaaggacctcgggaggaagaatatgagctcttagaagtagtgcaagcaagacttgttgtccatcatttgacagcgcctgttctaggaaatgatcatcatgagtttcgcagtcgcgaaaatcgggttggagtacccaagatacttgatggtgacatcttgacccagtttctggagctgacaagtatgcagcaaaagatgattttgtcactggagcaaccggatatggtaaaaccaagtttgaagccactcctaccctctcatgtttctgtaaatcaggtggttcaacttcttgaacgagtccatgatgctctgaactaa

SEQ ID NO: 66846 - DNA, 1110 bp, Glycine max
  Peptide Sequence Number=SeqID_158531
atggcagaagtggctaaaccgagttctgtgcctccgagctctcatcgaattggttcaggacctttgaaaagtggatctttggttagaaagaagacaccgtcagaacttaggggagagttgttgaagcgggcaagtaatgtggaccttactgatgaatctcaatccaccttggctgatcctacgaagaccactgaggtggacaatggatttaaaaaaacaaggttatggaagccccctagatacacagacacacgggttgatgaagtatttgctgccaaaaagcccaggttcaaaattgcatctggaaaggaaaatgcaaaggaaaatccatctttggggcaaactagtaatctgaagaatttttcagttttttcaacattggaggccaagggacagcaaggaaattcatgcttggagaattctgttacttctagtgaggtcagcaaagatagtgtattacaatcttgccaaacatttcaaaagtgcagccaaggaaaatttcgtagtgtttctgagctttcatcagctgctgataattcttgtggcacagctgctattgacctgggaaaagcattaagaggactatctgcacttgaaccatctaatgctaatgacacggctgctgatttggctgaaggacacaaagatttgacaactgttacaggaaatttcttatctgaattccttttacctggcaagaaggatctctgtttctctatgcctcttggccattcgaaagtagaacaagtttcaactgaggatctagttgagttgtcagagatagagaagcaaaacttaggacagactagaagagctgaagacattgctgcttcttctaatgggtctatatggaaagatgttgagtcagcacaaggatcatcagatagcctttgtaccattgaaattaaggatgcacttcttccaccttggattatttgtggtatatgtgcattgatggcctctgaaggaagaagctttgtggcaagcctgcccagacaattagggttatggtcaagactcactctctctgaccttgttggaatgcaagccatgtgttggagagccctgactgctatgattggggttggttgtttggacacaggagcttga

SEQ ID NO: 66847 - DNA, 1524 bp, Glycine max
  Peptide Sequence Number=SeqID_158532
atgcggagcttcaggatgagaaacttgttgtcccgtgtcaaaaagaaaaccatcaaaaacagaaacagaagttgcatttccattacaaaagagttagcacatctagtggaacaagaagaagaagaagaagaagttaatgaagaaggtttcaacatcaaaagctctgccccatcacacactcacggtgttcaacccttggggaatctctatctgaacacaagttccaccaactccagagacactggcttaggtaatcttcacaccctttcggatgagcttgttctcgacattctcgggtttttggattctacttccttaggggttttagcctctgtgagcaagtctttctatgtgttcaccaaccatgaacccctttggaggaatctcgtgttggagaatcttctcggtgggtttcagtacaaagggtcttggaaatccacttatgtttctgcttgttacccttcatttgataacttcgctgttgctcttgggggtttcaaagttagagacttttactcggattatctcttccagagttggctctgtgctaacctcgaaatgaagcctgagtggttggagagggataatgtggttcggaagagaggaatttcggtcgaggagtttgtgttgaattttgaagagcctaataagccggtgctgttggaagggtgtattgataattggggtgctttgaggaattgggatagggattatttggtgaggttgtgtggtgatgttaagttttcagttgggccagtggagatgaagcttggagagtattttgggtactcggatcaggttagagaggaaaggcctttgtatttgtttgatcctaagtttgctgagaaagttccaaaattgggtgatgaatatgaagttccggtgtactttagggaggacttgtttggtgttttgggcaatgagaggccggactacaggtgggttattattggacctgctgggtctggatcttccttccatgttgatccgaattcaacttcggcttggaatgcagtgatcaaggggtccaagaaatggattttgtttcctcctgatgtgattccgcctggcgttcatcctagtcctgatggtgcggatgtggcatctcctgtttcaataattgaatggttcatgaacttctatggcgccaccaaaaattggaacaagaaaccaattgagtgcgtatgtaaagctggagaggtgatctttgtgcctagtggatggtggcatttggtgatcaatctggaggaatctatagccataacccaaaactatgtcagtaggagaaatttgataaatgtattggattttttgaaaagtccaaatgctagcacactggtatctggaacaagggatcgactgaatttgtacgataagtttaagaatgctatcgaggcttattttcctggagaaattgatgaattgactcggaaagaagaagagagaaagatccagcaaaggaaactttccttctgggattctgtcgcggatactaatgcgggagctttcaagttctctttctag

SEQ ID NO: 66848 - DNA, 1524 bp, Glycine max
  Peptide Sequence Number=SeqID_158533
atggatttggaatcttctggcgattcggtgaaatgttgcaagcactgtgaatgcgggtgtagtgattgctccatggcagctcaatcttcagggaattggctccggtctgtgaaaaggaagcacaagcagttggaacagggcggccaattctctgcgccagggccggattgcgatccggtggcgcatgtcgagattgggaatgaatgtgatgcattacgtgaggctgttagcagccaacagaaatcaataaaggatttgtatgaagaattggaggaggagaggaatgcggcctcctcggccgcgaatgagaccatgacaatgatattgaggttgcagagggaaaaggcagagcttcagctggaagcgcggcagttcaagagatttgtggaagagaggacatctcacgatcagcaggagcttcttgcattggatgaattgttgtataagagagaacaggcaattcactcactcacgtgtgaggtgcaggcttataagcacaggttgatgagttttggcatcactgaatcggaggcagaaggtgatcagtataaatttcccccttatgagtaccctcctttgagatgtaatgcaatgcatgcttcaagtgatgataatgatgagatagacattgacaaatatgcgtttggcgaaacacctaaggaccgtttgaggaacctggaaagtaggatatctcaaatggagagaagtcccacttatagtcagatggatggggaattcagtggaaaaaatattctagagaaggtgatagttggacagtctccaagatgggctaaacattccaggaaattttcctgtgactcatcttcattgtgccctgagtatatgattgattctcctagctttaggaagatagatgaggacctttccaatttgaagaaggtagacaatgcatcagaagctggtgatgatatgattgataaagtctatacaattgactccgagttcaaagctggagctagtgtttacgatgattatgcaaccactccaagggattttgttaatcatgcagattttgaagatccatatgtgaagaagctttgcatgaggcttcaagaacttgaggctgatagggaatcaatgaggcaggcaatcatttcaatgcgcactgataaagcacagcttattttgttgaaggaaatagctcaagaattgtgcaaagagatgtcacagcagaaaaaaatgacagcgagatcctttattagcagcttttcattcttgacagtttttaagtgttcctgggttgaaggttgcaagggtttggcggtggcagtgcacgtctcaacctctcactctcagtatgcaaagtggtctcaacttgcaggtcgttggtggagagggcgacactgcaaagggaagagggcgacaccaaaacgcagtggtcttacccttggaacctgttgcaactcaaaacgcgatgcggagcctgtttcaactactggagatcttcatttcctccccgcaatggagaggatccgaacacaaatttggctgtcagggctttga

SEQ ID NO: 66849 - DNA, 774 bp, Glycine max
  Peptide Sequence Number=SeqID_158534
atggcattttcatcctccctatgttcttccctctctattgcgaacccaagcagaaccgccatttccactcgattctctcacaaatcgcccaaactccctctctcgttggcgttcgccatcctgccgatctccacgaccactgcggcagacgtctcgggcgccatcgacgggaccacgatcgtggtggtgagcgagggattcatggcggcactggcggcgatgctgtcgctaacagacccggagcagcgacgacagttgcaggtagaggtgggcgacgacgacaaggaggtggtgagggagtacttcaacaactccgggttccagcgctggaagaagatctacggtgacaccgacgaggtgaaccgagttcagcgcgacattaggttgggccacgctaagaccgtggagaagacgctgagcatgttgaaggacgaaggttcccttcaaggcgttacgatttgtgatgctggagaggttttcgagctcgggcacaatgttgccgatgagctccttgtcagagagggcaaggtattagaagtgttgcctagtgtcgtaccagggagggatctggccggagaaaaagttgtcgctgagatgaagacgaagaagggtcaccactcaccactcatcactgtggggctaatagtgcttagtgcatggcttggagtattgatggagattacaattaatgcttctgttgcgtggagctttagtgtcttgaaaatgttgttgggcagggagtcagagagggtaatgaaactaagtggatattga

SEQ ID NO: 66850 - DNA, 285 bp, Glycine max
  Peptide Sequence Number=SeqID_158535
atgatctcagtaaaaggagtatctgcagaccctaaaaagctggaagtaatggttgcttggccaatacctaaggagatgagaactaagaaggttgcaagaattcttaggtcttacatctgggttgtcttgcagggtaatgaattgttccaagaagagatgttcaaaaattcgtggtggcatatgacacttgccaaagaaataagcaggaatctctgtcaccagcagggttattgcagcccttaccaattcccacttgggtttggaacaacatctcattggatttaa

SEQ ID NO: 66851 - DNA, 1704 bp, Glycine max
  Peptide Sequence Number=SeqID_158536
atggtgaaaaaaggaaacattgtgcagtatcgggaaaggttggacaacacccttgccttacctgatctgacaaatgaacagatactcaaaacgcttgtcaaaagtcaactccaacgttcttcagaagtggaaattgaaggatgtaatgagaaagaagttgaaaccaagactacagagttatgcaaccttcttgatatgttgagaagtgcttctggagacaatggtggaggatctagtagtacatcacacgctgattggaaactttatgcctttcatgggagacccccctctacaagaaatgaaaggatgaaggttccatggccactatctacaagggaggctatagtgcattattatctgtttgagtactttcaagatgacttagtagttattcttttgaatacggtctctgagtcaaaaactgataatttaaacaaggatgcaattcctgaagcaaaggatgtcgtgagaattgatttagtgggaggctatgctatgcaaaaggtgacatcagaaagaagttattttcggataatagcaaatttggatttaaagctggattttctacctccaaccctcctaaatttcatttcaaggcagctcatcggcagtggtttcaggctttatcagaaggcagtaacttctatgatgggcaatgataaagacaaagacttcagcaaggctttggaggacacgttgtatgttagaatacacgaagctctattaagcactagggaatcaaaggctatggctggggaagagcttaagcaagatgcaagcattgttcctactgaagaacttgttcaaagtgaggatgaggcaaaagatgtaacctgtgaggatagcagcaaccagtgttcaaataattacattggagagactttagatgcaggtagtgaagaagttgttgaagcagattgtaaagaaattttgcaaattgaagaggatgtcaataaggtacttagcattccaatcgaggaaggtaattcattaagtgtactgatgggaaaggaaaatggtgagattgtagaaacagatagtgaagagattgttgagattgagatggatgtcaacaaaatgcatgaccttccagttgaggaagatggtacaaagagtgtactgaaggacagaatgaatgcatatatacgctcagatgtgagaaatgctctagaaacaatagagagggttatttcagtggttagagaatgtggatttcattccctcgggtccactttaaactctgctggtgaagagttccactgcatggaaaatggtggcacagttgattcagattctgcaaaagttattgaagtatgtttgaaaaatgaggttagtgtcaaagtatcaagcagcaatatgctggaggaaaatttagaagaacctgggacgatacaaagcttcagacacacaggaacaaatgctaacaaggaagtaaactataagaaagtagtaccagcttcaccagagcagaatctttcaagaccaatggaagcaaaccaggctgattcatattctttgaaaaatgggacaactctggaccaaacaatatatgataacaagcaattaaacagtgatgcagtccaagatatgtcttcagatgacctgaaaaagtcaaccagggagataaacatacagggtgtgatttttaatcctccattcactaattcgatgatccctatggatgttttgaagtcaaggtcttga

SEQ ID NO: 66852 - DNA, 243 bp, Glycine max
  Peptide Sequence Number=SeqID_158537
atgtggtttgtgattcattttctcatgtcttcaccgttgggatttgcaaagtactatatgcggagggagaaagatgcatcacacgtaggaccatggaatgaaggcttcgattccttctccttctccctaacgtttgggaaccctaacagagcaaccggaggaggagctctagagaacaccagaaatatcacaattgataacggagaacgcttgagtgactacatcgagttgatgtcccaatga

SEQ ID NO: 66853 - DNA, 459 bp, Glycine max
  Peptide Sequence Number=SeqID_158538
atgagaggaggggtgaaagaaactggtagcaacatagggctaccaccacatacatatacacatgttggtgatgttgattttgaaggtttcagtcagggtgatgttgatatggtgttgcctccaaacaattttggaggcctcattaatgaaagtagcttagggctctcaattgttggaagcgatatgatgttgcctttcaacaataattcccaaggcaacattattggaactttcatgggaataggacaacatgatgaaaatcaaggaggatccgttaacaatattaatatagggctatggggtcatcaaatcacccttggagccaataatgatggagctgccttggagagatccattcatccaaactttgtttgcactaccaatggcgaaaacttgaaccttggatttccttctcatgcaaatctagctagtaccggtgaaagaagtgatattgaatga

SEQ ID NO: 66854 - DNA, 234 bp, Glycine max
  Peptide Sequence Number=SeqID_158539
atggcttcggctacaactgtctttggatccaatttcgttcaagacaagaggtttttgagccatggtgaggtagtacttggcaatctctctaaacatggggacactcctgagatcgaccttggtgttgtccttgaacgttatgacgacgttgtgccactctccgatgaagcacgtcacgacctacacgtccttgatcaagttgtagctgaagttgctgtagtcttgtcccattag

SEQ ID NO: 66855 - DNA, 411 bp, Glycine max
  Peptide Sequence Number=SeqID_158540
atgcctaagagcatccgcatcaggacaccaggaagtaattggttagaactagcaccatacggcaaaatttctgcatggggttactttaagaaacattttcccgaaatggagcccatgcaaatcgcaggagggaatggcgctttccctgtgaatgcgacagctggccatggtgtcaccattaacgatggcgttttgctggaggttggactcgccagtcaaactggcgagttgatgttagggcactgtttgcccagcctacgcgtgcagcaggaagttgcagagagggacaggcttttgcagatgaaagcgccagtgccactggcgatttgggctgcagttgggagtagccagtggcactggcgatttgaggttgatgtagccattcctaatggcgatttcagccctttataa

SEQ ID NO: 66856 - DNA, 594 bp, Glycine max
  Peptide Sequence Number=SeqID_158541
atgtctggctccagaaagaagcttcttctgaacaccgtgtccgtgaaactaggctgcggcacctgcagaagaccaaacctgtgtcgcatattccacccgaagccaaaacccaagaatcttaacaacacttaccgaaagcacaaacattcttcttcttcttcttcctttttttcaggccaatggggtggtgaggacaagtgtgacagcaccagcaccacccccacccccacccccaccaacaccacattctcaccctacgttgattcctcgcacttttctgactcagattcgtacgtgaaggccgtggggggtttaggcagagctgggaaagaaggtgtggctgtggagaaagactctgatgacccttatcttgatttcagacattccatgctgcaaatgatattggagaatgagatatactccaagcaagatctcagagagcttctcaactgctttcttcagctgaattcaccgcaccaccatggtgtcatagtcagagctttcactgagatctggaatgctgttttctctgtgaggtccagttcacacatcaaccgtaagccactagctgcactgagtgctactatgttctag

SEQ ID NO: 66857 - DNA, 684 bp, Glycine max
  Peptide Sequence Number=SeqID_158542
atggccgataagcaaccccacctgaacggtgcttattacggtcccgccattcccccggcggagcaaccacgctaccgccctcaccgcgaaagaagctgctgctgctgcctcttcggaatcttgtggaagattctggttgcactcattgtcctcgttggcctcgcagtactcatattctggctggtggttcaaccccgctacttcaagttctacgtcacggaagccgacctaacacaatttgattactatagcaacaacaacaccctccactacaacatggtcctcaacttcactgcacgcaaccccaacaagaagctcagcatatactacgacaaggttgaggcattagcattctacgaggatgtcaggttcgccaattacagtgtgataacgcccatgaactccttccggcagtacaagaagagcagcagcaccatgagcgctgttttatcggggcagcaagtgttgccgctcgacaacgacctagtctcagagttgaaccaagacaagattggtggggtgtacgagatctatgtgaagctctacttcaggattaggttcaggctcggggatgtcaaaacccgtcgcttcaagcccaaggtcaaatgtgatgcgaaggttcccttgaggaccatgggcaacgtaactctgtttcagaccaccaagtgtgatgtcgattactag

SEQ ID NO: 66858 - DNA, 699 bp, Glycine max
  Peptide Sequence Number=SeqID_158543
atgttcgagaaggtgagacttcatcctactgagctgatgcgtcttattttacaacaggcagtgctatctcaagcacaccctctatgtgaccattttaagcttaattgtgatggttccaagagtggctctatagctgctgctggtggcttacttcgtgaccatatgggaaatagttgtggctataagtttctcaaagtagaatctgattctctatctactattgacttgttagccaaggattgcttagtctcacacccatgttccagtttggtgcatgatataaaggagtttggtctgaacaaaggtgtgtacacttggtctcagacattgagggagggaaaccaacctgctgacttggttactacatacgggttacagcttcaggagcaactgagagtttttgagtttgttccatcttttatttttttcgctgtacatgtattagctgatttgaactcaaccgtgttcccccgggttctagttcgtggatctcgacttttgagcgtagttcaagatcgcgcgcccgacgtgatggttctcgaaggcgttggccgctgtccccggcgtgttcgtcgaggcgcaaaggagctaaaacgcaccgtttcgactacgtgtgacgctacaaggaggatggtggggtttgacgaagtcgttttggaagtgggatgtggtggtggcgttgttgttcgtaccagatga

SEQ ID NO: 66859 - DNA, 1209 bp, Glycine max
  Peptide Sequence Number=SeqID_158544
atgaaagtgagggttgtttgcaggaaaatttacgactatatacgctatgatctcaaagaaatcgctttcccctcttctttgccagaccctcctcacatcaaaaagcgtcgcaaattgacctgggaccagcgtatctgggttttgaagagagctgcccggctttatgctgcaagctgggttcgtgacattggtcctgaccttcggcctgatgattataagaaggatggtgacatgactgatgaaacaaatggtgaaaagaaaacaactataggaaaagaaccctcaacactggaggaccttggtaccatcttgttctctactgtagctgcaagagggggaatggagactctcagaccagctttgcagcgtgtgtacatgaccagagcatctgcatacagagatgctcttaaaagtttcatagaagggtaccaagaggcatctcctaaaggaggcgcaagttcacccatcaccaccactcatctccgaccaattctccttcctctcggcagccatcctcacccttgtggaggcactctcaccggaggacagagaagtcctctcctacctcatctcccactcctcctccaccttctctggcaaggaaaaccgctgccgaaatcgaccattccccttcgttcagctgcagctgcttctgctgctacatgggttattgggttaggtgggacgaatctctactgtgtttcgaggcttcactttgtagaagggcttcgtctatcttcatttcataaatttcaacctatgatgccattaatcacaattctacagagtaccgataacttttcagaagcatctaaattaggggaacgtggatttggccccgtttacaagggaattctaccagatcgaaggcaaattgcagtcaaaaggctctcaaaagtttttggtcaaggctcagcggagttcaataatgaagtaacgtttatagctaaactgcaacatcgcaaccttgagaccgcaaaccatcgcaaatcgcatcacaaaaatggtgaaacttccgccgactgccctatgcctctgcagccaccgaagccaaaagtgaagatctacaagatgatggccagaggagatgtgtgggagggtggtgtgaagaaagatgctagctggtttggcgccagagaaggtggagatggaagtggctgggtctctgaggggaagagatggaaggggttctccaaaggacaaaattag

SEQ ID NO: 66860 - DNA, 900 bp, Glycine max
  Peptide Sequence Number=SeqID_158545
atgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccaggagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataa

SEQ ID NO: 66861 - DNA, 1008 bp, Glycine max
  Peptide Sequence Number=SeqID_158546
atggcttgcatcgataacacggccaccacctctactgacgaagcaggcggagccaccaccatcaccgccgtgcatcccgacataattcaaacccacatcctcacgtgcctggacggcccgtcgctcgcctccgtcgccagcacgtgctcccaactccacgctctctcagcgcgcgagcctctctgggagaacatttgccactccacgtggccctccacgagctcgccacgcgtccgccacgtcatgtccacgttcccacgcgcgtctctgtcctttttctccgactcgttcccttcgttcgccgcggcgcgcgaaggttcttcttcgcgcgcaccggagctgatttccgctgtggacatcttccaccggcggcgggcggtgctgtcgagagtggtggagacggagacggagtccgactggttccggtgctcgccgtttcgaatcgatgttcttgatcagaaggaggcagtggcgacggcgatggagtatccacggagcgaggaagcgtgtgagattctgggcgaggatttgaggttgagttggatagtggtggatccgaatggaaagcgtgcggtgaatgtgtcgagtgggagagtggtgtcggtggagcggcactggctgagcggggaggtgaaggcgcggttcgcgacggtggtgggcggaggggagagggggacggcggtggaggtggcgctgtgcagcgtgactgtgactttcgggggtgagatgcaggtgagggaagcgtgtctgcagatggaggacatggatggaatgttcctgaatggtagggacagtttggggattttgcagcgggcattggagggtataaggggaacattactgaaggacggaaaggaggaagaagggaggaatagatacttggaattcataaagagaaagatggagagaaaagataaaaaagaaagagatgagaggaggttggatatgctctgcgtgcctctcgcgcttttgtcctttgcggctttttctacactctttctcttctga

SEQ ID NO: 66862 - DNA, 1599 bp, Glycine max
  Peptide Sequence Number=SeqID_158547
atggatcgatctggaaccggaagtcgccaaaaaagaactccgtctatttctcacagggctaggatcactgaacaccatgttggtcctttggattctcttagcaatgccagtctcatggagattgaaactagatcccgagcacagacccctgcttcatctgctgttggagttaaaggacgtttaaaagatgttagtaatgctttaacgacatccaaagagctacttaaaattataaaccggatgtggggtcatgaagatcgtccttcatctagtatgtctcttatctcagctctgcatactgagctggagagggctcgcctacaggtcaatcaacttatccaggaacaacgctcagatcagaatgagataaattatttgatgaagtgttttgctgaagaaaaggctgcttggaaaaacaaggagcaagaaattgttgaggttgcaattgaatctattgctggggaactcgatgtagagaggaaactcaggagacaattagaaagcttgaacaagaagcttgggagagaactggctgacactaaagcttcccttcttaaggtggtgaaagagcttgaaagtgagaagagagcaagagaaattattgagcaagtatgtgatgagttagcaagagatgctgatgaagataagtctgagattgagaaacaaaagagagtgtctacaaaagtttgtgaagaggtagagaaagaaaaggaaataatgcagttgaccgataggttacgtgaggagagagctcaaaagaaactctctgatgcaaaatatcagcttgaggaaaagaatgcagctgttgataagctaaggaatcaacttgaagtttttcttggaggcaaacaagttagagaaaagagtcgcagttccactcacttgaatgatgaagaaattgctgcctatctcagcagaagccgattaggttcccatctcgttgaagataaagaagatgatggaggagaggttgacaatggagtagaatgcgaggaggaatctgctgaaagtgatctgcattctatagagttaaatatggacaacaacaagagttataagtggacctaccctcctgaaagcagatttgatacaagaagatatccaattgaggaagaagtgaaaggtagtaggaggtctacctctgggaaaacttcaaggaaaagcacatctctgcaaaggagtatatcagatggaatggaatggggagtccaagctgataagcttcaaaattcaggagatgggatagattgggaaagcttttatgaactggaaaagcaagctcaaggaaaaggttacggggatgaaatgcaaggctataaatcagtgaaaggtcttagggatcagatattggctggttctaggcttgcatcttatagaggttatgccagtccaactagacaattttcccagccttggtcatcacgagatctcacaaataacttccaggaaagacctgctacagcacagggcaatggtctaaaatcaaggttaggggaagccaggggtgagggccagaatctaaggaagtcaaaaaggccatacccgtttgcttctgctaccatgatggctggtaaaaatgcaggacagagattctcatag

SEQ ID NO: 66863 - DNA, 699 bp, Glycine max
  Peptide Sequence Number=SeqID_158548
atggaccccacactctccttccaccgccgatcctcctccgacctcctcctcggccccttccccttctgcccctccccctcctcctccgcggaggaactcaacgaggccgaacttttttgggccacggattcctccgaatcggaaccccaacgccctgcgccctcgccaaaaccccacctccgcaacttcgatcgccccgtggattccggaattctcgtcttgctaacggaacccgattcccgcggcggtctgctccgcggcaagtcccccgttccgacctcctcgcggatgacgattccgtcgcttccgaggccgccggcgccacccgccgccgattacctcgcgcagtccgcgcctttcagaaagttccagcaatcggcgcccgtcaaggtcccgattctcctatcggccggtgccgccaggcggaaaaacgccgacgacttcgcgcgcgtggtcgacgacgacgacgacgaggagatgctgccgccgcacgaaatcgttgccagaggctccggcgtttcgcccaaaaccactttttcggtgttggaaggcgtcgggagaacgctcaaagggagggatctccgtcaggtggggaagttaaattttgatagcttctctgcatccggtgatagcttttctctccttgtaacttcgttttcggatgctgtttttgttctcttttattttatagaatcttga

SEQ ID NO: 66864 - DNA, 603 bp, Glycine max
  Peptide Sequence Number=SeqID_158549
atggttcgttggcgagtcatcatcttcctctgcaatcagcaagaaaaactcggaagcgcacttgtgacctttgtgtgcactgccaattcctccaacgacatgcgtttgaaggatatgggcggttgtttcggtggtgtaggtaaaaggggaggtcatgggttgaagttcgaagctcatggcgacaatgggtcagaaggaacggggaaggatcctcatatgttgacgggacaaaacgagcctccaatgcttgaaggagaccagaccatgagattcaacccaaggagtatgacccatcaaagcgcgacacctccggcttcatatggtgcggattcagagatggagatgcaaagtgtaggtgtgcagaagaagatgaggagtggtggttggtctcgagaagggccaacttatgcaaaagctcgtcaagctttgtggacatattgttttgagttgcaacccacgaaaaagctcaaaggcaggcttattgcgaaatctcgcgctaagcgcatgaccgccttgctaagcccagacgtgttacgctcagcgtgtgatcaacccgctaagtccagaaggggcgtgcttaatgtgaagtcgcatgaattttaa

SEQ ID NO: 66865 - DNA, 246 bp, Glycine max
  Peptide Sequence Number=SeqID_158550
atggggcatccatcgttgaaaattgttgcgtccagagtcaaaattcttaacaatacgcagaagtggttggccggaaatgtactacgtccatcaattataagtgatgaaggctctttgttttgcaaaattatgggagaaggtaattatgcatggtcttctccttgccgtaaagaagctatttttggatttaaatccatgactaacttgtcaccgaagcgcaacttaattgttgcactagaacgctaa

SEQ ID NO: 66866 - DNA, 1530 bp, Glycine max
  Peptide Sequence Number=SeqID_158551
atgtactacaatggaatctatcatttattctaccaatacaaccccaaaggctcagtgtggggtaacattgtgtgggcccactcaatatcaaaggatctcatcaattggaggacccttgaacctgccctatatccatccaaaccatttgacaagtttggttgttggtctgggtcagccaccatagtcccaggtaaaggacctgtgatcctctacaccggagttgttgacgacaaacaaactcaggttcaatgctacgccgtacccgaagacctaaatgacccactcctccgaaaatgggttaaacctgacaaattcaacccgatcttggttgctaacaaaggtgttaatggtagtgcctttcgcgacccaaccacggcatggtggagcaaggatggacactggaagatattggtgggtagtagaaggaagcgtagaggtatagcttatttgtacagaagcaaggactttatgacttgggttcaagccaaacatccgatccattccaagggtgagacaggtatgtgggagtgtcctgatttttatccagttttggttaatggcaatcaaggattggagacgtccgagggagggaatcatgtgaagcacgtgtttaagaatagtcttgacatgactaggttcgactactacaccgtaggaacatattttgaagataaggatagatatgtcccagataacacttcagtggatggttggggtggacttaggtatgactatggtaatttctatgcttcaaaatcgttttttgaccccagtaagaacagaaggatcttgtggggttgggcaaacgagtctgataccaaggaagatgatgttcgcaaaggatgggcaggaattcaggcaattccgcgaactgtgtggctcgattctactgggagacaattggtgcaatggcctgttgaagaattaaataatctcagagggaaagaagttaatatgaacagtcaaaagcttcaaaagggagattacgttgaagtaaaaggaatcaccgctgcccaggcagatgtggaagttacattctcatttgcaagcttggacaaggcagagacatatgatcctaagtgggtaaatgcacaggacctctgtgcccaaaagggttcaaaacttcaaggtggggttggaccatttgggcttctcacattagcttctcaaaatttggaggagttcactcctgtgttttttagaattttcaaaggtccagttaagcatgtggttctcttatgctccgatgcaacaagttcctctttgaagagtaatatgtacaagccatcatttgctggctttgtagatgtggatttggccactaataaaaaactctctcttaggagtttgattgatcactcagtagtggagagttttggtgaaggagggaagacaaacattttgtctcgggtttatccacagttagcagtggctaatcaaggtcacttgtttgtgttcaacaacggaactgaacccatctcggtggaaaacctcaaagcatggagcatgaagccggctgatataaaataa

SEQ ID NO: 66867 - DNA, 3249 bp, Glycine max
  Peptide Sequence Number=SeqID_158552
atgacggaagtgcttcagttgccttcatcctcaagctgttcgcgtcgtccatgtggtagtctcacacccaatgatgggtcgcacccaatttcccttattaacgctcctcccactgtggaagatcaaagggtggaaattgaagaagaagaagagaaagaaagggaaagggagagggatcagctttctattttgacccttttgattgctacgttcaggaaatctttgattgggtgcagcaccactacaacttcttcttcttcttcttcttcttcttccatggagattgggtggccttccaatgtgagacacgtggcacatgtcacctttgatcgcttccatggctttctcggtttgcctgttgagttcgaacccgaagttcccaggagacctcccagcgctagtgcaaatgtttttggagtttcaacagaatctatgcagctttcttttgatgccagagggaatagtgtacctacaatactgctgttaatgcaaagacatttgtatgcacaaggaggtctgcaggctgaaggaatcttcagaattaatgctgaaaatggtcaagaggagtttgtgagggaacaattaaacagaggtgtagtaccagatggcattgatgtgcactgcttggcaggtctcataaaggcttggtttagagaactaccaactggagtattggaccctcttttgccagagcaggtgatgcaatcccagtcagaagaagaatgtgctcagcttgtgaggcttcttcctccaacagaagctgctttgctagattgggcaataaacttaatggcagatgttgctcaaatggaaaacttgaacaagatgaatgcacgtaatattgcaatggtttttgcaccaaacatgactcaaatggcagatcctttgactgctttgatgtatgcagtacaagtcatgaattttctcaagactcttgttgtgaaggcattgagagaaagagaggaatctattgtaaaatcaaatcctgttcctgaccttaattcttttgacgatgatgggaaccatagcaattcagaaatgcttgacaaggaggacagtgaaaatggaaatgattgtagcgatgacgatgaagatacagtgtttgtcactgcagagccttctcaacaaagccctagtcatcttacagaagatggttgtgaaactgaaaccgcgaccaaatccaaaagtttgccagcatctactgagaactatatttcaagtggaaataggttgctggttgacagttgtccttgcaatcttgtatctcaaatttgctctttggcaattggacttcaagactgtggcctcgctaccgggcagacaaagggggatcaagcaaaaatttgcaggagcaaaagccttcagttgagcacttatgacacggacaagtgttccagaaaggtgattcagcttccagtaaccggagctgcagagaagaaccttggaatggcaattattgagcagcatccatcgtccatgtactgggagcactcacataagctccttttgggaagggaatggaaaggacaaggtgtaaaggggaggtctctatttgtgtttccacgtttggaaatgcttgctactggcagaggagacgacatggaagcagtagcaggctcccgccatttctccactctccccctttctttctctcaaaacaaaaccttgcgctcttcttctgccaaatcaattaagctttcctctccttggaccaacgcttccttgacttccccaaactgtttcgcgaaagaggtatggggttgggtgaactccaactccaagggcgtcgccgtgagaagggacacccgcggagtggtggtgagggctgaaatgttcggccaattgactagtggccttgagactgcatggaacaagctcaaaggagaagaggttttgtctaaagagaacattgtggagcccatgcgagatattaggagagctctcttagaagctgatgttagtcttcctgttgtcagaaggtttgtgcagtctgtcagtgatcaggctgtgggtgttggtgtcattcgaggagtgagaccggatcagcaattggttaagattgtacatgatgaacttgtacgattgatgggtggagaagtttctgaactggtttttgccaaatctgggcccactgtcattttattggctggacttcagggagttgggaagacaacggtttgcgcaaagttggcaaattatctcaagaaacagggaaaaagttgcatgctagttgctggggatgtttacagacctgctgctattgaccagcttgctattttgggaaaacaggtggatgtgcctgtctatacagcaggtaccgatgttaaaccttcagaaattgccaaacaaggtttagaagaggcaaaaaagaagaaaattgatgttgttattgttgatactgctggtaggctgcagattgacaagacaatgatggatgagttaaaagaagtgaaaaaggcattgaatccaacagaagtgttgctagttgtggatgcaatgacagggcaagaagctgcagcgttggtgactactttcaatcttgagattggaataacaggtgccatcttgacaaagcttgatggtgattcaagaggtggagcagctttgagtgtcaaagaggtatccggaaagccaattaaacttgtaggacggggtgaacgcatggaggatcttgaacctttctaccctgatcggatggcaggacgcattctaggaatgggagatgttctttcttttgtagagaaggcacaacaagttatgcgtcaagaagatgctgaagaactgcaaaagaagatcatgagtgcaaagtttgacttcaatgattttctaaagcaaacccgtactgttgcaaaaatgggttctgtctctcgtgtcattggaatgattcctggtatggggaaggttactcctgctcaaattcgagatgcagagaagaatttgcagaacatggaagctatgatagaagcaatgacccctgaggagagggaaaagccagaactgttggcagaatcccctgtcaggaggaaaagagttgctcaggattcagggaaaacagagcagcagaacctgatgggtgtaatggaaagtggatcacttccaacacttagtaatcttgaggaagcgcttaaagcagaggaaaaggccccacctggcactgcaaggaggaggaagagatcggaatcaaggagtgtatttggggactcaacaccagcaaggccaagtcctcgtggttttgggagcaaaaattga

SEQ ID NO: 66868 - DNA, 213 bp, Glycine max
  Peptide Sequence Number=SeqID_158553
atggaagttacttgtaaaggaatggacctctgtaagagggaagcgaaaaagacttgcctccttggaatggacatctgtaaaagggaagcgaaaaagagttgcctccttggtcattttgtctttgcagatcctgaaatatttaagtttttttgcccctacacagcagggcttatgcagaacattagagactatactaataaagagatttattaa

SEQ ID NO: 66869 - DNA, 1500 bp, Glycine max
  Peptide Sequence Number=SeqID_158554
atggcgacctgttatactccctcgaatgttagaaattcggcgggggtgctggctgttgttggaggcagaacaatttctgagaatcacggtatcagatcgtgcttcttgagaattcaagagagcaagaccgtgtttggcagcaatcggaagtgtggttcgtttccagtgaagtgttccgcgaattcccacagcatcagtcgcaaggatccttttctggatctgcaccctgaggtttcaatgctcagaggagaaggagggagtgcactgaacagccctagacctagaaaggatgtatcaggtggaaacgtcgctgaaagtttggaagccacaacggctccgagtaactacagtgaagcaaagatcaaagtcattggtgtgggtggaggcgggtcaaatgcagtcaaccgcatgatagagagctccatgaatggtgtggagttctggattgttaacactgatgttcaagccatgaggatgtcgccagtcattcctcccaaccggttacaaatcggtcaggagcttacacgaggacttggagctggtggtaatcctgagattggcatgaatgctgccaaggaaagcaaggaatcaatacaggaggcagtttatggagctgatatggctggaatgggtggaggaactggcactggaggagctccagttattgccggtatcacaaagtcaatgggtatactgactgttggtattgtcacaacccctttttcatttgaagggcgaagaagggcagttcaagcacaagaaggaattgcagccttaagagataatgttgatacactgatagttattccaaatgacaaactgctgactgcagtttctcaatctacccctgtaactgaagcattcaatctggctgatgatattcttagacaaggtgttcgtggtatatctgatattattacgataccaggattggtgaacgtagactttgctgatgttcgagctataatggccaatgcagggtcttcacttatggggataggaactgcaactgctagagtcatgcactgtaggcctgtggatcacttcactcagcacctctctttggctgcttcgcaagctattaataggaagtggaaggtctctagttggggaagcttgtgtagttttgctttatatcctcagcctatggctttctttttgtatctctgtagtacctctgggaaaacaagggcaagggatgctgcattaaatgctatccagtcacctttactggatattggtatagaaagggctactggaattgtatggaacataactggtggaagtgatttgaccttgtttgaggtaagcataacattaatcgcaactggattcaagcgtcaagaggaaagtgaagggagacctatgcaggccagtcaactcacacaaggagataccgttggtatcaatcggcgatcttctactttcactgatggtagctttgttgagatccctgaattcttaaagaagaaggggcgctcacgttatccaagagtttaa

SEQ ID NO: 66870 - DNA, 1776 bp, Glycine max
  Peptide Sequence Number=SeqID_158555
atgggctgcgtctcctcaaaacacatcaagaaagaccttaagcaagaagaagtcattgccaccaatggcggcagttacgtgaaccacgtcgtatccctcacttcctccacctatggagcactcatgttggacaaggagaaggagcaacaccaacttcaactccccgtcgaagaatccaaaacatctccacctcggattcgcgaagaacccgaagttatcaacgcttgggaactcatggagggtctcgaagagggagtgcccatttcaaacaaccccatgaaaatccccaagtccacacctttccttcgcggattcatctccaccgacccaaaacccaaaaccaaaaccacccccttcaaattcctcaaccaactcgggtcccccaagagtctcaggaagttcacagggaaagagaacaaaattgaagtgcaagttcaccacaatgccggtgtaagacgcttggattacaattttagcccaaagggtattctcaaaccctccaatttttgttctcctctaaacgggtccccgattcgtgctcgaaggaatagtttcgggagcgacaccaagcggaggagtcctagtcctctgttcgatccagagcttctcgcctcttacgaaaaggaactctcccaagaggaagaacagatcaagagaatggtgtgggccacccccaagacccgaagagtcagaaaatctttggattcacaaactttcattaagacgtttgaggaaaaattgccccccggaggggaaaattgcgttgtcatttacaccaccactctaaggggaatcagaaagacgtttgaggagtgcaacaaggtaaggtccattatcgagtcctattgcgtgcacgtgctggagcgtgacgtgtcaatggattcgaggtttaaggaggagttgcggaagctgatggggaccgagcaagttaaggttccggttgtgttcgtgaagggaaggtttgttgggggtgctgaggaagttgtgaagttggaagaggaggggaaattaggggttctctttgaagggattcctcccaaggctttgggggagtgtgaagggtgtggtggtgtgaggtttgtgatgtgcgtggagtgtaatggaagttgtaaggttttggatgaggatcgcaagaagactctgagtgtgaaagaatcatggactaaaactcttcaatgttggtccttaccttgggttgacactcctattggagtgagacttgaggagggtgatatgcatcctatcggagtggggaagaagggcaacatattcttcagaaagaatgatggtgaactagtctcgtttgatttgagtagcctgaagattgaagagcttggtatcaaaggaaagcttcactgttgtcagacagctggaaacagttggtgcagagatgcaggttttaacaaaagtgagaaatggatctcgcttcaggccgatggtcaggttgttctgactcctgacaggggacaagaagcatcttcacagatactgcctatcaattttgatggactggcaaagtcaatcaagaagggagacaccaattttattggtcaatacttgctcacaggaagtgaaactacttctgtattgctagagcaactcccagtaggagatttcgtattgaagactagtttggttgcgctggacaaagtgaaccgtgcaggatataaggaggcccaatttgttattggcatcttggatgtgtggaatacaagaggtcaattggagcagacatattacagcaacgactaccggattatgtattgtaggagataa

SEQ ID NO: 66871 - DNA, 1728 bp, Glycine max
  Peptide Sequence Number=SeqID_158556
atggaagctgtttctcgaagaagaggtggaggcattttcgaaagcctctacaaggtcgttatgcgtcgcaactctgtctacgttaccttcgtcatcgctggcgccttcctcggagaacgggctgtagattatggagtccacaagctctgggaggctaataatgttggggctgtggtgatctctagggaggaaggaggcgacaatgcggtcatgatgatggtactgtttgcacaccatgttcgcatcgtggtggtgtgcttggcgttgcaatatgtgatttggtggtgggggtccttgttcggtggtggcagtggtgcatggagaggttacaaaaaagagaaagaagagcttgcaaaaatgattaagctacaaagtgatgcactgagagaggcaatttcccaggtggtgagtaattcaaaggagaaaaatcgtaaattcaccgagactattgagctgcaaattggattgaagaactatgatcctcagaaagataagcgtttcagtggttctgttaagcttccgcatattcctcgccctaagatgaaaatctgcatgctcggtgatgctcagcacgttgaagaggggaagctagtgttagagatggaggaagcgcaaatttgggctaagaaggtggagctgccagcgttcataggaacatacccaattggttggattgctaggactgaaaaattctttgaggtacaagaaattccttcgttccataagctgcaatatgcattcatgagcatgaagggtgctgcgacacattggttctacatttggagccaaaacaacccagattcagattgggagtcattttccacacctttgatcaaaagattcggagatcgccatggtaaccacatctttgaaagattgagtatcttgaagcaagaaaagccaactgaaacagaaacccacatcaaaaaatgggagacttccacaaagttcttgaaagggaggaccaacatttcagagtggaaacacatgttgtgcaagatattgaatgaagaagttgattcacatgcttctcaacaagacaaaaatagcatggagggaagtgggtcagaattcagtgaagcaaaggctagttcttgggcaagaaaggtggaactacccagctttgatagaagcatagaagggggaactgatttgaagggtagcagttttgagtgtgacaatgacccattgcagttcttgaaatcagaaaacaaaagtaaagaagaagaagttgatccattgataaagagggagaagcacaaggaaaatggagtgacgaatgtgggctgcgaagacgattttcttgataacccaattacagatttgatcaagaaggaagtcgaaactggtgattcaaccaagccacattgttttcaagattcagatttccataaaaagattgttattgtgaaacaaaaatcattcatgaaggtggttggaacaacaatggtgctggaatcttggaatgtcaacttgttggatgagcctttagcattaaattttgttgcatctatggctgacagcttagccatggagctaaggcagaaggaatgtactaagccagtcaagctgattaaagttatatggagtccacccttgttcctcccaccaccgaagccaccagacctcagtttgcatgcaggggcacaatcaaacaaaactttaggaagtttcagtgtgcaattccagttttcagattccaaccttgaggacaaggttgatttttaa

SEQ ID NO: 66872 - DNA, 750 bp, Glycine max
  Peptide Sequence Number=SeqID_158557
atggctcccttcaacttccaacagccatcaccgaagttactcaccttcaccttcaccttcaactgccaactgcaaacatctaactactttcagataccgagacctacttttcctcacatcaccaccaacatgcgttccagcaacggtacatcaagcagcagggcctccaacggtaacacagggcgccaccctgtttaccgtggagtgaggcgtaggagtagtggtaaatgggtttctgaaatccgtgagcccaaaaaacctaacaggatttggttagggacatttgccacccctgaaatggctgctattgcctatgacgtggcagcgcttgctcttaagggtaaggatgctgagctcaacttccctaactcggcttcctccctccctatccctgcatcatctgcagctcacgacattcagatggctgcagcactagctgcaaccgctgtcggagcagcgaatgatgcactggaaggaagccaaggaggaaatgtttcggtttcattggcggaagagttttcagggggaaacttaaatcactttgtggatgaggacttgatctttgacatgccgaatattctggtcaatatggctgaaggaatgctactcagccctcctcgttttgataattttgctgctaccgactatgaatacatggatgaagatcctaacctctggggtgtacagtggtaccttctagctatagtgaggtttgctgctgttgcacctcaaactcaaatatgtatgtaa

SEQ ID NO: 66873 - DNA, 483 bp, Glycine max
  Peptide Sequence Number=SeqID_158558
atggagttggagcgccagtgttggggcctgggtggtggcgtggcggcgcaatggtggcacggggtttggggaatgggtccggcaaataggcgtgctcttcgggaactcctattcaccacacctggtgcttttgagtgcctcaatggtgtgatcttgtttgaggaaaccctataccaaaagacagcttcaggaagacccttcgtagagttgttgaaggaaggtggagttcttgctggtatgaaggttgacaagggcacagtagagatcgctggaactaatggggaaactactactcaagttcagcagagcactctcaaggcatggggtgggaaagatgaaaacattaagaaggctcagggtgccttcattgctaggtgcaaggcaaactcacgtgcaactttgggagaacttacaagggtgatgctacccttgctgagggtgcctccgagtctctccatgtcaaggactacaaatactaactag

SEQ ID NO: 66874 - DNA, 1062 bp, Glycine max
  Peptide Sequence Number=SeqID_158559
atgaaggtcatcgccgcctacttgctcgccgtattgggaggcaatgcagccccttccgctgatgacttaaggaccatccttggctccgttggagctgacgcgaatgatgacaacatcagcaacttcttgtctgaagttaagggcaaagacattgcggagcttatcgccgccggtagggaaaagttggcctccgtgccttctggcggtggcgccgcggtttccgtggccgctgctcccggtggtggcgctgctgcaccggctgccgccgaatctaagaaggaggaaaaggtggaagagaaggaggaatcggatgacgctatgttaaatgaatataaattgcagaagctaaactgggtagaattcatgcttaatctgcctctagacttcgtctcagatcaccttagttttgatggaaaagtagcaagtagtaacatcacttgcagcatgcttactcacagtttgaacatggctgtgatagtccttccttcaatgtcaacagctacgatatcagcttgcaggacccagctgcaaccatgcctcttcgtggtgcctgttgtagcaggggatcttaagggaatagagatctctgaggtggagaatggattcttctacaagaaacctgaagagcttgaaaaaaaattaaaaaaaacttcaaaacagaaacccacaagaagaagggcgaaggaggaaaaagggggaggtcgcagaggggaggaaggaagaaagaaagaagaggaggaaggagagagggaggagaacaaatcacgaaggaagaagcgtgaacggaaaatggaagttggatgggagcttccaaattgcaaacggcactccaatattgaaatgagcagctttttgacacatgtctcaggacagcaaggctccttcacacttcactggcacagcagatgcgctctacaacctttacttcttcttccacgtctcccaggggttccgattctgatgaggaaatcaatggtggaaaatgcgcttgccgttgttgacgacaatgattacggtgaaggagagagtgaaggtcgaagggtgttacaggggaggtcgtag

SEQ ID NO: 66875 - DNA, 3537 bp, Glycine max
  Peptide Sequence Number=SeqID_158560
atggaagatgaggataaatacaacattagtgaagcagctagcagttacagacatattgaagatggacaaggctctgttgtatcatcacttgtagatgtgaacattccggccaagaaagcgtcggtatctgttggtaggaaatcaaagatagtaagtgatgaagttaaacctaagatcattcccccacctggcactggacagaaaatatatgagatagatccatctttgctagctcaccgtgaccatcttgatttccggcagcatgtggttccaacttccaagcacacaagaaatactggttggaaagattccaatgaccagcacatggtggtgcatatgtggtccaacagctgcaagcttccagcaacaggccagaatgaggatggtgaacaaggtggtggggatcagttggtgagaaacatacatcttcaagatagagattgcagccatgagaggagagaaaaagtgaatgaatcggtgaattacacctctagtgttaaatttttaatactaagtaatgttagtacaggcattacttacagagagtgggcacctggagctaagggagaagccgtgagtggcaaagaaggcaaggacaaagtcgtgtttctggggggtgtggaaggacgctgttatggcgttgcgaacgatcatgatggaagatgttcgcagatctgtcgaaaggaagaagatgagattgttccaccaggaacgtccaatggctctttcgtgtctctgcctttgctgactagcatccagaaagtggcgggactgacagagggtggcgaggactgtgctaatgatgaagattgtggggcggcagcgctccgctgtggcttcctccagggaggagatggagaggagacggaagtagacagtgggggatttggttcagcagcattaattggagacttcaacaattggaatccaaatgcagatgtaatgaccaggaatgaatttggtgtgtgggagatcttcttgccaaacaatgtggatggttcaccaccaattccccatggttctcgggtcaagatccgcatggatactccctctggaatcaaggactcaattcctgcttggattaagttttctgtacaggctcctggtgaaattccatacagcggaatatactatgatcccccagaagaggaaaaatatgtcttcaaacatccacagccaaagagaccaaaatcacttagaatatatgagtcacacatcggaatgagcagtccgtcaggttggggaagaatggagaatgcagcactgtacttgaaagaggtgaccaacaattatggattacaacctcgttcatgggaattcaccattcctgagcccaagatactgaattggttgatggagatgtgggtactcgattgtgatgaaaaagggtggagaaatagggactctagtgaggaagtaagggtagcagatggcatcatagagctgtgtgaggctgttgagaacaatagttacttcacgaagcctatagccaatgtttcaggtcaggcagccagaacatgtggtggcttcaatgttgtggaaaacatgttgtggagcccacctatgctaatattggccactgctccgccacttccaaacccactaaacttgaccattgtagcaatgttctacaagatatgcggtaatgtttctcatggaagcagcaccgagatcaggattatacagagactgattacacccctaccatcaccagacacaagctcgcatacagaagccagtggattgttaccagcagagccaccatgggtgtgcacaagagagatatgtattgctgggttagaagaaacagaaaggaggagcagaatggcattctgcaaaatgggtcttattcttgacctaatgggccaagcccaaccttgtctcagtatttgggtttgtgaagaaagaggatctctatttggtcctcaagcagatggagacacttaccgtccagcatctcatctcagaacaggcccacatttatggtaccatgttacaaatttctttgcacctagcagccgatttggaactccagaggaacttaagtctctgatagacagagcccatgaactgggtctgcttgttctgatggatattgtacacagccatgcatcaaataatacattggatgggctgaacatgtttgatggaactgatggtcattacttccatcctgggtcacgaggttatcattggatgtgggattctcgcctttttaactatggaagctgggaagttctaaggtatctactttcgaatgcacgatggtggctggatgaatacaagtttgatggatttcgatttgatggtgttacatcaatgatgtacacacatcatggattggaggtagcatttactggaaattacaatgagtattttggttttgcaactgatgttgatgctgtggtttacctgatgctgactaatgatgtcattcatgggctcttccctgaggctgttacaattggtgaagatgtgagtggaatgcctacattctgccttcctacacaagatggtgggattggctttgattatcgcctgcacatggccattgcagacaagtggattgagattctcaagaagaacgatgaagactggaaaatgggtgatatcatccacacattaacaaacagaaggtggctggaaaaatgtgtagcttatgctgaaagtcatgaccaggccttggttggtgacaagacaattgcattctggttgatggacaaggatatgtatgacttcatggctttagacagaccatccactcctattatagatcgtggtatagcgttgcacaaaatgattaggcttattaccatgggccttggtggtgaagggtatttaaattttatggggaatgaattcggccatcctgttaagtttagcattgctcattcattgttgctcacttcagagtggattgatttcccaaggggtgatcaacatcttcctaatggcgtagtagttccagggaataacaacagttttgacaagtgcaggcgtagatttgacttgggcgatgcggactatctaagatatcaagggatgcaagaatttgatcaggctatgcagcacctagaagaaaagtttggtttcatgactgctgagcaccagtatatttcacggaaaaatgaaggtgacaaaattatagtcttcgaaaggggcaacctcatctttgtcttcaattttcattggaccaacagctattcagattacagagttggctgctcaacccctgggaaatataagattgtcttggattcagatgatgccttgtttggtggcttcagtaggctcaatcacgctgctgagtacttcacctcagtatggaacttctctaaacttgtatctgagtgtgcaccatgctctggcatggacacaccaagtgaaggatggtatgatgaccgacctcgatcctttcttatctatgcaccttctagaacagcagtggtttatgccctagcagatgaagctgaacctgccctagcagatgcaactgaaccagagccagttgatcttgatgacaagcttctgggatga

SEQ ID NO: 66876 - DNA, 1359 bp, Glycine max
  Peptide Sequence Number=SeqID_158561
atggaacccaatgcactaggtggtggaatatttcctaacataagtagtggtttgctaggagtagaaaaccctttacagccgcaacaacaacaacaacaaccaaaccttcaaaaccagcgaaaccctcaccctttgcaccatccccaaatggtttcctacgccactcaccatgacactgacacacatcatcaacaacaacctcctcagcaaccaatcaaacatggctacaacttttcagccatcaaatccagcaagtcacaaagcacactcagtgacgaagatgaaccagtgttcacagcagaagacaacagctccggggaccccaagagaaaagtgtccccgtggcatagaatgaagtggactgacaccatggttaagctcctaataatggcggtttattacattggagacgaggctggttcagaatgcactgatccaaccaagaagaaagcctctgggctgcttcaaaagaaagggaaatggaaatcagtgtcgaagggcatgatggagaagggttactatgtgtctcctcagcaatgtgaagacaagttcaatgacttgaacaagaggtacaagagggtcaacgacattctaggtaagggcacagcatgtcgggtggtggagaaccaaaccttgttggacactatggatctgtcgccaaagatgaaggaagaagttcgaaagctcctcaactcaaagcacttgttcttcagggaaatgtgtgcttaccacaacagttgtggccacaacaacaactgtggcagtacttccaacgtgcaacaatcaaccgaggctcaaccaccacatcaacatcaacagcagcagtgtttgcactcatcagagaacggggtggggagtctgagaatgttgaaagaggatgaggatgaggacgatgattcggaggagttttctgatgaggatgaagaggaatcaggagaaggaggatcaaggggtatggaggaggatgaaaatgatgtgattaggaggagagcaaggaataagggagggtttggtgtttcatcatcacagatgatgcagcaattgagtggtgaagtgagtggtgtgttgcaagacggagggaagagtgcttgggagaaaaaacagtggatgaagaagagggttgtgcagttggaggagcagcaggtgagttatcaaatacaggcgtttgagttggaaaagcagcggttgaagtgggccaggtttagcagcaagaaggagagggaaatggagaaagacaagcttcaaaatgaaaggaggaggttggaaatagagagaatggtcttgctacttcgccatagggagcttgaattggtcaatgttcagcagcagcagcatcaacaacaacattcttctacctag

SEQ ID NO: 66877 - DNA, 1047 bp, Glycine max
  Peptide Sequence Number=SeqID_158562
atggctgtcatgtgtatattgtccttgctaatgaattcatttatagctgaaaagggtttggttgtgtcattgtgtggccgaaaagtcagatacataaacactggaccactgcttaatgcggaaacggtgaatgccgatgaatgtttgatgacccgaatgcaagagatgtcactagattaccattttactgtggaacaagaagtggggtcttccacttacgccttctttggtttcaacgggacagcgggagtatggagaatttcggcgcttaatgaggctggtggatggaaggataggaccacagtggaagatatggacttggccgtgcgagccagtctcaaaggatggaaattcttatacttgtctgacttgaaggttaaaaatgagttgccaagtactttcaaggcctaccgctaccaacagcaccgttggtcttgtggtccagccaatctttttaggaaaatggtcatggagatcataaataacaagaaagtgtcattgtggaagaagatacatgtgatttacagcttcttctttgttcggaaggtcgtagcacacataaacacgtttgtgttttattgcattgtattacctgcaacagttttggtgcctgaggttgtggtcccaaagtggggagctgtctatatcccttccatcatcactattcttaatgcagttggaactccaaggtcactccatttgatggtcttctggattctctttgagaatgtcatgtctctgcatcgaacaaaggcaacgattattggtttacttgaggcaagtcgagtgaacgaatgggttgtcactgaaaaacttggtgatgctctcaagactaaagcaggaggtaaagcacctaaaaagcctcgattcaggattggagacaggattcacttgttggaacttggtgtcgcattctacctcttcttttgtggctgctatgatattatgtttgggaaaaaccacttcttcatcttcctctttatccaatctttggccttcctcatcatggcatttggatatgttggcaccattgttcccaactcctaa

SEQ ID NO: 66878 - DNA, 1734 bp, Glycine max
  Peptide Sequence Number=SeqID_158563
atggggggtgaaacggtgaacgggtcatggttcagtgttttgtggccagtctctcgcaagagtgcatcagataacaaggcagtagttggagttttggcattagaagttgcagggttgatgttgaaggtggttaatttatggcaatctttgagtgatgcggaggtattgagtctgagggaagggatagtgaactcagttggagtcaaaacactggtatcggacgatgacgattacttgatggaacttgcattgaacgagatactggataactttcaatctctagcacggtctgtggctaggttgggtaagaagtgtgtggatccagtttatcatcgttttgaacattttgttcataacccggctcagaattatttccaatggtctgggtgggagtataggtggaaaaagatggagaggaaagtgaagaaaatggaaaaatttgttgccgctatgacacagctttgccaagaggttgaggtgctagcagaggttgaacagactttcaggagaatgcaggcaaatccggaattgcacaagttgaaattgcttgagtttcagaagaaggtcatgttgcagtgccaggaggtgaggaatctgagagacatgtctccatggaatagaagttatgattatgttgtccggttgttggcaagatcactatttacaatcctggagaggatcatacttgtctttgcaaataatcacccatcaactgttcaagaacaaaatgattatcagcatatgaatgctaacaatcttctgcgaagtcattccttttctgttatacattcttctgtacatccttcggagcatgatctctgtggcttcaattcaggacctgttggggggaggccagtatcaaaatcaggctttttagttgacaaaggcagaagaaaaaagaaactgcagcaagctcgtcacgaaccagctttattcagaaacaacctgcattcagaaagcaagcagttaggacatattgtaaccttcaaaggttgtatgtctgctgcaaacaattctcctgtcatacagagctgtatgcagacaaatggtggttccatgaggttgactgattgtcatttgaaatctattgataaaatgaaaacagtggacaagttatctccctccaacagaattagaatatattctaaattatccatcaaaaaccggttaaaggcatcctcacttacccttggtgatgcggctcttgccctacattatgcaaaaatgattgtattgattgagaggatggcgtcatcacctcaccttgtggatcttgcagcaagagatgatctgtacaatatgcttccaactactgtaagaactgctctaagggctaagcttaagcgccatgtgaaaagtaaatcatcttccaatggtcatgatgcaaaccttgctgccgaatggagtccggtgcttgcacagatattggattggttggctcctctggcacataacatgataagctggcattctgagagaaattttgagaaggagcaatcgattttcaacacaaatgttttacttgtccaaactctttactttgcaaatcaaccaaaaactgaggctgcaataattgatcttcttgtagctctcaactatgtgtgcagggttgatacaaaagttggcacaagagatacactggattgtgctaatagcactagatcttttaatggtgttcgtttgagaaagaatggaatgtacaacgaatttttatatactgacgttgacacttga

SEQ ID NO: 66879 - DNA, 489 bp, Glycine max
  Peptide Sequence Number=SeqID_158564
atgggtgcaacctacgtgataaaaggatgggatgaaggtatcaaaaccatgaagaaagggtatttttgtcctgctgtggtcaaggctgtgaaaacaataaagaagggagagaaaattctcttgaatgtgagtttatggtccgtggaagtgaaaagaagggttttaggtgactgttgtttgaggctcacacggcccttgcgtatgcaccggccacatactagttttcctgggcaagtgaacacgggttcagattgggaatgtttagttggcttcttcaagtgccagatgatacggtgtgggaggatgcaccaggatcaatgcgcttcactgcttctggctattgattccaggctgggaacatgcaatttcaggagacaaccagtgtatatagtggcttttaaatttgccaagtcactaaaaatggtccattcttacaaaagtgcttataacatgctccaaaagtatccggtttattgtttgcacctttga

SEQ ID NO: 66880 - DNA, 612 bp, Glycine max
  Peptide Sequence Number=SeqID_158565
atggcacctatcataccagaatacagtgaggataatttcatgggattcaatgttggcaaatactatgtcattttgggaatttcagatcgaccactcagattctcctcctccaccatcaccgccaccatctccgtcggcgacaagctcccggaggccaccttctcctacctggactcgtccggcgaggtgcagacgacgacggtgtcggaactgacgaaggggaagaaggcggtgctgttcgcggtccccggcgctttcacccccacgtgctcgcagaagcacgtgccgggcttcgtggagaaatcgggggagctgagggcgaaggggatcgacacaatcgcatgcatttcggtcaacgacgccttcgtcatgaaggcatggaaggaggacctcaaggtcaacgaggaagtcctcctgttatctgacggtaacggaaccttcaccaaagccattggggtcgaacttgatctcagcgacaagcccgttggtttgggcgttaggtctaggcgttacgcgcttttggccgaggatggggttgtcaagctcttcaatttggaggaagggggtgccttcactttcagcggcgctcaggacatccttgatgttctttga

SEQ ID NO: 66881 - DNA, 93 bp, Glycine max
  Peptide Sequence Number=SeqID_158566
atggaaaaacgagttgagcgattaaacaaagcagtttcagcatcaagcttaagggtgctacaatttgcaaaaagaagcacaagtagcatataa

SEQ ID NO: 66882 - DNA, 255 bp, Glycine max
  Peptide Sequence Number=SeqID_158567
atgcctacagctaacaacttggagaaagtgcctatgtgggagcagctcgcactcatctgtcctgaattgttgatgtatgcatccttgctcttgctggtagccagagagacgttcacagacaaggaacctgagcaccaattcaagattaagatttataaacaaagccaaggacggttatattatacgcatgaaagatacagttcctttggagaactcacaatcataatcggcccatccaattcgttgattagctaa

SEQ ID NO: 66883 - DNA, 1104 bp, Glycine max
  Peptide Sequence Number=SeqID_158568
atggcactaaatgagcaaaagggcaaggatgatatcccagaaagtcaatatcagaaaggagtgaaacacttgtgtgagaaaggtcatcttaatgcggtgcctaagaagtacatacttcctgtttccgaaagacccaccaagagtagtgtggaggattcaaatgttgtgaagcaaaatcttcaattacccatcattgatttttccgaattgcttggtccaaataggccccaagtccttcgatccctagccaatgcttgtcaacagtatggatttttccagttggtaaatcattgcatctcggaggatgttgtgaggagcatgatagatgtgagtgggaggttcttcgatctccctttggaggagagagctaagtacatgacaactgatatgcgagcaccgggatttcttgaaactcctgtgccatcccttaccagatttactcctccattggcctgcttcaccagtggactttcggtgagtagtggactactagtgtactactacaagcaagttaggaaagtggtggccacctacgcagaagaaaccaaacatttgttcctggtggtaatggaagccatcctagagagcttaggaattgtggaagccaaccaagaagaggatgacaatattctcaaagagtttgaaaatgggagccaaatgatggtggccaatttctacccaccatgccctcaaccagaccttacccttgggatgccccctcactccgactatggcttcctcacacttctcctacaagacgaggtagaaggcttgcaaatccaacaccaagacaaatgggtcaccgttcaacccattcccaatgccttcgttgtcaatgttggtgatcacttagagatatatagcaacggaaaatacaagagcgtattgcatagagttgtggcgaatgaaattaagagtagggtgtcggtggcttcgctgcacagccttcccttcaactgcacggtgagaccgtcgccaaaactcgttgacgaagcgaatccgaagcgttacatggacactgattttgggacctttcttgcctacgtatcctccacagagcctaacaaaaaggatttcctcgagtctagaaaagtgttacactga

SEQ ID NO: 66884 - DNA, 828 bp, Glycine max
  Peptide Sequence Number=SeqID_158569
atggacgccgccgtgaagccggagacggaatacgcggccgtttcgacggatcagcctcggaaagtttcggtggtgaatggttacattgtctacactcgcgccaagaggtcactggattcgtgcaacggtttttcagaacacgcggaattgaaggataacgccgaggttgaagttaaaacggagaacggagagtgtgagaagctgaaaaatgagtccacagaggtggttgcgaggacgcgcaagcggagccggcgatcggcgttggaagcgaaggttgagtgttgtgatcagatggttgtgagtgagacggaacaagtagttgcgaatggcggaagcggaatcaacggtgcattgggagctccgaggaataagatggagttgaagatgtcgaagaagattgtggtcaacaggaagcctatgactgtgaaaaagctctttgatacaggttttcttgatggcgtttccgtggtttacatgggcggcattaagaaggcttcgggattacgaggtgtgattagagatgggggaatattgtgctcgtgctgtctatgcaatggacgcagggttattccaccttcccaattcgagatccatgcttgcaaacaatataggagagctgcgcagtatatttgcctcgaaaatgggaagagcctgcttgatctgttgagagcatgcaggggagctaccctgcatactttggaggtgacagttcaaaattttgtttgttctccacatgaagaaagatactttacatgtaaaaggtgcaaaggtgagagtgtcaagcagatcatatttttatttgcaaaaatcaagggaaaatgcaattga

SEQ ID NO: 66885 - DNA, 1479 bp, Glycine max
  Peptide Sequence Number=SeqID_158570
atggctcaaggccacatcatccccatgatggacattgcaagactattggcgcggcgtggtgtgattgttaccatattcactaccccaaagaatgcatcacgtttcaattctgttctttctcgtgctgtttcatcaggcctccaaatccggctagttcaactccactttccatccaaagaagcaggactacccgaagggtgcgagaatttcgacatgttaacatcaatggacatgatgtacaaagtcttccacgccatcagcatgctccaaaagtcagcagaggagttgtttgaagcactgataccaaaaccaagttgcataatctctgacttttgcattccttggaccgctcaagtagctgaaaagcatcatattccaaggatttcgtttcacggtttttcttgcttctgcctccattgtctgctcatggtacacacttcaaatatttgtgaaagcatcacttcagaatccgagtacttcactatccccggcatacctggtcaaattcaagctaccaaagagcagatacctatgatgatctcaaattcagatgaagaaatgaagcacttcggggaccagatgcgtgatgctgaaatgaagtcatacgggctaatcataaacacttttgaagagttggagaaggcatacgtgacggattacaagaaggtgagaaatgataaggtgtggtgcattggtcctgtttcattctgtaacaaagatgatttggataaagctcaaagaggcgaccaggcctcaattaatgagcaccattgcctgaaatggctagatttgcagaaatccaagtctgtggtctatgtttgttttggaagcttatgcaacttgattccttcacaacttgtagagctggcattggccttggaagatactaaaagaccatttgtatgggttattagagagggaagtaagtaccaagagttggaaaaatggatcagtgaagaagggtttgaggaaaggaccaaagggagaggccttataattcgaggttgggctccacaagtgctaatattatcacaccatgccattggaggattcttaacacattgtggttggaattcaacacttgaagggataggtgctggattgccaatgattacctggcctctatttgctgatcaatttttgaatgagaagcttgttactaaagtgttgaagattggtgtgagcgtaggggtagaggttcccatgaagtttggagaggaagagaaaacaggggtgttggtgaagaaggaagatattaatagggcaatatgcatggtgatggatgatgatggagaagaaagcaaagagagaagagaaagggcaaccaaactcagtgagatggcaaagagagcagttgaaaatggagggtcttctcatcttgacttgagtttgcttatccaagacattatgcaacaatctagtagcaaggaggaaataatgtcgacgcctaaagagtcacaattttcatgtaacgtttga

SEQ ID NO: 66886 - DNA, 255 bp, Glycine max
  Peptide Sequence Number=SeqID_158571
atggctagcttttgtgatgtggttctcccaatgctcttatcaatcggtatcaaagctttcgactgcgtctcagctacaaatgacggatgtgcacagccagcttgcgtggatgccaaggaagcggagcacggtgtgatgttagaatccaattgcaaggtatggaacttgagtctcacattggaagtatggggttctagtgggggatttacaaggcatttggctctccaactacaatggctaccatttgtgaagtag

SEQ ID NO: 66887 - DNA, 1170 bp, Glycine max
  Peptide Sequence Number=SeqID_158572
atggttttgccactgaagcaacctcattttgtgttagttccacttcttgcacaaggccacatgatccccatggtggacatggcaaggattttggcagagagaggggttattatcacgttggtaagtacccttaacaatgcctcaagatttgagcaaacagttattagagcagcaaaatctggcattccaattcaactcctacaaatcccatttccatgccaaaaagttggacttccattaggctgtgaaaaccttgatactttaccatcaagaaacctactcagaaacttctatattgcccttgagatgacgcaagaacctttggagaagtacctccaaaccacccttctcctccaactctataactctcatctttcttgttcttctgactcagaacctttactcataccaggattgcctcagagggctgaaatgtctgcttctggggttgtggtaaacagctttgaagaattggagcatggttgtgctaaggagtatgagaaggccttgaacaagagagtttggtgcattggtcctgtgtctttatccaacaaggatggtttggacaagtttgagagaggaaacaagccttcaattgaagagaagcaatgcttggaatggctaaactcaatggaaccaagatcagttctttatgtgtgccttggcagcttgtgtaaggcttgttacatctcaattgatagaacttgggatgaaaaatttgatgaaagggtaagaggtagaggacttgtcataaaagggtgggctccgcaaactttgatattgtctcacccttcagttggtggattcttgacccattgtggctggaattcaaccatagaaggtgtgtgctccgggttgccaatgataacatggcctttatttgctgagcaattcttaaatgaaaaatttattgtgcaagttttgaagattggagttagaataggtgttgaggttccggtaaggtggggtgatgaagagaaagttggtgcaatggtgaagaaaagtagaatcatggaagctatagagatgtgcatgctgggaggtgaagaggaagaaaagaggaggaatagagcaatagagcttggaaagatggcaagaaatgccatagtgaagggaggttcatctcacttcaacatttcatgcttaattgaagatattatgaaacattaa

SEQ ID NO: 66888 - DNA, 1398 bp, Glycine max
  Peptide Sequence Number=SeqID_158573
atggcttttcaagctcaccaccaacacttccttcttgttcccttcatgtcccaaagccatctcattcccttcacacacttggccaaattacttgcatccaatggcgtctctgtcaccatagtccttacaccccttaatgcagcaaagttcaacacgctcattgaccaagcaaaagccttaaaactcaaaatacagtttcatgtactaccctttccttccgcagaagcagggttaccagaagggtgtgaaaacctggacacccttccttcccctcaatacaaacacttgtttttctctgcttccaatatgctgaaagagccacttgagaaatggctctcagagttggaaacacttcccacttgcatggtttccgacatatgcttaccttggactactactgttgcatcgaagttcaagataccgagggttgtcttccacggaatctcatgcttcgccctcttgtgctcacacaagattggccattccaaggtgcatgaaaatgtcacctcaatgtcagagccattcgtggtgccggacttgcctgacgcaattgaattcaccaaggcacagttacctggggcaatgagtcaggactcgaaggcttggaagcacgccgttgaacaattcaaagctggggaacattctgcagcagggatattggtgaacacttttgaggagttggagaagatggctgggagagatggtaatgagacatcactggatgaatctgaatgtctaaattttctttcttccaacaagccttgttctgtgatctatgtctgttttggaagcttgtgtcgcattaatgcttcacaactaaaggagattgctttgggcttggaagcatcaagccaccccttcatttgggtgattggaaagagtgattgttctcaagagatagagaaatggttagaagaagagaattttcaagagaggaatagaagaaagggtgtcatcattagaggatgggcaccacaagttgagatactgtcccatccttcaactggtgggttcttatctcattgtggttggaattcaacactggaagcagtttctgcagggattccaatgataacttggccaatgtctgctgagcagttcatcaatgagaagctcattgtgcaagtgctgaagattggtgtgaggattggggttgaagctcctgtagaccccatggagacacagaaagcattggtgaagaaagagtgtgtgaaaaaggctgttgaccagctcatggagcaaggtggggatggggaacagagaaggaacagagctagagagatcaaagaaatggctcagaaggcagttgaagatggtggatcatcagcttcaaattgcgaattatttattcaagaaattggggcagttgaagatggtggatcatcagcttcaaaatag

SEQ ID NO: 66889 - DNA, 2280 bp, Glycine max
  Peptide Sequence Number=SeqID_158574
atgggattggttgctgcatcacacttggatacagtgttagagaagctgaaggatattttagacaatgttggacaaagcatatttcagaggatactgtcattgttctctgatagtttcagaacagaagagtctgatgacatacatgctgctttggcactaatgtatggatatgctgcaaagtatgccccatcaacagttattgaagccagaataaatgcccttgttggcaccaacatgctctctcggcttcttcatgtgcgtctccccaaagcaaagcaagctgtcatcaccgcaattgatttactaggtaatgctgtcattaatgctgctgaaagtggctcgccatttccattgaaaagaagggaccaactgcttgattatattttaactttgatgggccgggatgatgaagatggttttgctgattacaatgatcttttgcgtactcaggcccttgctataagtgcctgcactactttggtctctgtggaaccaaagctaacagttgaaactagaagccatgtaatgaaggctacgttggggttctttgctataccaaatgatcctgttgatgttgtcaatccccttatagacaacttgattactcttttatgtgcaattcttctcactggtggagaagatggaagaagtcgagcagagctgctaatgcttatcttgaggcaaattgatcaatttgtctgttctcctgttgagtatcagaggaaaagaggctgtcttgctgtccatgagatgcttctaaagtttcggatgatttgtgtcagtgggtattgtgcactgggctgtcgtgggagttgtgcacataacaagcaaatggaccgaactctatatgggaatttttcaaagctgccatctgcatttgtattaccaagtcgagaagctttgtgcttgggtgatagggtaataatgtatcttccacgttgtgcagacacaaattctgaagtcagaaaaatatcagcacaaattcttgatctactcttcagcatctctctttcacttccaagacctgctggttcatctatatctgctgaagatatagaattgtcatacagcgcattatcttctcttgaggatgttatagccatattgaggaatgatacttcaattgatccatcagaagttttcaacaggattgtttcctctctctgcattctgttgacaaaggaggaggcaagtgtctttgattctctggttgctacactgcatggttgctcagtggctatatgtgataagatcaagcagtcagctgaaggggctattcaagctgttgttgaatttgttacgaagagagggagagaattgactgagattgatatctcaagtacatgttgttatcttattagagggcgagccctgatggtaaagttatgccttggcgaccggttggtcatgggtttgaatctagaaacagcctctttgcatatgcaagggcaaattcatcctttacttgtgaaaaagatttcttctttggctgaaaacactagcccaagaactgtttttgatgaagtcctggctgctgctggaagggatacaatcacaaaggatatatctaggttacgtgggggatggccaatgcaggatgcattctatgcattttctcagcacatggtactgtcagttttgtttctagaacatgtgatatctgttcttagccagattcctatccttaaaggtgatgtggagagacttgaggatagccaggttgacagtcatacagaagatggcaaactgcaagctgcaatttttgctcttaccgctttcttcagaggtgggggaaaagttggaaaaagggccgttgaacaaaactatgcttctgttctttctgagcttacactgcaacttggaagctgtcatggtttaacctattctggtcagcatgaaccattgagttttcaagggaaattagggagatatttaaatctgaatcttcttactgcatttcaggcattctgtgaatgcgttggtgacctagagatgggcaagattttagctagagatggagaactattggaaaatgagaggtggattagtctcattggagacatagcaggctgcatatctataaagcgaccaaaagaggtctccttaagtggtggctcgtggtccacaggtatacccctcgaatctccccaacaattggtatcagagccgatggttcaagttggtgaccgactcagacgagtatgcaagtaccgcaggtggtcagaatggctagcggcacagcgtgccccgcaggtgaagcggggtggccagaatggctag

SEQ ID NO: 66890 - DNA, 558 bp, Glycine max
  Peptide Sequence Number=SeqID_158575
atggctggagttttccaagtgatggcgtttggagttcgagctctcgacaaaaaagacgttgattctgctttcatggcgaagctcgctaagattgctacagctgagttgatatcgtctaaggcctacggtggcctagcttgtgtttttgactcagtgagaaaccaaataattgctgttaggactcagaatctaacgaggaagaagctaaagagaagttgtaagttgtatgatactttcaactatgagagtttgactaatctggcaggttctgttaggcctcagaaggagtggcaacaccctgtctgttgctcttccaacggctgtcatgcctggctggagtggtgcttttcgccaccaaagttgaaggaaatggcgaccagagtggccaaatcacattgcacttcagttctaattgctgttccactcatggctgtgcttgcatcttgtgggtcaaagaaaagagacgatctgattcacaagcctaacggacctaaccccaaacgacagtctactttggactgtgttttagttgctagacacaccgtgtttcaactatga

SEQ ID NO: 66891 - DNA, 285 bp, Glycine max
  Peptide Sequence Number=SeqID_158576
atggtggtttggttggtgacgatggtgatacggttgctaggttggcagcgacgatcaggtggcgtgtcagatgttggtagtggggatggtgtttggggaacacaaactttcggtcaagcccggagcaccatggattccggacagaatccgacggagaggagacggcatctccatcttcgggtcgaaggacatatggatcgaccactggaccctttcgaggtgtgggatgtatgtatggatgaacagggacaacaaccttgggatgtggagcagaggacctggtga

SEQ ID NO: 66892 - DNA, 579 bp, Glycine max
  Peptide Sequence Number=SeqID_158577
atggatgaagaatctaagagaatggaagaaggaatcaattcagcattgaatggtggtggcaataaggatgacttgaagaggagggtaaccattaaaaccagtaatggaggttctgttattgagcatgacaaaggcacaatggctaagccttatggggctgagagtgagtccgtacagaaaatagctgaacaggagcaaccagtggttaagcagaagaccaagaggattgcaaccctggatgcatttaggggtctcaccatagtgttgatgatactggtagacgacgctggtgaagcttatccacgcattgatcattccccgtggaatggatgtactttggccgatttcgttatgcctttctttcttttcattgttgggattgccatagcccttgcactaaagagaatcgcaaagataaagcatgccgtaaagaagataatccttaggacattgaagcttctcttctggggtataattttgcaagggggttactcccatgcccctgatgatctcgaatatggagttaacatgaaatttatacgatggtgtggcattctccagaggtaccagctcacatga

SEQ ID NO: 66893 - DNA, 741 bp, Glycine max
  Peptide Sequence Number=SeqID_158578
atggaacccaaccaatttgaaacctacgtcctcgctgtgccaagaacaagaagcaacctttcatcatctaacaaccaagaagtaatagttatccccgacgtcgaatcgcagaatcgcgtacaagaggacggatcaaacaaacgccgcagaaccgaagaagaaggcgaggcggcggcggcttctcattccaaagacattaatgagcctctcgtttgccctatttgcatggacatttggaccagtaggcggagaacatcacatctggtgcaatcccaatctcctttacttaccctaatttacattctctctccctgtgttttaattggatatgttatgttattttgtctcccttgtggacacatatatgacatgtctagcatacaaaaatggcttcagcaccgcagaaattccaataagataattcagtcacttgaggccaaaagtactgctcttgaaagtaaggtattgaggacaatgattggcgcaagaaagaagccgaatggcacaagagagaagcttcattgcatcttcaagttgagaagcttacacaggagccacgacgctggaattccttcattgagcattgatgcatttaatgagacactgggtagagctgagcatatgagttttgatcagaggattgctatgatgaagaaactatcagtggccttctgccgtgtttggagtggagtagtttcgatgaaactaaaaaagatgttggagcaactatcattggagtag

SEQ ID NO: 66894 - DNA, 414 bp, Glycine max
  Peptide Sequence Number=SeqID_158579
atgggacccctccaaaggaaagtcttccgtaaagtgtacggaaagattttagatttgaccacaacgaaggtatttacagaagccgttgtatccctcgcccaatactatgacctgccgttgagatgcttcacgttcggggacttccaaatagtaccgactgttgaagaatttgaggagattttaggatgccctcttgggggaagaaaaccgcatcttttctctgggtttcttccctccttgagtaagattgcagctgtggtcagagattcagcgagagagttagatcgtatgaagcaaactcaaaacggcgtagtgggcctaccgcggaaatacttggaaggcaaggcaagggatatggcaagtcaagaagagtgggtcccgtttgcggatatactagctttgctgatctttagg

SEQ ID NO: 66895 - DNA, 263 bp, Glycine max
  Peptide Sequence Number=SeqID_158580
ttactaggcaccctctggacccagagaagtccaacaaggccctggggtttccggctctgatcacaggcctctgccagtcctacggaattcctgtcaccctcagcaagtattgcacgcctagtcaggcgcagggtgacgcacatcaggccgcagacgcaccgccaccacctcggcaagccgatccagctgggtcactgggcgtggagcggtatctacagtatttggttcgccagcaggcggccaaccaccgtggaaaggtgtag

SEQ ID NO: 66896 - DNA, 234 bp, Glycine max
  Peptide Sequence Number=SeqID_158581
atgtcacctgacctcacgggtcaggatgacagaaagaaatcgtttctacggataaccgcttggggtatctccgtacgtcaccaaacttcacgggtctggatgacagaaacgatttgtacggataaccgcttggggtatccccgtacgtcacctgacttcacgggtcaggatgacagaaagtgtggaagacgacgtaaatctccgcgtgtcaacgggctcgttggcctcgattga

SEQ ID NO: 66897 - DNA, 374 bp, Glycine max
  Peptide Sequence Number=SeqID_158582
atggcctccaggaagaggaaagccacaacatcccggccccaggaaccctttcataccactagattcacttctgatggggcctgggaacgttattcacagaacattcactttcggaacatccttccggagaggaatgttaatctctttgtcactgagtacgacaaattccgccgagagctgatcaaatggaactggtacaagaccttgacccagttcatggacgggcacattgatgtggccctggtcaaggagttttactcaaacctgtatgaccctaaagacaaatcaccaaatcaagttcgagtcagagggcgggtgattaaatttgatgttggctcactgaatgccttcctggagacgccaccatactctat

SEQ ID NO: 66898 - DNA, 303 bp, Glycine max
  Peptide Sequence Number=SeqID_158583
atgctctcctacaacctaagacaaggtagatggggattacagtttataggctcagggttaaagtcaatcaatcaaactttcagctcaacatgggtgcaagggataatttattcatgcccaagaaaaataaatgaaagtcttgccaacaatcatcctgagcagcagtgggctcatcctgagctggtgcaggctcgccatgaggtgaagaaggagtatcctgggctggctgcgatttgctgcatagtcggtgtccttggctcttgggctgtggaagcctcacctccccccaaaggagaaggctga

SEQ ID NO: 66899 - DNA, 587 bp, Glycine max
  Peptide Sequence Number=SeqID_158584
gcttagcgagccatgctcgcttagccattgtgttgtttcagctaagcgagcacgctaagcgagtctgtctcgctaagcgcccaatggcctccaggaagaggaaagccacaacatcccggccccaggaaccctttcataccactagattcacttctgatggggcctgggaacgttattcacagaacattcactttcggaacatccttccggagaggaatgttaatctctttgtcactgagtacgacaaattccgccgagagctgatcaaatggaactggtacaagaccttgacccagttcatggacgggcacattgatgtggccctggtcaaggagttttactcaaacctgtatgaccctaaagacaaatcaccaaatcaagttcgagtcagagggcggctgattaaatttgatgtggcatcactgaatgccttcctggagacgccaccatactctatgttttgcaggtcgtgcacggatcctcaagagcttgcctctaagctttgtattccagggagtgccctggaagctcctgaggaaggatctgacaacgctggcccaaacctggagcgtgttgtcatattctaa

SEQ ID NO: 66900 - DNA, 453 bp, Glycine max
  Peptide Sequence Number=SeqID_158585
atggacagaggcccaggaacaagctataaagatgcaggtttgagtttgggtgaggtgtggttcgacatggttggctttcacaaaggagtggtaagcttggacgaaggtggtgtttggggttttggggtcatgggagaaggaggaagaacgggaaaagaagagaagagaggaagaatgaagggaaaaaaaatggctgcaagcaaggaaaatagcattgtgagagaacttgtggctatgaaggagcgtggagattgcaacagagaagaagatagaggagatgaggttcaccacttcaaggacaccgaacattgtgatgtgaagagtagtgagaccaaggtgttgttaagagacgggggttgcttacagcaaagctatgaggtagtggaagcggtagcagaggaatgcatgacgaagatgaggtataatttggaaagtaacaatatggttagctaa

SEQ ID NO: 66901 - DNA, 327 bp, Glycine max
  Peptide Sequence Number=SeqID_158586
atggccaaactcaattccacaaaaccagcttttaaggtgatgattgccccaacctttataaggagtggacctttggagcatggacaaaggcagcgagtcgctgtgactgcggatcacgtcgatgagccagtcatccctgcgccagatgttcaggatgacctgatggaggcaccagctactgtggaggacattcctgcggacattcttgtggacgcaggcgcaaaggcggttgaggatcagcctcagggatttccaggtggtccgagcgacccatccgtgttgacagcgtatgcggatcacgttgcttgcagcgtatggacgggagag

SEQ ID NO: 66902 - DNA, 467 bp, Glycine max
  Peptide Sequence Number=SeqID_158587
cgtccactaagcgcaacactcatgggctaagcgcgaggaagactctggaagaagatgagttgtacagactagagcttgaagcaggagccggtttgagagctcaagatgagtttgtgagtgattgtgagatcctagaggcttcctggttatggaaagctaaatcctctgttggatcttccctaacaatttctactagtattagtggtgcaagatactacactggaactttcaatactatcaatcgctctccagatggaaggtatgttgtagtctcaagtcggggcaacttctacttaacctgggagcctggtcagatgatcagatatttggccttagatgaggcagatagaatgctggatatgggttttgagccacaaataaggaagattgtagaacaaatagacatgcccccagcaggtgctagacagactatgttgttcaatgctacatttccaaaagagatatag

SEQ ID NO: 66903 - DNA, 617 bp, Glycine max
  Peptide Sequence Number=SeqID_158588
cgtacatctacttgggttgtaatactgagaacaagagagggtacatctgttgtggatcagttcaagtggagcgtacatccatttggttgttcaaagagaacaagggagggtacatcccttgtggatctttgcttgtaaaggattttacaaggttattggaaatctcaagaaccggtggttgcttggggactggatgccacttgatccaacacattttgctttcacgatcctcaaaccttgctcaagcctttgaggaggacttgattctgatgtgggcttttcaaactggtcgtcagatcgactgggcccatttagttcggtaccaaatgcataaggtagtacgggccaatgctcttctcccttatccttaccttgtcactctttttcttcatcatttcaatattgctttggatgatgaaccatttgtcaaggtcaagcgatctttctctattggtgctggtgaacaatttaatgcgatggatactcgtcttgatgcaatggatgcacgctgtgatgggatggatatgaggatcactcatctcgaagatgatataagcttcattaggcattgcttcgatccctcgaccgactcttggttgtttatcattatgttttga

SEQ ID NO: 66904 - DNA, 330 bp, Glycine max
  Peptide Sequence Number=SeqID_158589
atgcttcttcttttcctcatttttgtttttccccttctcctctcaaaaccctttctttttctcgcatctcaccaaacctgtctcagaaaaaaaaatagcgatctcgaattaatttaccgttggatcgtcatgaaatttgagcaccacgtttacaacccaattccgagaattctcaccgttgggaatttcgttcctcacatattcaccgttgggatttgcgagataatattcacggagagggaaaaaggaatcgcaccaagacagtacaagtggagacttcaatcccttctctacttctctgacgtttgggaactctatcggaacagttag

SEQ ID NO: 66905 - DNA, 468 bp, Glycine max
  Peptide Sequence Number=SeqID_158590
atggctacaaagaaacttacctctaagagagctaggaagaccactacaggagaaggatctagcacagctccacctgtagaatttgaatttgatggacaccactttcataagattgctaggacacattggacacagcttgcagagcccatgcctaaagatgaccttgaagttgtcctggaattttatgcaaatgcttggcctactaaggaaggtgttatggataagcgctctaaagtgcgaggccaatggattccttatgacacagatgccatcaaccaatttttagggaatccattgatcgtagaggagggacaacaatgtgaatacactgcaataagaggtcagactacaggttttgatgaaaaggccattgatcagctactttgcttcccaagacgtaattttttatggagcatggaaaggaagtggtttcaaataatgcacaccaacatgatgactctgacttaa

SEQ ID NO: 66906 - DNA, 252 bp, Glycine max
  Peptide Sequence Number=SeqID_158591
atggttgccagttgcggagttgacaaaataagagacaaggtggaccaagtctgtccatcctttctgtgtactggaaaaagtcttgtcccacattgcaaatcttatgacaatccatgttactttgctcgttgggctgctacgcggaaacttctctatcagtttcgtgatgttgagaataacacagatggagatgccttaatcacgaagcagatattatcacttggagcaggctttgacccaacatatttttag

SEQ ID NO: 66907 - DNA, 999 bp, Glycine max
  Peptide Sequence Number=SeqID_158592
atgggaaaaaggaagctagaaatgggcatagatgaccagaaggtcaaatttgacttgtttgatacaatagagcactcacctgatcaggatgattgtttaaaggtaaacaaagagaagaatgagagggttctgaagatggcctcaaggaagagaaaagccaccgcctccagacccagggagccctatgacactaccaagttcacatctgagggcgcctgggaacgatattcacagaacattcactcctggaacattcttccgaagaggaatgttaaccttttcgtcacggagtataatgagttccgtcgggagctcattaggcggaactggcacaaggccttgacccagcacatggatggtcacactgacgtggccctggtcaaggaattctactcgaacctttatgatcccgaagataaatctctcagacaagttcaaggcgaggttggtatatggcttggtaatgaagatgaacatggacgtgggctcactcatctcaggccagatttcacagatggcccagtccaactcctctcgactggttttctagccctcattactgcactttgcatatctagaggggtggtttcagactcactgacttttgagtctcttagccctgccattaatttgtcatacataaagaagaattgttggaacctggataatcccacgatcactattctaggggcccgcaaagctaggactaggggactagattcttcagcaccttcttcttctactcctgctctttctctagcaccaagcattcataatctggctcagcatcggcccatcatcagtatggaggagtttgcagcacaggcttctacagcccaggagtcccagccacagccagaggtcgtttcagaggtcactccagagtccactccacaggctttaccagttacgacaccagtattgaaggtctctgatgaggaggatggtgctgcagacgcagattatgaagctgatatgatagcaacgcaaagcacttga

SEQ ID NO: 66908 - DNA, 609 bp, Glycine max
  Peptide Sequence Number=SeqID_158593
atgaagaaaaagaaggttgcagcagcaagtgtctcgctaagcgaggcatatgtgcttagcgagcaacaactgctaagcgaggcactgagctcgcttagcgagttaggggaatctggaaaagaatctactaagcatgcacgcgcccagtgcatcatcagctcgcccagcgagtcatttgtcttttctggcgctaagcgcgcctggctcactaagccaaaattcactaactctcgcttagtgcgaaaatgggtcaaggcgggtccagacccgagccactcaggatgctccactagcaccaccaccagtcattcctccaccagccacctcatcttccatcagccagctcttccccatgttgcaaagcctccaccatggccagtatctcttgatgcagagccttcaccagttatctctccagcaacaagtgatgacaccataggcattcctatctcaggttgcctggccaggagtccagcttccttctgtaaggggggtgatacctttggtactggtaatgatgatgccacaaagattggagctgatgatgattactttggagacatcactgctgcacatgttgcttgggatccatggcccacacaagaatga

SEQ ID NO: 66909 - DNA, 455 bp, Glycine max
  Peptide Sequence Number=SeqID_158594
atgacaacgatgatggaagcaatgatgagcatgaggaagatgatggaggataacactgctacagttgttgctgcaagtactgctactgagatggacccgatccacccaaccgatttcaatcaagttcaaagcaagcattccttcccaccatatgggttgcctcctaattacacatcgccgactgttgtatacacttctggtgagaatatcagcaattttgtacccgtactcattgagaatcagcaaccccaatctgatcatgcacatgtctctcaacccatgggggaaacacatgaagttcctcaagaccacactccggctgggtttggggtttatccaggatataccactgaagggattcacgatgtcggatacaatgtccaggacatcctgcccgaaaatactggagttgctaaaagcattgaagttgcaggatccacgatgtcggatacgat

SEQ ID NO: 66910 - DNA, 414 bp, Glycine max
  Peptide Sequence Number=SeqID_158595
atgaggcttcactattatcaagcgagttggggacccagcatgaccacagatcgaccttcactccctatggctaacatagacccggttttaagaacccttaaacccttcccctgcatggctatttataagaaaaggtcatttggtgcaggagaagctcgcccaggcgagttggagctcgcccaagcgagccagttgcttgggcttgaaggtatcagctcgcccaggcgagcagggtgcttaaggctaaagctttcccatggcccaggtgagccagatgctggcatgggcgagtttaggtctagaaagttccagaaaatgaccattttgaccctttccttgtggtcggcttttgttttcggatttgacaatcaaacatcaaccctgagcgacccctcagccttgcactgcaactga

SEQ ID NO: 66911 - DNA, 1116 bp, Glycine max
  Peptide Sequence Number=SeqID_158596
atggacttgaaagaaaattgtacttatgtcatgcacaattttaaagtgctaaaaaacaatggtcagtacagagtgtgtgatcatcaatttaaattggtgtttattggggttactgttgtgagggagtgtgttctaggggacatcccttttagaaaatacaggtttgctggatttgcagatgttgtggctggccagtttgaacgtggactattggttgatgttattggtgttgtggaggaggttgtctttcgccaagtttcaggaaaaggtagaagggtagtcttcaaactaaaggacttgagccaacaattgctatcttgcactttgtgggatgattattgcttgcagtttttgaagttcttagatgattatgaaggtgatggcccaattacagttctattgagccattgtaggatcaaggaagcgcagggatcttatcccgcatcgatcaacaattctttcaaggcttcaaagttaattattaaccagcccgtgatggagattcaagaattcaatgaacggcttgcagagttgggcattgaggcccggtcaggttttaaatcccatggtgaagggagtacacaactttcaggttctatccaattatcatcaaaagaatcattctttggcaaggctgaggcaaagactattgctgacataaacaccatccctgaatgccataaaaaaagtgatgtagagatagcgccctttacatgtgcatgcaacaaatacaataaggaagctatgcttaggtataggcttgaggtgatgatcaaccagggaaatgaaagcacaaaattgctgctttgggaccgtgaatgcagtgaattaattggtcaatcagctgatgcagttaataagcttaaaattgaagatggtgatgttgatttgaatgcttcaccccaagcacttgataagctgctgggttatgaacttgctttcaagataaaggtgcaacccaagttcaggaattatgttgttttgaagtgttcagctgactcgagcttaataaatgttgtgatggatatgctagctgatgctgaggtaatgttcaatacatcttcaaaaatggatatcccggtttctgattccaatcattcttctcaacatgaatct

SEQ ID NO: 66912 - DNA, 327 bp, Glycine max
  Peptide Sequence Number=SeqID_158597
atggttttatttctgactggtgcaggatcctatccatgctcagttagcaattctttgaaggcttctaaattgactattaatgagccagtggcaccaattgaagaattcaataagaagctttcagaattgggcattgagatctgctcagttttgacacgtcgttcccagtggagttcacaaccttcaggttctgctcagttatcatcaagggaaacattcatttccaagtcagaggcaaagaccatttctgagataaacaacttttgtgaagtaattatcttatatatgtttacctgtttatcgcttctttggctgcctcctgcttaa

SEQ ID NO: 66913 - DNA, 243 bp, Glycine max
  Peptide Sequence Number=SeqID_158598
atggagtttgacttggatttgcgagcattcgctaagcgtgacattcagtggctaagcgcgaggaagaatccagaagaagatgagctgtcaagttcgctaagcgcaccgctccaggtcatcaagtgcaccgcttcagcttatccactaagcgaaacaagcgcgctaaaccaaaatccacttatgcgcgctaagcgatccagatctgcgctaagcgcacgagcacgaacaaggccccctatttaa

SEQ ID NO: 66914 - DNA, 81 bp, Glycine max
  Peptide Sequence Number=SeqID_158599
atgacagaggactttgagtcctatgaaggcgaggactttgagacctacgaaggcgaggactttgagtcctctgaagtttga

SEQ ID NO: 66915 - DNA, 372 bp, Glycine max
  Peptide Sequence Number=SeqID_158600
atgatagatctcatccagcacaagaagttgcagcccagatacgctcactgctatataaacacgaaggctgcacgagttctgtaccaacgtgatgtcgtgacatcctgtacgacatctgtccccagtatcagaatttcagcattcttcaagtgcataggcaaaggcttcaactccaaggaaggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 66916 - DNA, 165 bp, Glycine max
  Peptide Sequence Number=SeqID_158601
atggaagttggaagttggaagtggaagttggaagttggaaatgaaagttattggaagttgaaagttgaaaatgcaggttggaagttggaaggggaagtggttgtcatcatcaaaaagggggagaatgtaaatcatgaagattttgatgatgtaaagaagaattaa

SEQ ID NO: 66917 - DNA, 486 bp, Glycine max
  Peptide Sequence Number=SeqID_158602
atggaaattttatgcaaaggaagcaagagaatctacctgaagcctggcaaagcttgcaagagattatcagaaggtgtcaaccaggtggagaaagatgattcccaaactgaattaggaaagcatatgcaagatctaacactaaagaatgagacactcatgcctagagaatgcactattgatgatgagttagttgcaaccatggatgagaacaattttgttgtgggaagaaacaactcttataatcagttgatgaggatgttcgtatcatattggggtgaactttcctcagtacttttgatttacttgttgagtatggggatgcttgaccctttagagagagttctcactgatgaggaccttgaccgggagttgaaacttgaggtaaacgaaatactgacgtttctccactctcaacatagtcttggactgcctagttgtgagaggttagaatggggcaatgttccaaagctaaagcctcctaattag

SEQ ID NO: 66918 - DNA, 2241 bp, Glycine max
  Peptide Sequence Number=SeqID_158603
atgcctgttctgcatctagggatatggccagagtctccaagtttcagggatgagggtataggggagattccttcaagatggaaaggtgtttgcatggagggtagtgatttcaagaaatccaattgcaatagaaaattgataggtgcaagatactataatattctggctacatcaggtgacaaccagactcatatagaagcaaccaaaggttccccaagagattctgttggacatgggactcacacagcatcaatagcagctggtgttcatgtcaacaatgctagttattttggtttagcacaaggaacagcaagaggtggttcaccttctactaggattgctgcttataaaacatgctcagatgaaggatgctctggtgccaccatactaaaggctattgatgatgctgtgaaggatggagtagatataatctcaatctctattggactcagctcactattccaatcagactttttaagtgatcctatagccattggagcatttcatgcagaacaaaagggggtcctggtggtgtgttcagctggcaatgatggtcctgatcctttcacagttgtgaacactgcaccgtggatatttactattgcagcttctaatattgataggaacttccaatcaactattgtccttggaaatgggaaatatttccaaggtactggcattaacttttcaaaccttactcattcaaagatgcatcgccttgtctttggagagcaagtagctgccaaatttgtccctgcatcagaagctaggaactgttttcctggatcactagatttcaacaaaactgcaggcagcattgttgtttgtgttaatgatgatccaactgtttcgaggcaaatcaagaagctagttgtacaagatgcaagagccatagggataatactcattaatgaggacaacaaagatgctccctttgatgcaggtgcatttcccttcactcaggttggcaatcttgaaggccatcaaatcctacaatacataaactctaccaagaacccaactgcaacaattcttccaacaacagaagtttctagattaaagccttcaccaattgttgcatctttctcatccagaggtccttccagccttacagaaaacgttcttaagccggatgtgatggctccaggcgttggcattttggccgctgtgattcccaaaactaaagaaccaggaagtgtcccaattgggaaaaagccatccttgtatgccataaaatctggtacatctatggcttgcccacatgtgacaggtgcagctgcattcattaagtcagtacacacaaaatggagttcttcaatgatcaaatcagcattgatgacaacagctacaaactacaacaacttgaggaagcctcttactaacagctcaaactccattgccgatccacatgaaatgggagttggggaaattaatccactcagagctctcaaccctggcttagtctttgaaacagatgtggaagactatctcagattcctttgttattttggctattcacagaaaatcataaggtcaatgtctaagacaaacttcaattgcccaaagaactcttctgaaggccttatctccaacgtcaattacccatcaatatctgtaagtacacttaaaaagcaacaaaaagcaaaagtgatcacaagaaaagttaccaatgttggatcccttaatgccacatacactgcaaaagtgcttgcacctgagggattggttgtgaaggtcatccccaataaacttgtgttttctgagggtgttcaaagaatgacctataaagtctcattctatggcaaggaggcccgtagtggatacaattttgggtctctaacatggcttgatggtcaccattatgttcatacagccgccatcgccggactccttgacgccgagccacaccacatgtcgaaaaagaactacctccgctgctgtcgcgaccgctacgtcgacgtcaccgctgccggaaaagggagtactttcgcacctggacttttcgctgtcaaggtggcttctgttgcttcaaaactaggtattacgacggcgttttacagcatagtgactccatcgttatgggcattcatgggagaaactccttcatctctaatgggtaacgaatggctcaatccatggtgggtcccattcccgacaaccgttgttgcatttggttactttgagaatctgaaacggcatggcgtttcttcaaacgcgtgcagagtgggtttgagtatctag

SEQ ID NO: 66919 - DNA, 1800 bp, Glycine max
  Peptide Sequence Number=SeqID_158604
atggagtatgtggctggtgaactagatatggagttggtgcttcccttcctcttgtacaagagtagagctaactgcttcgcgcatgttgtatttgcggaactctctgaagattgctttcaggtctgccacttgttgggctatgctttgagatttgacgatcatgtcgtcgatgccaaaaggcatgatcctatagcaaaagttggcatcttcagttataaatgccatcttctccttgtctgcagcgtacatcctgatttggttgtatccgaacgctccatcaactactctgtcgatgttgggcaaagggtatgcatctttggggcatgccctgttcatatcagtatagtcggtgtccattcgtcatttgccataggcctttttgaccatgacaacattggcgagccagtgaagtatttgatttctccgatgaagttggcattgaggaggacaaatggcgagcttgtggcagataatgttgggatggatttctggcatgtcagatggctgccaagcgagcaggttcacgttcttatttgtaacttgtcaagctcttcgatgggcttcgagcctctgtcagaagtgtcgtcacgcaaatctttatcaaattcatcgtctaggcttgcttggcttcctaatgggaggatagggtgctaccttcaggctctctacatagcactgccatgtttgcttttaatcctccttgaagatgtcgatgtcccgaatggattggcgagactatcctccataggaaaattttctcacaatggggttgtcgctcatacctctgctactggtgtctctgtctacctcgatcttctactctatctcttcttctatgtccatcgtaattcctatgtttctcctcttactttcctctggtatttggtcgtgtctaaccccagcctaggaggtttcgttgggggtatcctgatgggtacctccaagtttaaagcttcctctaggattgtagtgcaattggccgttagggttggccttggtgtttccttctcgcttgtcgtacttttgtctgacttatgcctcttatctgacttcgttcccaaatctagacatttcatccatctggatgtagcccttgactcgttcgcgcaacttgtccatgctactagggtttttttttgcatagattgttcacgaacttgttgggctgtagggcaaggagcatggaatgtaatgctacatactgaccaaggcggtagaggtcatgcgatgagacctgttggttacgtattgctcacaaaagtatttgacgatgatgtcgaagctgtctatggatcttggtgggagtccactgtaccaggcatccaaatgctcatctggattggtggtcccatcataccgctccaggagaggcttaggtcatctggagtgttaattgtgcatcgggggtgtgattcccttgggtgtgctcaagcaatgtgtgagtggagtactcgtcgccttggggatctttctcggctcctcctcatggcgtcactcagttttggagttgctgaagagtatttgtatgtcatggctgctggtggagggttaaagccctcaaaaggggtctcgcgtctaaagctagaccaagtgctaaccataggtgaaaaagatagagatgacaaggtattgcggggtgggctcctggacttcacatgtcagtcgagagtgacctttgttaggaggacaagaagggagacttgcaaaacaaaggactctgacgctcaaggttcgatggaacctggtatttataagagtggtatggagctagggggtccttgtttgcaggggttgttatag

SEQ ID NO: 66920 - DNA, 747 bp, Glycine max
  Peptide Sequence Number=SeqID_158605
atggaagatagggttcttgaagtaacaaaaaccaatgtgtgtatgatattgattgcaaatattgacagagttttatgtccatcagcaattacagagatcttacatagacatacttcagtatcagctagtgtcttcatttttctgaatttgtcattggaggtatatacttggggagccattgtgttggattctgaaaaagagttccaagagctgtgtgactttttgaataatcccaactgcatcgtaacatcttcaactggtaggccatgggtgatacttgaaaagccagtggggctcaaaaacattaaagcatcaataggaagattggtgcatgttacaaagaatatattacaaaagggaaagagtggaacgagcaacaatttgaaggttgtacactcaagaactcaagaattcaagatagctagtgacatgagagatttgtttttggaattttttaatcaccaagagcggctacacaagaggcttgcacttgaggagagaagggtatcattcaaacttgtccccatagagcttagtaggagctatgtgcgacaagaaatcatcaattttggtacatactgcaaaagagacaaactcgttgctgttgttccatatgtgaagatgaaaattatatctaggcttcttgatcttgtcaaaaatcactgtatattgattactgagatggtaattcacacatctatgcccttgatcaagattgttgcattgtattcaactggatcaacataa

SEQ ID NO: 66921 - DNA, 267 bp, Glycine max
  Peptide Sequence Number=SeqID_158606
atggctaggcgggcgataaagcttgacccgccattgccattggcgttacaggacgtgacgtggacggtaccgccatttccactggcgagacgtggtgacgtggacggtaccaccatcgcaactggcgatacaggccacgtaggagaaggtctcgccttctgtagtggcgagatatgtgaaaagaaggtctcgccttctctagtggcgagatacatggtgcatcacgtgaagaagctcagcccagggtcacagatttgcagtgtttag

SEQ ID NO: 66922 - DNA, 873 bp, Glycine max
  Peptide Sequence Number=SeqID_158607
atggactgtgtgatctttaaagtgtcaacgtcgaatgctgaaacagaagacaccaattgttccctcaactttctgatgaaactaaacccgacaccagcgatgttcttgaacacgatccctctatatcggtcgaaggccgctctgagaatggcggagccaccgccatttccggcgacagagagggtgaacacggggtcaacggagagagtgttgccgcctgaagtgaactcgccggaagtgaactccaacgttccgtcgagtgcctccatgcgtgtccactcgccaatgtccgacgacgtcttggactacagctccaccagcgaggttggccgtggcggtggacgcggtggtgatttcttggcttcagcggagcttctccagcttggtagcctccttcttggtggcctttttgctgacttgggcctccgacgatgctgcggcagcggcgagatcgtgtatagtagacctcgtcacgtggagatccacctttttgcgaggacggcgtggatcgtgtatagtagagcttcgcctttttgtgagcggaagcacaagagacggaagggttcaaaggaagtgcaagagacgagattgaaagaagcactcgctagcttcaaggtctacgagcctctgaagaagcgaaagctctacgagcctttaccagtaccgccaccgtctttgcccggcggaacaaggatgaaattcgaagcgtgtaagaaggctacaagcggattaagcgttgcttgcttcggaaagacgctcactcctccttgtctaaactcgaacaaagttatctcgctctcatcacttcttccagagaggattgtttctgtagatggccatttaggaatgtttctatgggaatcttgtgcataa

SEQ ID NO: 66923 - DNA, 147 bp, Glycine max
  Peptide Sequence Number=SeqID_158608
atggcagaaaaagaaatgactccatcctggatgaccatgaccaagatggaatctggaaccacactttcctccacaaatatgtcccaacctatcaatctaaattcaaaaatagaaattgaagataaaactctgtcctttgcaatataa

SEQ ID NO: 66924 - DNA, 684 bp, Glycine max
  Peptide Sequence Number=SeqID_158609
atgaagaacacaatgtcatcgtcgtccaacacgaaccaccgcacgtgtcgtcagagatcaccaacagtggcgaggaatcatcgaggtggtgttgggtggtgttttgtcgaggaatgcgagggcgcaggtggtggcgggggagtaccagaggttgatgtaggggagacagcggagccaggaggtggaggaggaggcgttggagaagaggaggtgggagatgaatgcagagtagataaggccgggaactacgaacgcgaggtatacaaaggtgaggtatttttacgctgggaactacgaggtacaaagctgatcagtacagagcatgagttcaacagctacaggatggaagaggtggtggagaagttccttaagaaatattttctagattccaagaccgctgaggggaagcttcttgacacatctgctagtggaaaaattaaattcaagacccctgatgaagctatggagttggttgaaaatatggtagctagtgaccatgccatccttcgtgatcaagcttacacacccacaaagaagagtcttcttgagctcaaatctaaagatgcattacaagctcaaaacaagctcctagccaatcaaattgagacccttacaaagaccttgaacaagcttcagtcatgcaaattgggggatgcaacatttgtggcgagacccatgagttag

SEQ ID NO: 66925 - DNA, 180 bp, Glycine max
  Peptide Sequence Number=SeqID_158610
atggctatttataggaaaaggtcatttggtacagggaaagctcgcccaggcttgttggagctcacccaggcgagccagttgcttaggcttgaaggtatcagctcgcccagatctgacaatcaagcatcaaccctaagcagcccatcgaccttgtgctgcaatcgatgccaaacaccgtaa

SEQ ID NO: 66926 - DNA, 489 bp, Glycine max
  Peptide Sequence Number=SeqID_158611
atgaaggctgacatagaggccatgaaagagcaaatgaccacaatgatggaagctatgatgagtatgaaaaggatgatggaggtcaatgtggctatagttgttgccgcaagtaccgccacaaaagtggacccgactcacccactggcttcaatcaagttcagaacaagcattcctttccaccatatggtttgcctcccaactatacaccatccaatgttgcacacactctcgatgagaatgttgaaaactccgcacccatacccattgagagccaacaaccccaatctgatcatgcacatgtctctcaaccacaatttagccgacttcgagcctcacctcgaatatgctgctgaaggcaggcgttttgcgatgtacccctaccaaacactttggggggccctcagtatcgcccacaaccataacccttgcatttcgcgatgggaagagtccctcctgctatggtggaaagggagaaatttgatcatatag

SEQ ID NO: 66927 - DNA, 162 bp, Glycine max
  Peptide Sequence Number=SeqID_158612
atggctcttcacatagactatgatgcaatcttccctaggaaaggaccagccaccagagccatgagcaagaggctccaagaggattgggctagagctactgaagaaggccctagggttctcatgaagcttagggtatgtaaggtaccctacccaacaagttaa

SEQ ID NO: 66928 - DNA, 108 bp, Glycine max
  Peptide Sequence Number=SeqID_158613
atggatgtgaaaaaaaccattcttaatggtgatttaaaggaggaggtttatacgaaagagcctaaaagcttctcctctagcagtggggctaaaaaatttaaagactaa

SEQ ID NO: 66929 - DNA, 294 bp, Glycine max
  Peptide Sequence Number=SeqID_158614
atgaattccttacgaagttcaatgattgctgttatctttgccatgacattgatcctttcatatggagtgattctgtcccaagctaggacgactcacccttcttcacccttagtttcaaaaatgtcacaatcttctcaatctcattcacattcacttctgcacaaagaagagcacaaatcaactcaggaacctgcggttgccactagccttagaaggataccacctagcagaccgaatcctacacagaacaggttcaaattcttaggtttattagtgtgtgagagtgtggtatag

SEQ ID NO: 66930 - DNA, 300 bp, Glycine max
  Peptide Sequence Number=SeqID_158615
atgaaagggttatggaagaaaagggaaaggttcatttgggttgcgttgggttggggaggaggaaggaagaagaagggccagtatgagaagaagaaggagaaagggaagggacatgggtttgggacgaagatggagaaggaaaagggtaaagagatgttgatacatgagaaagagggacattaccagttgggacttcaggagcttgtgtggaatcacttggtggggaagaaatttcaggattcattgctggaacagaatgtgttggagcttgtgatagaggtccatgacattgtggttgag

SEQ ID NO: 66931 - DNA, 405 bp, Glycine max
  Peptide Sequence Number=SeqID_158616
atggctttgtcattacaaaatatgcttgctttggtagaatatagcatgccaaaacctattcattttgttaagggacttgcactgcctcctgagcctcaggttggtcccttaggtcctcgagtaagcacaaaggggagttgtgttgatccctcaggaaacgatcctgagacgggtgactcggataggtgcggcttgtacatcgaagcaaatcctgatcgtctggttgccctggggagaatttatgagggatccactgttgttcataacactcctttgttgcctggccaagtaaagctgggtgtggaggaggttaaagatgcagatgctccaattcctgtacccactaatgaggtttccttagtggggcaagcaattgacaccttccttgcttggccgacatatctg

SEQ ID NO: 66932 - DNA, 447 bp, Glycine max
  Peptide Sequence Number=SeqID_158617
atggcttcaataaatagcatggaagctagggaagttgcatgtaacaaagatgaaaaggaggccctggtcatgagccaaatcctaatgatctatgaaaaggcatcaggccaaactcttaatctcaatagatccgaaatattttgtcataacactgctcataatcatagggagttgcttgcaaacattcttggtgttatggagtgtctgagcatagggtggtacttggggaagcaagggtttagattgatcacctacccgaatggtttaatttctcacatcttcaaagctaaatttggccaatatgagagttcttggaggttaaacttggctataatccaagttatacccagagaagcatatggaattcctaaccattggttaaggaaggttgcaaatggaaagttgggaatggagcgtctattaagttgtgggacgacccttggctaa

SEQ ID NO: 66933 - DNA, 381 bp, Glycine max
  Peptide Sequence Number=SeqID_158618
atggaagatgaggaagcggaggccgtcgcagagttgaagcatgtccgacggaggatcgtggccgccgggagtccactacacgccgaggccgacaacgaggcgctcctggtcgacgaagtagcagttgaagtagagcgtggaggagatccaccgcttgaccacggaggcgttggcggcgatgatgacgatgatatagtttttggcgagatagacagtgtagatgtcgtagttgtaacaatgctctatgtatgtgacggaggctatggtttggaaaacatacttgtttcgaaatgctatgagcgagttatccacatagagaagcaaatatatgctatgataaacacattaatcataaggacttatgttgtacccatgagataa

SEQ ID NO: 66934 - DNA, 366 bp, Glycine max
  Peptide Sequence Number=SeqID_158619
atgattggtcattgggatatgctaggtgcacccagcattattgttggtgcacccagcaatttattgaaaggtcaacattctcttccaccgcaagccaccgcgagcccagctgctgcttctttcgcctggacgccattgccgttcgagaaccatagggtagaagacgagagcaggaggtgccggaaaaaatggggaaagggggctgacggcgaggcttccggaagacccgttatgggttcttccgaaacttccggaagaacattttccggaaactttccgaaagaagtgttcttccggaagaaaccaaacgttttccggaagaactcttcttccggaaactttccggaagaagtgttttttctttaa

SEQ ID NO: 66935 - DNA, 228 bp, Glycine max
  Peptide Sequence Number=SeqID_158620
atgcatagtgaagaagttgtaccgtgtttcagaatcatttgttctataccaagtctcaccagaagcttgacccttctactatccccaacatcaccagactcgattgcggaagggtacactcgtttgatggttgcaggagtggaagcaaaggtggaagaggagttgtggaggttaaaagctgccttaaattgtttggctatgccaatagcatatgcagtgaaggactaa

SEQ ID NO: 66936 - DNA, 255 bp, Glycine max
  Peptide Sequence Number=SeqID_158621
atgaactaccccatcaaggaggttttgagaaagcttgaactcataggaaggatggtagcctggcccatcaaactggcagagtttgacattcactacaaaccgtgcggcctcatgcagacacaattcatggctgaatttctagcagaattcactggaaacgacacaaccaccctagaatggtggaccctttatgtcgacaaggagactactgttccagcaacatcaaaacaaagaaaatataagggtggaacttga

SEQ ID NO: 66937 - DNA, 501 bp, Glycine max
  Peptide Sequence Number=SeqID_158622
atggctagccaaggggtcattcaagtgtcaataagccttgtcaccttgaagcctatgccttatcttcttgttaactataagaaaaaaattgaagctttcattgaagccttgtttgtcaccttgaaaattgaagctttcaacgacagggaagaaggttctgggggatgtggaggagctcagttggcaggggaaaactcaaccaccaaggacaacaatgacagagagacagatgtagaaagtgatgttgcaagaagagagtttgatttaattgaggaaacggtattggttgtgaagaaggaatcacggccaaaactgcttatccaagtcagcaagaacagatcagaggccaataaagcaaaaattccaggaattccgttgtcagagaggccacaagcagaatctgaatccactgaagcagaagtgaaaggtaaactgatatggattgattccaagcaacagacaactcgaggcaaggttatcaaattgagactcaatttgtga

SEQ ID NO: 66938 - DNA, 1845 bp, Glycine max
  Peptide Sequence Number=SeqID_158623
atggtgctcctggcttgggttgactcaaaactggcgcctatcgttgagcttttgtacttcttgaatgttgatggggttgtgcatcttcagtatggcagttcatttttctgggttggcttcaatcccctggccaaatggcatgaccttgtagcaaaaattgacttcttcagtgatgaataccattttttcctcatttggaggatgtattctgatctggtagtatccgagatcaatatagtttgtgcatattcgccattttccgttggcctttttgaccatgacaacattcgtgagctgactagaaaatctaacctatctaatgaagtttggcctagggcagatggccagtttgtggtagattatgctaggatggattcctggcatgtccctactgagccacgtgcactgccttggtttaggtttgagttgcagctggacaagctttttgatgggttttgggcctctatcagaggtgtcatctcacagatctatgtcaaattcattgcccatgcaagatcgatagatggtcagggctcggatttgagacccttcatccactgtcatgacttgagtgccttcagccgctgcgagattttggtaagctttgacggttacaatctccctgacagtgtagggaatttcattgtcagatggggcgtggagactatggctccaggctccttaagtgtcttcatgtcgattaaggcaaatcatcaaatccatgtagcctctggtcttgactctctcgcctgcgaagccggggagtggaccaatgtgatggtggacaatgtcggttgttatgatgatggagacaaccacgaggttgtcttggttgatggggttgatgcccttgaagtccctgtctgtaaagataaaccaccaatgatggtgctaattacacctttgatgtgttggggggttcctactctggtggaggttgtcgctcacgccacagttattggtgtctttgtctacctcggtctttggctcttcttctatttgctccctggttcctgttcttctcctctggatgtcctccaggtcttactcctgcttggtggttgtctggttgaatgctttctcaagaatcgtggtgtgattggcctttacgggtgtgtaatgctcgtatctgggccctttggagagagattggcgcttgtgtctcttattcgacttgtgcaagttagccttggtgtgtgcttcacgcttgtcacacttctttcgtccatgctacctggtggttttttgcatagactgtctacgaatttatcggggtgtaaagtgaggagcatggaatgcaacgctacctcgggattgagatttcggatctggatggttgtgcacccaaatctatcattgaactttctaagggactcgtcgtctacttgtagcagactagccaaggcagtcgaggtcatgcgggtgtcgaagttgtctatggacctaaatggaagtccaccataccaggtcaatgctgctcccttaagtgatgtagggaagacacgttggtgtagagggtatgtctgcctccataatgcggttgacaaaaggatgtcgatggatagttcatgttggacgcccctagctagtcatggtcagctttttgctttgtcaacccttcctcatggagtcgttccatctttggaatgcagttttggagttgttgtagaataccgagtgctaacaatggatgaatgtgagaggattgacgacaagctacaagtggagtcccgaacttcacacgtcggcatggagagccttgtagataattctcggcttgtagataatagtcgggagcttatagataatgctagagataagcatttgcttatagataaaaggtag

SEQ ID NO: 66939 - DNA, 197 bp, Glycine max
  Peptide Sequence Number=SeqID_158624
atggaggagcttaggctcaaaaggatgatggtctcgaaaggatgtgcaagtttatatagcttaccatgttgttctataatgtatcaatgggtttatgggtttagggagacattggagtatgagagcaaggttggcttggaggagcttatgctcaaaaggatgatggtctcggatgagagcctcgagctactctcttg

SEQ ID NO: 66940 - DNA, 436 bp, Glycine max
  Peptide Sequence Number=SeqID_158625
atgagactaaaccaacatgaagaaaatgaaaagaaaaagaaagcaattgcacttaaagcctcaccttttattcaagaagaaagtgacaaagaggacttgaatgaaataaaagaagatgatgatttcaatttcttagtaaagagattcaataagtttctaaggaacaaaggaaatcaaagaagaacaaacttcaatccaaagaaaagaggagaagattcatcttttgttccaaagtgttatgaatgtaatcaacctggacatctaagagttgattgccttagtttcaagagaagaatggaaaaatctgataggaaaaccttcaaagataagaaggaaaagaaagcttacatcacttgggaagataacgatatggattcatccaaagaatcagaaaatgaagttgtgaatctaagtctcatggctaaaaactatgaaa

SEQ ID NO: 66941 - DNA, 852 bp, Glycine max
  Peptide Sequence Number=SeqID_158626
atgaagaaagacataggtcacatcttagacctcactcccataggagataaaataaaagaaagcctcaagaggctaacattaacctcccatacttccatgagaaggacaatggtagagcaacaacttaaaaggaagtctacttcaaaatcttatggctctcacccttatccaaaggaagaccaaggtcaaggcatcttaggggtgacatcttctaagcccaaagatgataaggggaagacaatagaaaagcaaccccttaaggctagtatgcaagagaagactagctccatgaagtgctttaaatgtcttggaagaggacacattacttctcaatgctccaccaagaaaactatgattatgaggggccaagacatttatagtagccaagatgaggctactacttcaccttcctctagtgaaagtgaaaaagcaaaaggggaagaatctagtgaagagatctacccccaagaagaaggacaacctttaatggttaaggaggagtgtaaggaggtaagtgtctcctccaagaggttagctaagaaggaaatacattttgaaataaagacaaatattaaagaaatttcccctcttagacaacctccacattttctcttttgtaaaaagacacttgttagcattgccacacctcttaggcttgagtttattcctcaagtaaaggagttgttggatgagggtttggttgacaagagcttaaatccttgtgctttgttggtgcccaaaataggtgttgaggaaaaaagcccagagtttcaagaacctcgggatttgaggacaaatccttttcaagggggagggaatgatgcaatcctaccccgcaagggcattggatag

SEQ ID NO: 66942 - DNA, 867 bp, Glycine max
  Peptide Sequence Number=SeqID_158627
atggagaaggagaaagatgaatggagacaccacttcaaggaaaagatgagtcaagaagaagctcaccacaataggaggtcatggataagagcttggaggaaaaaggagatgaatgaaaggagaggaagagaagagcacgaaattttgtgctctaaaagagctctgaaatctgaagatacttcagagtctgaccctttcgttttggggatccaaacagaatggcaactgcaacaaatgattcgttatggtcatcgaaatgttgttgcagcagactctacgtttggcgcaaagagacttaaatatcccttgttcacactacttgtttttgattcaagacaacatgcacttcctgtggcatgggtcattacacgtagctttgcaaagcctgatgtgtctaagtggttgaaagctttaatcgatcaaactcgtagtgttgagcctggatggaaactcaatggatttttaattgatgacgctatagctgaaattgatcttttgagtgattctttccagagtgtgaaggaaaaatatagtgcttctacatcatggcatagagcacttcaaattctggactatgttgtttccttggatgataaagacctttttgccaaggttgtgagccaaaaagatagtagcttaacacatatagtgtggaatccaggatctaaatttgcattctgtgattgttcttggtcaataggttttgatggatctatggaaaaagccaatattggcactgttgttaacaatatgccgctgaaatgggtttctaagaaaggcagaacctacatcggcaaaccatcaagtttgcctcttcctcatggtagtagtaacacaaaaagtgttggtgtgcataagaagaactag

SEQ ID NO: 66943 - DNA, 522 bp, Glycine max
  Peptide Sequence Number=SeqID_158628
atggcgctgactttttccgggtctggagcttcgccggcagctgaaacaatgtatcccaggacattgaaaacttcctccaagtgggataggtgcagtgtgagggaagtgttgtacacaagaatatcgttgaagaacactgcgacaaacttgcgtaagaatggtttcagcaactcgttcatggaggcttggaaggtggcaggcatacttctgaaagtgtgggtacctatatggatggacgttgactgggttgatctgtggaaggaggtggatatgatgggcaatagtgcgtggtggtgggtggtgatttcgggagagggtagagcttcgaggggaagggatgaaggttcattgggttgggccggatcagataaccaggcaaggtggagcatggtggttatactctgtgtttgcgctagccttttgagttggtgggttgatgccatggttggaagtaacgacacatcaactcaaaggtgcacttgctggcccaaatatgagaacaccattgttctggttgtgtaa

SEQ ID NO: 66944 - DNA, 801 bp, Glycine max
  Peptide Sequence Number=SeqID_158629
atgggttgggagggtgtcatgtttaactctagggaatttcttcctgcacctcctaaagttagtgatgatgtggaagaagcccctcagcgtcgaaggccgacaacatctgctcgtagacaacggacagctgtagttgttgctgaggatgttgaccatgtcgatcatactgctgacgaggttcatgaggagcctcaggggccagttcctgatgatgtacgtgttgatacacagggttttctaagcaagcccaaagatacatcagtgttgacagattatgtttatcatgtgggagccagagtttgggaagaagagctgcccattactggcaccttccataccttcaatgctcttgatgtagaccaagtcgtggacttgttagttgagttgcttgaaatgttgtctgctgaattccttatggcgaccaccattcatttagagaatttgagttcatcttattattttttagacacatcagatgaggagaatggcgatagatggcttcaattttcagaataccttacaccggttggacaaatttgtagcgctcctagacaatgtgcacctagacatccacccatggttcatgataatgcatttgttgaaccacctcctgcagctgctaatgtagatatgtctcgacatgcaatggacgcttgccaacagataacaaaaagtttggaaaacatgatcaacatgagaatgattactattggaactgaagcatacactctgaccaagcactgcctgagattggccaggggtgtcactgagcaatggaatgtttatgttcagtcgagatga

SEQ ID NO: 66945 - DNA, 780 bp, Glycine max
  Peptide Sequence Number=SeqID_158630
atggccaaacttgctgcagctcaactccacttcgccgcgaccgtagcttccatggaatctaaactggatgcccttcttctaaaattgcctccgataactagccaccactacccatcttcttcctccatacagtcaccaccgctgcctccgcttctcaggatgactgcacctccatgccccgtgccgattcaacaatgccaatcacccatgccgactctgccgcctatgccactttcgctgtccatgtcgtctttgtcgtccatgtcgattgcgcctccatgctccacacccatgcaaccaagtctcgtaccatcaccgactccgcttcccatgccaactgcgcctccatgtcctgcactcgtgcaaccattccttccaccattgtcggctttacttcctatgcctgctcttcatctgcccaatctcgaccccgtttgcaccgccatttccttcaacaagctcatcaacactatttttctttatgaccatgcagttgttcctcatgacaaaccttggaaatataaagacatggtgatgtttgagatgggacatatgtcctataggactgccatggccgcatacaagctccaactagttgcctttgcactatgcacaactgctaaaccaggtgcaattcgccggaatagaccttgggatctcggaattgcagaaggaggaaataggcctgctaaggtccaagaggaaaacagattcgtggctgagctggcagagggtaggataatgatcttgttgtgtagtgctgttaggggacatgcataa

SEQ ID NO: 66946 - DNA, 255 bp, Glycine max
  Peptide Sequence Number=SeqID_158631
atggagggaacaggagtaggaactgcaacagggtgttacaagtgcggcaaacatgctgaaacaagagttcttagacaaccatggcatgatttgcactgcagaatagatggatctgctgcatatgatgttcttattaattttgagcagcgatggagaaaagcaactaagtggaaagagtttgcgatccttttcaaaaatatcctctcaatggcatggcgatgctttaataagaatagaacgcatctgaaaggataa

SEQ ID NO: 66947 - DNA, 444 bp, Glycine max
  Peptide Sequence Number=SeqID_158632
atgaatccatacagaagtaccataagtagcaacgaacccacgtacctcattgcgtacaacacccctctgaactcgttcaacttcaacggacttgctggaggaagtgattttgagggcaacagaatagtaggtgttgatgccaaaaatgccaaacttgatgacttggcaaacatcccaaagtttggagctctcatccatgtactcattgagccatttgtcaccaacggggagatggagtttctagacaaggagagtcaattgcatgttgaaaaggattgttgggagcaaggcatggccaagaagctgaactttagggtgacagggaaggagttcatggtgaggatgcagggggcgatggaagggaggaaggggaagctgaccatgatggtggagaaggggaagaatgtgatgatgtggtactttgtctattacgtcatcacttaa

SEQ ID NO: 66948 - DNA, 597 bp, Glycine max
  Peptide Sequence Number=SeqID_158633
atgccactcaaaggagttgggcatgtaaaagaaaaaacatcttcaagctttagtctttatattgcttatgttgctccctatatctctaacacctctctcaaagtacggtgtggtttgaggacgaaccaaatggaagttggtaggagtgtgttagaccctgatttcatccggttacaatgcaaggccaaggggtcgcgtagggttttgatggttgtttgtcagttccagaaacaaaagccacaaggaaatggcaaaatggtcacttgctacatttttctgaccctaaactcgcctaggctagcatctagctcgcctgggccaagaaaaagctttagccttaagcaagctactcaccaccaacgtttatttaaggaaaacgttagaaaaaccaaaaagagaacccccaacctctccccctacatggctatttatagaaaaagccatctagtgcagaggaagctcgcccaggcgagctggttacttaaagctgaaggtatcagctcgcttgggcaagtggcttgcttagggctgaagaaatttcatgggccaggcgagccagatgctagcctaggcgagtttaggtccagaaaattctag

SEQ ID NO: 66949 - DNA, 243 bp, Glycine max
  Peptide Sequence Number=SeqID_158634
atggagaggaaaatgataacaatgatagtggacacattaccagtgttctactttgagaagatgccaatatcactcattctcattacccaccaccctaccagccaagaacgcctaatcatccacaaaggccacccccaaattggccacaaaatccacccgatgcacatccaagaccaaacaccacctctaataccaataaaaacaccaactagggaaggagctttccagaaaacaagcctgtag

SEQ ID NO: 66950 - DNA, 339 bp, Glycine max
  Peptide Sequence Number=SeqID_158635
atgttagagcatcgatatacagaaacattatatcagaagtatggaaaagaatctcttaatcggattaaaggaactaaagggttccagatggaggagcattggaataaactgaatttcttcaatgatgacaaattcagggcagggatcgacccgaacagaggcttttcttcaggaaattggagccaagattttgctgcttcaaatacagattttaatattttaataaggaaaggaacaagaaaggaggtcaaggaggtcaatgttagaaactggttgaggttcagcttcatgtcaatgctgcatgttgttattgatgaacagaaagaatgcacaatttaa

SEQ ID NO: 66951 - DNA, 717 bp, Glycine max
  Peptide Sequence Number=SeqID_158636
atgcaaacgaaggattgtgctaggcaattacgagcagatcttcatgccacttctcttgaaggcaaaagaatgtgtgatttcttgagtcaaatcaagaacattgttgatgaactttctcatgttggaagtctagtggagcatgaagagtatgttgatgcaatactcaaaattttaccacatgactatgctctagtggattttgtgattgagagaaaatttatctctctttcaatcgttcaagtcaaggctctcttactcacacatgagtctcatatcaatcgatatcgcaaacattcattttctccctctgttaattacacttatggttatgttaaccctaattcctttgctttaattgatttcgatggctattgtggtggtcatagtggaggctatgctcacagaggtagaaaccatggtggtaatggagatcacggcggtgctagtggtggtcatcatggtggtggttctagtagaaactgtggctgtcattttgctaattttcaatgtcaaatatgcttaagtatggtcaattctattcaatctaacaccaaattcaataatacttgggtgaatcccaattccaaagctcattctcaaggtgttgcagctaatcaagctccactaagtgttatgttggctaattcttcttctcaaagaactgccaattcgacttggattcctaattctagtgcatcattccatgtcactggttaa

SEQ ID NO: 66952 - DNA, 239 bp, Glycine max
  Peptide Sequence Number=SeqID_158637
atgatgacaaaaagctcaaaagtcaagatcacttcatgataacaaagatgataacattcaagaatgagttcaagattgagtcaagaacacttcaaggatcaagagcaaatttgatttcaagaatcaagattcaagattcaagaatcaagaataatcaagatcaagattcaagactcaagattcaagactcaaaattcaagattcaagactcaaaattcaagaatcaagagaagacttaa

SEQ ID NO: 66953 - DNA, 882 bp, Glycine max
  Peptide Sequence Number=SeqID_158638
atggccaaggaacttcgcaagttcgtccagaacatcaacatgtcccgcaagtccttcaacaatggagaatatccccttgccagaaccctaaatttgccgcttgccgccacaaaaaatggagacactaagctcaagttcaaaaagaagcagaaaattggtccacataatgattttgaaccactggttgggattgagttacaaaaaggtacgttcaagaaacgcagagtggtggaggattctaccgcaggaagtgacaagcttttcaaaaagccccttttccataactctcaagaggagctaaggatagatcaaacaagaattacatcattgactgaaagcaatccaaagagaaataattatgtaacaccaaataatcaaaggattcaaaaatgcaaaccaacaagcagcagggcagcctccaaatggaacgattacttaactgaggacaatgaaaatttagagcttgcatggaagaaaagctttaacttggaggagcattcaggtccaaggaacaacatcttagaggccataactattgaaatttgctcctgctttggcattcctatccttgtctatatgtccaaggtggatgggaaattcaattttagcccaattagtgttaattcttttactgagattacgaatgttttctttgctattgttacgcttcttctccaggctgttactcactcagataaaaatatgatagaggtcttagatagtttttctgccactttgtcgggtctgcaaactcaaacctatgatgatgaagcttcaactgcaagttctggatttggttctgatgagaaaactatcaacgtagtttttaaacaaatgaagcctcaagttgatccttcaaagttagatgcaccaccacattag

SEQ ID NO: 66954 - DNA, 891 bp, Glycine max
  Peptide Sequence Number=SeqID_158639
atggttggtccctcaggtcctcgtgtcagcacaaaggagtgttgtgttgatccctcaaggaacgatcttgagacggcaaatcctccccgcctggttaccctaggaatagtttataagggatcaacaattcacaacattcctttgttgcctggccaagtgaaggttggtgttgaggaggttaaagatgcacaagctcccgttcttgtacccactgatgaggttaccttagtggggcagacacttaacaccttccttgcttggccgacacatctcgtgaagcctttatcagaacatggtaattatttaactatgtttgatcagcatgcagctgtttctccaacaaaacctccacaaaggccggatcctgcggtcgatgatccgctatatctgatgacattgactatcccagagcttttcttgaagcccttccaggttaactgggatgctaccatgttcggtgtgtttaatccacacttcccattgtacataaagcacgaagatctctctggaattgcacacagtggtcaatgtctgagcacatttgtcatacagttgtggattttgcatctgactgaaacaagtatgcgagcggggaattccgatgtgtatggattcctcaagccacagtctattcagagatctgggcaatcacaattttgctccgaaagttacatcaagagttggatgcagagttcaaaacgcgatgtataccttggagcctacttaaatggtgctttgaaaggacttgatgatactccacagcctaaatccaaggctgctgctaggtggattgtcgttaagtgtaatagacaaaaaggaagcactgagtgcggctattacgtcatgcactggatgtccaccatcatcttaggaagtttcaagaataactag

SEQ ID NO: 66955 - DNA, 351 bp, Glycine max
  Peptide Sequence Number=SeqID_158640
atgtctgatgtgattcttactaggagcagatcgcttgatacaggtcacaagatagacgaagatcagtggatgtatgaaagtataatgtctgaagaagtggatatggattatcaaaatgaagaagaatgtggtgtgaatgaaccacatgttgattgttcagatgcgttcaatacttctcaggtgtttgacggccgaaaggatgttttgcggtgggctcgatctgttgttcatgaaaatgaatttgtggcggtgattataaggtctaacacaaacactagtagtagaggaaggacttcatttgtgttaattggctgtgaaaggagtggcgagtataggtgtaagaagaaataa

SEQ ID NO: 66956 - DNA, 453 bp, Glycine max
  Peptide Sequence Number=SeqID_158641
atgtggcaatttggatacatccagagtattcctgctccgcctgttgattcatgggtgtcatttgatgagatagacgacatgtggatgcactactcagaccatcttgtgccagcaggtgagacgtgcattgtgccaggtcattgtgcacctgactacatcgactggttcttccacatttctcatccattcatgaccgcgacccagccatcaaatcctctgccaaatgcacctgctatgcagcccagacatgtccctcaggtcccaaagccagcagcaccatcgacatctgccaggtctgatgtggacaagcttagacatacagtggaggcttgcgattcaatttccgagaggttggagcgtcatctcaacctaggggtagtcacgctaggcacatcgacacatgaagtcattgaagaatgcctcgggattgccaggagtatcacagaagactag

SEQ ID NO: 66957 - DNA, 597 bp, Glycine max
  Peptide Sequence Number=SeqID_158642
atgaagaggtctccagcatcttcttgttcatcatctacttcctctgttgggtttgaagctcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtcgacaaggggcatatgatactgaagaatctgcagcccgtacctatgaccttgcagcccttaaatactggggaaaagatgcaaccctgaatttcccgatagaaacttataccaaggagctcgaggaaatggacaaggtttcaagagaagaatatttggcttctttgcggcgccaaagcagtggcttttctagaggcctgtctaagtaccgtggggttgctaggcatcatcataatggtcgctgggaagcacgaattggaagagtatgcggaaacaagtacctctacttggggacatatataactcaagcaaagaatgtcacatgggcatgtggcaatccgtag

SEQ ID NO: 66958 - DNA, 246 bp, Glycine max
  Peptide Sequence Number=SeqID_158643
atgggaaaacttactgtgaagataatgtctcattcttgcaagatggccgatatcactgatgaaggtgtgtcattggttgaagacatatacaagcaaaggaagccattacccaccatggatgttatatacttcatccagccagccagagagaaatcaatcgcagcggaatggagaaggaggaacggtgattggagacgctacttcaaggagaagatagtcaagaacaagctcactgttagtcgatga

SEQ ID NO: 66959 - DNA, 177 bp, Glycine max
  Peptide Sequence Number=SeqID_158644
atggatcaaacatggcaatgggacgggacgaggatgaatattgtctccccaatcttcaacctcccactctcaacatgtctccccacccgtaaccgcaaggttatcaaactcgagagtttatgcagactcgtgagagtttcatatactcaactcgtaactcaacttgtagacttgtaa

SEQ ID NO: 66960 - DNA, 240 bp, Glycine max
  Peptide Sequence Number=SeqID_158645
atgaaggtccaagtggagaaggacaaagcccccgagtggagaaggatgaaggcccaagtggagaaggatgaaggcccagaggcagagacactatcaagactattaattgttgctgaaggcccaagtaatccttgtggcgtctacccagacttatcttccttcatcggaagtggcgtcatccaaaacctccgtagtctgtatcaaacgatccgcccctgtctttcagactttgtgtcataa

SEQ ID NO: 66961 - DNA, 528 bp, Glycine max
  Peptide Sequence Number=SeqID_158646
cacgactactccttgaagttcaagaagcacacccaaaaggggaagctgctaaactacatggtggtgaagcagaggtactttgatatggaggttttttcggtgaacgatgaccacccctcacatgacatggcgatcgggcagatgttcgtgaaggaggagatagcggtgttgattacttacgacaagcatggtgggttttatgatcatgtggcgacgtcggtggaaggggtgcctaaccccgataggatcgttgggcctcacccttattactttcggtttgataggttacgggtgagggtgcccatgtttattatcttgccttggatcgacaagggtactgattggaaaaaagatgagaacatggctggggagtggaaccacacctctggtcaatggaatggagacgctaatgacaaaggtattcaaacaagagaggattacagattctatgctattttagctgaataccctgaattcaacaacaaggataagatactactcttccaattttctgtcaagcatgaatag

SEQ ID NO: 66962 - DNA, 1004 bp, Glycine max
  Peptide Sequence Number=SeqID_158647
tctagcattgaaagaaggaggatgtcaaaacgtcttgcagaagatgccaaggcttattttgatgagtgtgtctcgctatcaacttttgatagttctgacttttcatctccagaggatcccccactcaatttcgttggtcctcctactccatctggcagccctgaatccggcacacgaggacaatccatgaatatccattatgacatttcacaaccacctgctaacattgatactgtgggagattttcacggtcaagtcagttcaatcactgacagcacagaaactggtagcaaaccctgcttctcctttgcacagaaaccatctgaaacctctgcacttcaacaagacatccaacagtacataaaaaagttcgaaaaaaatgttttgaagtcttcaactatgagatcaaactattgtgaccctcgtgagtatagttttcaatcatcagcggagagcttgttgattgatagagtactgctaaaaagtagaattgagtctggtagtttgttactctgtggtggtggtggtgaaggtgaaggttctggtgttgagcgttgcggtggtcggtggcgacaaacgaggtacacagaaggtggtggatctatcgaggatgtacggatgacttacggatcaaatcaagttgatccgtatttcacttacggatcaacttcatccataagaatggacgaagatgagtggatgtatgaaataatgtctgaacaagcggatatggattatgaaaatgaagaagcatgtggtgcaaatgaaccacatgttgattgttttgatgcgttcaatacttctcaggtgtttgagtgtcgagagaatgttttacagtggactcgatccgttgctcatgaaaacagatttgtgacggttgtgaaaggagtggcgagtataggtgtaggaaaaaagaatttatcagaagagacactgagactaggaaatatgggtgtctcttcaagcttcgttgcaagccagtggttggaggagaaggctagatg

SEQ ID NO: 66963 - DNA, 1434 bp, Glycine max
  Peptide Sequence Number=SeqID_158648
atgtcttcatcaagcttccttagaaactcatcaccaaagtccttagaatcaaaggacatggtaaaggggctaccaggaggtgtgggaaatgaaacaggagtggttcggagtctgataactgctaaacttcatgatgataagaactaccaggtggcttctcttcagattccaagggcgagctttaacaaattggacataggctacatccttttcattttcaaggaattcttctttgcccttgtagcatttgaacttctgatagagtacatgcttctcaacggaaagctagtttctaaagtggcctggcacgagaattgggtcccaaatacgaagggcattctgttagggaggaagcatttgaatgattggttcgcctgcaccataggaatcaagagcttattgctcctcttcaagattaagtacttgacttccaatattaaccttgtttctccatactttgttgctggtttgccattccaagattcgatgacccctgaagcctgggtagaatctgacattcctattagggaagctaccttcttcttgcttataatgggagaggttggttgggtacaggttgaggtggaagtacgaaggagggtgaagattgatgggcaaaggttgagattagggatctttgatttttatggttttccttattggtggtcagatgatggttgcttcttggatttcttggataggtctaagggttttgggttagatgatagagtcaagagcttcatgaggattgacacacattacgagaaaggaacagatgaacgaggtacactaagggatggtccgaacaattcaaaggaacttgggggaatatggagtagtgataacctgactaagggcattgccatggaatgtcctatattggcatttgacatgtcttcccaattgccatccatatgttgtgtaagaccacaaaggtttggaaggcttagtggcagtgttaggttcaagaataaggactcattgcaaattaggatgtcgatgaagtactcactcccttatcaccattttcaggatttgatgtcaaacacaccatcaaattccctattgttcattgactccatcgagacacgatgggaacatgatgatatgcttcatgtagatcatttctatagagttattgagttgcattcatcaactgcagatgatgcaatgccctatattggattcgactcctcatctgaggatattgaggtcatttcccctattctgatgtctcccagattagagttgcatgagtctcaggtaccacctgaggtagattgggtagatctcatgttagaggactatagagaggatttggagaaggacacaccttttgaggaggatttgtcgatgaataaggaggattctgtcatgaagctagagtgtatggaggaggattcttcacaggattcctctaagaagtctttctag

SEQ ID NO: 66964 - DNA, 786 bp, Glycine max
  Peptide Sequence Number=SeqID_158649
atgcttttaagaaaaggttttcatcaagtcaaggtcaagtatggaagtaaccaccttgcaaaagttggggcagtagatggatcaagttacatcgctcctttgtctactgccaacacgaaagaatgcgttttacagtgcccttaccgaacacgtggcagagctagagtaatgagtggaatagaagaggtacaagaacagatgaaggtcgatatggaggccatgaaagaccaaataaccgccataacggaggccatgttgaccatgaagaaaataatggaaagcaatgcagctgcaattgccactaagagtgtcgccattgagggagactcgactcacccattgggccttaagcaaagcaagaattatttcccaccatgcagcttgcctcccaactatacaccacccaatattgcacatactcccaagaatgtcaataactctactcccatactcattgaaagccaacaacctcaatttgatcatgcacatgtctctcaacccatgggggagacacatgaagtaccccaccataatctagccgactttgagcctcacctcggatatgccactgaggggcaggcattttgtggcgtacccatgccaaacattttggggggctctcaataccacccacaaccagaacctttgccttttgtagtgggaagactccctcttgccatagaaagtcttactgggtatcaatacaattctgatatggctccagataggatgcagctacagagcatgtgtaagaaagagcatgaatatttcaaagaatatgcctag

SEQ ID NO: 66965 - DNA, 300 bp, Glycine max
  Peptide Sequence Number=SeqID_158650
atgtttgccaccactttcaacagtccaccatctgcatataatctagcaccatcgagttcttgttacccactcaaatacgtgacatgggtcacgaagataaggatgaggataacaacaataacaatgatgacaatgacgatgatgatggtgatgataattacacgtgagcatcctagaacaagaggaggtagaggccgtagaccaagaggacaacaaacacagacaaatccagtccaacaagatgagagatcgatacgcatatctagaagaactcgttgcgggacatcgtctcgttattag

SEQ ID NO: 66966 - DNA, 594 bp, Glycine max
  Peptide Sequence Number=SeqID_158651
atgacttctgctggacttgccttctccttttctggaaccccaactatcacgactgcaaaactaaactggaagaactatttgtcttggtctgcttcggttgagctgtggtttctcggccaaggacaccataaccacttggaaaaaggtattgatactgttccaagtgacagaaaatctgagtgggaaaagctggattatcagctatgcgctgtcttatggcaatcagtcgaggcagatgcccgagaaatcttttccaatgatattcagagtttgtttaatgcaactatgaaggtcacagccctcaaacaaatcagtcatggcatgattgcacacataggtaaagctcgggttacagtggaagagttgaagaagttccttgtggctgattcgctggaagaagtgactaaaaagctggataagttctatatggttcttatcttgaggagtctccattcagactttgatcatgtgcgtgatcaagttcttgttgaagatcaagtaccatcgatggattctctcatcactaggctgtttcgtgtgccccatgcgctgaaagaagaaaacccagctgatattataaatagactaatctaa

SEQ ID NO: 66967 - DNA, 288 bp, Glycine max
  Peptide Sequence Number=SeqID_158652
atgtccggtacctatgcagactgtttcagcttaatgaattgttccttacagagcctcaaaagtctaggatttatcattactatgtacttgtctttctctggtgcatgtgaacaacaaattactgagcatcagtccaagttcaaagatggagaagatatacctcctttagtgggatgctacatacttgtcgctctctctgccataattggttttagtgctcctcaaggttgtggaaagacaacccttgtctttgctgttgactatcttttcgaagtgattggcaggtaa

SEQ ID NO: 66968 - DNA, 867 bp, Glycine max
  Peptide Sequence Number=SeqID_158653
atgaggtcgtcgccaccaccattgtgtagatcagtggacaacgatgctggtggttgggtcaccagccggaaaggcaccgtagctctagcaacagctaccagaaaatgcagtagattcccggcagtcaaattagacaaagctgggataagtgctagtggtgctgcaaggacactaggggttgccccagcaatggcaaaggagcatctcttgtctgctgagagcaaagtcgttggtgcctcctctgttcgtgcctctgtctgcgtcgtgccatcagttcgtgcccccactgtagacatcgacttgtaccaccgtaagtccctttgtgacttccctcttgttctttcggttttggcgatgattatgtttagagccagaggattgagtcggactttaggcaaggttataggaagaaccttagggagagaagttgttgaacatgtggatcatgcaactgacgaggtccatgaacaacctaaagagggaactgttgatgatgcccagggtttttccagccaaactggaagctatgcatggagagctgttgcacttgtccatatgtatgagaaattgaatgatgcatccaagagaagaactagacaacttgcagaatatatcatcacactttacagtgttggatctataagcattttcctactattgcttcttttattgttgttgaagattatcatgagaggaaaccatgtgcttgttgttggaagtctgggaaggcattaccaatgtcgacgtatcaccattcctccagaccctgctactccatctctatgtatagaggatattgatgatagatggattcgattttctgaataccttgcactgatgggtttgatatgtgttgcacctggatag

SEQ ID NO: 66969 - DNA, 169 bp, Glycine max
  Peptide Sequence Number=SeqID_158654
atgtttctacatactgaccattgggatcttgaaaataataactttggtctcccactaagcgagaaaggcgcacaaagcgcaattccaaccgaggggaattgcgctaagcggcccaaagctgcactaagcccaattccaaccgagaggaagtgcgttgagcgcccagagg

SEQ ID NO: 66970 - DNA, 767 bp, Glycine max
  Peptide Sequence Number=SeqID_158655
atgaggtgtgttgtattgaagtatggtgttacgcgacaggaatgtgataactcattccccgtgtgctatttgtgtttggatcctgtgatgatctcggactttgtgttcatgagagcagatgggtacatcctttgtggtacaagtagagggtatatctacttgggtttgactgagaacaagagaggatacatctcttgtggatcagttctagtggatggtacatccactaggttcaaagagaacaagggagggtacatcccttatggatctttgcttaacttgaagcttggtatccatgaggattcacagaacaagggaaagattgttgaattgcttaggtaccactccaccaagagtggtgatgagatgacaagcctcaaggattacgtgactaggatgaaggaagatgaaagcaagaaggccgttgagaactctccattgttggagaagttgaagaagaagggatacgaggttctttatatggttgatgccattgatgaatatcactactacaaaagcaactttctacgtcggggattcgatgacggtagaaacacgtcatcatcttcgtcatttagatacaaagacggtcttgcgccaagacctgtcttcgtattgttggtggtttcacgtggagatcacagagcatcgtctccgacaaagagcatcgtctccattgcatcttcttccgtttgcagccaccgccgacaaaggccattagttgttggtggtggtctacatcgtcgtaaagctgtgtcccataaaag

SEQ ID NO: 66971 - DNA, 193 bp, Glycine max
  Peptide Sequence Number=SeqID_158656
atggaaccaactacgaaggagttgattaacaaaacacaactctctcccaaaacaatcccaatgtcatcacgtcgacttggtggctccacaaaagaatctcacttcacgtactctactgctgtcattttgctcccacgaacaatggttcgtgatcatcacaggtaccaaccatacggtacaaaaattgcgaggg

SEQ ID NO: 66972 - DNA, 144 bp, Glycine max
  Peptide Sequence Number=SeqID_158657
atggaaaagaagatgaagaacaaggacttaaaatcaatggcagcggaatggagaagggggaaaggtgattggagacatcacttcaaggagaagatgagtcaagaacaagctcaccaccataggaagccatggataagagcttga

SEQ ID NO: 66973 - DNA, 504 bp, Glycine max
  Peptide Sequence Number=SeqID_158658
atgaatgtgaaaaattctatgaattggaaagtagcaaggccttcgatgattatgcgggaaactactttgtgcttgcaacagtgtttccttctagcagctgtgtctccagcaaaacctccagaaagcccggatgaagaggtcgatgatcccctgtacctgatgacattgaccatcccacaactgtttttgaagccgctccaggttatgtgggatgctaccatattcggggtgtttaatcaaaacttcccgttgtatataaagcacgaagatctctctgaaattgcacatggtggtcaatgtctcagcatatcagttatacagttgtggattctccatctgactgagacaagtgtgcgagcggggaattctgatgtgtatggattcctcgagccacagtccattcagagatctggacactcacaatttgaatccgaaagttacatcaagagttggatacagagttcaaaacgagatgtttaccttggagcctatctgaataggtaa

SEQ ID NO: 66974 - DNA, 252 bp, Glycine max
  Peptide Sequence Number=SeqID_158659
atggtgagaagtctacatcggttttctgtcaaccgatgtagaattaagccattatgggcactttctacatcggttgttggggacgaccgcaataacgatatatgcaaataccaaaacatgtctcatgttacccaccatgaggtagcgaacttccttttcatacagctcactcagcctgtgtgtgttgaaaaactggaagtcatgcctgaaggaaacagaattacaaactcagtcaaaatagaactctattaa

SEQ ID NO: 66975 - DNA, 723 bp, Glycine max
  Peptide Sequence Number=SeqID_158660
atggttctacacgaaaaagccattggtgttaatgttgaagatgatgattcagccgttgacacttgtgttagtcctttctccacacaaatgccgcctaacatcaatggtggtgaagaagttaacaatgcacatggctacaccacccagctcccctcctcttccttatctcgagtcatcaacaccttcatggcttcaccgtctacgttgaagaagtcaagaaaagcaacacgactcagatcattagctaccaaacttgttggggtagagagaccagtggtttttgtggatcctgccattgggaaagtcgatggtccctatagaaagaaattaatgacgtatttggttatcttcgttggagataaggacatgaaaaagaaacgattggaggaagcatcccaatccaagagcactgacaaaattgttgatcctctatcttccattagacgacacttgaagtggaagatgactcacacgaaaaaatctgatcaaacgacatttgaggcaacaaaggaagttgtatataggattgagcaggcctcacagggaagctttgtcgcccatggatgtcaggatgtactaactattgccattgggcgaccagagcaccctggtcgtgtccgtgttgttgcagccgatggactcacactacctcctgagcctaaggttggtgcttctactgctcatgttagcacaaagggaagttgtgtcaatccctcagagtag

SEQ ID NO: 66976 - DNA, 333 bp, Glycine max
  Peptide Sequence Number=SeqID_158661
atgacgaaaattgttccaagttacatgctagctattggcagggctggtatgacttgggttgtcctttcactctgctggatgatagtggtacaggttggtgcccatgggggtgtcaatggagccaaatttgacatccttgaaggtttaactgcgaagaagaaggttatgttcaccgttgggaccagatggaggcaatttaagtcctccctaacgaccagatatgtatatgctgagaatgacgatgaacaaaacaaggatccatctgctaagtatggtattgatcgaaatacatgggaagaatttgcaaagactcgacagacccctacttggaag

SEQ ID NO: 66977 - DNA, 315 bp, Glycine max
  Peptide Sequence Number=SeqID_158662
atggggtgtaagcaagatattgtgaatgctatttgtgatgacgacgacatcaaagccatatcctttgttggttcaaattttgccgaaatgcacatatattcaagagcagcagctaaagggaaacgcgttcagttgctactggttttggtgttgttggacaaaggtgtatggctctcagcacagttgtttttgttggaggctcaaaaccatggcaaggcaggggttaacttctatacacagattaagacaataacacaacaatggaaggattcaattggtggtagcaagattaacttggcgacctctcaaaaataa

SEQ ID NO: 66978 - DNA, 501 bp, Glycine max
  Peptide Sequence Number=SeqID_158663
atggagagaaatatgatagatgctgccaatggtggagcccttggagacatgacccctgctgaagccggaaatttaattgagaagatggcttcaaactcccagcaatttagtgccagaagtgatgccattgtcattagaggagtgcatgaagtagccacgaattcatcttcatcagccgagactaagaagcttgaaggtaaactagatgccttggttaacctggtaacccaactggccgtgaataaaaaatctgcagttgtcgccagactctgtggtttatgctcctctgccgaccaccacatagacctttacccttctgtgcaacaatctgaagcaattgaacagcctgaagcttatgtcgcaaacatctacaatagacctcctcaacctcaacagcaaaatcagccacaacaaaacaattatgacctctccagcaacaaatacaatcccgggtggaagaatcatcccaaccttagatggtcgaattcttcacaacagtag

SEQ ID NO: 66979 - DNA, 159 bp, Glycine max
  Peptide Sequence Number=SeqID_158664
atgtctttgagtggcgcaaagaggagccgacggagagctcacgatagtacttgggggcatgtcactcagtttggaactcctttaaaactctggctgatcaccatgggggaagggaagttgcctatgcatgacaaggtgacctcgacatttgctgcctag

SEQ ID NO: 66980 - DNA, 261 bp, Glycine max
  Peptide Sequence Number=SeqID_158665
atgacacatcagactaggattcctgccttgatcacaacctataagaattgttggaatcttgatgatccaatagtaactttcagaggacccaagaaggccaggggtaagagatctgaggcccctgccacttcagcatcagaggcaccaacaccttcttcttctacggtacctccttcttcatccactcagattccagttattcctctagtacctctaaagatgcgacttccaactcctctctctgtaggtgtcatgccctaa

SEQ ID NO: 66981 - DNA, 393 bp, Glycine max
  Peptide Sequence Number=SeqID_158666
atggagatcattgatttgtgcgatttttgccagatcggtgaccttgaaggcaagatctatcattccttgttggggatccatgaaatccttcttcatggagaacaatgcacaaatagtaattcaaaaagaacaaagctttatgttattggagaatactcattgtcatctaatctagagacatcaattggggtttcaaaaagtgacacgcccacacaaatcccttgcccaataggacaaaaggcaatcaaaaggaagatgaaggggaaaagagatgtagcatcttcactgattgtcgacttgtttggcatggaatatgtaatcaggaaaaaaaaatattatcaacaaaagaatagcacaggcaaaggaaatagagaacataaaggtgttgtatga

SEQ ID NO: 66982 - DNA, 198 bp, Glycine max
  Peptide Sequence Number=SeqID_158667
atggatgtcgaggagctaccttcacccgtgaactccgatgttgtcaagcggagcagaatcgtcttaggcaatggtcaaatgtcaggccagatccaaaggcagagaccaatcaaggtaaacagtaacgtggccacagtttgccgcgcaatgtcatttcctgctttcaggtacttagggatggacgcaagtagaggctag

SEQ ID NO: 66983 - DNA, 846 bp, Glycine max
  Peptide Sequence Number=SeqID_158668
atgcataccaggccgagggttcatctgaacactgaggtccatccttggaggatcctgaggaaggatttgacaactttagcccaggtgtggagttttctctcatactccaacctggcccccacatctcacacatttgacctaacagtggacagagctaggctgatcttgaacataagagctctcatttctggccagatgacttctatagcccaatctaactcttctaaacttgggtttcctgctctgatcaccgccctatgtagagccagaggggttgtctctgacagcctcacttttgagcgcctgagcccgatcattaacttggcctacatcaggaagaactattggaatcctaatgatctgacagtttctatccgaggggctaggagggcgagggcgaggccagctaagcttccctccacatctacagctcctactccagcatccacttcagcagccccttcagtcccagctcagattgattctcagcactttgatgccatgcttcagagcattcatcagggacatatcattttacttcagaagagagtagcctggcctggggcccaaccttttcttcacagggaagatgaaggtcccacagcccaggtaccccagcatgtagaggatgcatcatctgaggccatcattctagagccattcattatagaggaggaggcaggtgagacacgggttagacaggaagctgctgctactcctgagaggtctcgagaggtcacatcaaatccacccacaccagtggtgaacctatcctcacctcagcatgcagtagacccctccactcccatactcgagatgccaaaggacccgacccaccaatcctaa

SEQ ID NO: 66984 - DNA, 285 bp, Glycine max
  Peptide Sequence Number=SeqID_158669
atggcacgtggagacaaatcacggtcatccgcaccctttccgctatccagagacgatcaagtccaatggcacgcgaagacaaatcatggtcatccgtaccctttctgctatcaagagatgatcaaagacaatcgaatccgatggcatgcgaagaccgtgatggtcactcgctttcgttgctatgagagtatcaaagtccccttatcatacagagacaagcatgtccgatgttacctatgctatccgaagactatcaagtctgatggcatccagagacaaacatag

SEQ ID NO: 66985 - DNA, 183 bp, Glycine max
  Peptide Sequence Number=SeqID_158670
atgaagaagattcaaggcctacaagttccacatggagctacatcagttaaggtgtctgatgaagaactagatgatgcaatcctccctaggaaaggaccagtcactagagccatgagcaagaggctccaagaggattgggctatagctgttgaagaaggccctagggttctcatgaacctcaag

SEQ ID NO: 66986 - DNA, 735 bp, Glycine max
  Peptide Sequence Number=SeqID_158671
atggtgaaggctctacaacatcggcactgtgaggtgtcggcaggtgctggaactgatggtggtggagcaaagggagctggtgctggagaaggagcaggagtagaggaagaaggtgctgaagagttagccaaattaatggtagggctaagggactcaaaggtgagagaatctgagatgactcctctggctttgcataatgctataatgagggctggaaagccaagcctcgaggagatggactgggccatctgtgagatctggcttgagatgatcgagcccgcgtccataggtgaggttggagtaggaaaggacactccatgtctgtgcaagagtgatgaggtccttcctgagcagcttccatggtgcgccttctgcattcaaaatgaatcccctccctggaatgcagagcctggcagccagctcctgggggtcataaagatttgcataaaactccttgaccaaggctacatctatgtgcccatccatcttcctggtcaaggatttatgccagcatcgcctctcgagctcccagtggaactcgtcatactctgtgacatagagaataacatttctctcctaaaggatgttatgggagtgaacattctgggaatacctctcccaggcagcctcagagatgaatctggtggtgtcataaggctcctggggccgggatacagtggacttcctcttcctggaggccatctgcataaaaaagagtcacatgaatcaagttag

SEQ ID NO: 66987 - DNA, 762 bp, Glycine max
  Peptide Sequence Number=SeqID_158672
atggaatacagtcaagatgtgaatccattaagcaaagccttgtatagatggaagggttggggaaaacattgtgtacaaagctataatgtctttgactttctgagggacgttgttagcagggttcctgactacggccatggccatggccatgctgaggctggtcctgatgatcgggtcattacaaaaagaaggaaagctattggtgatgatggtaatgacagcgatgaagaggctaagaggagcaagatgcttgagttgggccacactggcagtactggtaggggaagaggccgaggtagaggaagaggccgtggccgagggcgaccacctttaaatagagagacatatcatcaagatgctgaatctgagccttgcacttctgttcagccgagcaacccacaaaatacaaacacaagtatagcaatggataatggttctgagtcaaaggagataccaaaggaggagaatattgcagctcccgttgttcctgttgtaagcacggattccctccggaacattgatctgaatgccatcacgaatgaaaacgatgacaaaaaggctagtgcagaagctgatgcctccgcctcggtgcctgaacctgatgcctcattgcctgaacccccaacagagagcaagcatgaagaaattccggggtggtcactttctgatgtggacaagatggccattgattcactgcagcttgcacaacttggtaggccactagaagaggaggaggaagactatgatgaagaggaggggtaa

SEQ ID NO: 66988 - DNA, 471 bp, Glycine max
  Peptide Sequence Number=SeqID_158673
atggtgtttcatttgcctgtgggaaagcatagtgtggttgtagaggacgcaaaagttgttggtgcatcacggattattggcgtatatattgatagcaatagagaggaagcatttggacctgttgcacccagagaggaagctatcagaattactaatgacactaatgcaggtttgggttcatatgtatttacaaacaatatccaacgatcatggcgtgttgctgaggctcttgaatatggactagtgggtgttaatgaaacagtggctccatttggtggttttaaacagtctggcctcggaatagaaggctccaaatatgggatgaatgaatatttagagtctttggttaacgaaaaagatgaatttcatgaggaggaagaatctgataagagtaaggataagagaagaatactcaatgcgttgttgttcagcaatattgacaatcagtggtgcagagtttgtgaattctag

SEQ ID NO: 66989 - DNA, 387 bp, Glycine max
  Peptide Sequence Number=SeqID_158674
atggagttccaaattagaacaacaatagtacaaaatgatggggaaattaatgaagatatcacacaggaaaaaagctgggtgattaaattggaagaaggcataggagcagcattcattttttgcgtgacctgcagtggtcacatgttcgcaccccctgacctgccgacacaacccgcaaacgttaaagggaaggcaaagatagcggaagaacaaaatgacaaaatgatccccactccgaaagagaatattctagtgaaaggtcttccggagaaaaaggatggttatggcaagaaagaagtatcgctagaggaggcaggcgagttcctccgcattattcagcaaagcgagttcaaggtcattgagcagctcaacaaaaccccgacctga

SEQ ID NO: 66990 - DNA, 129 bp, Glycine max
  Peptide Sequence Number=SeqID_158675
atggcgagttcttctggagacaaacgtttaatgggtggagacgatgaaggcttttgtggtggggcagagagtgacaggggttggaaaggtcgcgggttagggctggaagaaaacggaggggggttgtaa

SEQ ID NO: 66991 - DNA, 210 bp, Glycine max
  Peptide Sequence Number=SeqID_158676
atgacgcaaaggggtcggcgccatcgaaatgtgggacctctagtttcaactggtgggagccgagggagggcgatgatgcacaaggtgaggccgaggaggaagttggggattgcgagtgggattcgagggataattggttcaaagtcagcttggcgagagcttcctcgaggtggtcctagtgagatttggagagtgtggaattggccatag

SEQ ID NO: 66992 - DNA, 324 bp, Glycine max
  Peptide Sequence Number=SeqID_158677
atgaagttatctacttacaaagaagaaattcgactaaggcagacttccttaagacatttggagagattcttcttcacctctcatatgaatcccttaattgaagaagaataccctggtctagcattggaagtatatgatccttcactagaaagggattatgttagaaggatcaagaaaatggctacaagttcagaacctactagaagtccttcatctccaaggagtgcttcacacccaagacatctcattgaagtctcctcagactcagactcttttggggacaagttcactactagaaaatatgcttttaacatcggttattaa

SEQ ID NO: 66993 - DNA, 183 bp, Glycine max
  Peptide Sequence Number=SeqID_158678
atggtcagatcattggctactagaccagtggtccatgttgatattgtcactgggaaagccgatggtccccacagaaagaaattaagaatatatttagggcttgtcactcgcgataaggtggatgttacaaatgataattgggaggatattcaggatgttcgaaagaaggcgcaagccatttag

SEQ ID NO: 66994 - DNA, 909 bp, Glycine max
  Peptide Sequence Number=SeqID_158679
atgacgtaccaacaaggacggtccacagaaaacgacgtagaatctttagattggaagttcaaggacggttattttgaaaacccgtctttgaattgttatatttttttctctctcttatcttatcttcttggatacactgctgacccttcattttccactaacccttcattttcctctctcattgttgccttgcatttccctttctctttgtcattttcactctctggcagaggacgacatgggtggatgtggaccacgagcttcactccaatgacctcaccacctcacgtgccaccccgagcctccaattctttgatgaagcgagacactggcgccggcggcggcgattcctcccctctcattcccgacaaccacctcgctgacgacgacgtgcacgatcgacactcgtccaaggaccgcgaccggcacatgtgcttcttcttcaccgacgaccctagggtttcacctcacaactccaggatctctcttgttttcacattacttcttcttcttgttggtttagtctcccttttcaccatcttgaataatctcgttagtcctcatctctttggctgcattttcagattcactactaaatcactaatgcattgcatccttcttcgcctttcgaatgcaccttacttgtgtaaaaaagatgggattgttcttcactacccgcatgttaaagaatcaccatcactttgggaaaatcctttctcttccacaacatcttggaagccatgtgctgagcgccaagatggtgttttaccagtttcctctaagtttgttatttgcaaatttgccgcacctctcagattggtaaagtcaggcttcaaagacggtgttgacatcacgaatgtcttagaaagtcaggcttctaagacggcgttgacatcacgaccatcttag

SEQ ID NO: 66995 - DNA, 132 bp, Glycine max
  Peptide Sequence Number=SeqID_158680
atggttataggaacaaggcaagtctctacagaggaaggggaagcaaagtctcgagagctaaatgttatgtttattgaagctaatgcaaaagctggctttaatataaagatatcaccacctacaccactctga

SEQ ID NO: 66996 - DNA, 471 bp, Glycine max
  Peptide Sequence Number=SeqID_158681
atgacatttttgggagaaacaagcagtcagaccattgtcaactgtagatttgcgtttatttttccaaatggatcaattattcacaacaaatctagtgtttatttccaaagttccactctgatacacattcgagtacttgatgattgtggttttgaaatactaaaaagcagaatgcagaatacccttcaactaaccaacaatcaatatttggatgaaatttactatcgacaaccattcacagattcaggaaaaaatccaaaaagatttgacattccttcgggatgtagcatcgacggactgaaggatgtgatcaagcaagttgcacctcaagggattcccccttatggtattcatgaatcacaaacgcctagagaaatttgtgtaatgctgcattctacctatggatggggagggtcgctgctttgcctaataatgacaatgtatattccacaacaacgccaatggtggtaa

SEQ ID NO: 66997 - DNA, 156 bp, Glycine max
  Peptide Sequence Number=SeqID_158682
atgaagcccttcttgggtttggagcaaacaccattgcctttaggatcagatgtttcaggtcttggaagcagttgtagtgtaccactatccaatgaagcaacatggaatttgaggaaatgtctgcataagctcttgcttcagttgcctggtcactag

SEQ ID NO: 66998 - DNA, 525 bp, Glycine max
  Peptide Sequence Number=SeqID_158683
atgtggctgatacggtattgtgtgaactcattgacaaggtcaggtagcacaatttggactatttcttgggtggccaatcaatctgcatctaggcgtgatggtggtagtgatgaggatcctgaagtagcaaagtttaaagagcaaggtctcaaatttttacctgagatggaattcctttttaaagattcaagacaatatgaagaattcaacacaagaacagaagagacaaatgataacattgattataacactgacatggaagtgaatgagcctgagatagacacgacaactcaaaacacgtcttcggcaaaggaaaatggacagaggaagagaggtgtatctgctcaagacccaactagcattactgcatgtgtagcaaagttgaaagatctaccaggacttgagcgtgggagtgaactattttacaaagccactaaacttatgaaaaaaagggcaaacaaaatcacctttgttgctttagaagagcctgagctacaacttggatggatcaagtctgaaacttaa

SEQ ID NO: 66999 - DNA, 330 bp, Glycine max
  Peptide Sequence Number=SeqID_158684
atgaggcaaatattgctccagggagctgaacacaagagggttgaactccaattgaaggtcctcatagcttttggacttgtgatctttctgagggtttatgcagagcctattggaacctcccacttgcacgtgtccattggaggagcctcaaagttgttgttctggggaaattcgtacccacttgccattctgtgggaccgtggacctcgtcggaaccaccaagagctaccgttgcttcaatgtggaagaacaatggaagaacgacatagaggtgctgtgtgcatgcgactagggttcaagaacaatggaagaacaacaaaggttaactga

SEQ ID NO: 67000 - DNA, 453 bp, Glycine max
  Peptide Sequence Number=SeqID_158685
atggaccctagaagaagcggtcttgtagctactcgagaaattctatctacgttgcaaagctatcagtcatcatctagtgatgctgctcaaattgttgtggttgatgttgtggcatcgcctcatagtggtgtgttggagactatcaccactgttgcctttgaggggatggttggttctgctcttgtagttactattgctgctctcctagctgtggtgggagagacatatacccaatgtgactttgatgctctgccaatggtagttgaactgaatgcttgcgttgcatcgctccctgtgagctacttgtggacgatccatagggctgggtcgtggaagagcttggctttggaagttccaggtggaaagtgtgaaaatcctatgatctctttgaaaaatggacctgatattgacgcttcggatgcttatcaagccatccgatactcctcgttctga

SEQ ID NO: 67001 - DNA, 402 bp, Glycine max
  Peptide Sequence Number=SeqID_158686
atggaagttgataggtgcatacacattggtttgttgtgtgttcaagaagatgcaaaagatagactaaccatgtccgatgtagttgaaatgctggcgagtgacacaatgacccttccaaaacccaagcagctaacattttcaattggaagaatggcctcagcggaatcttctatctcaaaaagctccaagaatgtttccattaatgatgtaactgtctctataaccttaacaagagcaaaaacattggtgttaagaaggttcgggatcctttcgatgcacacaatcggaaccagtggattgtcgtatgttgagagaggagcgcaattagattaccataagagcattttctatctaattaggaaagcatttgtgcgcttaattatttctccccctaatttataa

SEQ ID NO: 67002 - DNA, 504 bp, Glycine max
  misc_feature (483)..(483): n is a, c, g, or t
  Peptide Sequence Number=SeqID_158687
atggacattatagaagtgcccactttttaccaccaacaatgggcaccagaatatcctgagtttgtcaactttagatatgatggaacaatataccaaatcaggctaaggcagcatcgggcaaaagtctactttgcggaagggctgaaagaattcagaaaagatttatcaatttacgaatctgtgatcattaaattcttggcatgcagcagcaaatccttgtttgatctttatttcgttccctcactggaatgccagacttgcggaatgccagaagttatgtcaagacaacatatttggacacttgaaatcacacaatcaattcttggtgcaccaggaccattgaaactccccaattgtgcaataacacatgtaaatgcctgcggtcaacacatgaccattctcaggagatttggacctccattacagtgtaatgttgtggtggttgatggtggagttaggcgcagatatcttgtccaaccatgngtatcaattccttgcagataa

SEQ ID NO: 67003 - DNA, 345 bp, Glycine max
  Peptide Sequence Number=SeqID_158688
atggagggtgttgagagctatactaaggttttgagtgagacttctgaggaggaagatgatctcctgattagaagtacgaggaaggttaagcgtaaagataacaaggaggatgatcttgagatggttgaagagtttaagaataatggagaggtggaaaatagtccctataaacaaaagcttcttaacaatggagctgttgttccatcttctccttttgagggtagatattgtgccatgaaagggttggttgatggtgacaatgttgggaaaaaggcttggtttctggatgttggacaccaaattaatccaggtttgggtaacgaaaggctctatcaaaattattga

SEQ ID NO: 67004 - DNA, 312 bp, Glycine max
  Peptide Sequence Number=SeqID_158689
atgtctcctccacctctagaacctcacaatcactcactgactcatctcatgctctcaggatggcttcttcttcatgctcagttctatgccagtggccttgttggtgcttgtgcgcttagcgcaactctagaccgcttagtgcgcattagtgaatttcggcttagcgcgcgtcttctcgctcagtggatggactcaagtggtgcgctgagctggatgacacctcgctcagtgaacatgcacaactcatccttcttccagattcttcctcgcgctcagcggagggagtgttacgctcagcagatggctcactga

SEQ ID NO: 67005 - DNA, 336 bp, Glycine max
  Peptide Sequence Number=SeqID_158690
atgaggatagatgctctagaaatatctccttcgatgcatcgtgctaaagcaaaggctgaacaacatgttgattgttcggatgcgttcaatacttctcaaatgatgttttgtagtgggcttgatccgttgctcatgaaaatggatatgtggtgtataggtctaggaaaaaagattgttagaaaagatactgggagtaggaaatgtgggtgtcccttcaagctttgtgggaaactagtggttggagggcaaggaagtgatactgaaatgcaacatctaatgaagcttcttgaacgagatcaatatattcatttgcatagattaaaggatgaagatgtg

SEQ ID NO: 67006 - DNA, 482 bp, Glycine max
  Peptide Sequence Number=SeqID_158691
atggatgttgagttgcgtaccggcgttgggagcagagacagtgtagtatttgtggatgaagaacgtgtagtggtggatcccaccgtggaagttggtgtgcgatacggtgaagcacctgcctgcacttctctgcgaatagatggactcaatcccgagataaaacaactcaatacaaatggcgccggtaacccaactattctatttgctagggactcaaactccgagaggaaggctgaccacgaggacaactgcacgttacgatgcatccactggaaccatgccagtgctggtccctccattcagttggatcggagccatcgaatcgcggaacgtccagcttcatacggtgcagtggactgtgcgatggtgtctgtcctgccgactaagacgatggcatttgcggttgttgctgattcacttcgagttgcgacattcggtggaggagatcatcgatctttgagttcatggcgagttgtgaagct

SEQ ID NO: 67007 - DNA, 495 bp, Glycine max
  Peptide Sequence Number=SeqID_158692
atgttgtcataccctaatttcatccggggactatcgttcattgatcttttgatccttcctagtcgacttacggtgttgaaacaccatgttttgatcaagaatgcgaaagatgccaaaaaggggggcaaaagggttttttccttgagtttcctggaccctagctcgcccaggctagcctctggctcgcctaggccaccaaatgacttcagggtgaaggaactaactcgcctggccgagccaattacttcaggactaagccttagctcgcctgggcgagctgcaagtcccctaaaatggccctttgcctatataaataggcgtgctaggggggctgagaaggggtttcaaggtttagaaggtgagggaattgagagaagacagaaagaagaagaagaagaaagaagaggaaatgaggtcgaggcgctaccgaatcgcaaccacgatcattccttacttcatttcttgttccgtgttctttgtgcgaccgtcggttag

SEQ ID NO: 67008 - DNA, 746 bp, Glycine max
  Peptide Sequence Number=SeqID_158693
atggctgcccgtaaatgtcgagctgtgcccactcccggtgaggaatccacctgggattcgtctcgcttcacatcagagattgcatggcatcggagctccagaggcaccgatgagaccagggttcaaggacaggtggtcagatttgatgctgagactattaatgacttccttgacaccccgatcatcctggcagatggggaggagtacccagcttactcccagtacctccacactcctccagatcatgaagccatgcttgccagcttgtgtacactagggggcgacctgacgacactcgctcagacatggagtgtcctttcgtatttttatcttgctcctacttctcacacttctgatattaatgttgacagggcccggctcatatatggcttgggggttgtctctgataccctgatttttgagtcactcagtcctgtgatcaaccttgcttatattcggaagaactgctggaaccccacatacccctctatcacatttccaggggtccgccgtgcacgcactagagccccagcatcagcatcaaaggctcctcttcctcctcagccttcctctcagggcccaatccctccacttgcatccacttcagcacccctagacatgcatggacagatgctcaggtcgcatggccaggagtccatccctctactgataggggggagagccatctggagccggaagcacagtgtagaagcaaagcttaatggtgaatcaaaggtgattcaaag

SEQ ID NO: 67009 - DNA, 429 bp, Glycine max
  Peptide Sequence Number=SeqID_158694
atgtacaatcattatgagaaagaaagagctcctgattttgaaagtgtattggcagacttcatgacatatcaagctagctctaaagattatcaatgggaatcagaatggcaaccttgttatcacaatgaagtagaaggattgtctaatctggatgacctgttaatgcaattcaagggtacaatagattcaatgcaacaagcatttaaaagagctgagactcagattggtaagttggtggatgacatgactaaagttgtggtcagaagtgaagaagagtatgcagagattgaaaaacatcaagaaaacattcttcaagttaacacaatccatcatcaactgatcaccaaagaagttggcaaagagggtgttgacgatactatatgtgaaaagtatgacactagcaatgagaaatggactcagttttgttag

SEQ ID NO: 67010 - DNA, 300 bp, Glycine max
  Peptide Sequence Number=SeqID_158695
atggatactcaggatacaaccagatcgcggtggaccctagggatcaggagaagacagcctttacatgcccctttggcgtctttgcttacagaaggatgtcattcgggttatgtaacgcaccaaccacatttcagagaatcaaagaataagttcaagatgctcaagattaaatcaggaacacttcaaggttcaagaggaaatttgatttcaagaatcaagaatcaggattcaaggttcaagcttccaagaatcaagatcaagattcaagactcaagattcaagaatcaagagaagaattaa

SEQ ID NO: 67011 - DNA, 484 bp, Glycine max
  Peptide Sequence Number=SeqID_158696
atgtcatatcgaaattcccaacggtgataatgctcgaaaatgggtttcgcacctgttgtttaaatttcacgacgatccaacggttaatgagtccgagatcgtcatttttctgagacagttcagcgacgtgaacggaaaccaagttggattggatctaaacagagtcgtttcaaagcaagttagcgacttgggaggcattggagtggatctcaaaagtggtgactcgatgaacacgtggatcgagtacaacggaaatgccaatgggttgtgcatttcggtctcatactcaaacgttcgacgaaaagatccgattttgaaggtagatctcgatgtgggactacccaaggtagcacggaggttcacagtgttgagtggtgtatggctaaggaggcggcgaggtcgacgacggttacacggtggtcccatgattcgggcatgggtgaagggagggggaagcaagagaatgtggtggtatcgtggttag

SEQ ID NO: 67012 - DNA, 441 bp, Glycine max
  Peptide Sequence Number=SeqID_158697
atggcggtcattggaaaggccgcaggtgcagatcgacaagatcgagggcggccccgtggctgccaaacaggcccaacagtgggcgtgggtactgttcacccacaaagaaagctaggcacaaaatgtatttgtgcgagggacgtcgccatgaaaaaagagccaaacaaggggctagtgatggtcatcagaggcaaggaaggcccgggaaaggtgacggtggtcactggtggtcattggagaaaggatgctgagatggcttgcaaacagcaacaaagtcattcgtggaggtcccaagacatcaatttccaagaatcaaaaggaaaatacaaaagaaaatggaagaaagtgcaagaaaatgtgtgggactttatttctcttactgaacaccttgggtcattcatagaggtcccaagactctcccctcaacaacttctcaactga

SEQ ID NO: 67013 - DNA, 945 bp, Glycine max
  Peptide Sequence Number=SeqID_158698
atggtagtcacgacataccagacatcctatgactgttcggaaaaaacaattatagatatcttggttgcaggattttctggccaattaaaaggatgtgttgttaaaacggatctcaatggaaaagtctttacaaatgacgataatgaagagatccctgacgctattaacacctttatttttacaatagtccaacacttcattggcgacccgtcactttggaaagataggtcggcaaaattattattcaatcttaagtgtagaactttagcggactttaggtggtatagagacaccttcctgactagagtttacatgagagaagatagtgaacaacctttctggaaagaaaaatttctagtcagtcttcctagatcattaggagataagattaataatctgctcattgaaacctcagaggaagaaaccgaagatgtatcctctgaagaaaatcttaacctagttcaacaagatgatcaaccatggtctacgaatgatgaagatgaagatatccaagaaatcaacactcaaacaagagaccaagatcttttgtttgaggcaatcaattccataccaaaccttcaggaaaagaaggttttcctgaataaactgaaaaagtctttggaaaccaaacctaaaccaaaagatttcattaccaataaaaaatttgatgttagcaatattctcaaaagactggaaaacacttccgtcaaacctaccacaatccaagatctccaaacagaaatcaacaacctaaaacaagagagtatatcaagggcacttcaaattgtctgcttgactatcttacccgtgaattcttacagagaaattcccatgccacctaggacatctggtacctccctaaggggaaggaagaagtataggaaaaggattgaaactggctctaccagggccatctcccaaaaagagttcaccatcatcatctag

SEQ ID NO: 67014 - DNA, 153 bp, Glycine max
  Peptide Sequence Number=SeqID_158699
atggcgactctgcgcatctttcctcctttggaaagcacaccctttctaacgttgatgcattgcagagttcctaataaccctcaaccaaagattaaggaggtcaagaagaagatgaaaggaaaggtcaacacttcaagcatatttggaaactga

SEQ ID NO: 67015 - DNA, 178 bp, Glycine max
  Peptide Sequence Number=SeqID_158700
gctaacgacagtattgaaggttacgcattttgcccatgcaatggttgcaacaataggactcgaggggggtgagaaaggagaagggtggcttcaaaatcttcattatggtgtgtttggccttggaaacaggcagtataagcatttttacaaggtggcgaaggtaggtgtcgccgattga

SEQ ID NO: 67016 - DNA, 381 bp, Glycine max
  Peptide Sequence Number=SeqID_158701
atgctgctgaagggctcgctcagcgagccagattggctaagcaaggcttatccgcttagcaaggaagctagctcgctaagcgaacacaaaatcctagagaatgttaagccagagagtagtgcacttagcgcccgcttagcgcacaaccacttactctcgctcaacaagacatgctcgttgagcgtgccttcgtatgctgagaagcccaagaaccttcaaaacactgagaatagaggagatgaagggacagactacgtgagacagaaggaagatgacaccaagaatgcgtttgttgaggaatcaagaacaaaaactaagggagttaggctctttcatgtgaggaatcatggtctgagtaaattgacagagcaagaacattag

SEQ ID NO: 67017 - DNA, 120 bp, Glycine max
  Peptide Sequence Number=SeqID_158702
atggagaatggacaacaatatcttgaaatagaaagtgaaaaggcgattcaagcaatccttctaaaatttaggggaaaaaacaaaggcttaaccttgaactacctaaaagaacataggtag

SEQ ID NO: 67018 - DNA, 279 bp, Glycine max
  Peptide Sequence Number=SeqID_158703
atgcctgactcaaaatctacctttcaccctgctcttgctgtatccaacatcaagaatcatgtctcaatcattcttgagatggaaaatgtccaatacgcgacatgggatgaacttttcaaaattcacgcacgatcccataagaaggcgccaccaacggaggaggagacagaactctggttgacactagacgccaccgttctacaatggatttatgccatcatttctcatgatcttttacatactattcttgaacccgacatcactataatggaggcttag

SEQ ID NO: 67019 - DNA, 393 bp, Glycine max
  Peptide Sequence Number=SeqID_158704
atgttgattgggagagcctctggcagtgggggctccttggcgaggacttcctatgagatcagagccccgacgacgctaagggacacggtggtgaagggaccttggagggaggagaagcgtgaaaaaggtggtggcgcgaggggcagcaagtgttctgaagagaatggaaggtacctttctcatggcatcacatctgatattgattcacaacacaatcaaatatctcccactttcaccctcacttggaagaagagaaagaggctgagagagagtgaatcaactccctcagtgccgcgaccaagaagtcaaggtgtagaagcacgaccaatgtgctgcccaataagagagagagaaagtgagaataacagagagaagaggctaacagctatctga

SEQ ID NO: 67020 - DNA, 456 bp, Glycine max
  Peptide Sequence Number=SeqID_158705
atggaaaggccctattgtgattatcttgaaagacaaatgagaaaacaagtgtgtttggcaagaccggttttgtcggacacatcattaagtgaatgctttttgaagagtgatcaatttaaggaaattttgttgggttttgaactcacaagaattcctttcctggctgcattaaaaccccctattgaagctgaagcaatagaatcagctttacctgaagggtttaatgagagaataaagggaagaagggtggtacatggggattgggttcagcagctattgatcttgagtcacccatctgttggtttctttgtgattcattgtgggtctgggtcattaacagaggctaaggtaaatgagtgtcaattgataaaggttcagaaaacagtattcttatccttttgtgcgcctcccaagtgctttgcagcaagttgtcgcggcctagaaattgctggctaa

SEQ ID NO: 67021 - DNA, 472 bp, Glycine max
  Peptide Sequence Number=SeqID_158706
ggaaacatcccttagcatcgccatacctcttgagcttgaggttattcctcaagtaaaggagttgttggatgagggtttggttcgtaagagcttaaatccttgtgctttgttggtgcccaaaataagtattatgaggcaccaaatccctatgataggtggtatgatgaatgtgttgaatggtgcaaccctcttttgtaaaatcactcatgcacccaacatcttcatgatttgtgtacatagggactcattaggtagtgatcaagggcttcccatggaccctaagagaataaaggtcattcctgagtggcctactccgccaagtgttgaggaaaaaatccatgagtttcaagaacctatggatttgaggtcaaatcattttcaagggagagggaatgaggcaatactactccccaagggcattggattgaagactccaagaagattgggacatagatgcaagagaaggccctag

SEQ ID NO: 67022 - DNA, 267 bp, Glycine max
  Peptide Sequence Number=SeqID_158707
atggataagggcttgaaggtaggagaagatgaggggagggagaaggagagaaagagcatgaaattttgtgcctcaaatgagctatggttcagcccactaatccaagatcaagtccatgattcactactaagtgtgctcaggtgtcatgagacatgctcatacttagtccatgggcccaaaatctaccctaaggctcatgagaaccctaaggccttctcttgcatctttgacccaatcttcttggagtcttctatccaatgtccttag

SEQ ID NO: 67023 - DNA, 1533 bp, Glycine max
  Peptide Sequence Number=SeqID_158708
atgattcatccacacatgcatgaaacatgggatcactactcaaataccattacttccttgccattttcagctccaaccccatcaaacccttatccaaagccagcaacagaaaacaaccattgccttaacttggggcagaatgaactctgtgattggatggaagaacacattagtgacatcaccaaacactttgttgaagacttaccagaaacaaccacttctgataacttgctttctaataacccaacaggggttgtttcccatcacaaccttggtgttccctcactactttcacccaacttcacccaaagaaaaccctcatgttttagaccccagtttgagtccttcaccaacgatcccccaaacttcaatcttcacattcaaacaaacacctcaactttagatcaaaacaaacacaatgtttatgatcaagggttgaacctaataacccttttaatggagtgtgcagtggcaatctcagttgacaacctaggtgaggctcataggatgttactagagctaacacaaatggcctcaccatacaaagcatcatgtgctgaacgtgttgttgcttactttgcaaaagccatgactagcagggtgatgaattcatggcttggagtgtgttcccctttggttgatcacaaaagcataaactcagcattccaagtgttcaacaacatttcccctttcatcaaatttgctcacttcacttccaaccaagcaattctagaagcagtgagtcattgtgacagcattcacatcattgacttggacatcatgcaagggcttcaatggccggcttttttccacatcttagccacaagaatggagggtaaaccaaaagtcacaatgacaggtttgggagcctcaatggaactccttgttgaaacaggaaaacaactcacaaactttgcaagaaggcttggcttgtcactgaagtttcaccccattgcaacaaagtttggggaagtaattgatgtgtccatgcttcatgtgaagcctggtgaggcagtggcagtgcactggctgcagcattcactgtatgatgcaactggaccagattggaaaacactgagactccttgaggagttggagccaagaatcatcaccttggtggagcaagatgtaaaccatggagggtctttcttggaccgttttgttgcctccttgcactactactccaccctctttgattcccttggagcatacttacacaatgatgattcaaaccggcaccgtgtggagcatggccttctctccagggagatcaacaatgtgttggccataggaggacctaagaggagtggtgaagacaattttaggcagtggagaagtgagcttgctaggcactgttttgtgaagcaggttccattgagtgacaattcaatggctcaagcacaattgatattgaacatgttttcacctgcttatgggtatagccttgcgcaagttgagggaactttaaggcttggatggaaggatacaagcttgtacacagcttctgcatggacctgctgtaattctagctag

SEQ ID NO: 67024 - DNA, 1794 bp, Glycine max
  Peptide Sequence Number=SeqID_158709
atggtgaaatgtgattcttatgcagtgacaagaatggggagagggaaagcagatgggaaaccgagaaagcggttgttcacaacggtgttacttttagcgattgttggtgctttatttttcctgtattctaggaaaagtggttcatcttctattgagtatggtagcaaatctttaaaatttggaggagatgatagtgctataccaaagaccattccagtctgtgatgatcgtctctcggagctaattccatgtctagacagaaatttcatataccaaacaagattgaagcttgatctgacgttgatggagcactatgagcgacattgcccgatgcctgagaggcgctataattgtttgattccccctcctccagggtacaagattccaatcaagtggcccaaaagcatagatcaggtatggagggcaaatatacctcatacccatcttgcaactgagaaatctgaccagagatggatggttgtaaaaggtgaaaagatagtttttcctggtggaggaacccacttccattatggtgctgacaaatatattgcatcaattgccaatatgctcaactttccaaacaatgtcataaacaatgaaggaagacttcgcaatgtttttgatgttggctgtggtgttgcaagctttggaggatatcttctttcttccgatgtaatagcaatgtcattagcaccaaatgatgttcatgaaaaccaaatacagtttgctttagaaagaggaattccggcatatcttggtgtcttggggacgctaagactcccttaccctagtagatcttttgaacttgcccactgttctcgctgtagaattgattggcttcagagaaatggcatacttcttcttgagctagataggatactcaggccaggaggctactttgcctactcatctcctgaagcctatgctcaggatgaagaggatcggagaatatggaaagaaatgagtgctcttgtagggcggatgtgttggaaaatagcttctaagaggaaccagactgtcatatgggtcaagcctcttacaaatgactgttacttgaaaagagagcctgatactcaccctccactctgcagtcctagtgatgatcctgatgctgtttggggagttaaaatgaaagcttgtatcacacgctattctgatcagatgcacagagcaaaaggagctgatttggctccttggccagctcgattgactactccacctcctcgtctggctgactttaactattcaactgaaatgtttgaaaagaacatggaatattggcaacaagaagttgctaattactggaaaatgctagacaataaaattaagcctggcacaattcggaatgtgatggacatgaaagcaaatttgggttcatttgcagctgctttgaaggacaaagatgtttgggttatgaatgtggtgccagaaaatggaccaaacactctcaagatcatatatgacagagggctgttaggaacagttcacaactgccacatcgtcactgttgaagtattaccttcttgtgaccttggcttgttttggcatcaatgtgacagtccagaggatttattgattgagatggatagaatcctgaggccaaaaggtttcatcattgtctacgataagcgatcagtggtgttgtctataaagaagttcttgccagcattgcactgggttgcggtggccacatctaatttagagcaagattcaaaccaaggcaaagatgatgcagtgttgataattcagaagaagatgtggctgacaagtgagagcatccaggtttcagaataa

SEQ ID NO: 67025 - DNA, 2139 bp, Glycine max
  Peptide Sequence Number=SeqID_158710
atgaagtgcctacgctctgtggagtcgttgggaggagccgatgaagtgtttccttcatcatctggatctcttgcaagtgcaatcaaggacttttcagctagtgaaaattcttgcctggctgaacagttagataagaagccagacaccggcaacatagaagaagctgaatcatccttacgcgagagtggcgtcttgaactatgaggaagctagagctctgctaggaagatatgaatatcagaaaggaaatatagtagctgctttacatgtctttgagggaatagatataggtgttgtgactcctaagatcaaaattgccctttccagaagcagagaacgccgcaagagacattctcaaaaccatgctgaaccgcaaatgtctatacattctgttggcttactattggaagctgtcttcctgaaagcaaaatctttgcaggttcttgaaaggtttaaagaggctgcccaatcttgcaaagttattctggatatagtggagtcttcattgcctgaaggcatgcctgataactttggtgctgaatgtaaattgcaggagaccctcaataaggcagttgagctgcttccagaattatggaaacttgctgattgtccacgtgaagctattttgtcttatcgacgagcactccttcatcattggaatctcgatgcggagactatagcaaagattcagaaagaatttgctgtttttcttctatatagtggaggagaagcaacaccccctaatctccgttctcaaatggatggctcatttgtacctagaaacaacatagaagaggctatacttcttttaatgattttattaagaaaggtctctctaaatagaattgagtgggatccttcaattttagaccacctttcatttgctctgtctgtttcaggagatttgacagctttagccaatcaattggaagaattgcttcctgggaccatccatcgaagtgaaaggtactatgctctagctctttgttattatggaacaagtaaggacttggtagcactggatcttctcagaaagttgttgaggagtagagaggatcaacaccatgttcctggtttgttaatggcttctaagatttgttgtgagaactctactcttgcagaagaaggagtaagctttgcgtggcaagtgcttcagaacctggatggtagatgtaatcagctagaaaatcatgccaatttctttcttggtgtttcactttcagcacactcgaaattggccgtttctgattctgataggtttaagagacaatctgaggcacttcaagccctagaaactgctggaagaacgggaaacccctttgtactataccatctcagtttagaatatgcagaacaaaggaagctggatgctgcactttattatgcaaaatgctttctaaaactggaaggtggttctaatgttaaaggatggttattgttagcccggatattgtctgctctaaaacagtttttggatgctgaatctattatcaatactgctttggatcaaactggaaaatgggatcaaggtgatttgttgcgaacaaaagctaaacttcaaattgcacagggccagttaaggaatgcaattgagacatatacgcagttgcttgctgttcttcaaatccagagtaaaggttttggttctgggaagaagctatacaaggaaaacagagatcgtgctaggaacttggaagtggaaatatggcatgatattgcttatgtttatatcagtcttttacagtggcatgatgcagaggtgtgcctttcaaaatccaaagccatcaaaccactctctgcttctagatgtcatgcaataggcataatgtacgaagcaaagggccattacaaagaggctctaaaagcttttggtgatgccttggacgttgatcctggccatgtccctagcttaatctccactgctgtagttcttaaacgatgtagtaataaatcaaatccagcagttaaaagctttctggtggatgcgctacggcatgacagattcaatgcttctgcttggtataatcttggccttcttcacaaggctgagggtacagcatcatcattagttgaagctgcagaatgttttcaagcagcacactttcttgaagaatctgcacctgttgaacctttcagatga

SEQ ID NO: 67026 - DNA, 678 bp, Glycine max
  Peptide Sequence Number=SeqID_158711
atgtcaactgtgtcgaaagatgacaacttggtgctgtcttcggaggactcttcgtgcccagaagagtctgagcttgaattgggtcttggcttgagcctctcttctggcccttcatcaaagtctcatcaccaccatgttcatgctcctacaactctttatgctagaatttacactgctaaggattttccttcttccgcagcagcagcatcatcatcaccttcctcttcttcctcttcgtctcccaacatcactgccggcaccaagagagctgctgctgattctcttgttgccaataaccgtcccagtcaagtagttggatggcctccacttcgaacatatagagtgaatagcttcaatagccatgcaaaatcaactgaagtattcaactctgtggctgagaagagtaagataaataatactgtggtcaggaagactaatgacaatgacaatgataataacataaatgccaaagaaaaaagacacctcaggagttccctgttcgtcaaggtaaatatggacgggataccaattggaaggaaggttgatttgagtgcccatagttcctatgaaaccttagcacaaacattggaggatatgtttaatgaatcaactacagtcaccacttgcaaagagaatgcatctccttcagggaattctgacatgtttcatgatcactga

SEQ ID NO: 67027 - DNA, 510 bp, Glycine max
  Peptide Sequence Number=SeqID_158712
atggaaccggaagggcaaaagggtacggtgaacccgtcggcaatgttagcttctctgcttagtaggagagccaaacttcacgaagatcttcgcagcattgaaaagcaggcagaagatcttgcagctggacgagatgatggtagaccagattatggtcctggtcgttcaaaaggtggaggaatttatgctaatggacagggtaaaccaaagaaaggtagaggtggggcaagagatgccaagagagcaagggcttcaagtgaacaagattttgattatgaagatgatcctgacctgaccttgcacggcacgggtgacctgttgtattattgcaaggcagtcaggagatacggtaaatgttactttgcggctcggcacggtcatttgaacactgtagcattgctttttggtgttgcagctattgtagctgccatagtggtccctgcaataatatctatttgccatgctaccggtagccaaggtggagatcgaatgtatgaagatgaatgttag

SEQ ID NO: 67028 - DNA, 451 bp, Glycine max
  Peptide Sequence Number=SeqID_158713
atgaattcgtattccataagaccatggacctctacaacaaggttgacggcgacaaaggatgcatgcggcgtgaggaggaggtgctcgcgtgacgatgaaggaggagcgaaggtacctcacacaacgatctgtggtgacctcacgcgaaggaggttggcggtgacctcacgtgaccagagggagggcaatggccatgaaggaggtggcggtgctgtagtgcagcggaggtggtgtagcggagttggtgaggaggagtgtgggcacggtaagatgcagaccattgctaggcgcttagggcagcaatcgctgaggccatcgacgtcgctcaagtccatctatccaatttccgatcaccattatggaatggatcacgagcgttacgtttctacccctcgcaccaagggagttgggcacctcgttctaagggcactggtggacgatcctccgtcag

SEQ ID NO: 67029 - DNA, 852 bp, Glycine max
  Peptide Sequence Number=SeqID_158714
atggaggaaggaagaacacagaaaagcagtgaagtcgtggaagtgttgatcacctttttcctcctcaaactgctcatagtccctcttgcactcgtcagagccggatatctgttccaccagtgcagtgtcccaattgacaagggattcgtcgatgcggtactcgctggcgccggcgctggtgatggtgcgagtgaacttgatctcggtggagttggcgaggtggtagacgaggcggacgaaagctctgcggcctttctgctccttctcgcggtcgtcgaaggcgtagatgaggtccttgagctgcgcgccacggagctggccggtgcggacgccgaggacgaagctgatggcgtccatgaggttggacttgccggcgccgttggggccaaggatggcggtgaagtcgtagaagggaccgatcacttggaagcccttgtaggacttgaaattctccacctcgaggcagtggattttgcccggggagagaggtggatgcatcatatctggacttgtggtttaggttgcgtgcggaggttggtggatttggtttgggtggtgggtgcaaatctgggttcctgggggtgcggtggtggttggtggtgtgcgcagacaatggagcgcgattgtgtggttggaggtatatgcgtggagtttggatctttgcggaggttgatggtgcttgtttgggctgagtgtggatttgggtccacagaggttgtggtggtttctggtggtgcgcggtggtgcttgtttgggctttgcggaggttggcggtgtcgtggttgcggtatgatgctggcaatgtcatgggtggcggtactagtcatggttgtgggtggttttttagggtag

SEQ ID NO: 67030 - DNA, 423 bp, Glycine max
  Peptide Sequence Number=SeqID_158715
atgactcatcttaagatgcttcatattgttaactgttctctgctgttgtgtctgccaagtttgagcatagaaaatttgaaccacaatctggtaattactggtccttcattgctcacatcaaacacctatccattggagaaacaagagaagggcaccacctccttttccgaatgcagtcgccgatgcgtcatgacagagggcactacacacggaaccctccaccctcagcttctggacgttactaaggaaatcaaatacctgagagagaaagtcttcttatggagaaagtacaagtcttcctatggagaaaaaaaatcacttaagaattatacatatacttctctcatttcaccacttactatacccctttaccagttatttcagcatgcgaaaggatacaccggtgctggaagtgaaacttga

SEQ ID NO: 67031 - DNA, 3504 bp, Glycine max
  Peptide Sequence Number=SeqID_158716
atgccgtcgctactctccccgggcaaaatccactgcctcgaggtggagaatttcaagtcctacaagggcttccaagtgatcggtcccttctacgacttcaccgccatccttggccccaacggcgccggcaagtccaacctcatggacgccatcagcttcgtcctcggcgtccgcaccggccagctccgtggcgcgcagctcaaggacctcatctacgccttcgacgaccgcgagaaggagcagaaaggccgcagagctttcgtccgcctcgtctaccacctcgccaactccaccgagatcaagttcactcgcaccatcaccagcgccggcgccagcgagtaccgcatcgacgaatcccttgtcaattgggacacctacaacaacagacttaagtccctcggcattctcgtcaaagctcgcaatttcttggtctttcagggtgatgtggagtctattgcgtcgaagaatcccaaagagctcactgcactggtggaacagatatccggctctgacgagtgcaagagggactatgagcagtttgaggaggaaaaaggtgctgctgaggaaaaatcagcacttgtttatcagaaaaagaagactgtggttatggagagaaagcagaagaaagaacagaaggaagaagcagagaagcatctctgtctgcaacaagaactgaaatctatgaagggagaacatttcttgtggaagttgtttaatatacacaacgattatgctgaaacaattaaggatcttgaagatgaggaaaaaagtcgtgaaggtgttgttaaagaactagaatacttcgaaagtgaagctagtaaaaagaaaaaagaacaggccaaatatctgaaagagattgcactacgtgaaaagagaattgctgagaaaagcaacaagcttgacaagagtcaacctgagcttctgaagttaaaggaggaaatgactcgtatcacttcaaaaattaaaaaagggaagaaagagcttgataaaaaaaaggttgaacgaacgaagcatgatgctgatatagcattactacagaatgacatccaggatcttacagccaaaatggcagaccttcaggaaaagggacgagatgttgatgacgagcttgatttgcaaggcaatgacttggaagaatattttcgcatcaaagaggaagctgggatgaaaactgcaaagcttagagaggaaaaggagcttctagataggaaactaaatgctgatagtgaagctcaaaagaacttagaagaaaatcttcaacagttaagaaacagggagtctgaactgaattcacaggaagaacagatgcgagcaaggcttgaaaaaattcttgataattctgcaaaaaataaagttggccttgaaaacttgaaaaaagaactacgcgtgatgcaggacaaacatcgtgattccaagaaaaaatatgaaaatttgaagttaaaaattggtgaattagaaaatcaactacgtgaattgaaggctgatagatatgagaatgagagagatgttaggttgtctcaggctgttgagactctgaaacgcctgtttcaaggagttcatggtcgcatgactgatctttgtaggccaacacaaaagaagtataacctagctgttaccgttgctatgggtaaatttatggatgcagtcgtagttgataatgaaaagaccgggaaggaatgcatcaaggcaattctctttgctgttgggaatactcttgtttgtgatgatcttgaggaggccaaaattttaagctggagcggtgagaggtttaaagttgtaactgtggacggaattctgttgacaaaatccggcacaatgactgggggcactagtggtggaatggaagcaaggtcaaaacagtgggatgacaagaaaattgaaggacttaataaaaagaaagagcagtatgaatcagaattggaagagctaggatcaataagagatatgcaccttaaagagtctgaagcatctggaaaaattagtgggcttgagaagaaaattcaatatgctgagattgaaaagcgaagcattgaagataaactttcaaatttgagccaagaaaaaaagaccatcaaagaaagaattgaatgcatcagtccagaactgcagaagttaaatgatgctgttaacaagagcaatgcagatgtacgtaagcttgagaggaggataaatgaaattactgataggatatacagggacttcagcaagtcagttggggttgcaaacatccgtgagtatgaagaaaatcgactcaaggctgctcaaagtatagcagaggagaggctgaacctgagtagccaactttcaaaattaaaatatcagttggagtatgagcaaaatcgggatatgacttcacgaattcaagaattggaagcttctcttggcactttagagaaagatttaaaacgtgtacaggacagagaggctgcagcaaagttagcagctgagaatgctacagaagagattaatcagcttaaggaggaagctaaagagtggaaatcaaagtcagaagattgtgaaaaggaaatccaagagtggaaaaagaaagcttctgcagccacaacaaacatatccaaacttaatcgtctgatacactctaaggcacagattgatcagttgaatgtgcaaaagcaggagatattagaaaagtgtgaactagaacagattagcctcccagtcatactggatcctatggatactgatatctcagttccaggtccatcttttgattttcatcaactaaatagggcactgaaagataggagacactcagatagggataaaattgaggtagagtttaagcaaaaaatggatgccttgatatctgaaattgaaagaactgcaccaaatttgaaggcattagaccaatatgaagctctgctagaaaaagagagagttgtaactgaagagtttgaagctgtcaggaaagaggagagggaaaaaacacagagattcaatgaggttaagcagagaaggtaccacttgttcatggatgctttcacccatatatctggtaatatagataaaatttacaaacaacttacaaagagcaacacgcatccactgggtggaacagcatacctaaacttggaaaatgatgatgatccctttctacatggcatcaagtacactgctatgcccccaacaaagcgcttccgtgatatggagcagctatctggtggggaaaagacagttgctgcacttgcattgctattctccatccatagttataagccttcaccattctttatattggacgaagttgatgctgcattggacaacttgaatgttgccaaggttgctggctttattcgttcaaaatcttgtgaaggagcaaggactagtcaggatgctgatggtggaaatggttttcagagtatagtgatatcactgaaagacaccttttatgacaaagccgaagcattagttggggtttacagagactctgaaagaggctgttcgagaactctcacatttgatttgactaaataccgagagttctaa

SEQ ID NO: 67032 - DNA, 318 bp, Glycine max
  Peptide Sequence Number=SeqID_158717
atggcgtgcggtgacgaggttggtggtggttgtcgcgcatgcggacctggtgtggtagagagttgtagtggggtcacaattgcgcgtaaagaggaggtgaagggcacgatggtcgatggtggttgtggagttacacaaggacgtgttggggttggtggtgatcttgtcgttgttgccattgcggctgcagatgttttgcagtcgttggctttcttgatgatgtcgtggtggtggacaataatgatggtttgcggcaatgaagaacaaagaagaagaaagagaaaggaaggggaaagaactgggaggagggagttttga

SEQ ID NO: 67033 - DNA, 1356 bp, Glycine max
  Peptide Sequence Number=SeqID_158718
atggcgggaggtaaagcgaagaaggaaaaggggaagccccatcagcagcagaagcacatgccctaccaaggcggaatatcgttccacaaatcaaagggtcagcacattctcaagaaccccttgctcgtcgattccattgtggagaaggccggcgtcaagagcaccgacgtcatcctcgagatcggtcccgggaccggtaacttgacgaagaagcttctcgaagccggcaagaaggtcatcgccgtcgagatcgatccccggatggttctcgagctccagagacggttccagggtacccctcactccaatcgcctcacggttatccaaggtgatgtgttgaagactgaacttccttattttgacatttgtgttgcaaacattccctaccaaatatcttctcctctcacattcaagttactcaagcacgaacctgcttttagggctgcaatcataatgttccagagagaatttgccatgagactggttgctcagcccggtgataaactatattgtcgtctcacggtcaacactcaactacatgctcgagtcttccacctcctcaaagttggaagaaacaacttcaggccccctcccaaggtggattcctctgtggtgcgaattgagcccaggaaaccccgtattgaagttaagcaaaaggagtgggatgggtttttgcggatttgttttaacaggaagaacaaaacacttggttcgatatttaggcagaagagtgtgatctccttgcttgaaaaaaactataggactgtgcgggcactggaacttgggcaagaagattcactaaaggaagtggatgctaaaatggacttctctagttttggtgatgatcgaggtatggagatggatgatgatggagcagatgatgatgaaatggaagttgaggatggggaagcagatgaggtgcaatctgaattcaaggacaaggttttgggtgttctgaaagagggagattttgaagagaagaggaggcttgatgagtgggtgaagcttgaccagttggatcttaattctgtggaggctgttgttgatgagaaagtggaggagaagggtgcgacagggttgaagatgacacgccaccaaaagaggaagattgatgagacacatgtagagagaaatcaagacaacaagaccaaaggaaacagtttcttcctctactcctccagcaccaccataaatgacaaaggaaagagaaggactgaagaggatgaaatctacacaatagggaagggaatcaaagaagtagttgcttcggcttcggagggtgctacaattattgtaattgtggcattgggagcttacgtgacctacaagtttacctcagcttctagcagagcatga

SEQ ID NO: 67034 - DNA, 633 bp, Glycine max
  Peptide Sequence Number=SeqID_158719
atggctcacaaattttgttttgtggcacttgatcacagccttagagatatcatcaaacacaactcaagggacagtaaaatctttggaggtaaagtaatggtctttggtggatatttccggcagatcctgccagtcattccaagaggcagccgctctaatattgttaatgcaacaattaattcctcttatctatgggatcattgtcagatcttgaggctgacaaaaaacatgtgcttacaaaacaacatgcaagcaactgatcaagaagaaactgcggccttttcacaatggattatagataatggtgatggtgaacaaatggaatatatgagctctgatttagttgacaaatccgaaaccattgaaagttatcatttccgctcactcacaactgaatttcttaattcattgacaacatctggcttacccaatcattgtcagaaactcaaaattggaacacctataatgctcttaaggaacttagaccaaactcaagggttgtgtaatgatactaggttaattgccacaaggctagcaaaacatgttattgcaactgacataatttctgggacaaatatcggagatcatgtttatatcccacgaatgtctatgtcaccttcacagtcaccatga

SEQ ID NO: 67035 - DNA, 291 bp, Glycine max
  Peptide Sequence Number=SeqID_158720
atgtttttgttcaacacttgctttgtcaagaaaagtgtagaagcaaagcttcatgataaatcaagattgattcaaagatgttttgatgataacaaaggtgatgacaaaaagctcaaaggtcaatcaaagaatgagttcaagatgttcaagatagaatcaagaacacttcaagattcaagaggaaagttgatttcaagaatcaagaatcaagattcaaggatcaagcttccaagaatcaagatcaagatcaagattcaagactcaagattcaagaatcaagagaagacttaa

SEQ ID NO: 67036 - DNA, 297 bp, Glycine max
  Peptide Sequence Number=SeqID_158721
atgaagaaatgggatacaggccatcaaagtgtgtcattagagaataagacaagagattcaactgtgctgaagataggagattcggctaaagttgtgataaaacaagacatgaagggaagaaagcataaatatgggtttaacaacaataaacgtgagaagccagagaaggtaagggtggtggatgatgaaactagcgacaaacatgagttgtatgaagtcctaagggtgccctctaaaacaaaataccgatgcctcaatcagaaaaaaaatgtagttatcacttacttgctttggtga

SEQ ID NO: 67037 - DNA, 267 bp, Glycine max
  Peptide Sequence Number=SeqID_158722
atgagtcatctgaggccaccatcacagagccattttgatataggagaagaggcagaggagacacagcgatcccttgaggctactttagagccttctccaccagtggtaaacctaccctcacctcagcctgcagcagacccctcaactcctcttctacagatactagaggacccaactacaccagtcctagctgtggaaacttctcctccaactactccagtgcttcagttgacagatgaggaggatggtaagacacaggacacctag

SEQ ID NO: 67038 - DNA, 75 bp, Glycine max
  Peptide Sequence Number=SeqID_158723
atggatcatcgtcccacgtctagctccggacaagtgatggttggatgcctaatttaccctaggggctttgagtaa

SEQ ID NO: 67039 - DNA, 588 bp, Glycine max
  Peptide Sequence Number=SeqID_158724
atgaatcatctccttggtcttggaaaaccgtttgaagatgatgagctaaacatcaaaatccttaattgtcttacaagaacttgggaaccaaagattacaacaatcaaggaatccaaggacttaggtacaatgacaatggaagctctcatcgataaatgtcttgcatatgaacatgagctgattcaacaatctcatgcagaagaaactaaaaagaaagtaaaaggaattgcattcaaagtcaactcctcaaaggaagatggcaaggaaagttccaacagtggggaagaggcagagaatttcaacttgatggtaaagaagtttggagaagattacaaggaaagttctagcagtgcgaacgaggcagagaattccaacttaatggtaaagaagtttggaaaatttctcaacaaatccaaagacataaaattctctaaatcctccaagaagattgaaagcaacaacaccttcacatgcttcgaatgtgacaacgtgtctacatccttcgactcttctagtgatgaagaagttgcaaatgtatgcttaatggaaaagtcaatggatgactcaccaaccattgaagaaactgag

SEQ ID NO: 67040 - DNA, 639 bp, Glycine max
  Peptide Sequence Number=SeqID_158725
atgaccaaaaggcttcttgccggatcattggcattcgaatgccgcatcatgcactacatgattgtgtgcatcctacttcctagatcatccaaccttgcacaggcccatcttgttagatatcgcatgcataaggcattgcgatcaaatgctccacttccatatccccatctgatcaccttgtttctgcatcattttaatgtccctcttgactttgagccctttgttaaagtcaagagatctttctttatcggtgcaaatgtggtctcctcgtttggataccgcaaaaagaggggtggttcttgggtaaagaaggatcccgcacaggccctagaagaccgctctccatcaccacctcctcagagagatgattcttcatctcttatgcacaacattcttgatgcaatggatgctcgatttgcaggaatggatacacgcatcaccaagcttgaggaggatggggagattgtggaagcaaagctttctaagtttattttgatgatgccaaagagtcaagtcaagaatcaagagtcaaaaaagtttcaagaatcaaagagtcattcaatcaagaatcaagattcaagtgaagattcaagagaagactcaagatatgcaagaacttcaagaaaaacatcaagataa

SEQ ID NO: 67041 - DNA, 768 bp, Glycine max
  Peptide Sequence Number=SeqID_158726
atgcaaaccccaccattcttcatgcaagaaccaaaccaaacctaccatgactcaaacaagccattccaaggactaatacaattatctgacctaaacaacaacaatgccccttctggctccaactttttcaaccttccttttctatccaaccgtgccaacaagaacaacaactattctgaggaacaacaacaattcaacacggctgaagagtccaatttcttctcagaaagcaccatgaacattggcactgatcaccaagcaaactccaccaccactgccccttctctcttcagcactaattcccttcaaaacaccaacatttctcacatgtccgcaacagcactgcttcaaaaagctgctcaaatgggttcaacaagttcaagcaaccacaacatcatcaacaacaacaccaccaataacaaccctagtgcctcctctattcttagaagcttagcatcaaaatctgatcagaggcaactcggtggtggtgctggaaactatgcaacaatcttcaacaacagtgttcaggaaatgatggacatttcagggtttgaagcatatgatcatcatggtggcatgaacaaagaacaaaaactcggtgttggaggctctgataggctcacaagggactttctaggagttgcgcagcagcaacaacaacaacaacgagaagggtttaacttggtgagttctttggaatcagagacaaataataataatgctgcgccgtcaggtcaatctttcggaagtgatggcaactttcagtga

SEQ ID NO: 67042 - DNA, 712 bp, Glycine max
  Peptide Sequence Number=SeqID_158727
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcatcaggcacttcgagtcaagtatctggtccgactgatgaacctaatccaaatacttccaaccaagactggcaaaaagtaatggatgaaattaattcaagcattcttgacaaagactggcaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggagatacttaacagggaagtgagaggccgcggcaaagc

SEQ ID NO: 67043 - DNA, 207 bp, Glycine max
  Peptide Sequence Number=SeqID_158728
atgagaggggaagaaggagagtttcttactattgaagtagccttaaaactcaaaaagtgcataaggtcttttgagtcgtggaaattcaaggtctcacactctctaatgatttacagagggtttatgaatttctcacctccttctctttacgccccatactttactaaactcaccacccctttcatgactcaagcaacatccacttag

SEQ ID NO: 67044 - DNA, 237 bp, Glycine max
  Peptide Sequence Number=SeqID_158729
atggatttgctaacaaacagtgaagtaataaacatagttgcttcagcaccaaaaaggtccgtggcagccaaattgttagtaaaccatgctgctcgggcttggaaatataagtatggtttcaagatatggcaagagtatggtagaatgaaaaggaagaatgggatgctcttggagggttctccagagccaactttgaatcatagattgcaatcacctcagtacctcaaggagggttga

SEQ ID NO: 67045 - DNA, 298 bp, Glycine max
  misc_feature (205)..(205): n is a, c, g, or t
  Peptide Sequence Number=SeqID_158730
atgactagaggcaatccatctgacttacaaccctttgatcctgagatagataagatatttcatagattagttaggcatcattttataccttttgagcatcctgagcattcttttactggtgagtctgtgcattctgttattggtgattttgaacatcctgattttgagcattataattttgaacattttgagaaaatggaacaancttcaccccgtgagaggactctaatggaaatggctgcacctgatttcacctacgaaagcttatgcatccaataccctgatgaggatgtcccat

SEQ ID NO: 67046 - DNA, 598 bp, Glycine max
  Peptide Sequence Number=SeqID_158731
atggacaattcttttttggataatatagtgtcttctgatcataaccaattggctcaatcttctccacaggttcgacttgactcttcagaggtatcttctgatcctatctctgataatactaatgtagatgaaactgatcgtgaaattgtttctcttgatcctacccttgataatactaatttagatggaaccaatcatgaaattgatccttgtctgtgtgagatcaccagcaatccaaacaatgagtctactattgtccaatataatcttccaccctgctctaattgtggtcaacctccagctaaatatgaaccagacctccaagccaaagttaagaagctttggcaaatcctagatggaccgaagcaatggttgatgagatggcagcttcagacaaaaaacaacacttggaatcttgtgtccttaccaagagagaagaaaattgtgggctgcaaatggatatttacaattaaacgcaaaactgatgaaactattgagagattaccaagagacgttcgcatcgatagccaagctcaacactgtgagactacttttgtcactagcaacagaccaagattggtctcttctacaattttat

SEQ ID NO: 67047 - DNA, 483 bp, Glycine max
  Peptide Sequence Number=SeqID_158732
atgggtcaactccaacttcatgcctttcgcaagacatatggaaagatttgggatttggctatgatagaaatgtctgttgaatccattgcatccctcgctcaatattacgaccagccgctaaggtgcttcatgtttggagactttcagttagtaccaaccgtagaagaatttaaagggatcttgggatgcccgctaggaggaaggaagccgtatctgttttctgggttatacccctccatggcgagaatagccaaagtggtcaaagtcttgattcaagaattagaccgattcggagtcgtcctctttcctaatatggatgggctagtggatctagcgacgatcaacgctttccttgcttatcaccatagcaaggaaagtatggtcgttgctattttggctgatgcctatgacacctttgactggagatgcgagaagaacagcgcaaggattgtctgttgcacacccactctctatgtatggctg

SEQ ID NO: 67048 - DNA, 285 bp, Glycine max
  Peptide Sequence Number=SeqID_158733
ggggagattgtagaagcaaagcttcatggtgaatcaaaggtgattcaaaggtgttttgatgataacaatgaagatgagaaaggtgatgacaaaaagctcaaagatcaatcaaagaacaactcaagtgaatcaagaacaattcaagagttcaagaaaagaatcaagaagaattcaagactcaagaagaaagccaagaatcaagaatcaagatctcaagaatcaagatcaagattcaagactcaagattcaagaatgaagagaagactcaatcaagataagtattaa

SEQ ID NO: 67049 - DNA, 291 bp, Glycine max
  Peptide Sequence Number=SeqID_158734
atgaagaatgatgaagaacggttgaaaatcttcacgaaatcgcccacggaaaggtcccggaagcgttacggaagcgcctcggcttggattttcttcacgcaaacaatttttctcactaatttcaagggaaaagagggaggtccaagtgggcctgattgcgcaacaatgcttcctttcgacttccggcatgcgcgaaacttcacggattgcctaacgatgggtgttaaatacctcgaagcggtcaagcgaaggttgcatcccaccaaacaaatgctcccaggacgaaattag

SEQ ID NO: 67050 - DNA, 1296 bp, Glycine max
  Peptide Sequence Number=SeqID_158735
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcag

SEQ ID NO: 67051 - DNA, 288 bp, Glycine max
  Peptide Sequence Number=SeqID_158736
atggatgaacatcaagaaaaatggaaggaaatgactaacataatgatgaagattaacaaagaatcagatgaaatattcaacactattcatgttattgatcagtcttacgatgaaatgagtaggtcatttgctataagatggaaagataaaccagagcctacgtggcatctgctacattctagtggcaacatgcactctgtcacatataaccaagatttggtgagcccagttctacttgctggatggatgaaacttagagagttctatgggctcactggaaatcattag

SEQ ID NO: 67052 - DNA, 520 bp, Glycine max
  Peptide Sequence Number=SeqID_158737
atgacgaaagacaacgcgattgatacctcaaagccttacattgaggcaatgaggggcaccgtgcatgagcctcaagcgaacctaggggcagatcaaaaacgctccctcaatgagtcaatcccttgctttctcataaggttggaccccttcataggattgtacgtcctcgccttcggagggctacacgtcctcgtcttcaaaaggctgcacgccctcgcctccagagggctatacgtccttgccttcagagggctacacgtcctcgcctccagaggactgtacgtcctttgccttcagagggctacacgtcctcgccttcatagggcagtacatccttgccttcagagggctacacgtcctcacctccagagggctgtatgtcctcgccttcagagggctgcatgtcctcgccttcagagggttgcacgtcctcaccttcagagggctgcacgtcctcgcctccagaaggttgtacgtcctctgccttcagagggctacacgtcctcaccttcagagggct

SEQ ID NO: 67053 - DNA, 1206 bp, Glycine max
  Peptide Sequence Number=SeqID_158738
gcttggaccagatatactgacaatgtgttgggaaaacacatattagctgagaggaaagtggaaatttatcacacagagttggatgaattcaagggcgagctggagaggcgtaactttcacaagcgcctcaccaacttagctgatagtagcattgacctcgcgttggtgaaggagttctacgccaacctttacaatcctaaggggccttcacctaaacaagtcagaattcggggccacttaataaggattgatgcagacaacctcaatgcctttctagaaacacctgtggtgcttgctgagggtgaatctttccccgtctactcaagatactgtaggatgcctactgacactagagaaattgaggcagcactgtgcatacccgaccgaggtgttctatcctactgcaacctggcttcgacctctcacatatcagatctgactgtggatcaggctaggttaatctttggtctagttactcagctagacatgaatgtcagagccctcatttcagggcagattacttctatggcccagtctaactcctcaagacttggatttcctgctcttagcacagctttatgcaggaccagaggagttgcctccgacaatcttgtctttgaacgactaagcccattcattaatttggcatacataaggaagaattgttggaaccctgatgatccaacaattattattaggggggccagaagaccaagggcaaggccagttgagactccttctacatcagcagctcctcctccagctcgtattgcagcagctccttctaccccacctcctctggtagcacctcctgactccatccctatagtagaacaatttaatgaatgggtagcctggccatggactcaacctcctcttcacagggacgacgaggatcccgccgctcaggtaccacatcagccatcggatgagtcatcagagtcttccacccctgagcccttgatcaggaagaggagggaagctgcaaccactcctgaaaagtcccctgaggccactccaaagcctctgggaccaatggtagataccacttctccacagcaagcagtagatacttcaacgcctgaagttcaaaccaccccagtcctgtctccgaacacctctcttgtagctactcctgtattgcatttgactaacaaggaggaggttcagacatgggacacccaggaccaatcacaggatctttaa

SEQ ID NO: 67054 - DNA, 118 bp, Glycine max
  Peptide Sequence Number=SeqID_158739
attcgatgacaagtcctgtgaaggtactaattccgaggaccctgatgttgattttgaacgagtagcaaaccgagctgaggatgaagaagatgaagatatggggttcccccggagctag

SEQ ID NO: 67055 - DNA, 243 bp, Glycine max
  Peptide Sequence Number=SeqID_158740
atgggtgccaagtacctcgaagaggtcaaacgagggtcacatcccaacaatggatggtccccgaacgaaattaggacgcataatgaccataatttgtctctgtgtgttgttggacacgatcgagcctgggcagcaagacacagaatgaccataatttgtctctgtgtgccaccgaacacgatcgcctctgcatggcgaaaaggtgtgcggaatgaccataatttgtctctccccacctcttga

SEQ ID NO: 67056 - DNA, 437 bp, Glycine max
  misc_feature (22)..(22): n is a, c, g, or t
  Peptide Sequence Number=SeqID_158741
gcgaggactttgagtactctanaggcgaggactttgagccctctaaaggcgaggactttgagtcctttaaaggcgaggactttgagtcctctaatagcgaggactttgagccctctaaaggcgaggaatttgagtcccctaaggactttgagtcctctgatggcgagaactttgagtcctctaaaggcgaagactttgacccctctaaaggcgaggactctaagtcctctaaggagaggacttttagtcctctgatggtacaagtaccaaatgatggcgaggaccttgagccctctaaaggcgaagactttgagccctctaaaggcgaggactctgagtcctctaaggcgaggacttttagtcctctgatggtgaggactttgagccctctaaaggataaagacgaggactttgagtcctatgaaatgagccaatag

SEQ ID NO: 67057 - DNA, 540 bp, Glycine max
  Peptide Sequence Number=SeqID_158742
atggtggcacgggttatgctcaagaacggatttgagcccggaatgggtctaggcaaggacggcttcaggaatgccgacgtagtcgatattaagggaaatccgtacaaatatggattggggtatgaacccgggatgccggggaggaggaatgtgccatcaagacttcgggcggatagagtatggcccggccgtattagccagtgtttcacgagtgccggaatggtgtccgaggaagaggtagccgcagtaggagaggagttccctcaagacccaccaaatttcttgcaaccatgccatcccgattcccaagtggggaactggcacgtgataagtcagtcagaggtctataccgctgattcaatatatgagggtcgattcttcgatgatcctaacgacgacggtttgacgatcaatttcgaccgagatgtaagccaaatgatgaacgaagaagaggaagaggatgtcctttcaccagagttggagaggttgatcgctcaggaagaacgcgaaatgaagcctcgccaagaagaaaccgacctg

SEQ ID NO: 67058 - DNA, 258 bp, Glycine max
  Peptide Sequence Number=SeqID_158743
atgatagattccctactgttgcaacctacccttttgcgggcgagcgaggcgaggctcacgggtgcgtcttccaaaggaggaaaatgcgcggagttgccaccaatgtttatttggggaaaacattggaaaaaccgaaggaaactggtcatgaagaattttccagattcgggagttgtatttacgtttgaggaaggtcgacaaaagcggggctcttgctcctatgtaccctccatcgaagaggaaatcagacctacgtag

SEQ ID NO: 67059 - DNA, 1251 bp, Glycine max
  Peptide Sequence Number=SeqID_158744
atgtgggagcgtttctcgttttacggcattcgtccgttactgatcctgtttatggccgccaccgtctatgacggcgggatgggcctggcgcgtgaaaacgcctcggcgattgtcggcatctttgccggtaccatgtacctggctgcgctgccgggcggctggctggcggataactggctcggtcagcagagagccgtctggcgacgcgcgtcgcgacggcggtttctcgctgttctatatgggcatcaacatgggctcgttcatgccccgctgatttccggctggctgattaaaacccacggctggcactggggctttggtattggcggcatcgggatgctggtggcgctgattatcttccgcgtgtttgcggttccggcgatgaaacgctacgacagcgaagtcggtctggattccacctggaacagtccggtggtgaagcgtaatggcgtgggcatctggctgctggtgctggcggcaggtgtggcaacgctcgtgacgctgattgcgcagggcgtgattgtgattaacccggtcgcggtagccagcgtgctggtctacgtgattgcggcgtctgttgccctctactttatttatctgtttgtttttgctggcctgaaccgtaaagaacgcgccagactgctggtgtgctttattctgctggtctcagcggcgttcttctggtctgcgtttgagcagaagccaacctcgttcaacctgtttgccaacgactacactaaccgcatgatcggcgatttcgaaatcccggcggtgtggttccagtcaatcaacgcgctgttcatcatcctgctggcaccggtgttcagctgggcgtggccgaagctggcgagcatgaacattcgtccgagcagcatcaccaagtttgttatcggtattctgtgtgccgcagcgggctttggcctgatgatgctggcggcacagaacgtgctgagcagcggtggggcgggcgtatcgccgttctggctggtgggcagtatcctgatgctgacgctcggcgaattgtgtctgagcccgattggcctggcgaccatgacgttgctggcgccggagagaatgcgcggtcagatgatggggctgtggttctgtgccagcgcgctgggtaacctggcggcgggtctgattggcggccatgtgaaggccgaccagctggatatgctgccggatctctttgcacgctgctctgtcgcgctcctgatttgtgccgcggtactgatcgtcctcattgttccg

SEQ ID NO: 67060 - DNA, 1395 bp, Glycine max
  Peptide Sequence Number=SeqID_158745
atgtcttcttcttcttcttctcctgctgttctctcaaaatgcaccgttttccctcaccggaactccactctgggggacctcaagctctctatctccgaccttaacatgtttttatctcactacatccaaaaaggctgtctcttcaccactccttcacttccctctcactctcacactctcatccctcacctcaaaaacgcgctttcccaaaccctctctctcttccctcccctcgccggccgtctcaaaaccgacaccgacggcttcgtttacatcacatgcaacgacgccggcgtcgacttcatccacgccaccgccgccgatatctccgtcgcagacctcctctccccgtcgtcttcgtctgatgtccctccaatctccaagcaactcttccccttccaccacaaaatcagttacactgctcattcttcccctatcatggccttccaggtcaccgatctcgccgacgccgtcttccttggctgcgccgtctgccactccgtcaccgacggcgcctccttctggaacttcttcaacaccttcgccggaatctcaagaggagccaccatctctccctccagcctccccgatttccgccgcgagtccatcctcagctccaacgtcgtgctccgcctgccagaagatatcaaggtgacctttaatgtggaggaaccttttcgcgagagaatcttcagcttcagccgcgaatcaattcagaaactgaaagctactgtgaacaaaagcttgacattgtttcctccgccagagaacggtgacgcggttgagttgatggcgaagatgagcagcgacacgcaactgagaacggttacagagatttcgtcgtttcagtcgctgtgcgcgctggtgtggcgctgcgtgacgaaggcgcgaaatctcgaggggtcgaaaacgacgacgtttcgaatggcagttaatgttcgccaacgcttggagcccaagttgggggacagttacttcgggaacgcgattcagagcattgccacgtgcgcagaagctggtgatgtggcgtctaaggagcttcgctggtgcgcggagcagctgaacaaaagcgtgaaggccttcgatggtgctacggtgcgccgtaacttggagaattgggagcgcgagcctaagtgcttcgagttgggaaaccacgacggcgccaccgtgcagatgggaagctcgccgaggtttccgatgtacgacaatgattttggatgggggcggcccttagccgtgcgcagcggcggagcgaacaagtttgacggcaagatgtcggcgtttcccgggaggaatggcggcggcgccatcgatttggaggtggttttggcgccggaaaccatggcgcgactcgagtctgattctgagttcatgttttacgtgtctggttggtag

SEQ ID NO: 67061 - DNA, 1639 bp, Glycine max
  Peptide Sequence Number=SeqID_158746
caatggcttctttgccaacacttctctcgttcgccgtcatcttcttcaccgtcgccctcttatacctccgccgcgtgttccgccgccgtcagttccgcctcccgccggggagccacggcctgccgttgatcggcgagacgctgcagctgatatcggcgtacaagagcgacaatccggagcctttcatcgacgagcgcgtggagcggtacggttcgatcttcacgacgcacgtgttcggcgagccgacggtgttctcggcggacccggaggtgaaccggttcattctgcagaacgaagggaagctgttggattgcagttatcccggttcgatatcgaacctgctcggaaaacactctcttctgttgatgaaaggtgctctccacaagagaatgcactctctcacaatgagcttcgccaactcctccatcatcaaggatcatcttcttcaccacatcgaccgcctcatctgcctcaacctcgatgcctggtccgacactgtctttctcatggatcaggcaaaaaagcatgtgattgcgatgtacgtaatgggaatgggggtggtgactcagattccatggttcggtacaatgagtccaatttccttgcacatgagcctttacatctcgttaacttaaatgaaaagataacatttgagttaacggtgaagcagttgatgagctttgacccagatgaatggactgagaatctaaggaaagagtatgttcttgtgattgaaggattcttcactctcccttttcctctcttctccaccacataccgcagagccatcaaggcaagaacaaaggtggcagaggcactagcgttggtagtgaggcagaggagaaaagagtatggtgaaaacaaagagaaaaagagtgacatgcttggggcactgttggcctccggcgaccacctttccgacgaggaaatagtggattttttgttggctttgctcgtcgccggttacgaaaccacctctaccataatgactcttgcgatcaagttcctcactgagactcctctggccttggcacagctcaagttggggtttactgaaccggtgaaccgtatggatgtggctgcatggaaccccaccctgcaccctgtctatgtccatgaccatgaccaccacaactccaccgaagagcatgaccaaatcagagcaaagagtcacccaggggcaccactggaatggacggattacaagtcaatggcatttactcaatgtgttgtgaatgagaccttgagagtggcaaacataattggtgggatatttaggagagcaacgacagacatcaacataaaaggttacactattcctaagggatggaaagtctttgcatcatttcgtgctgtacatctgaatcctgaacattacaaagatgcccggtccttcaatccctggagatggcagagtaactcatcagaaacagcaaatcctgggaatgtttatacaccatttggaggagggccaaggttgtgccctggctatgagctagccagagttgtactgtctgtcttccttcaccgcattgttacccgcttcagttgggttcctgctgaggaagataagttggtgttttttccaactactaggacgcagaagaggtatcctattattgtgcagcgtagacattag

SEQ ID NO: 67062 - DNA, 732 bp, Glycine max
  Peptide Sequence Number=SeqID_158747
atgggtttttcctcaaaagaagagaagtccaaaagaatattgaggggcttgaagactctcttcttcttgatcactatggttatatcgcttcttcttttctccgccccggttctccttgttattgccgatgcacttgttccttctgctctgctctcctcgctttctcaatcttctttctccatggaaactctcgcttcccatttccacaactacgattttcgatactctctcattgatattccccttgtgtcaataatacgatccttcatcatcttctgtgtttatagtttgtgtgatggaccaaggctttcgcatggaccttatttggggatcacgaccatgtgctctgttttgtctctgatgtttgtgtcgttcaaagcagtttacatcttcagtgtttcgggtattgatcgaagtgggtatgttcgtgccaccgaaatagctctgttcgtgtgttcttgtgcgttggccgtggggcatgttgtggtggcctacagaacaagttgcagggaaagaagaaagcttttggtctacaaaattgatattgaagctcctaagatcacggccttcaatgttgtcatgatgccattccaattggcaccttgcaagttgaagatttcagcttgcaaaaatgggtatcctagagctacagctattcatcatattatgtccttgcgtgcgtcaagggatgctacggtttatccaaaggatgccagtaaccttgacacctaa

SEQ ID NO: 67063 - DNA, 2511 bp, Glycine max
  Peptide Sequence Number=SeqID_158748
atggaagatcaatacgtaaaacgaagcgtaactacaggatgttacaacgtagatgtgtcaaatcccaatgatatatggaaaagtgaaaacatcctgtttttctaccttcctaactttgcagcccaagttgcttttatgttgttgtccactcgtcttttgtactacatcctcagacccttgaaccaacctcgtcttgtatctgagattttgattggtattctgataagtcctgaactatttggaatatctgctttatctgaggttctgacccctataaagtcaatcctaactactgaaaccatatcatatgtgggactcgtttactctgtgttcctggctggcttggacatgaactttgacacaatcctaggagcaagaaagaaggccacaagcattgcaattgctggcattgtcatcccaatggtattgggtgctggcatatatgctttgactctaagcatgtacaagggacctgctgagtattgggcaaatttcaacaccactaatgcttatatgttttgggccttaattttaagtgtcacaggttttcctatggttagtcacatccttgctgatctcaagctcctctacacaggacttggcaaagtggcgttaacaacagctatggtcagtgacttctataattgggtcatgtttgcaatgttgattccattcgccatcaacggggcaagcgccatctactcggtgcttggaaccataggttttgcgcttttatgcttctttgttgtgcggccttatttggtacagataatagtgagcaaaaccaataaaaatgagtgggacaattatgggttgttctttgtgatcatgggatcttatgctagtgcacttgttactgatctcctagggacacaccctgtggttggggctctggtgtatggaataatgatacctcgtggtaaatttactcagatgctcatagagaagtcagaggattttgcagctgtttatctggctccattgttctttggtagcattggaataagactcagaatagtatatgttgtaaacactcaaggtttgggcctggtgcttttgattttgttcctctctttcatcccaaagattttaagcactgttatagcgactcaattttatggcatgtctgttcttgatggtgtctcaattggactgcttatgaacaccaagggcatcttaccagtattaatgctcgtcaacgcctgggacaagcagattttgagtgtggagtccttctcaattttgacagtagctgttgttatgatgacaatgatggtgcctctaatcatcaatgccatatacaagcctaggaagttatacaagcaaagtaaactaaagaccatacagaacttaaagggcgacatagagctgagaatactagcttgtgttcacaaccctcggcaagccacaggaatggtcaacattctcgatgcatgccacaccacaaaactctcccctctgcgcgtttttgcgcttcagcttattgaactaactggaaacaccatttcccttttggcttctcatctcaatcagcacaaccaacagcagagtggtagagcacaagccctcacaaaagcacaagaagacttggagagcatcaccaacattttccaagcatacacaggcacaaatgagaacaccagtgtggagacatttgctgcagcatcaacttactcaaccattcatgaggacatatacaacgtgtcgcaggagaagcaagcgaacttgattctccttcctttccacaaacagtcaaacatagagggcattctggagacaacaaacactgcattccaagacataaaccgaaatgtgatgagggatgcaccgtgttcagttggaatctttgtcgaccgtggactaggatcattgttcaaggtgaacttgcgcatgctcatgcttttcattggtggcccagatgaccgcgaggccttggcggtcgcgtggaggatgtcaaagcatcaaggggtgcaactatcagtgatgaggatccttatgtatggtgaggctgcagaagttgatgttttgtcgtcccatcttgagtctcgcggactgttagccatggtgctagacagtgaaaggcaaaaggaattggatgaagagtatgtgagtgcatttaggctcaaggcagtgagcaatgaagattctattaagtattcagagaaagaagctcgttgtcgtgatgatattcctcgagtgcttaaagagattgaagaaattgggtatgatttgtatattctaggacaagggacaggtaggaactcattgatcttgtcagagttgatgcaatgggctgattgccctgaacttggtgttataggggacatagtggcatcaaacagttttggttcaagctcttcagtgcttgttgtacagcaatatggttttgggggaatggtgtttgataatagtaatgctgccacacagcagcaacctagggaagtagtgcctgcagatgatgatgatgattctggggcacttgctatcaaggtagaacagcatcatcagtga

SEQ ID NO: 67064 - DNA, 447 bp, Glycine max
  Peptide Sequence Number=SeqID_158749
atgttgctatgcataacttgcaaactgattttgtctggtcatgagatcagcaataagtgtttgaagcacagaaatcttgctgcacctagaaacaagcacaagttcaaagtacatcatgatatgaatgctcccttgtcacattatttcatgtatacgggacacaattcctatctgactgggaatcaacttaccagtgagagcagtgacgagccaatcatagaggctttgaaacaaggcgtacgagtaattgaactagatttatggccatccaagtcttcaaataatgatggaattaaagtggttcatggaaggacttttaccactccagttccggtatccaaatgtctacaatccataaaggattatgcatttcataaatctgattatccagtaattctaactttggaagaccacctaacaccaaaacatcaggataactttgcaaaa

SEQ ID NO: 67065 - DNA, 228 bp, Glycine max
  Peptide Sequence Number=SeqID_158750
atgagcgagctgatgacgcgctgggcgcgtgcatgcatagcagattctcttccatattctcccaacccgctaagtgagctgagtgtctcgcttaacggatgttactcgctaagcgtatacatctcgcttagcgagacaccaactgctacaaccttcttcttcttcatccttaaacctgaaactgaagttgaaaacacattaattcaaaatgttgggaatatttactga

SEQ ID NO: 67066 - DNA, 1167 bp, Glycine max
  Peptide Sequence Number=SeqID_158751
atgggggtacctataggggcggacattgacaggtgtagcttggggaagaagatggatacggtggtctgtctctcgttggggtggaagtgtattgggtggttggaacaaaggttggctgggaggttggtgtcgtcggagacgatgaaattgggtagaagagatgaagttcagagtggtctccgtgtcccccttcaattccacaaaactgccggcgacgacgttagcttcggcaatgggcaatacgtgcaggtcaacagtgaacctcgtattctgaataaccaccgtgacgtcctcacagacacgcgtgcactccagttgttgaccattgccaaccatgacgcgcaagggagtggtatcacgagtgggaaggcccaactccgaaaccagttgaagctggatgaagttgtgggtactcccaccgtccaccagcaagatcacctgtcggtctccgatgaagcccatgaaacgcagcgtttcaggcgccacttgtcctgccaacgagttaaaactgatctgggccgggagaaatgccctagaggcgcagcgatgccctctgtggtatttctcgtcgcatgtgaagcaaagccctctctcccggggttgggtcgcgtgggtggtaataacagaggtggggtgggaatggcgcgtagagggatggtggaattggggttctgggaagggggaacaggggtgacggtggttggtaaaggtggggggtacatctggggtcaaaggctgatgggcctggacctcgcggcgaatatccggtgccaaccccgacacgaagtagctgagcaggaatggtggagggagaccgatgatgcggttcgccaactcctcaaattcggcgaggtactgggtcaccgtacccttttgggtgagcttgaacaggacacctatggggtcctcgtactgcgaaggcgcgaaccgagtctgaaccgcttgaagaaaggcaggccaagatgtaaattgaccattgccgttcatccattggaaccaagccaaggcgcagccgtccatgtagaacgcggcaatggtgaagaagaagaaatgggggtggaacaggtgtgggtagcgtgggagggagacgatgcaaaatctcattcaactggaatgttaccgtttgcaaagtctcacccatggacaattgctgggctgcgagcttga

SEQ ID NO: 67067 - DNA, 132 bp, Glycine max
  Peptide Sequence Number=SeqID_158752
atggatgatatcgaagttgatgaaagaagttttagttgcgcagtggacagtgatataaggagtgaggatataaaaaatggaggtgtaacaagcaaaaaggccagaaaaattgaagaaaagaagaaaatctga

SEQ ID NO: 67068 - DNA, 90 bp, Glycine max
  Peptide Sequence Number=SeqID_158753
atggaaaatgttgcggtgattttttctgcttcattggcagagttggtttacgtggagaagtgtgaagaagaagaaatattgggagggtaa

SEQ ID NO: 67069 - DNA, 414 bp, Glycine max
  Peptide Sequence Number=SeqID_158754
atggttgatctcaagcaagcaaaaggagggtcaaggagaacagtgaacgaccaggagctggacgatcgtaacaccactgtccccaaagtgcagacccgtgccggtcgtggtggtggggagatggtggcgggtgtggcggaggacgtcgacgctgatgatggacagagcaagagattgaggggcgacgacgtgaatgacgacgagaacaacaggtgcaagaaggagcctgatagagacagagcgagagaccgtgattgcgaacattcctctgcatgcttgagcatgcgtgacttcattacggagcttccatggaaagccgccatggcaagtgatgctgacttgggtgcaggactaggtggcatgattatgcgtgacttcattacggagcttccatgggaagctgccatggagtga

SEQ ID NO: 67070 - DNA, 555 bp, Glycine max
  Peptide Sequence Number=SeqID_158755
atgatgaagagaagggaaagggatattcatattatactacagggaatgaaggaaggaatggaattatttggtgtgtcgcggcttcaccacgaaacatgcaggacacctaatcaaaccgttggaattgcaagacgaacagctcctgaatccgccactcttctctccgaacactttgtggcttccatcgcactcgtcgcagaccacgaatctcagccctccgcacaaatcacacatcttcctcacctcgtcggcaccgccgatgtacacgccggcgacgaagacgctcggcagcggcacgctgcggcggacgaggatccgctgcagttcctcgcggaagcgctcgtcgacgctgacgtcgcgctcgtcgatcgcgacggcgaagccgcggaggatagatcggacggcgcggcagtcgtcgaaggtgcggcggacgacgcggaggctagtgtagtagacgacgacggcggtacggtcggagtccggaggcggttggacggcggaggaggcggcgcgggggctgctaaaggagcggatgagggagggagagacgattag

SEQ ID NO: 67071 - DNA, 963 bp, Glycine max
  Peptide Sequence Number=SeqID_158756
atggcaaggaaactgacgaaagcgcagaagaagatagcatacgatgcgaagctgtgcaagcttctggacaattacacccaaattcttgtggtggctgcggacaacgtcggatccaaccagcttcagaacattcgacacggtctacgtggcgactcggtgattctcatgggaaagaacaccatgatgaagcgcagtattaagatccacgcccagaacaccggcgacaccaccatcctcaaccttattccccttctagtcggtaacgtggggttgattttcaccaaaggtgacgtcaaggaggttaaggaagtggtttccaagtacaaggtggcagctcctgctcgtgtaggtttagttgcacctattgatgttattgttcccccaggcaacacagggctggatccctctcagacctctttctttcaggtgcttaacatccctaccaagattaataagggtactgtggaaattgtcacccctgtagaactcattatgaagggagacaaggttggctcttccgaagccgtattgctttccaagcttgcgataaggcctttctcatatgggcttgctgttgtttctgtttatgacaatggttcagtttttagccccgaggttcttgatctcactgaagatgacctcgttgtcaagtttgcagagggtgtctgtatggtgtcttcactttcattggctatctcgtacccatccattgcagctgctccacacatgtttgtcaattcctataagaacatcctggctgttgcagtggcaacagaatattcgttccccgaggcagacaaggttaaggagtacttgaaggatcctagtaaatttgctgtagcggttgttgccgcacctgctactaaatctggcgctgctccagcggctgcatccaaggtggaggaaaagaaggaagaagcagatgaatctgatgacgacatgggcttcagtttgtttgattaa

SEQ ID NO: 67072 - DNA, 837 bp, Glycine max
  Peptide Sequence Number=SeqID_158757
atgttacctcagaagcaagctgaagaagccatgatgtcaagcctcactcaaacgatggagcgggaggagggagaggaagtgataggggagacctcaaattttagctttaaaaatgctctctggcatggtggttctgcctacgatgcttggttcagctgtgcctcaaatcaggttgctcaggttctgttgactctgccttactcattctctcagctgggaatggtttcaggcatcatattccaagtgttctatggcttgcttgggagttatactgcttatttaattagcattctgtacattgagtacagaagccggaaagagaaagagaatgtcagcttcaaaaaccatgtcatccagtggtttgaagtgttggaaggcttactgggtccatactggaaagctattgggttggccttcaactgcacttttctcctctttggatctgtcatccagctcatagcttgtgcaagtaatatatactacataaatgaccacttggacaagaggacttggacctacatatttggagcttgctgtgccaccacagtgttcatcccatcattccacaactacaggatatggtccttccttggtcttggcatgaccacctacactgcttggtatttgaccattgcagccattgctcatggccaggttgaaaatgtgaagcattcggccccaaacaagatggttttgtatttcacaggcgccaccaacatactctacactttcggcgggcacgccgtcacagtgacaggcatcaaagataattggagaatttcactgcacggtccctttcctttcttcaattgcagctttatcctgcattcattctaa

SEQ ID NO: 67073 - DNA, 1665 bp, Glycine max
  Peptide Sequence Number=SeqID_158758
atggcgagtagcagcagcaacactccgaaggaaagcgtggttgacgatcggggaaggcgtcgaacctcttgtggctattgcagatcctctcgtgacaatagcatctctcatgatggaaccttggatgtaaaaaaagtcgatgtcacggaggacccaaccaaatcaggaaacttctccagtcctatgtcagaagaatccttagctgctggcagtgaaaacaaggatgaagttgaaaaatctttgcatttatcaaaccaaattgataatgtaatacacatcctcattgagaggggggaatttgcctctggtattcaattaccaaaagcttcagtgaaaagagtttcacagggaaaaaggaagttactagtcaatggatcagaagatctcttatatagtagcaatatagcctttcaaattgcagcatctataaaacgagcacaatcatgtgacaaggttgtcaatgattccaaaccatcaagagtttgtgaaaaggagaatgattcatctcctaaaattattgcagaaaagctagtagcttctttagatccaactgtgaaaaattctggtttgtctatcagggcttgcaatggacatatcaatttttatgcttctagtaagcaagtttccttgaacagaagtgttcaaaatgctccagttcctaaaaattctagaatgaagcattacagtggaggaaattgtttgattggtcaggtaaaaaggcgaaagcttgagatccgtttaaacagatccagttttgatccagaagaatttgctttgtacagaagatatcagctcaaagtacataatgataaaccacaaaatgtcacagagaactcatatcgcagttttttggttgatactccattaatacaagtttctcctactggtggtagcacagttcctccttgtggttttggctctttccatcaacaatatctaatagatggccagttagtggcagttggtgttatagatatccttcccaaatgtttgtcaagtaaatatttgttctgggatccagactttgcctatctatcactaggcaagtactcagcttttcaagaaataggttgggtgaaagaaaaccaggtttattgtcctagtctacaatactattatcttggctattatattcactcttgcaacaagatgagatacaaagctgcatatcacccttcagagcttttatgccctcttcgctatcagtgggttccatttgacattgcaaggcctctgcttgacagaaaaccttatgttgtcttatcagattcttccattttacaaaatggagagtcatccctacctcaaattactgacgatgtaatgggaagggattttgatgatgttggccaagaagatgcaaatgatgttccaatgcttgatgaagaagaaatggttgattctgaatctgaatgctctgatgatgaacctgacctagaaaccacttcagatgatgatccagaaattgttgatgtcagcaaggttttgctagggataaagggatctcatgtgaaatacaaggatctgtgggttgtctttgatcctgagcagcggagttacttggagtcacgattgcggagatacaggaaggttgtgggtccagcgctatccgagagaatgggtgctttattggttcttttcgtggctcttcgtgttgctcattag

SEQ ID NO: 67074 - DNA, 321 bp, Glycine max
  Peptide Sequence Number=SeqID_158759
ccctaagcaagtgaaggtgagaggacatttaatcaggattgatgctgacagcctgaattctttcttagagacactagtagtcttggaggagggtgagacactgcctacctattccaggttttcgaggatgaggattgatcctcaagagtttattgcccatctttgcatccctggtaagggttttgttcttaatacagagggccatccttggaagcttctaaggaaagatctcaccactcttgcacagacatggagtgtcctctcctacagtaacctgactcccacttcccacacctctaatcttaatatggagagagccag

SEQ ID NO: 67075 - DNA, 651 bp, Glycine max
  Peptide Sequence Number=SeqID_158760
atgagagagagaaacagagtgagagagagagtacgagagggagagagatacagagatagtgagagacagagattcagagagggagagagtgagagagttcatgataggtacagagcgagagtgtgggatagagacagggtgagagtgagagagggtagaccgagggagagagtgtacacgcagagagccgtagatgacaggaacaacttccatagaagggggccaaggagcaacacagggcgttcttggtgggctgatgaagactactcaccctcacgtattgcatacgtttaccaggaggaccagagtttcgatgctgacaatcatggtacctgggttgaagtaacgcgcaagaagaaaacgaaagaggtgaccaatagagatggaccgggtcgtagcagccatcaacagaagtggggaaaggtgtgggaagtatttattcccagaaccaagaataagttgggtcataggttcggctttgtgaggttcaaaggtgtgatggatgagcaaagactggagaggcagcttgataacaacattttcatcgacggggtgaaagtgttcgttaatagaccgaagttcgaaagggggaaggtggtaaacactcgtgaaaaagggacctctattcgtggtgagggggatattccacag

SEQ ID NO: 67076 - DNA, 318 bp, Glycine max
  Peptide Sequence Number=SeqID_158761
atgacagatccattgggtctacaccaagtgaagcatctcccaacagacctaacctcctcaacttccatgtcagctaatctagattcctccctgtacataaagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagagtgctatcaagggtcttgatgatgctccacagcctaaatcaaaggctcctgctaggtggattgtcgtcaag

SEQ ID NO: 67077 - DNA, 229 bp, Glycine max
  Peptide Sequence Number=SeqID_158762
atggacaaaactggggaatcagtgagagtaacaacttcttcaaatgaagaatcagaaagattagcaactcctccaactggggaattaggaggatcagctacttttctagctggtgaatcagggggagcagtagtttcttcagatggtgaatcggagatgataatcagaggtagagatgggggaactatttcaagctcaggagaaggaggtagattcaccactggagatt

SEQ ID NO: 67078 - DNA, 819 bp, Glycine max
  Peptide Sequence Number=SeqID_158763
atggctatgtcactgcaggtttcacgtcacgatttcgatcaatggatgatgccggtttatgcccctgcggcttttgtgccggtgcgtgccgaaggttctacgctgtgggatcagcagggcaaagagtacattgattttgccggtggcatcgcggtgaacgcgcttggccatgcccatcccgcgctgcagcaggcactgactgagcaggccggtaaactgtggcacaccggcaacggctacaccaacgaaccaattctgcgcctggcgaagcagctgattgatgccacctttgccgaccgcgtgttcttctgtaactccggggcggaagccaacgaggctgcgctgaagctggcgcgtaaagtggcgcacgaccgtttcggtgccgaaaaaaacggtatcgtcgccttcaccaatgccttccacggccgcaccctgttcaccgtttcagccggcggacagcccgcctattcgcgcgatttcgccccgttaccgccagccattcagcatgccacctttaacgatctggcctcggcggcggccttaattaatgaccagacctgcgcggtcatcgtcgagccgattcagggcgagggcggtgtattaccggccgatccggcgttcctgcgcggactgcgcgaactgtgcgaccgccatcaggcgctgctgatttttgatgaagtgcagagcggcgtcggccgtaccggctcgctgtatgcctatatgcattacggcgtcacgcctgatgtgctgagcaccgccaaggcgctgggcggcggtttccccatcggtgcgatgctgacgcgtgaagatctggcgcag

SEQ ID NO: 67079 - DNA, 643 bp, Glycine max
  Peptide Sequence Number=SeqID_158764
atggcacactgtgctttgggcagcgtcggcggttttgcgttacagctcaatcagcggataaacgccggacagcagcggtcggcagagaattttgtagccgtcatggtcgaagccgtgacgcgcacgctgcagctgacgcgcttcctgctcactgctgaccgatcccagccagaaccagtgatcgatgacgtgaatctgcgtcatctccgtcccgcgctccaccatacccaccgggccctgccacggccagcataccacgcgcagctgctccagccctgccagcaggcgctgctgatgcgccgccagcgccgcgccccggttgcaggcgctctaatcccagcaggccgtgacacaggcgcagctcatcggcgaaggctttttagcttctctaacgcggcaaagcggctgcggaataatccgtacaggtcaggcgaagaggagaaatcgagatcgcgcgcgtacaccacctgcggtgcgccgtcgcccagctgcagcgagcacagctggcgggatccagctgacgcgtcgcgcctggcgcagcatgctggcttcatctgccgtgcgaaagtgcgccatcacccggctgcgcaggttgatactcttaccgatgtacagcggcaggttgtcgttatcaccgtggaaa

SEQ ID NO: 67080 - DNA, 516 bp, Glycine max
  Peptide Sequence Number=SeqID_158765
atggatggcttactgattcattctgaaccgctatgggatcgcgccgagctggaggtgtttgccagcctgaatgtggatattagccgccgccacgagctgccggatacgctcggcctgcgcatcgatcaaaccgtgacgcatgtggcgctgcagctgtgtcagcaacagggcctggcgattgcgctggcctcggcgtctccgctggcgatgctggaacgcgtgctggagatgttcaatctgcgtcactactttagcgccctcgcttcggctgaagcgctgccttacagcaaaccgcatccgcaggtgtatctggatgctgcggcaaagctgggggttgatccgctcaactgcgtggcgctggaagactcgttcaacggcatgatcgccagcaaagccgcgcgcatgcgttccattgtggtgcctgccgccgaacatcgccacgatgcgcgctgggcactggccaatgtgcaactggaaaacctgacgcagctgcaggcggaacatctgtttaactga

SEQ ID NO: 67081 - DNA, 150 bp, Glycine max
  Peptide Sequence Number=SeqID_158766
atggaggtaaacatgggaacaaatcaaactagcaaaaggttttatcaagtcaagattaaaggcctagatatcaccagtattaaggagttggggcggttgatgggacctctccaaatgcaagccttccgcaagcgtacggaaagatcttag

SEQ ID NO: 67082 - DNA, 714 bp, Glycine max
  Peptide Sequence Number=SeqID_158767
atggtagccataaccccagccaaggttcatcaacctccatttctccgaggatacgactcgaacgcaatgtgtgcttatcatggaggagccccggggcattccactgagcattgtagggccttaaagcataaggtgcaagatgtaggaaatctatacacgtcctcgccatcagagggttccacgccctcgccttcagagaactacacgtcctcaccttcagaagactacacgacctcgccatcagagggttgcaggccctcgcctttcagagagctacacgtcctcacctttagagggctacacgcccttgccatcagaggactacacgtcctcgccaacagcgggctacacgccctcaccttcagaggactacacgtcctcacctttagaggactacacgtcctcgccatcagagggtggagcgccctcgccataagaggactacacttcctcagctttagagggttacacaccctcgccttcagaggactacacgtcctcgcattcagagggctgcatgccctcgccttcagagggacacatgtccttgctttcagagggctgcatgcccttgccttcagaggactacacatcctcacctttagaggactacacgtgctcacctttcagaggactacacgtcctcgccttcagagggctacacgcccatgccttcagagggactacatgtcctcgcctttagagggactacac

SEQ ID NO: 67083 - DNA, 186 bp, Glycine max
  Peptide Sequence Number=SeqID_158768
ggtacatcctttgtggtacaagtagagggtacatctacttgggtttgactgagagcaagagagggtacatctcttgtggatcagttctagtggagggtacatccactaggttcaaagagaacaagggagggggcattgcacaggccgaaaggcatcctcctataggcaaaagtgccgaaggggcag

SEQ ID NO: 67084 - DNA, 114 bp, Glycine max
  Peptide Sequence Number=SeqID_158769
atggggaaatgggctccgagaaagctttccacaaaaagatctaggaaggacgccacggtcgaagggactagtggccgctcccgagttcgacagccatcatttcaggagcgctga

SEQ ID NO: 67085 - DNA, 519 bp, Glycine max
  Peptide Sequence Number=SeqID_158770
atggagtcgccaactgtcacaacctacccttttgcgggtgagcgaggcgaggctttcgggtgcgttttccaaaggaggaaaatgcgtggagtcgccaccaatgtttatttgaggaaaacgaaggtattagcacctctcatgtttgtcccaaagggtgctaagtacctcgaagcggtcaaacaaaggttacatgccatgaaacaatggtccccagacgaaattagggttacaggttgtaccatctgtggtgaggctcatgaaacatgccaatgtattctcactgaacaaaacactcaagaaattcattatatgggaaatcaacagcaacaagggtatactcaaggaggatttttaggcttccagcagggtccctataatcaacaacgacagtggaggacacatcctagcaaccagttcaacaaagaccagagtgggccttcaaacaggccaatccaacaagggcctaacatattccagaggactactaagttggaggacaccttaactcagtttatgcag

SEQ ID NO: 67086 - DNA, 333 bp, Glycine max
  Peptide Sequence Number=SeqID_158771
atgcaatcaattgatagtgtgcaggaggatgaccttaccattattgggaaggaatcttatgatgaaattaaatatttaagttttggccttggagttaatgatgaacgtatggctgaacaagctttgaccttttataaaataacagtactttctacatgtagtcgtagaaagactacaacttatgaatgtgctggcgtaagcaacgatgtagaaatcagatatttctctacatcgttgctaaggagagaaacgatgttgaaagcacaagttattacatcggtgctgacgagaaacgatgttgaaagcgccggttactacatcggtgttgactaa

SEQ ID NO: 67087 - DNA, 165 bp, Glycine max
  Peptide Sequence Number=SeqID_158772
atgggagatgcgcttcacgactccgaaaatgccttcctctcgcgatttggagcagaaatggtgaccaaaggttggagctttgttgggcaacaatggtgggtgagaaaagaaggagaaagctacgtgagagaggggagtgatcgaggccgtacccgaatcaaataa

SEQ ID NO: 67088 - DNA, 528 bp, Glycine max
  Peptide Sequence Number=SeqID_158773
atggaggaaggggtggaagcagatgaagtggtaaggtcattgagcagcttgaggatgaacatagggtctttgagcaggaggagttgggtctcagaaactgttccagagatgtggggtgctggtgctggacatggtggagatgtttttgagagaagcactagagtggatgatgataatgatgaagaggagctcatgtgggctgccatagagaggcttccaacatttgagaggctaaggaaaagcatagtcaaaagggtcttagaagagagtggaaggttcaattatgaagaggttgatatatccaatcttggtttccaaggcaagaagaaactcctccatgccattttaaggaatgttgaagctgacaatgaaagatttcttcgtagaatgagggagaggattgatagggtcgctatagagattccaaaagttgaagtccgatttgagcatttgtttgtggaaggagatgcatttaatggaaccagagcactgccaaccttagtgaactccaccatgaacgcgatagag

SEQ ID NO: 67089 - DNA, 204 bp, Glycine max
  Peptide Sequence Number=SeqID_158774
cgttataaaggtctgggcgaaatgaacccggatcagctgtgggaaaccaccatggatccggagagccgccgcatgctgcgtgtcaccgtgaaagacgcgattgcggctgaccagctgttcacaacgctgatgggcgatgcggtggaaccacgtcgtgccttcatcgaagagaacgcgctgaaagcggcgaacatcgatatttaa

SEQ ID NO: 67090 - DNA, 63 bp, Glycine max
  Peptide Sequence Number=SeqID_158775
atggaaagcggtgccttctggtggaagcaacccagctcgcctgggcgagctgagctcagctag

SEQ ID NO: 67091 - DNA, 1341 bp, Glycine max
  Peptide Sequence Number=SeqID_158776
atggagttttcaaaaccgtttaaatcatacggaacctattctgaaggtaaaataactgaaaatgaaaggtttgcgctggctaaagatgcaaaagcttttgtaagattttctacacaggaaaatgaaagcattgaagtaaaagtctctttatccccggtaagtacagaaggagcacaggagaattttgatgcagaagcaaagaatgttgattttgctcaagctaaagaaactgcccaaaaaacatggagagacctgatcaacagattccagattacaggaggaaccgatgaccagagaaaaatattttatactggtgtttaccatacttttattgctccgaatctttatatggataccaatggagattatgtggctgcccaggaaaatatgaataccaaatggttcaccaattatagcacatattcttattgggatggcttcagagcaacacatccgctgcttaccattatggatcagaaacacaccaaagaatttgcaaactcattgatcagcaggtatacagatcgcaaggatcacatgccaatctgggaactttgtggatatgacaatttctgtatcttgggctaccatagtgtttcggttatttgggatgctatttctaaaggtgtaccgggaattgattatgagaaggcgttcgctgcgatgaaagatgcttccttaacggataaaatgagcagcagcgacggcggtggaggtcttaacgagtacattaaattaggttatactccttcagaaaacggagcttctgtatccgccaccctggaatatgcctatgatgattggtgcatccagcaattggctgaaaaattaggcaaaaaagaagatgcagaagtttataaaaaacgctcaatgaattttcgtaatactttcaataaagaaaataatcacttctggcctaagcaaaaaaatggacaatttctggctgacttccctttaaacgactggaaaaagcttcagccgcactgggtatcaggaaacatctgggcatatgatttctttgctcctcaccagatcgatgaaatgatgaatctgtatggtggaaaaaaaggatttgaagaaaaattagatagaacatttacagaaacccttaaaatggaaggggaacaacatgttgatatttcaggatttatcggatctcttggatttggagatgaaccgggacaccatgttccttatctttacaattatgcaggagctccctacaatacccagaaaatgatcaaatttatccgtgacaatatgtacgcagcaaagccggacgggcttgtaaataatgaagattgcggacagatgtctgcatggtatatttctcttctttag

SEQ ID NO: 67092 - DNA, 120 bp, Glycine max
  Peptide Sequence Number=SeqID_158777
atgacattaccccccagggcattggataaagaccccagaatatgggccaagctgctgaaaaaggcttcgggttctcataagtctgatgggctgcatagtgtagcgacggtacccgagtaa

SEQ ID NO: 67093 - DNA, 1722 bp, Glycine max
  Peptide Sequence Number=SeqID_158778
tcagactgctcggtcaactatggcctgaacgaatacgccaataacgtgatctgggccatcggcgacgcctgtgaagagcatggtctggaacatccgaccgtgattacggaatcggggcgtgcggtgaccgcgcaccataccgtgctggtctccaacatcatcggcgttgagcgcaatgaattcagtacgccggtcgcaccggatgccgactcaccgcgcccgattcagagcctgtgggatacctggcaggagatgcacgagccaagcgtacgccgttcgctgcgcgaatggctgcatgacagccagatggacctgttcgacatccataccggctattcgtcaggcacctacgatctcggtcagcgcgcctgggcagagcagctgtatctcagcatctgccactatattcagcagcaccttgacccgagcaaccgcgcccatcggccgatcattgatgagctgcaggagcgcatggcggataagatttacgtcaacttctcgctgttccagtcgatgccggatgcgtggggcatcgatcagctgttcccggtgctgccgctggaagggctgaacaaaaccccgcagcgtcgtgcggtactgctggatatcacctgtgattccgatggcaccatcgatcactacgttgacggcgacggtattgccaccaccatgccaatgccggaatacgatgtggataatccaccgatgctgggcttctttatggtcggggcgtatcaggaaatcctcggcaatatgcacaacctgtttggcgataccgaagcggttgacgtcttcgccttcccggatggcagcgtagaagtgcagctgtctgatgaaggggataccgtggcggatatgctgcaatacgtgcagctcaatcctaacgatctgatgacgttattccgcgatcaggtaaaacagcagcaggatattgacgaagagctgcgggcgcagttccttgaagagtttgagagtgggctttacggctatacctatctcgaagacgaccagtgtaaggatcgtaaaatgcgctgcaaatccgactacattctgatgctggagccggttcacgctatttccggtgaagtggtggcatgggaattgttgacgcgtttcgcagatgatgcagataccaataataagcgtaaccctgacagggatgcagggttcttcagtcggctttctgctgacgaaaaatggcagttattcctccaccaggtcgaaaaacttattcagctttaccatgcggggtttgagcaggtcatcagcgttaatgtagacagagatattgtttcaggcatttttaaagatgctgaaatacaaagaaaactggccgcgctgacgcgatcacggctggaaatctctgccttcttcaccgcacgttttaatagtgccgacctgctgatactgaaaggcgtagccaaaatcacgccggccccgttatggctcgatgactttggtccgggttattccaacctgaccatgctcgatagcggaatattcgacatcgtcaagattgataaaaaatttttttggcaatttggcgaagatcgcactttcgacattctgctcgaccacctcaatcaattatgtcgcggcgtgattattgagggcgttgaacatcaacgtcaggttgatttgctgtcgcaaaaatcaatttacggcatgcaaggctaccactggaagagcgtctatctcactgatttgttggcgcaagtctga

SEQ ID NO: 67094 - DNA, 921 bp, Glycine max
  Peptide Sequence Number=SeqID_158779
atgttcattccgatatgggctttgatgctaactccctgtgcggtgctgagcgcgattggcaaacagtcgccggacatcaaccagggcgtagaccgcaccgatccgctggaacagggcgcgggcgaccagggcctgatgtttggttacgccaccaatgaaaccgacgtgctgatgccggcaccggtgacctacgcgcaccgtctggtgcagcgtcaggctgaagtgcgtaaaaacggcacgctgccatggctgcgcccggatgccaaaagccagattaccttccagtacgacggcggcaagattgtcggtatcgatgcggtagtgctgtcaactcagcattcagaagagatttcacaggccgatctgcgtgaagcggtgatggaagagatcatcaagccggtactgccgaccgagtggattaacgccagcaccaaataccacatcaacccaaccggtcgtttcgtgatcggcggcccgatgggcgactgcggcctgaccggtcgtaaaatcatcgtcgatacctacggcggcatggctcgccatggcggcggcgcgttctccggtaaagatccgtcgaaagttgaccgctcagcggcttacgctgcgcgctacgtggcgaaaaacatcgttgccgctggcctggccgatcgctgcgaaatccaggtttcttacgcgattggtgtggcagaaccgacctcaatcatggtggaaaccttcggtaccgagaaagtttcaaccgaacagctgacgctgctggtgcgtgagttcttcgacctgcgtccatacggtctgattcagatgatggatctgctgaagccaatctacaaagaaaccgctgcctacggtcactttggtcgtgaacacttcccgtgggaacagaccgacaaagccgcccagctgcgcgaggccgcaggcctgtaa

SEQ ID NO: 67095 - DNA, 231 bp, Glycine max
  Peptide Sequence Number=SeqID_158780
atgattgtccctgaaagatttgaggctactattacatccttggagaatactaaagatctttcaaaacttaccttggcaaaacttcttaattgcaaactaaccaaggagagaaaaacaagtggaagaaatacaagaagaaaaatttcaacacctaagaagcagcaactgacactagcaacaataatggagacaacaaaggatttcctccttgcaaacattgtggcagaatga

SEQ ID NO: 67096 - DNA, 273 bp, Glycine max
  Peptide Sequence Number=SeqID_158781
atgtacatcaagtatggcccaaaatacatcatgaagcatagccaacaaaacaagttgtccaatgaaacaaaaaccccccacacttattcccaaaacaattccaaagctccaaaattccttaaggatatggacgcatcaacaagaatcaagccaaggctattgtgcaagcaatcaatggggcaaaacacaccaaatgattataatgatggatggctcaaattctcacaaaggtcaaatcatcactttcaaattgagctttcaaaactatcatga

SEQ ID NO: 67097 - DNA, 531 bp, Glycine max
  Peptide Sequence Number=SeqID_158782
atgtcttcagtcattgtatgccttcaaaagacgaccatgtcctcatctatatttcgaagacgacaatgtcttcaatcattgcatgccttcaaaaggcgacaatgtcttcttctacttttcaaagatgacaatgtctttagtcattgcatgctttcaaaaggcgatgatgaccctcatttacatttcaaagacaacaatgtcttcaatcattgcatgccttcaaaaggagacaatgtcctcatttacatttcaaagacgacaatgtcttcagtcattgcatgccttcaaaaggcgacagtgtcctcatttacatttcaaagacaacaatgtcttcaatcattgcatgccttcaaaaggcgacaatgtcctcatttacatttcgaagatgacaatgtgtttagtcgttgcatgccttcaataggcgataatgtcctcatctacatttcaaagacgacaatgtcttcagtcattacatgccttcaaaaggcaacaatgtctttatttacgtttcgaaggcgacgatgtctttag

SEQ ID NO: 67098 - DNA, 168 bp, Glycine max
  Peptide Sequence Number=SeqID_158783
atgaaacaaaaaggaaaaagaaagaaaaaccgcgaaggtcgacatgttatagttaagagaatcctcattccttccccgaagcaaaggatagcggaatcccctcaagggagagcgaatagaatgctaaaacccgatttcccaaagaaagggatggggaaggagaagtga

SEQ ID NO: 67099 - DNA, 1303 bp, Glycine max
  Peptide Sequence Number=SeqID_158784
atgaacaccctttccgacctcgtcaacgcacggataccgcagatgcagacatggcgccgcgacctgcaccagtttgctgaatccggctggctggagttccgcaccgccacgctggtagcggaagagctgcatcgtcttggttatcagctgcagctgggccgtgaggtgattgatgccgatgtgcgcatgggtctgccgtctgctgaagtgctggcgcagcaggaagcgcgggcgctgcagcagggcgcgctgccacagtggctgcctcacttctccggcggtttctgcggcgtggtggcaacgctggacaccggacgtcccggtccggtgatgggctttcgtgttgatatggacgcgctcgaccagacggaaagcgccgccgccgatcacctgccgacgcgcgaaggctttgcttcgtgcaatcccggcatgatgcacgcctgcggccacgatggtcacactaccattggcctggcgctggcgggcgtgctgatggcgatgaagcaccagctgagcggtcgcataaaactcatttttcagccggcggaagaaggcgtacgcggtgccaaagccatggtggccgcgggcgtgcttgatgatgtcgatctgttcaccgccattcacctcggcaccggcgtgccgcccggcgagatcgtctgcggcagcgacagctttctcgccacgaccaagctggacgtgcgttttaccggggtcggcgcgcatgccggtggcaaaccggaagagggacgcaacgcgttgctggcggcggcgcaggccacgctggcgctgcacactctgccgcaacacagcggcggcgtggggcgcgttaacgttggtgtcttacaggccggcagcggacgcaacgtggtgccggatgttgccctgatgaaggtggaaacgcgcggcgcgagtaatcaggttaatgacgatatctatcagcaggcgctgcgcgtgattgccggtgccgcggcgatgtacggcgttgaacacgaggtcacgctgatgggcggtgcccgcagctgcacgccgagcccggcgtgggtcagttttatccatcagcaggccgaagcgctgggtctgttcagttcggtgatagacagcaaacagcaggcggccggttccgaagatgccacctacatgatggagcgcgtgcagcagcgcggcggccaggcgtcttacgtcatcttcggctgcgagctggcggcgggccaccacaatgcgcggttcgattttgatgaagcggtgatggctactgccgtgcagatgctggctacgctggcgcttaaccaggcgcagttcggcg

SEQ ID NO: 67100 - DNA, 252 bp, Glycine max
  Peptide Sequence Number=SeqID_158785
atggttttcaggatttttctcaagggtacatcctttgtggtacaagtagagggtacatctacttgggttgttgtaactgagaacaagagagggtacatctcttgtggatcagttcaagtggagggtacatcaacttggttgttcaaagagaacaagggagggtacatcccttgtggatctttgcttgtaaaggtttttacaaggttgaaaagaaatctcaaggatcgcaagttgcttggggactggatgtag

SEQ ID NO: 67101 - DNA, 296 bp, Glycine max
  Peptide Sequence Number=SeqID_158786
catactatgggaaagcgcagaaattgaatatcattcaaaatgatggtcaatcacaagcaaaagagaaatcaattgaaagctctactgaagtgaaccaaaataacaactctatacttgaagaaaatgcacaatttgaaggagaacaacacatacaagaagaaagtcatgttcagtctcatacttctcttgaaagtgcaagtgaaagttcaactaaaggtaaaaagagaaccagaggttatacacatatgctagatgtgtgggacttgccagatggagaattcatacttttgaagtag

SEQ ID NO: 67102 - DNA, 177 bp, Glycine max
  Peptide Sequence Number=SeqID_158787
atggttgctcacatcccagatccaagggttgatccttctcagtatcgtgatttagtacattattggtgttctgagaaaggacagaaaataagcaacatcaacaaaaggagctgctcaaaatatgaggacttgcattgcatgggaaccaataatcttccaagacggattcatgagatg

SEQ ID NO: 67103 - DNA, 342 bp, Glycine max
  Peptide Sequence Number=SeqID_158788
atgaaagctatgccaagcaagccaacaagaaaaggaaggaagtggtacttgaacccggtgatgatcctggacattagagggaaaatgttttcccagaaggaaggaatgatgagaatcctgaaactggacaaatacaggctaaaggcccaaacttatcaaggtaatccttgtggcgtctaccctgacttatcttccttcatcggaagtggcgtctaccctgacttatcttcgttcaatggaagtggccccgtaaggttcacatcaaaatgtgaagaatcacattctttcacaaaaaaactttgtgtaatcgattacactgatttggtaatcgattaccagtga

SEQ ID NO: 67104 - DNA, 385 bp, Glycine max
  Peptide Sequence Number=SeqID_158789
tgaatgcattggcattatcatggtggaagagaatgttggggaatgcttgtgcaatggcttgaagcaaattgagggagaaaagcaaaagaaggtaaagcttgattatatgaagctttcaaaattagggttggggcagcagggacatgaaggggagaagaagtgtctgaattctgagctatggcatgcatgcgcggacttcactcttgaagatatctatgatagccaaagcttaaaaaacgaaggagtaacgatgaagatggattccaataccaacaaccttgagatgattatgcttttggaacaaaaggatgaggttagtatttctattgacatggaaactgaagaagaagttataaaccagaacatggttaatggaccagttggg

SEQ ID NO: 67105 - DNA, 564 bp, Glycine max
  Peptide Sequence Number=SeqID_158790
atgaggtcctttaatagtgattttccaccatggagatgcagcggaagacaaaggagaagaggtgagaggaggcgccatccactagggaataagccatggaagaaggagcttcaccaccaagatgagccttggataagaagcttggagaggatgcttcaatcccatgggctcaaaatctaccctaaggctcataagaaccctagggccttcccttggatctctggcccaatctacttggagtcttctatccaatgcccttgcggggtaggattgcatcagtcagtgatacgattggttgttgaacgacacgacaatcatgaaaaccgtgcccgcggtgaggagcctcccgtcgacgatccccccctgtcgtccggaaagggacatggtgaaggtgttcggtatcaccaccgaagaaccgtggtggaggaaggtggtgggcatggagaggatatcgaagcaaccatggaaagtgacaatggtaacagtggcatcggctctgtcgcctctgggagtgaaagaaggttgacgaagagtgacgttagcgacagttccggaaccggttag

SEQ ID NO: 67106 - DNA, 801 bp, Glycine max
  Peptide Sequence Number=SeqID_158791
atggaatgctctgagttcaaatctatgggtggtgcgatggtcgatgttagaaacaaattcttcatcactgcactagctggcaatctcttgctaggccagcagattgaacactatgagcataatagaactatagaagctaagttgttgcacatctatgatcctctagtggggaagaagcccgaagctctttacaaagtagacaatacggaggttaggcagtttgtagagaaatgcttagaaattgtgtccctcaaactttcagctagggaactcttggatcacccttttctccaaatttatgattatggatttgactcaaaagttgtgcagtatcaaagacatttctatgaagtaaacccattaattagacaacctttgaatggaatttacaacattaacaacaagttaataagtggggacactgataatgttggtggttatggacctgtatctgaattggattatcatcgagatgatttcgaagcaagtgaaattggtctatttggttgtgaagaggatgacaatttggccgaagttgacaccacaatcaaaggtagaagagaagatgatggcatctttttgacactcagaatagcagataaggaagattttaatattttaataaggagaggaacaagaaaggaggttaaagacaacataagtactaatgtgagaggaccatttaaggggacaaggcatctctcttatcatataagcttatggagagacacagcaagagactctgttaaatgtagacaaaataacagcccaacacaccaaatcttggacaaagcatcttag

SEQ ID NO: 67107 - DNA, 381 bp, Glycine max
  Peptide Sequence Number=SeqID_158792
atgtaccctctcttgttctcagtcaaacccaaggaaagggaaaaatcaaaagaattctcaaactgtgtcgttttgaattctttgacaagggagaagggagacacaaaagaattcaggcgattagtcctttgttcttttggaaaagggagaagagagacacaaaaagaattcaggcggttagtccttggcgaattctttttggcaaagggagaagagaatgaaaagatgaatagcacaagttttcaaggtttagaaaaccagaaaacttcagaaagcttttggtacgaagaagaagaagttcaaagagattcaaggcttgtaaaggattgtaagagattgattggaaaagtattcaagattgttgttggaaagattgattga

SEQ ID NO: 67108 - DNA, 225 bp, Glycine max
  Peptide Sequence Number=SeqID_158793
atgtggttcttaagatttgaggtgatagatttgatagctagcactgtaaagttagatttgtcttcaggggatgagattatggtgggaaaacatggttatgaagctgaaattggagcaattggagccttgaaggacaatcaattgcagaagatgcacaattgtacaaaagagttctcatggatagggttgccatggacgtgtaaaaaattggttttaatggtttag

SEQ ID NO: 67109 - DNA, 250 bp, Glycine max
  Peptide Sequence Number=SeqID_158794
atgagtatgggctgcatatctcactttggttgtgttcatcctgaagatattggtatcctaaatttgcatgctacaaatgagtctatttatgggtcactttcctccatagactggcgagatgaccttacgctggttcagccagtcgcatttgcgggatccttggtccattggtttcgccattcgaggttgtgggatggccttcgtccattggttcgcgagatacaaccgatgcagtgcaacatgcatgagg

SEQ ID NO: 67110 - DNA, 918 bp, Glycine max
  Peptide Sequence Number=SeqID_158795
atgaatatgaagaacatgaaggttccgaatgttctaggtggcgcggggatctctgtgctgctgaagcttgggattgttggtggaattgccgaggcgctttcgaaacgtttccgtaacgtttccgtgaagaatttcgcaaaggtttcgaccgttcttcgacgttcttcattcgttctttatcgttcttcgatcttcaacgggctgccgtcccttgggacggacgtgtggggtgctaataccttccccgtgcgtaaatacaactcccgaacctttcacttaaaagttcgtagatcacgtcttttccggtttttccgacgttttcctcaaataaacgttggtggcgactccgcgcgtattcctttcgtggaacacgcatcccgtgagtcacgcgtcgccctcccgccgaagggtaggttgcgacaggtctatcctgaaggaactcacttcataatttcatggtttaagaggctggttatctatgatgtctgtgcacgaccccatctagttgaaagtacatctgggagtcgtgatatgttgctaggatttgcatgtagtcatagagaaatggttttgtgttgtctcaaggaagcaataatatatcaagtcaatctttatcatagtggcctacttctaaccatgacacctaaactaactgttaaaagcaagaatctaaaactgcaccataacaagagcaaccttcatctgagaaaaaatctcaagatgaatgtcaccaagcaccaattgtacaagtttccctccacaattctcgagctatcggaattcagatttctagaaaagatccagtccttaataacctatatgattaaacaagtaaataacacaagagaattgttaacccagttcggtgcaacctcacctacatctgggggctaccaagccagggaggaaatccactaa

SEQ ID NO: 67111 - DNA, 336 bp, Glycine max
  Peptide Sequence Number=SeqID_158796
atgtgggtgaggttcaaggtgtggtttagggacatgcacaatgtaaaaagcttgacagagagaatggctgaggaacaaaggaaagtgcacaatgtggttaggttcagggtgaggttcagggacatgcacaatgtaaaaagcttgacggagagaatggctgaggaacaaatgaaagtgtctgagacaatggctgagggaatacattctaagatggttatttataaccgccttagaatgtacgacgtgaaagctaaattttcccccctaatttcaaaattgccaccgcaccttattctacatcgtttatccagcaccgtcgtagatatcgcgacttaa

SEQ ID NO: 67112 - DNA, 246 bp, Glycine max
  Peptide Sequence Number=SeqID_158797
atgatgagaatcatgaaactggccaaatacaggctaaaggtccaagtggagaaggacgaaggcccaagtggagaaggacaaagcccccgagtggagaaggacttatctttcttcaccagaagtggcgtctaccctgacttatcttccttcattggaagtggcgtctgcccagacttatcttccttcaccggaagtggcgtcatccaaaccttcgtagcctgtatcaaacgatccgctcctacttag

SEQ ID NO: 67113 - DNA, 441 bp, Glycine max
  Peptide Sequence Number=SeqID_158798
atgaagatcgtatcggggacagagtcatttggcagcgacgagagtggcgtagacggtgaggaggaaggggtggtggagatttgtttccctgaccgtggcggaaaacacaacgaaaagggagaagcagaggtcggaggaaaggatgcagcgactggggggctccggaggtgggaagctaccatgggaaggggaggcaacgtggtttctgctggtggtggtggctttgcaaaggaagaagatgggaaaagttggctcgttacctttggaagcagaggtagcatggttccggctagtggtggtgactttggagaggaagaagatggagagagttgtctgggtaccatgtttggaatccatggaagcttgggctgcgacgagtttggccatgacggcctcgaggcgatccaggctggaggcggaaggttcgacatccgccattga

SEQ ID NO: 67114 - DNA, 537 bp, Glycine max
  Peptide Sequence Number=SeqID_158799
atggcaatgtttgatccaaaacctaacagggagggtaagaagaagattcaaatgatgatattggcaacaaaaaatttctccataaatattagttcagttgagtcacccgcactcaagatccaaggagaaccttctagaagagtacctacaaatcatttttctcaagagatccttggcaacgagggacgcagtttagaagattctagaaggaaacctaagcttatccctaagcacaacttcaaatatctccgcagcagagtctccataaaaagggggaatcatcgccaacattatatacaaaatcaccccatagctccacacatcaaccttctcatcgtactccctctccaacagaacctccagcgtcatgtagtacgtcgtccccaccatgccgctcatgctcctcccgtctttgaaacactacgccaaaccaaagtcgatgagattaagattgtccgccgaatcaaagacaatattgtcgggctaaatatcacggtgggcgacatcgaggcggtggcattattcgatggcttctag

SEQ ID NO: 67115 - DNA, 282 bp, Glycine max
  Peptide Sequence Number=SeqID_158800
atgaaactaccagaaaatgcacaacaactgccacttgcagatatggagaaatcaagtgaacaagcagcagcgactgagcctcagagtagaagaagaagaagcaactcagcgtgggaagaagaagaagcaaccagcagcttcgtaaaccctaatttttttggggaagaagaagaagcaaccttgcgtgagagagagtttatagatgcagacctcagtgccacgttggacaatctacgtggcactgaattgccacctatacacctcactaacgccgtcacctga

SEQ ID NO: 67116 - DNA, 96 bp, Glycine max
  Peptide Sequence Number=SeqID_158801
atggttttgttggtcaaaggagtaactgttgtggaggcgatagttgtagttgtggacatgagggttgtggagatgatggttgtggttgaggaataa

SEQ ID NO: 67117 - DNA, 386 bp, Glycine max
  Peptide Sequence Number=SeqID_158802
ggccaggtgttgaacaaacacattttgaaatttcacatcctcagtcaatgtattctactccttcacctgttcatcaaacttttggccacactggcgagtcagtcaccgcaagcacccatgaatggatgaccgatttatttggcgtcgatttcaatacaccaaatttagcggcatcatatgtatctactttacaacagttcgatgcaccacattcgtttggagaacatggtcatagctcttcagtagcaacaaccaacattgcaaatactaacatagaacaacaacatcatcatgacatgggagaaccggtcatactggaaagaagaaattcgcgacgtaatcggcgtccaccaccttgtgggactggtcatcatcttggtcattga

SEQ ID NO: 67118 - DNA, 159 bp, Glycine max
  Peptide Sequence Number=SeqID_158803
atgatcgttagtgaaggaagagtgggagtcattggagctacttttggtgaagttgcgtgtttagagctaaaggcccaagtggagaaggacgaaggcccaagtggagaaggacaaagcccccaagtggagaagggtgaaggcccaagtggagaaggatga

SEQ ID NO: 67119 - DNA, 240 bp, Glycine max
  Peptide Sequence Number=SeqID_158804
atggcttcactggctaagcaaatggataagttacaaagtaatgttcagaggaggatgggagacaaatttgatgagatacaaagaagcactcaagagttgagtgggagaatgaaagacatagagaggagaaggcatcatagaaggcatatgcataggaggaatatggatggaatggatgatatgaaggtcaaaattcccaagttcctaggtacttatgatccaaaggcttaccttgattag

SEQ ID NO: 67120 - DNA, 174 bp, Glycine max
  Peptide Sequence Number=SeqID_158805
atgactgatagagggctatccaaagagcataaggacctagaaacacttcatgagttgaagggtgcaatgacaaggtctagagccaaacttctacaagaagagatggccaagaagatcaaggatggactactcatcaaagacaaggaaggagaaaatcacaagaagttaaattag

SEQ ID NO: 67121 - DNA, 565 bp, Glycine max
  Peptide Sequence Number=SeqID_158806
gtgggcaactggggatggtgtgcttatgcctgggcttgtggaagtgggatatttgttttgcgccatcgcccgatcgccacctagtaccacatatgacgggcgagctcctggcaatcaaccaataaaagaacaaaagtccacgaagcagggaggcttgtgtggcggctggccagctatctatcttgggttgttatctgaaaaattccctctgatcgcgatggcagcacagttgatccatgatcgcgttgtgatggaatgcctagagggtcaacctgcacacacacttcagcagcctgtggagtggatactacctacacctactccatatcgactagttgagccggttcaagtgatagaggtgtcatcctctgaagaggatcttgaagaggacccagaggagttacctcctgtacctgctatggacgcccctgacttaccagaggatgatgaggacccactccctgatgttgattctccagaggatattatattagcatctgaggcagactctacagaggagagtggccctggagggacaacgaatagtgacgactcttcatcatag

SEQ ID NO: 67122 - DNA, 1782 bp, Glycine max
  Peptide Sequence Number=SeqID_158807
atgtatcgcttggcttctaacctcgcttccaaagcaaggattgctaggagtagcagccaacagattggaagtaggctgagtttgagcagaaactatgcggctaaagacattaaatttggtgtggaggctcgggctctgatgcttaagggtgttgaagagcttgctgatgctgtcaaagtaaccatgggtcccaagggccgtaatgttgtgattgagcaaagttttggtgcccctaaagtaaccaaagatggagtaactgttgcaaagagcattgaattcaaggataaagttaagaatgttggtgccagtcttgtaaagcaggttgctaatgctactaatgatgtggctggtgatggaaccacatgtgctacagtccttacacgagcaatatttactgaaggctgcaaatcaatcgcggctggaatgaatgcaatggacctgaggcggggtataagtatggctgtcgatgctgtggtcacaaatttgaaaagcagagctaggatgattagcacatctgaagaaatagcgcaggttgggatgatatctgctaatggagagagagaaattggtgagttgattgcaaaagctatggagaaagttggcaaagagggagtaatcacaatttcagatggcaaaacattatataatgagttggaagttgttgaaggaatgaagctcgacaggggctacatatctccttatttcattacaaacgataagaaccagaaatgtgaacttgaagatccccttattctaattcatgagaagaaaatctctagtataaatgctatagttaaagtcttagagttggctttgaagagacaaagacctttattgattattgccgaggatgtggaaagtgatgcacttgcaactcttattctaaataagcttcgggccggaattaaggtgtgtgctattaaagcccctggttttggtgaaaataggaaggctggtcttcaagatcttgcagttctcacaggaggagcacttattactgaagagcttggcttgaagcttgaaaaagtggatttggatatgcttggtacctgtaaaaaaataacagtttctaaggatgacactgtcattcttgatggagcgggtgacaagaaagcacttgaggaaagatgcgagcagattaggtcagcaattgaaaacagtacctcagattatgacaaggaaaagttacaggaaagattagccaagctttctggtggtgttgcagtgcttaagattggaggagccagtgaagctgaagttggtgagaagaaggatagagtgactgatgcattaaatgcaactaaggctgctgtagaggagggcatagtgcctggtggtggtgttgctcttctatatgcatcgagagagttggataaacttcaaactgctaacttcggtcaaaagattggtgtccagattatccaaaatgctttaaagacacctgtgctcactattgcatcaaatgcgggagttgagggtgcagttgttgttggcaaactattggagcaggagaatcatgatctaggatatgatgcagccaaagaagagatactgattctactgacattttttgcaaatttttttcctgcttcacaaggtgaatatgttgatatggttaaagctggaatcatagaccccttgaaggtgattaggacagccttggttgatgcagccagtgtatcgtctttgatgacaacaactgaagctgttgtgtctgaacttccaaacgataataaagatactccagctatggctggtggcatgggtggcatgggttattga

SEQ ID NO: 67123 - DNA, 147 bp, Glycine max
  Peptide Sequence Number=SeqID_158808
atgcagtttaagttctttagcaaattcccaagtagcattagcaggggagtgattagaccagtgattgagcaagttggagcatggcaagagttaagctcgatggatgaagggaaagagctacttgagctagagaaaggacttgcttaa

SEQ ID NO: 67124 - DNA, 400 bp, Glycine max
  Peptide Sequence Number=SeqID_158809
atggctagtaacccatcaagagttcaaaaaaaggaaaatcccaagcagccatcaatcgcttggacacttggttcactgatgaaggaaataagaggtttcaattttcccaacctgctaaaagttcaagggctaactaagcaagtgcagatgaaagggactttctacctagaactggtcaaagttttctacacatttactcgtgctggccttgaaggaaatctcttctcaactgtaaatggagtagacatggagatagatgttattgtgtggaaggaagttgctagtctagtcatgggtgaagtcagaaaattcgatgaaactgtagatggctacaacaagatgcaaacctacataagatttcttcttgatcctacaaggagattgagaaatcaccttggaa

SEQ ID NO: 67125 - DNA, 501 bp, Glycine max
  Peptide Sequence Number=SeqID_158810
atggaaatttttattcaatcaatcgatctcggtgcatggaatgccattgttaaagaaccctttataccaactaaagaagttaatcatgaattggttccaaaagaatgggatgagatgaaagatgatgagaaaataaaagtgcaagattatcaaaaagctaaaagcattttaacttttgctttccgaatgaagaatggtgaaacccattctgaactccaaataagattcaaccacatagtgaatcacttacttggtcttggaaagacatttgaagatgatgagttaaacatcaagattctcaactgtcttataagaacttgggaaccgaaaatcacaatgatcaaggaatccaaggacttggcatctgtgtcgatgaaagccctctttagaaaactgcttgcgtatgaacatgagttgattgaagaatctcatgcaaaagatagagaaaagaaaaggaaagggattgcactcaaagctagttcctcaaaggaagaccactaa

SEQ ID NO: 67126 - DNA, 525 bp, Glycine max
  Peptide Sequence Number=SeqID_158811
atgattgtggttgttgtcgttatcatggtgggtcttgtcacgggatgcgtgggtgttgagggagatcatgaggatggtaagattaagggggattttatgttatggtggaatggggaaaatgttggacttaaagacttggcattggatagccatactattgaggtactaaatttcgggttgagaaactttgcactgaaagtttatgtggagaagttgaatcatggtttggctaatgttgcaaatgttgttgaggatgaaggtagtattgaaagtgattctgatggagataatgggagtgttctttttaaagatagtgaagatgagagaggagttgcaattgatgatggttttgataacgatgaacctttggtttacctgattttgaggaaaaaaggtgttgataaacatctagaagaaagagacaatgagatgagtgaggggtatgaaattgaagaacttctcgatggtggatcaaaatctaatgaagaggatgtaggcatgtttgtaagatttagaaaagaatag

SEQ ID NO: 67127 - DNA, 1227 bp, Glycine max
  Peptide Sequence Number=SeqID_158812
atggcaagtttctggcagattatgctgggatggattctcagcatccgcatttattgcccgggtttaggtccaagttgcaagctcttcgatgggtttcaggcctctattagaggtatcgtctcgtggatctatgtcgaattcatctcccaggcttgcttggtagacgatcagggctcagatttgagacccttcgtccatgctcatgacttgagtgccttcagccactgtggggtaaggcttggcaagctccctggtgggaggatatggtactaccttcaggctttctgcataacactgttgtgctttcttttggtctgccttgacggttataatctcccctgtcaaggtaaggaaatagggcatggaaactatggctccaagcttgttaagtggtcatcaagtccatgtagcctctggtctctagagtggaccagcatcgggggagatctcgagtctgtggaaagtcttccaatacaggatattagtggaactgccctagtcgataaggaccttggacaccatgaagtttgcaatgataatagagacaaccacagggttgtccttattgacgaggttgatacccttgaagtccctatccgtgaaagaaaatccgcccgcaatggtgttgattacacctctgatttgctgggagggttcctgttcttgtggagttcctatgctgctcctcttggtgtcctccagtccgacctcatcttgggaggtttcatcaggggtagcttgatgggtacctccaagttgaaagcttcctccagaatcgtagtgcgattaaccgttagagcccttggcacgctcgcgcaactcatccatgctaccaggtggttttttgcacaaactatctgtgaacttgccgaggttgtgtattgcacattgaatcattcgacaagggtgtcgaagctatctatagacctaggtaggagtccaccgtaccaagtcaatgtcgtccccttgagggacatccattatcctatcataccgcttgaggttgagtggtttccacctcatgggcttaagtcatctgcaatgttgattgtgcgtcgagggtgcgattccccttgggtgcacttaggcaaaccttcagctgatcatgctcagcctttagctttctcagctcttcctcatggcgtcactccacctctacaatgcgggatagaagtcttcgagaggggtctcacatctgaggccaaactgagtgctaaccatggatga

SEQ ID NO: 67128 - DNA, 645 bp, Glycine max
  Peptide Sequence Number=SeqID_158813
atgtccagatttaggaatgtagccttacaagttggaaaaaagtgtgacaagcgagaaggaagtaccaagaccgacttacacaatttgtcaaaaagccagacaattagcaagcaggaggaagacctggaggacaccaagaggagcagcataggaactacaaaggagacaaaagaagagataaaatggaataccaaggtagacaaagataccaattgtagcggcgtgagtgacaacctccacaagaacaggaaccctcccagcaaatcagagactcgagatctcccccgatgctggtccactctagagaccagaggctacatggacttgatgaccaccttcggtcaaggcaagctctttaggagctttactataagatatctactggttgacacagacacatcatacttttctttaatcggcaagaagacacttaacaagcttggagccatagtttccatgccctatttccttaccttgacaggggagattataaccgtcaaggcagaccaaaagaaagcacaacagtgttatgcagaaagcctgaaggtagtaccatatcctcccaccagggagcttgccaagccttaccccacagtggctgaaggcactcaagtcatgagcatggacgaagggtctcaaatctga

SEQ ID NO: 67129 - DNA, 204 bp, Glycine max
  Peptide Sequence Number=SeqID_158814
atgccacgtcaaactgtctttgctattgtcatagaagagctaccattcaaacaacaaggacggcaaggaataatgggagactgttttatgcttgtccattaccacaaattgaacatggggatttttgtggtgggcagcaagatgcagatcgatgtaattttcttttcgggggtggatgaagacatgggtgttggggccaactga

SEQ ID NO: 67130 - DNA, 183 bp, Glycine max
  Peptide Sequence Number=SeqID_158815
atgtattctgcttcagctatggatagtgctacgaaagcttgcttcttgcaattccaagatatgagtgaacttcccaagagcttacatcttggaaagtcagaatctgaaaagccaattaaactcaaggaggtacctttgggataccacgaaccaacattggttatgcccttaagggctccataa

SEQ ID NO: 67131 - DNA, 312 bp, Glycine max
  Peptide Sequence Number=SeqID_158816
atgactaaagcacgtcaaaagggggtacggaaagggaaaaagggaggtggttgtcgcctagctcacctaggcgagctgtgttgcttccaccagaaggcaccgccttctgttggaagatcctggaaggcccaaaactttacggattgcgccttaacacaccctttcaactctcgacatgtcacgaaacttcacggattgcctaacgatgggtgtcaagtacctcgaagtggtcaagcaagggtcgcaccccaacaaacagatgatcctcggacgaaattagggtatgaaatatccaacaagagcctattatag

SEQ ID NO: 67132 - DNA, 459 bp, Glycine max
  Peptide Sequence Number=SeqID_158817
atgaggaaatataggataagggtaatcaggcatgaggtagttcttgctgaggatgttgttgggggtattcctatcatggtcgagtttggttgggtagatgagagaggcttggttacccaatccaaatatattaaccctaatatggttggggttttgaaaaaggttgtgtatagtgttaggggaaccgatttggttgaggtagaatcgtgtagcgcggaggaaaggatttgtcattttcccacggtgggtatggggtctatgatttctatttctaacgttcaacttcatgaggattacaagcagaaggcaaaatttcaatcaaagaatgtgaccaagtcatccttgttattcttggatgggaaagtatcctccaatctcgttcctgcaagtggtgttctaaagccaacctttgctcctctcgaccctctttctgagaatcaacccttgaagaagtcatga

SEQ ID NO: 67133 - DNA, 474 bp, Glycine max
  Peptide Sequence Number=SeqID_158818
atgcaatctcagggacttgcactgcctcccgagcctctggttggtccctcaggtcctcgagtaagcacaaaggggagttgtgttgatcccttaggaaacgatcctgagacgggtgacttagataggtgcggcttatacatcgaagcagatcctgcctgcctggttgccttggggagagtttatgagggatccactgttgttcataacactcctttattgcctggccaagtaaaggtgggtgtggaggaggttacagatgcatatgctccagttcctgtacccactgatgaggtttccttagtggggcaggcaattcataccttccttgcttggccgacacatctggtcaagtctttatcacagcaggcagctgtgtcttcggcaaaaccacctcaaaagcccgatccgaaggtcgatgatccgctttatctaatgacattgaccatcccagagcttttcttgaggctttatcag

SEQ ID NO: 67134 - DNA, 330 bp, Glycine max
  Peptide Sequence Number=SeqID_158819
atggaggaaccatcgaagaagcgaaagggcacttcgagtcggagtcaacggcattccgggtcacaggaaacgccaatttcttcctccattccctctggatcattgttttcatcagaggaacaacgtatacggtacacaaacctatttttctcttgttccattatagacccaaaattcatagatatggatttcttctcaaatgagagttttgaatgctttcaagcatttgaaaactccaatcttattccattcatgtctctgaaattacctgtttattctgatctagtcaaagccttttattctaatatagaatccatgaaggcaccctaa

SEQ ID NO: 67135 - DNA, 574 bp, Glycine max
  Peptide Sequence Number=SeqID_158820
atggctaagttcaggaggtatgctctagagattgaaggccttgtggaaactagtagtttccatttgcccatcgaagaggtgactatcaccttggatgacgtcacatcgttgctacatctgcttattgtaggggcattccacagcttcgagcaattttatgtcgacgacgctatcaatatgctggtggaattactcgaggtcaacgccacagaggcgagagctgagacgattcaatatcatgactcttatgttcgactatcgtggctgcgcgacgtgtatcagatgaaaatcgagagttacgcttggggcgctgctgcacttgtgcacatgtatgatactttaaatgaggcgtcaaagagcacggcgagacaacttgcaggatatatcactctgttacagcattttctgtctgttggttccgtcgtacctgccaatgattatgatgagaggagaccgcgtgcatgtggatggacctctggcaaggcactgccaatttctacgtatcgcaggcgtctagacaaactgacccatgatgtgatggggtcccttgatggtcattcatcgaccgaagaag

SEQ ID NO: 67136 - DNA, 477 bp, Glycine max
  Peptide Sequence Number=SeqID_158821
atgtgccctcctccatcaaaggtgaacactaaaggtgcaccgaagaaaccgatgaaaagaagtcaaacatccacaaagcgtgatccgtcttactggcggacgataactgtggatatcggtccattggcggctttattaggtatgggggaagattcgtggccgttagtgcgtaatgaattgattaaagaacttagcaggtggtcgcatgagtacatgaacctcttcagtggcacagagagatttgaacaattaaagttgtccctacttgttgatgggttttcgaaggttagtatggacaagtggatggatataacagacataggatatgtgattgcatcacggtataacgtaatccttgtatcgttgtcccgagaacaaagcatgacattttttcctcttagaagtcaaccaccacctgattcttctgggcaccgcatgatatgtgtcgatcatgtatttggaaatcattttgttcag

SEQ ID NO: 67137 - DNA, 594 bp, Glycine max
  Peptide Sequence Number=SeqID_158822
atgctttcctcgtatatcaccatagcaaggaaagtccagtggtggctatcttggcagatttgttcgacacctttgaccggagggggcagcacgatcaattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtatctcgcctttccttgtgagggatctaggcgcgcaaggtctcaagaaattcgaagctccggaggaagatgaagaagtccgagctctaaagttagagctagggaaggcgagactcgccaaggagaagtcaaatcagctgctacacaattccggaaggagtgcaccgagctacaagaggaaaacgcggccactgcaagagcccttgaacaagaaaccaaaagggcccgcaaggaggaatacggccgagagaaattccgaggagcattgtggggtagcaacaatgagctcaagctccgaagagaggagagagatcggtcacgggtgtatggcatga

SEQ ID NO: 67138 - DNA, 297 bp, Glycine max
  Peptide Sequence Number=SeqID_158823
atgtcaggatttacacatgattctcctcaaatttcagccagcccgcatcaattagaccttgcaccttatgcttcagagccctacaatgctcaatggaacgccccagggcttctccgtgacaagcacacgttgcgtttgagtcgtatcctcgaaaaatggagattgaggaaacctagcagggtttatgactaccactgcattattgagtggacatgggagcaagtcaacataggacaccggaatttggggatggcctttgtcgataactgggcggtgggtaaggagaaggaatggtag

SEQ ID NO: 67139 - DNA, 699 bp, Glycine max
  Peptide Sequence Number=SeqID_158824
atggaggaactgaagaacacacaattctcaggtcaagatgcagtttcagaccctggactactgcataaggagcttgttggagagaaaactattctgatttctgagttgtataaggctattgatgaaaaaggaaatatggataactttgttgatgtgttggagcaagaatgtagacaaaggaaattgaatttgtctgatatctttgaacaagtcactgaaacaggacatacattgctcatgtggcagcagttaaggggagagaaaagattgggaaatgtaagaggtcacactccacttcatgttgtgtggagttccaagaacactactatggtcaacctcattctttcccaatatgcattagtgaagtcaacacatgatgatgtgatgaaagataaaaagataacaatagagaagaatgaacttggggacactcctttgcatgaggctgtccatagtggagatcttaatgtggttgaagtcattttacaaagagataaagatatggtccatgaattgaacaagtctaggtgttcaccactgtttttggcagctgctagtgagaaggtggaaattctgaatcttccgttgcaaattccattccctgcagatcagaagcttcctcggttctttggaaactctccactccatgcagccatactgaaacggaatcctggtactccttcactccaaattacttga

SEQ ID NO: 67140 - DNA, 135 bp, Glycine max
  Peptide Sequence Number=SeqID_158825
atgacatgcttgcctgctactggtatggaggcttcaaaagtaggacttgggttgctcaaatttgagagacaaagtgttgtgccgcaagacgacgcaaaatctttccggtggcagtcttgggcaaagaatcagtaa

SEQ ID NO: 67141 - DNA, 351 bp, Glycine max
  Peptide Sequence Number=SeqID_158826
atggactcaatgtttctcacgtgccaacaagtcacgaattggcagacattctcactaaatcactttcttccacgcgccataaccaagattgtcattgaagctgcttccatcttgcgggggcaagtagagcacatgcaaatcgcagctcgtattggcgcttcccttggcgacgtgacacttggcactggtgtcgccagtgctgttgacgccttgcaggagcttggactcgccagtttgactggcgagttgagggtaggggacttcgagggtgcaggccagcagaggtcatttcccaggaggcttgcagtctgcaacgcgcagaggaggtgcagcagggtgtcgccaggctga

SEQ ID NO: 67142 - DNA, 372 bp, Glycine max
  Peptide Sequence Number=SeqID_158827
atgagggttcactgtaatcaagcaagtcagagacctagcaagaccacatattcacctccactccttatgttcccacggacccggattgattggcctaactctctaaaaatagtccccagtggagtcgccaattgtcgtaacctacccttcgacgggagggcgacgcgaggctcatgggtgcgtcttccaagaaaggaatacgcgcggagtcgccaccaacgtttatttgaggaaaacatcggaaaaaccggaaaaatacgtggtctacgaactttaagtgaaaggttcgggagttgtatttacgcacggggaaggtgtttcccttgctcctacgtattcctcaattgtggtaaggaaatcagacctgcgtag

SEQ ID NO: 67143 - DNA, 687 bp, Glycine max
  Peptide Sequence Number=SeqID_158828
atgaataactttgggtggggatgggagttaagtccttacaatcaatatgaagaagaaagaactcctagtcttgaaagtgtgtttgaagaattcatggcataccatgctagctctaaagccgatcaaacttcaatgaaaaatcaggaacttcaatttggcaagagctactccatagaagattaccaagggggacccgagttgcaaccctggcatcaaaatgaagcagaaagaggttccaatttggataatttgttgatgcaattcaaggaaacaactgaatcaactcaacaagcattcaaaagtgcagaaattcaggttgataagctggcagaagaagtgactcaatttgtggccagaagagaagaagatttggtagaggttgaagctcaagaggaaagccctgtaaaagagcatgaatcaagagaaaaagatgaagagaaaggtgaggaaaaagtgcaacaatgggagaagtactcattagtagaaaatcaacaagaaagtattctccaagaagaaaggcagggagaacaagagaaaaccttgagtgtcattcctaccttgatcaccgacacctctcctgcaatgaattggaatgtacttccaaaatacatgaagttcatggaatttctagctaaaaggaaaaactgccaggaggatgtgttctatgtgaccttcatgccaccttga

SEQ ID NO: 67144 - DNA, 213 bp, Glycine max
  Peptide Sequence Number=SeqID_158829
atgtgtctatcggggaaggagagtatgctgataaccgtaaatgagattttggatgttagcatttcgtttctaaaagaccatttagaggaaacactgggtccaacaaagataggagaaaatcactcaaagtgtatcaatctcacacagtgcgtggcgagaaagtcgctagcgcacagtattttgtcggtagtcaaagggagaggaccactttag

SEQ ID NO: 67145 - DNA, 131 bp, Glycine max
  Peptide Sequence Number=SeqID_158830
atgggggaaccatcaaagaagcgcaaaggttcttcgagtcaaagccaaaggcactccgaggctcaggatactccaattccttccagtatttcctcctcctcattgttctcatcggaagaacaacgtatacg

SEQ ID NO: 67146 - DNA, 763 bp, Glycine max
  Peptide Sequence Number=SeqID_158831
atgaacacaaaaacggtaacccctagactacgacaagtttctctattcaccagtctcgccttgctgagtacgcaagcctttgccgaggccaccatacaacgcaacgaaaatcaatttatcaatatcggcattgcctcacgagtgagctttagctcgattaaagatgcggccccaaacggcaaagaccgttcaaacgactttgaagtcgaggaggcgcgtctatataccaacggtaagctgcatgagaacgtttcattcgaattcaacttcgcacgcaataccgccgacgacaaaatagaattgctggatggtcatctgggtctagagtttaacaactacctgcatatttgggctggccgcttcttgccagccgccagccgcgcctcagcagcggcgccgatgtattccacgacgtttgatttccccatcgccgaacaaggctcttaccagtttgcaggtcgggataatggcgcagtcctcttcggtacagacaaaagcgaggcattcaaatactacttttcggccactaacggtcgccagggtggttctaaccaagccgacaatttgtcttatgccacccggctgcaatacaacttttgggattccgagccaggcttttacaacctggccagttacgatggcaaaaaatcgattctgtctgtgggtggctcttaccgttaccagaaagatggcacagggacgatcctgaacaaaggggactccaaatactggaacctggatgcgcgcctggaaaaaccgctca

SEQ ID NO: 67147 - DNA, 186 bp, Glycine max
  Peptide Sequence Number=SeqID_158832
atgcaacctaaagtactaaacctcgacccctcgtccttcaatggtgattttacaccatggagatgcagcggaaggcaaaggagaagaagagaggggaggcaccatccactagggaataagccaaggaagaaggagcttcaccaccaggaattgctttggataagaagcttgaagaggatgctttaa

SEQ ID NO: 67148 - DNA, 776 bp, Glycine max
  Peptide Sequence Number=SeqID_158833
atgagtcttccctgggcctttaaggcccctgaaggaacgtttaagactaagacgttgataggctggagtgacgcggttggaatgaaacagaatttgcctggcggcaatagcgcggtggtcccacctgaccccatgccgaactcagaagtgaaacgccgtagcgccgatggtagtgtgggagcgcgatattgccggcatcgaaagatgcaacgtaaaagaatcggtggagcggtagttcagttggttagaatacctgcctgtcacgcagggggtcgcgggggcgtagctcagttggtagagcaccggtctccaaaaccgggtgtcgcgagttcgagtctctccgcccctgccatattaagaaccctttgcgaaagcaaaggagcgcttttgacgttatatgccgatgtttgcccgatcctggttgcttcatgttcctccgagctctatcctgccggcctcctgattcttatctcgctttgcattatcttctctcagaaggcgatgagcgcgttttggctgttgatcgctgttttgcaaccagacggcatacagtgggcggataatcggcgggatctcggtggcggccaccaactgtggatactctttttcccactggctgggcaggaaagcacatccacccgtggtttccaacagctgacgcgtcaggtgagcggaggtggtagtaagcaccggcacgttatcaccttccagtatgcggctttcctgttggtggaagtcggctccccattccagcttgatgtagggcatgggggcct

SEQ ID NO: 67149 - DNA, 399 bp, Glycine max
  Peptide Sequence Number=SeqID_158834
atgtcgacgcctgtatcgccattgccactggcgggtcatgccttattgccaaagctaatggcggcttccatgcaaaaagagaccccatgtgcaaatactttcaaaatagaccctgttactgaagctttacaagaaggagaacgtgttctttcacttccagttttcaaagttgtatcaatggcattttcgtcgtcatgttcatcaaatatacaaattaagtctgtccgaatgacggtgatgtattatggatgcaacctaagcatgtttcaaaacatgtttggaatggggaagaagactggaaattacacattagacgagttgtccccatgtatcaagcgaaagaataaataccagaggaaattattcctttactttggcaatcgggtttttattggataa

SEQ ID NO: 67150 - DNA, 159 bp, Glycine max
  Peptide Sequence Number=SeqID_158835
atggctaagtttgaccctgagatagtcctggagttttatgctaatgcttggcccacaggagagggagtgcgagacatgcgatcatgggtgaggggccagtggattccctttgacggaggaaagctaggagtgtattcccacccactaggcaccctttaa

SEQ ID NO: 67151 - DNA, 504 bp, Glycine max
  Peptide Sequence Number=SeqID_158836
atgccatctactatttgtagggatcacgcccacaagacacccagtggacccggagaagtccaacagagcctggagtttccagctctggttatgggcctctgtcagtcctaccaggtgcccgtccccccagcaaggtcacgccatcatgacataaagattgcgcctgcaagacacctagtagacctgaagaagtccaacagggtcctggggtttccagctctgattacgggcctctgtcagttctacggagtgctcgtcgcccccagcatggcaggcgtagggcaagacaccacaacagcatggggatggccggcagcgggcaatagacgcactgctgccacctctagagcccctcagctcatctacaaaggccggagctttgcctacgacccgtggccgaccagtaagcgaccaagtccaaagccaaaggtaagcaaaagtactaggtccgtgaccgacaagtcatcacgcgtccagctccagatgttaaagaagtgttactag

SEQ ID NO: 67152 - DNA, 240 bp, Glycine max
  Peptide Sequence Number=SeqID_158837
atggatgaattgaaggatttgatcaagcaagttgtgcctcatgggattcccccttatgtggaatggagaaggaagagagagaggagacgccacttcaaggagaagatgagtctagaagaagctcaccaccataggaggccatggataagagcttggaggaagaaggagatgaatgaagggagagggagagaagaccatgaaattttgtgctctaagagagctctgaaatctgaagtttaa

SEQ ID NO: 67153 - DNA, 510 bp, Glycine max
  Peptide Sequence Number=SeqID_158838
atgtcgcggaactttacggattacctaacgatggatgttaagtacctcgagacggtcaagcgaaggttgcatgccgccaaacaatggtccccatatcgtaccatgatgatggaaaagatggacattttgaatacctggcaccacaaaatcccaccgtatattgcaaggaacttatcagctagttcctttgttgaaaccttaatttctccattattacatattttgtccccaccaactataagaccggtagcatttcaattactatcagataaggagaagaatgatcttgctcaattagttagcacaatggtgtcatacactataacatataaaactgtgaaatcagatattctgcctcaaacccagaggtgtgacgtagttgatagcttggctcggtctcttgttcctcctattagcgactttataaatttgaaggattatacttcaaaccattatgtgctttctatagctatcaagcagcttttggttcatgatgttagacttcattaa

SEQ ID NO: 67154 - DNA, 300 bp, Glycine max
  Peptide Sequence Number=SeqID_158839
atggtggggaacgcaccttcaagctttgcggatttggtctttgacggcaaaaggatcgaagcgggtctgaaaagaggaaaatttgatcatcctactttgataagtgagaaagctggggcaaatgaagaggatgagaatgagggagaaacccatgttgcgactatcattcctacacggccaaacttcccaccagcccaacaatgtcattactcaaccaatatcagctcttctcattacccaccacccagttatccacaaaggctatacctaaatcaaccacaaaacccgcctaccacataa

SEQ ID NO: 67155 - DNA, 753 bp, Glycine max
  Peptide Sequence Number=SeqID_158840
atggagtttaagcaccatgagaaaactgagttgagcatgcccgcagcaacagcgagtcacaacgactttggaataccgccctcaagtcaaggcgaagaggagccagtggcggcggcgataccagtggcgattccagtgaccccaacaccacccaccttggctcaaaacaacgacaatgagaagtatcatgagtgccttaagaaccacaccgtcaaaactggcgtccacacacttgatggatgcatcaagttcttgcctctaggtgaggagggaaccctggatgcgctaaaatgcctcgtgtgcaactaccaccgaaacttccatcgtaaggagacccccaatgacacctacctggtgccctactaccaccactcgccgttgccattggcagcgtactatggggagcagatgggctacccccgtgtgcaagggcaacaatgcaccacactggcactcccctccaggtcaaggggtagtggtggggcccagtcctcgagggaggacatggaagcagtgtcagacccaacgagtgccactcctcatggcgggtccagcaagaagcgtttcaggactaggttcaccctagagcaaaaagagaagatgttggcctttgcagaaaagcttggttggaggattctgaagaacgatgagagtgtcgtgcaggagttttgtgcccaaactagcatcctacctcatgtgcttaaggatgttctagacacatcattaaagagtaaccttctgttgcaactgtag

SEQ ID NO: 67156 - DNA, 1282 bp, Glycine max
  Peptide Sequence Number=SeqID_158841
ggttttggatgagatgaaaaccaagagctactcttttgacactgataaggatacaaacatctataatggaaacacctcatatcttgtaacatgcacaacgagcgacatagatgatgatctttgcaaggctgctgagctactctatggatctacatactatggtttagagattgatctttggtcattgggatgtgtctttgctgagctattaacatcgaagccattgtttcctggaacaagtgatgtagatcaactcagcagagctgtaagtgtattagggaacattaatgaggaaacatggccgggttgttccaagctttctgattatggatcaatctcatttggtaatgtggaaaatccaagtggtcttgaaccatgcatgcccaattgctaccctaatgaagtttccctagtgcaaaagagacccacaactatggagttacttcaggacaagtactttagggaagaacatcttcctgttccaatttctcaattgcgggttcctttgactagaaatggacaagaccaggattcccctggtgggcacaatgaaatggggtctgattatgatttggaggagtttagcaccttgaatatcaccacaacttctgtgaaaggtgacaaggtttttgctaaatcagatggacattctgataaccataaatctgatggtaagaaccacaagtccaccaacatgcctagtgatttgacaagtgcaggggatcatggactggacaagaaaaaacaagaagcagctattgctgcagggaatggttctgatgatttctatgatggaatcccatggtttaatgattcttttccccacaagtctagtattaaggccagcatattcgaaacacttggtgtaacatccctttccggaaaattctccccagtccctgcatttcaaaagggcagtgaatctggctaccttgataagaaaaatttggacacttgtggtcctgaatctgaatctgaatcacatccagtgagcaagatgaagtcttctaaagacataaatccttattgtgaagttattaggactcatgagaggaataattttccagtttctaaagacaacaaaaatagtttagatcagtcgaagcagtatgatgatcacccaataataggatatttcatttcatcagagcaggtcgatgaaggaggggtcggaggtgaggaaggtgtagatggtgtgttgaagggtgctacagttggggaggaacttagttgcacactgctttggtcttgctgtaaggcagagtcaacggcacgagtgtag

SEQ ID NO: 67157 - DNA, 291 bp, Glycine max
  Peptide Sequence Number=SeqID_158842
atgatcttctacgatgcaaaaacccctaaattctcctcctcactctctctctgttcgtgcctctatcaccgtggagatccccacgaagccggtgaagatgtagaggcacaagtgttcattgctcacgagattgacttggattcttcaccgccgaaagctatcctctttctcgttcgaacatggcatctacatcctccttatcaggtgcattctttgagtgagttccaaacaaccataactcctcaaggcatgataatctggttccttcttgaacaaaatgttgaagggtga

SEQ ID NO: 67158 - DNA, 333 bp, Glycine max
  Peptide Sequence Number=SeqID_158843
atgaagaacggtggaaaaccttcgcgaaatcgcccacggaaatgtctcggaagcgttacggaagcgcctcggcttggatatttttcacggaaacaatttttctcactaattttaagtgattctcagataccaggagggttgaagaaatttttctgccctcctccccctatttataggggaaaagagggaggtggttgccgcccagctcgcctaggcgagctcagctcacccaggcgagctgggttgcttccaccagaaggcaccgccttctgttggaacatcctggagggccctagtgggcctgattgctatttgcacacccctgtttactaa

SEQ ID NO: 67159 - DNA, 126 bp, Glycine max
  Peptide Sequence Number=SeqID_158844
atgacaagagagataaaggatcaagccgatgttttgatgatgccaaaagatcacttgcgtctcaaagctttattcaagacaaagaaattaaagatattcaagatggatgatcaagacagtctatag

SEQ ID NO: 67160 - DNA, 129 bp, Glycine max
  Peptide Sequence Number=SeqID_158845
atggagatcccaagctcaacaatggtggccaaggggaggggggaagggggagagggagttaggagtaggttagtggaagttaggtgtctcaattgggtcatggaaggggttaggcagaggattgattag

SEQ ID NO: 67161 - DNA, 327 bp, Glycine max
  Peptide Sequence Number=SeqID_158846
atgagactagttttactagcaatatttggtttggaatatttggataatttcatacaagcgctacctatctcttggaattttttaaatgaagtaattcatgctaatcattcaacgctaatgggtattgatgatgtgatccgtaaacagcccaacaacttcccaatggcggtttccgccatcgacgacaacaatggaggaagaagaagcaacgcgaaggagaaacgtacctcgaggaagaaactgagtgtcgaagatgaagcagaaacgcgaagaagaaccacacccacagtcctacgtagaaatgcgaagaaatgcgaagaacaatga

SEQ ID NO: 67162 - DNA, 507 bp, Glycine max
  Peptide Sequence Number=SeqID_158847
atgcaacctgacgagcaagttcttgtctctgtggtacttcctgctcttcacgctcaattgcttcccgaagaacttcagcagcgaaaatcgctgttcctggcccatgctcgcgccgccgttcctgccggtgctcgtgccgccgttcctgccgaagttggctgcattctacgtgcagactgcagagggtgtcgcggctgggtgcagctgggtcgcggtgcatgggaggggagggctaagcttttgaatgaattaccgggtagggttggtttggctagcatgccaaaatcccttagctttgtcaacaaagaagacccatctatctccttgagaagttgtagctctggtgatgacaacccattacgggtcgtatgtgagcttgcatccggtgggtctggtggtggtgtagacgcaatcagtctccatataatcccaatttccatggctgtgggtttcataaagaaaccattatcaccctcaacttcaacgacatttgctacccaggaatga

SEQ ID NO: 67163 - DNA, 516 bp, Glycine max
  Peptide Sequence Number=SeqID_158848
gtcagggggtgcgaacacgcgactgctgcgggtcatgccgctcagccccgtgatattggttaccttggccgacagcgtgctgatgttggtggcttcttccttcctttcgcttggaggcgcatacctccatggaactgtgtggttgttttggtatggaaacggaataggtctaactaccgagggggcctcgtagataaaccttctaggggtcgtcacgtccttcaaaggtttggacctgcgcggcctacccgactcgacggcattaaccgctccccctccatgattggcaagcgggttggtttttacgttgggtcagtcctcttgaaaggagatattatagccatctggttggcgacgagggatggcaagaggtcctcgtacgtcattggaatcgcagtgaatcttggagttggcctcaggggaaagttccttatcgcgttggaaccgacgccaaagtgggcattgctggctaggcgagtcgaggttggagccggagcttggggggcctccctctag

SEQ ID NO: 67164 - DNA, 201 bp, Glycine max
  Peptide Sequence Number=SeqID_158849
atggtggtggtggtagttttcggttatggtgaatcatgggttggcagggctataatggtggtgtgtcacgatgctaaggtttataggtattggtcgtatggtaaaggagtagtgatgttgtcatgtttttggtggtgtggagcattgaagaggcagattaatggtgcttacatgtgggtttgggtaatgcaacaatgttag

SEQ ID NO: 67165 - DNA, 418 bp, Glycine max
  Peptide Sequence Number=SeqID_158850
accgccgatcactcgagccttcatcgagaactactgcacgcctaggcaggtgcaaggtgatgcacatcaggacgcagacgtactgccaccacctcggcaggccgatccagctgggtcactgagcgtggagcgttatctacaacattttgttcgccagcaggcggccaaccaccgtgggcaggtgcagatacatgagtgtctctaccggttcagcctcagtctgcagggacagggttccgccccttttgtatgccctactccggagcagtttggggctgaggtcgaatggcctggagactggcccgatgcccaggcaggggaggagcttgcaggatcccctggtgaggcaggtgaatcccatatggatgaagatatgactgacttgctcggtttcttgggagggagcagagccacgtga

SEQ ID NO: 67166 - DNA, 162 bp, Glycine max
  Peptide Sequence Number=SeqID_158851
atggttgtggagttaaggcaacagacggtggagctatccaccctcgtcacacgtgccgctaacgataagtccttcgatatgttagcggcactaaccaatcagagggttcttcccgatctgttgtgttgtgttagagcagcaacatcgaaactagggttttaa

SEQ ID NO: 67167 - DNA, 474 bp, Glycine max
  Peptide Sequence Number=SeqID_158852
atgcacgatgtcccccgagagacgagttctctcctgttcccatggcgtattccgagtagtggccctcattattggaaaatcatttggcggtggccatacccgggaaggtcttccagccaccataccccaagtggtacaactcgaatgccacatgtgcataccatagtggagcccccggacacaatattgactcttgcctgtcgttcaaaggaaggccccaacgttaaaaccaatccactagccagacatggaggggctagtgtaaacgccatcgaaaaggataggccgtcagggtcaaagagattagaagaggtggctacgtctagacgattcatctaccagtcgctgcaggtagcatgcatggtctctcgtggcggaggcgaaagtgacgaatgtatgtttcatctcggggaatcacacgacatggaaacctgccccacggtggaagagttacttcaacggctcatggactag

SEQ ID NO: 67168 - DNA, 360 bp, Glycine max
  Peptide Sequence Number=SeqID_158853
atggggcttgctaagtgtggggaggttgataaatctaggaggttgtgtgataacatgcctacaagaactaaagggaattttgagttgaatgtcgttgttctcacaataattattgacatgtactgcaagtgtggagctatcgtaaagggtattcaagtgtttcgggcatcacccacaacaacaggattatcatgttggaacttcattataatatcacttgccatgaatggctatgagagaaaagcaatcgactacttctcaaagcttgaagcctcagatttaaagccagaccatttaagttttattggagttttaactgcttgtaaatatatagcagcaatagaaaatgtgacatcctag

SEQ ID NO: 67169 - DNA, 554 bp, Glycine max
  Peptide Sequence Number=SeqID_158854
gtcttcctccagagaagcatggcgatcctggaatagaatgggcaaaggcaacaagaagcgctaagcaaggtggtgtccttagaggccaagtggagcgccttaaggtgaccaatgccacagtagcctttgctgaggctgtgaagtcgaaccatcaactatcctccaaggttggtagtgttcttgacaagttgttgtgcactagattagatggtgaggagctacttgagcactacaaagaattgcagagggcatccaaggagagggagaccaacaaggagcttgaagaggagttgctgatgtacaaaaaggaggctgtgcagcaacatgaaaagggctttcataaggctgtttggcaggtcgggttctttgccaaggaccttgacttgggtctttttgacccattcaaggacgtgaaggatggtgttctgcttgatgagaaagatattgttgctgaggagaaggaggctgcggaatggagaaggaagagagagaggagacgccacttcaaggagaagatgagtctagaagaagctcaccaccataggaggccatga

SEQ ID NO: 67170 - DNA, 627 bp, Glycine max
  Peptide Sequence Number=SeqID_158855
atgtctatccttagtaagtctcgcttctccaaaggatcgtcaaacccaaggtccatccttggtgagtcttgtagctccaaaggcttgtcaaaaccaatgttcatccttggtgagtctcacagctctaaaggctcgtcaaacccaaggtccatccttggtgagtctcctagctccagaggcttgtcaaacccaaggtccgtccttggtgagtctcacttctccaaaggctcatcaaactcaaggtccttccttggtgagtctcacttctccaatggctcatcaaaccaaggttcgtctttggtgagtctcgcaactctaaaggctcgtcaaacccaaggtttttccttggtgagtcttgcttctccaaaggctcatcaaatccatggtctttctttggtgagtctcacagctccaaaggctggtcaaacccaaggtccatccttggtgagtctttcttctccaaagacttgtcaaacccaaggtttgtccttggtgagcctcaacccatcttcacgggcttgtcaaacccaaggtccacccttggtaagcctcgccaaaacccaagatgaacgagtccctggtccaaaatttgttaaacctaaggaatacatgtctgtaggaacataa

SEQ ID NO: 67171 - DNA, 393 bp, Glycine max
  Peptide Sequence Number=SeqID_158856
atgggatcaaatcaaacacctctgcttaagaaaaggttctatcaagtcaaaatcaaaagcttagaggtcgctagtttacgagaattatggcaattgatgggtcagctccaacgtcaagcctttcgcaagaccaacgggaagatttgggacctagctaagataaaagtctccgtggaagcaattacatcccttactcagtattatgaccagcccctaaggtgcttcacttttggggacttcaagctagtactgactgtggaagagtttgaagaaatcctgagatgtacactgggaggaagaaagccatatctctttttggggttctatccctctatggcaaaagtagccaaggtagttaagatctcgatacaagagttggaccgtttgaagtaa

SEQ ID NO: 67172 - DNA, 699 bp, Glycine max
  Peptide Sequence Number=SeqID_158857
atggctaaggtactcatcgacaacaactcatcgcttaatgtcatgcctaagagtacactgaacaagctgcctttcaacgtgtcacatctaaagccgagctccatgatagggcgcttggtcatcatctcgagggagaaggatattctagtaagttgcccttcttctatgctgtatgttaaagttgcggaagaatccttggagacgacttttcagtcctttgaggtagtgagcaacgcttttgtggaatccctcccgatgcgatcccgcatttttgacgctgcgattatggtagcccgtgagatgttagggcacggatatgagcccggaatgggcttaggaaagaacaacgatggtgtggccagcttggtggaattcaaggaaaaccgcgggaggtttgggctaggctatagacccatgcatgcagatgaaagaacaagcacccaagagaggagaagtaaggacatgggccaacaaccaaggctgcaagtgaaagaagcccctcctcgccacatcagcaagagcttcgtgagtacgggctggaggtgtgaagtgcaagtcgccatgatacacgacgatgccccccaaaagcgttcaaactgggaccctgacgtcgattttgaacaaatagcaagccaagttgaggatggagaagatgaagatatgaggttttccccggagctagaaaggatggtctcttag

SEQ ID NO: 67173 - DNA, 753 bp, Glycine max
  Peptide Sequence Number=SeqID_158858
atggagtttaagcatcatgaggaaactgagttgaggatgcccgcagcaacaacgagttacgacgacttcggaataccgccctcaagtcaaggcgaagaggagccagtggcggcggcgataccagtggcgattccaatgaccccaacaccacccaccctggctcaaaacaacgacaatgagaagtatcatgagtgccttaagaaccacaccatcaaaactggtgtccacacacttgatggatgcatcaagttcttgcctctaggcgaggagggaaccctggatgcgctaaaatgcctcatgtgcaactgccaccgaaacttccatcgtaaggagacccccaattacacctacctggtgccttactaccgccactcaccattgccattggcagcgtactatggggagcaggtgggctacccccatgtgcaagggcaacaatgcaccacactggcactcccctccaggtcaaggggtagtggtggggcccagtcctcgagggaggacattgaagcagtgtcagacccaacgagtggtgccactcctcatggcgggtccagcaagaagcgtttcaggactaggttcacccaagagcaaaaggagaagatgttggcctttgcagaaaagcttggctggaggattttgaagcatgatgagagtgccgtgcaggagttttgtgccgaaactagcatccaacctcatgtgcttaaggtgtgggtgaacaacaacaagaacaccttaggtaagaagctctag

SEQ ID NO: 67174 - DNA, 528 bp, Glycine max
  Peptide Sequence Number=SeqID_158859
atgtctttctctattcttacctctagggttcccaaaattcgtgagagatctctctcgccgcaccgctccgctggaaccatgatctctgcacaggacgactaccaccgccactaccacttccagccgcagcttcccaactctattgacacctctcgcacaaaatatagaaatgcttcccgcatgctgggtgatcagttagctcttgcttcagttgagatgtcaaaacctcattttgacaccagcaagtttgccaaagctcttgctttctctgaagatattgggggtagttcaatattgtttttaccttgttctatgtacaattggactctgcctgagggtgctggtcaatttcatggtatgccattggatgttaagatttatgctacccatcaactagaattcttggaagttgcagacctcatttttgaaagctgcagaaaggcagagtcaacaccaaataacttatgggaacatttgctcttttatcttttggtggcaccatcttcatactgggaaggactgttttaa

SEQ ID NO: 67175 - DNA, 2166 bp, Glycine max
  Peptide Sequence Number=SeqID_158860
gggaattgtgaacaagggcctgtttcatttgttgcatccaacgttgtggtttgggtgctggttggtgggttggattggggcaagtggagggtggaatacccaattgggaaaattatggcgggaattgatgctacaaagtatggtcatagtcctgtgcacaaggccttagttttgaaggatcatggtgaactcaggaggatacttgctggcctcccacggctgcgtagcacggccgagattcgcactgaagcggtttcgattttagaggaagagaaggctgatgccatcgctgctgtgattgaccggcgtgatgtgcctaaccgtgatacccctcttcacttggctgtgaaattcggggatgaagtggccaccgagttgcttatggttgctggggcagattggagtttgcagaatgagcaagggtggagtgctcttcaggaagctatttgcagtagagaagagggtattgccaagataataattaagcattaccagcctctggcttgggcaaaatggtgcagacggttgcctcgcttggtagggaccatgcggaggatgagggacttctacatggagattacattccattttgagagttctgtgattcctttcatctcaaggatcgctccttcagacacatacaaaatttggaagaggggtgcaaatctaagggcagacatgactttggctggttttgatggtttcagaattcagagatcagatcagagcattcttttccttggtgatggttcggaagatgggaaagtcccacctgggtcactctgcatgatctcacacaaggaaaaggaggtactcaatgctctagacgatgctggctttccagcaaatgatgaggaggttcagcaagaagtggttgcaatgtctaaaacaaatatatttaggcccgggattgatgttacacaggcagttctgttgcctcagttgacttggaggcgacaggagaaaacagaaatggtagggccttggaaagctaaggtctatgatatgcacaatgtagttgtgagcataaaatctagaggagttcctggagccatgacagatgatgaactcttttcttcttgcaatgaaaatgaaacagagagtgaagagctcaatgatattttgactgaggatgaaagaaggcaattggaagatgcactaaggttggattcgacagacttgaacaatgagagtgatgaggtgatcattgggcatcgtcatagctgttatgaacatagagaaattcctattgaagaaggaaattataacaaaagtggagaaaataagctggaaaagaaaggatggtttggtggatggaggaaaaaggattctaaacctgaagctccaaagaagattgctccgccaagaagttctctctgcatagaagaaaaggtgagtgatttattgggggattctccttcaagaaatcagagtaagccaggaagacattctgttgagatagctgtgaagggtgatgagtcacggaggagaaaagatgccaaagcttcttctgcaaattctgatagcagaagtcgtcacaaggatggaaatcgtgaaaatgaatataagaaagggttgagacctattctttggctttccccaaactttccactaaaaactgaagaactcttgccattgcttgacattgttgcaaacaaagttaaagcaattcgacgtttaagagaactccttacaacgaaacttccaatgggaacttttcctgttaaggccgccttagctatgacttctttgggggctgcctcaattgcagcccgccttaataagatgaggattgcccagctgtctatttttagttggttttgtgagcttgttgccatccctgtggttcccaccatcagagtattggttacttttacaaagtttgaagaactagagccagtagacgaatttgcaacaccaccatcaagcccatctgcagctgagcaagagagccctgcagtgcctcacttctcggcatcgtcttggtttcaatggataaaggctccttatcgctctagtacatctgctccaggatccagcagtaggatagaaaatattgaagacccttttgcaattccatctgactatacttgggttactgctgaagcaaagaaaaagaagatgcaagagaagaacaagtcaaagaaaggaaaaagtcataactga

SEQ ID NO: 67176 - DNA, 564 bp, Glycine max
  Peptide Sequence Number=SeqID_158861
atgcctggacaatatgcattagactacatcaactggttctacttgatttcacattccttcttgagcccaacatatctcggggatccagtcagacatccacctatcgtgcaagatgacacatatgtcgaaccagatatgcctcagtactcgttggcgacatcagctatggaggaaacacctgcacatgcagcttctcacgtggagcaacctcaacatgcagtggaggcttgccaagcaatagctaaaaggttggagcggttactcaacctaaggatagtgactaaaggcacaaaaacatacgatgtcatggaagactgcctaaggatcactagagtgaaaaacctcgtcgggcgcctaagagtacatgacgatacatgcctcacaatgggtaagtcaagtcactggggagaccagtcagggtcactctgttttatgagaatgctccaaccatgtgggattaacacaagcttgaagaagcactcaaaccaagtgtatttacccccaaggcctagactccgaggagtccatcaaggcctccccctcctgattcagaaaatattttaa

SEQ ID NO: 67177 - DNA, 663 bp, Glycine max
  Peptide Sequence Number=SeqID_158862
atgtcggcaatcgaagacgaacaactgcttacctcgacaatgctgacacggatggagaacaccaccctcaaaatgcctgggctactcaaaaccaacgagcaccacgatcacagaacacaaactctcggcatggaggaagaagacgacgctcacggggggaacacgacatggaggacctcgacagtgggtcaagcttttttgaaaccagcaaccacttcatgcaaacaaaacgaaaggaagaagaacgtggctgaggtgaggccaggagtgagaaaggagaccaaaaccacttcacgccagcaagaagaagaaaaaatggtgagaggtcacgaggaagaagaaggccaaagcgggagggagggagggagagagatgaaccgttcttttttaaaaaaactaagccaggggtacaaaggaggaaggtgtcgtggtgcttcttcttcgcatttctgcttcttcttcgtcgtccaccgtcgagggagcttcgtgaccgtccacagtcgaggtaagcaccgtgaaccttttctttttttcaccagtgttgccgacgatggcgtaaaccgctatcgaaaagttgctgtgcattttacaaatcacctgatccgtaagcatgttccggatcaagttgatctggaagatgcttacggatcaagtgatccgtaa

SEQ ID NO: 67178 - DNA, 1647 bp, Glycine max
  Peptide Sequence Number=SeqID_158863
atggcaggcattaatgtctcagaatatgctcatagttctgtgcacaaggccataatattgaaggatcatgctggtcttaaggagatacttggagttctcccaaaactaggtaacccccttgagatcaaaactgaggctgcttcaatagctgaggatgagaaagctgcagccatctctgttgtggtggataggagggatgtgccacatggtgacacccctcttcacatggctgcaaaactgggtgacattgttgctactgaaatgctcatggatgccggggcaaatggtaggttgaagaacaaggaaggatggactgctgttaggcaagctatcattaacaaacaagataaaatagcaatggttatgatcaagtactcttggaatgaccctgacaacaaatattttagaaggttgcctaggtatatagggactatgagaaggatgaaggacttctacatggagatttcatttcattttgagagttctgtgatacctttcatctcgaggattgcaccttcggatacttacaagatttggaaaaagggtgggaatatgagggcagatatgactttggccggctttgatggtttgaaaatcaagaggtctaatcagagcgttcttttccttggtgatggtacttcagatgatgagagcaaatttcccggatcgctgttcaaagtcttgcacaaagagaagaaagtatatgtggtttcacctagtttagatgcccccactgatagagatgttaaggacacattagctaagaagtctaggtctgaatcagtgaggagggtagggcttgatgtgagtcaggcacttcttgttccccagttaacatggaggagaaaggagagaaaagaaatggtggggccatggaaagctaaggtgtatgacatgcaaaatgtggtttttagtgtgaaatccagaaggatccctggtgctccaccacctgaggcgaagccagctcctaagaaaactaagaagaaggacaatggaaaaattgaagacattttgacagatgaagaaaggaagcaatttgaagctgcaatgaattcatcagatgataatggccacagtcacaatcgtgcgaagaaagaaaagaaaggaaggtctggtggacatagagaccacaaggagagaaaaaccaatagtgcacaacctgctgagcattttgtaaaccagaagggtgaaagccagtttaagagagggatgatgcctgctctttggctttcccagaacttcccactaaaaattgatgaattgctacctatgcttgacattcttgctgaaaaacttaaagcggtccgtcggttaagagaactccttacaacaaaacttccaaaggaatcctttccagtcaaggttgccattcccgtggtgtccactgttagagtattggtaacttttacaaagtttgaagaaatacaacatgaaaatgcagatgagtttgaatcagccccatctagtcctacttctggtgaccaagagaacccagaagaggaacgttcctcatcatcatcatggtttgggtggataaagaccccttctagatcaagtacgacatgtgcggaatctagtagtaaaatatttgacgccgaggacctgtttgctattccctctggttttaaatggattactattgaataa

SEQ ID NO: 67179 - DNA, 532 bp, Glycine max
  Peptide Sequence Number=SeqID_158864
atgaacaagaatgtggtgtttggtaccctagatgatgttttgcagtgggctcgatccgttgctcatggaaacaaatttgtggaggtcattatgaggtctgacacaaacactggtagtaaagaaaggacttcatttgtgttaattggttgtgaaaggagtgatcagtataggtctaggaagaaagattttgttagaagagatactgagagtaggaaatgtgggtgtcccttcaagcttcctgggaaaccagtggatgaaaagacaattattgttgatatgaccaaggcaatggtgaaaccaagaaacattttgctaatgttgaaggagcacaatgtcaatagttgtacaacaatgaaacaaatatacaatgcaagaagtgcataccgttcttccattagaggaagtgatactgaaatgcaacatctaatgaagcttcttgaacgagatcaatatatttattggcatagattaaaggatgaagacgtgggtgaacatgttaataatgtggtatgggctttagaatggttccaag

SEQ ID NO: 67180 - DNA, 252 bp, Glycine max
  Peptide Sequence Number=SeqID_158865
atggcacctttaagaggtcttgcgcctgaaggtgctgagatccgtgcttttgaaaagcacttagaaggatggaaagggaagaatgtgtctattggatgtaaaatcgtgattattaagtcggtgctaagcagtcttcccttatacttccgctcattttatttagcccccaaaatagttttggatactttggtcgggaatcaacaaagatttttatggggtggcgctaatgcgggaaacagatcagctggataa

SEQ ID NO: 67181 - DNA, 354 bp, Glycine max
  Peptide Sequence Number=SeqID_158866
atgaaggacaaatatattgttcaaagcttgttaaagaacttagaaaaaatcaagaacaagcttgttcgcacatcgttcgcgtgtatgatatccactccacaagcttactccacacaatggtggcctcttgggaatgaagcggctattcctccttctaatgacgcatggacacttatccatgacccaactacaattcgtgcgaaaggtcggccaaaatcaacaaggataaggaatgagatggattgggtcgaaccatctgagcaccgacaaaaatgtagtagatgtggagccgaagggcataacagacgtcgctgtccaatgcaatctgagcatgggagttgttcaaatcattga

SEQ ID NO: 67182 - DNA, 201 bp, Glycine max
  Peptide Sequence Number=SeqID_158867
atgcaaggtcataggttcaaggaatggggatttgataaaggttggggcaacattgcaggaagggttaaagagacaatgaaattgctctatgaggtggtatatattcttgatcaagtaagggccttagaggaagagctactccataagattgagttgcaagtccttgacgtgaagcctcagattcttgtcgtaagctactaa

SEQ ID NO: 67183 - DNA, 645 bp, Glycine max
  Peptide Sequence Number=SeqID_158868
atggagtttaagcaacatgaggaaactgagttgaggatgcccacaccaacagcgagtcacgacgacttcggaataccgccctcaagtcaaggtgaagaggagctagtggcggcggtgataccagtggtgattccagtgacccctacaccacccaccctggctcaaaacaacgacaatgagaagtatcatgagtgccttaagaaccacaccatcaaaactggcgtccacacacttgatggatgcatcaagttcttgcctctaggcgaggagggaaccctggatgcgctaaaatgcctcgtgtgcaactgccaccgaaacttccatcgtaaggagacccctaatgacacctacctggtgccttactactaccaccactcgtcgttgccgttggcagcatactatggggagcaggtgggctacccccgtgtgcaagggcaacaatgcaccacactggcactcccctccaggtcaaggggtagtggtggggcccagtcctcgagggaggacatggaagcagtgtcagacccaacgagtggtgccactcctcatggcgggtccaacaagaagcgtttcaggactaggttcacccaagagcaaaaggagaagatgttggcctttgtagaaagcttggctggaggattctaa

SEQ ID NO: 67184 - DNA, 177 bp, Glycine max
  Peptide Sequence Number=SeqID_158869
atggatgacgttgctactttgcaacattcttcccagcgtccacaataccgatctcccctgcgaaaggatcatgcccgcaagacacccagtggactcgaagaagtccaacagggtcctagggtttctagctctgattacgggcctctgtcagttcaatggagtgcccgtcgcccctag

SEQ ID NO: 67185 - DNA, 424 bp, Glycine max
  Peptide Sequence Number=SeqID_158870
agtccacaaggcgtggaggagcccgctgaggaaagacaaggagcttaggggcatccgtaatggcgccatcggaggttatcatgggtggctaagaattcatacgcgagggttagattggctctccagattgaaagttatcgatgaagaaaacttcgaagccccggaggaagatgaagaagtccaagctctaaaattagagctagggaaggcaagactcaccaaggagaagttcaaggtgatcgatgcattgcatcaagaagcgactatgtggatggataggttcgccttaaccttgaacggaagtcaagacctcccgcgactactagccaaagcaagagccatcgctgaagtgcgtacagcccctgaggaagttcacgggctaatcaattactatcaacacatgatagatggcccacataattag

SEQ ID NO: 67186 - DNA, 261 bp, Glycine max
  Peptide Sequence Number=SeqID_158871
atgtcggctattgtcttttctattcaatccctgaataatatttggatgatgcctattaggaaatgttcgatcggcgtcatccggcgatgcttctttttcaaacctcgatcggtcatctttcctggccgaagtcggctagcatttttttcgatcagtgccggtgaatcactgtttttctgccgaggaaatgttcgatcggcgtcaccaggtgacttttctttaggcctccatctgttaactttcctggccgatgtcgtctag

SEQ ID NO: 67187 - DNA, 276 bp, Glycine max
  Peptide Sequence Number=SeqID_158872
atgggggtgcaaatagcacccaggcccatttgggccctccagaagattcctccagaaggcggttgcttctggaggaagcaaccctgctcgcctgggcgagctggggcggcaaccacctccccctattttgctataaataggggaggaaggcaagaaggaagggccgaggcgcttccgaaacgtttccgtaacgttttccgtgaggaatctcgcaaagctttcaaccgttcttcgacgttcttcattcgttcttcatcgttcttcgatcttcaacgg

SEQ ID NO: 67188 - DNA, 92 bp, Glycine max
  Peptide Sequence Number=SeqID_158873
cgggtgctatccgagaacaattggccgatctggatttgagaattcttatggattcttcgttgatagaatggaaagaattagggatcctctag

SEQ ID NO: 67189 - DNA, 392 bp, Glycine max
  Peptide Sequence Number=SeqID_158874
tggctgagacatcgagcttggattggctcccaaagctaagggctgcgagagaggaagaggccgaagctccggaaaagaggacgtcaatatggccaccaccgaagccttggaacgagaaaccaaagctaaacctagtggcgactcacgagcaaaggctagaggatgattacaccaagatatcagcagaaagggaagcaagggaaagggtaattgactcattgcacagagaggcaatgatgtggatggacagattcacctttactttcaatggaagtcaagagcttccccgaatgctagctaaggccaaagcaatagtggacatttacggaaactcacggattctaaaactctgtatgggtgatgtagaggatcccacattagaatcaggatga

SEQ ID NO: 67190 - DNA, 2817 bp, Glycine max
  Peptide Sequence Number=SeqID_158875
atgattgaacaacgactgtccgaacaacgtggcttaggcgatcacggctggctgcattcacgccataccttttcgtttgccagctactgggaccctcaacagaccggtttctccgatctgctggtgattaacgatgatcaggtagcaccgggtcgcggtttcggtgcacatccgcataacaacatggagattatctcctacgtgctggaaggcgcgctggagcataaagattccatgggtaccggttcggttatcgtgcccggtgacgtgcagctgatgagcgccggcagcggcgtgacgcacagcgagtttaaccattcgaaacaggacaatgtgcacttcctgcagatctggattgtgccggcagaacgcggtaccgagccaggttaccagcaggtgtcagtggcagaggccgacaaacgcggccagctgcgcctgattgtttcgccacaaggcgacaacggctcgctgcgcgtacgtcaggatatgcgtatttacgcgggactgtttgacggtgccgagcagcagacgctggaactggctaacgatcgttatgcttatattcatgtggcgcggggcagcattgaagtgaatggcgtgagttttaaagccggcgacggcgcgcgcgtacgcaatgagacggcgctgcagttcgctaacggtaacaatgctgaagtgctggtgtttgatttacgaccagtcgaagttaatcacccgcagcgtacgaataataaccagcgcctgacagtggtattggttttagccttttctgtaacggcttgtggcatgtctcatcgtggccgtaacaccgccattggcgccggtgtgggtgcggtcggcggcgccgttctgaccggcggcagcaccttcggtaccctcggcggcgcggctatcggcggcctgattggtcacgaagccatcgacaacggcctgcgcgacaaagtcatggcgatagatgccaccgtcgaccaccagcgcggcgcagacaatcgcatcaaatttgccggtttcggccaggcgtttggccagcagcggcatttcaaacgcgccggactgacggcttcatgtgcaaagccgtctggcgcaaaggcgagcccgatcgctggcgtcgattcccttcacctgtatctgcgggtctcagttatcactgagaggccgatcgtgctcggtagcggcgtgtccgggctttgtgttgccacgctattggctgagcgcggcgaaaccgtcgaggtcattgatgatgaagcgcgtcagcctgcctcgtggtttgccggtggcatgctggcgccgtggtgtgaagcagaaagcgcgccagcggaggtgattaccctcggccagcatgctgcggcctggtggcaaacgcgcgtcagcagcgtggtgcatcagggtacgttagtgctggcaccgccgcgtgataacccggagttaaaccgcttcgcgcgcatgacgacggcgcatcaatgggttgatccggcgtcgcttgaaccggcgctggaaaaccggtttgcgcgcggactgtttttcccgcgcgaggcacatctcgatccgcgccgcgcgctgtctgagctgcgtgacaaactgctgcagcgtggcgtccgctttgatgcgcgccagccctcgggccggatcattgactgtcgcggtatccatgccagagcgcaactctccggcctgcgcgcggtgcgcggggaaatgctgatcctgcagagtcatgaggtgtcattttcccggccgattcgtctgctccatccgcgttttccctgttatctggtgccgcgtcgcgacggccacttcatgctcggtgccaccatgatcgaaagcgacgatgccagcgctatcagcgcgcgcgccatgatggaactgctcagcgcggcctacaccctgcatccggcgctggcggaagcgcgcgtcatcgaaagcggcagcggtctgcgtccggcatggccggctaatctgccggaaatccactatcacaacgcgatgaatattcagcttaacggccgcaccatcagcactgaggccaccagcctcagcgaattgctgatcgaacagcaaattgacgcggcctgtgttgccactgcctgcaatggcgattttgtgccgaaaagctatccttcaccggcgattttgcagcaggcgatcgccgcatccggcagtgaaattatcactgtcagcctgcgccgcgaaggcacggcgggcgcggcttttcgcgagctgctgacgggcatgaatgtgcgcgtgctgcccaatactgctggctgccacacggtcaaagaggccgtcaccaccgcgcacatggcgcgcgagttgtttaacacgccatggatcaagctggaagtgattggtcatgccgatacgctgcagcccgatccgttcgcgctggtcgaagcggcacgcattttgtgcgccgacggcttccaggtgtttccctacaccacggaagatctgattgtcggtgaaaaactgctggccgccggctgtgaactgctgatgccgtggggcgcgcccatcggctccggccagggactgcgaaatattgacgggctgcgggcgatgcgtgcctggttcagcgatattccactgatcattgatgctggcatcggcgcgccgtcacaggcagcgcaggcgatggagatgggcttcgatgccatcctgctcaataccgctgtggcgaaagcgggcgatccggtggcgatggcgcgcgcgttcagccatgcgatcgctgccgggcagggggcgcgcgaagccgggctgatggagaagcgtgatatggccgtggcctcaacgccgatcttcggcctcgctaacctgaactaa

SEQ ID NO: 67191 - DNA, 1586 bp, Glycine max
  Peptide Sequence Number=SeqID_158876
acactgtcgccagcctctttgctgtttttttcacctgcggtacggataaaaacatgtcatcagtacaacctcaactctctcagctcccggacgaggcctcgctgccgcgtcacagcgtgccaaaagcgctgttcgcgctgggcaccggtggatttgccatcggcaccggtgaatttgtcatcatgggcctgctgcccgatgcggcgaacggcctgaacgtcacgattcctgaggccggccatctcatcagcatttatgccctcggcgtagtgattggcgcgccgctgctggctattctcggcgcgcgggcttcacggcgtaatttcctgatgacgctgatgggcctgtttgcgctgggtaatctgctgagcgctgtcgtgccgggctaccctgcgatgctggtagcccgctttctggcgggctttccgcacggcaccttctttggcgttgcggcgctggtggcggcaggactggtggagcgcgcgcggcgcgcgcaggcggtgtcgatggtgctgctgggattaaccatcgccaatctgattggcgtacctgccgttaccgccatcggccagtggtttggctggcgtgatgcgtttgccatcgtcggcggactggcgctgctgacgctgttactggtgtggctttgggttcccaatgtggccggtgacaagcaggccagtccactgcgcgagctctcggcgctgacgcgcaagcaggttctgctgacgctggcgattggcgcgattggcagcggcggcatgttctcggtattcagttacgttaaacccaccatgatggaactggcccacctgccggaaaatttggtaccggcgatactggcgctgtttggtcttggcatgattatcggcaaccttgtcgggggacgtctggccgatcgcgggctggagaaaaccatccgcattgtgctggtgtggtcgctgctggtattgagcgcgtttgtctttgccgcgcattatgcgctggcgggcgcgcttaacgtgatgctggtcggcaccatggtggcgctgggaagcgtgctacagatccggctgatggacgtggccggtgatgcacaaaccctggcggccgcacttaatcattcagcgtttaacattgccaatgcgctgggggcgtggctcggcggcatcaccatttccgccgggctgggctggcagtccaccggctgggttggggccattctgtccgtgctggggctgctgattcatgccgttgcgacatctgccgttgttactgctggtcgtcattattcccggattactgctggtgctgtttcttgctgcaggcggttggctgacgccgcagcgcctcagtgcgcaaagtctggtgcagtcgctgcagcaaaacagcggtgtgcatccgggataccggcgcaatcatgccaagggcgtgtgcgttaccgcgttttccagccgggtacggtgccggtgattggccgctttgccattgccggcggtaatccgcacgcgccggactatggcgtgccggtgcgcagcctggcgctggaatttcagctggcgcacggcgagcagtggcgtaccggcatgaacgcgctgccgtttttcccg

SEQ ID NO: 67192 - DNA, 525 bp, Glycine max
  Peptide Sequence Number=SeqID_158877
gaagctattaaatccagtagcactgacattgtcattgatcctccatctctcatcagacgacacgtgaagtggaagatggtttgcaccaagaaaattggccaaatgacgtctgaggcagcaaaggaaattgctgacaagattggttcctttgtcgcccatggacatcatgatgtaatgattgctgccattgggcgactagaacaccttggtcatgtgcatgctgctggagctgatatgcaatcacagggactcacattgcctcttgagcctgaagttggtccttcagctactcgtgtcagcacaaaggattgttgtgttgatccctcagggaacgacctaggcatgggtggcttagagaaatgcgggttgtacgtcaaagaaaatccttctcgccaggttgccctaggaagaatttatgaggggttgacaaccattcacaatatctctttgcgcaatgatcaagtcaaggttggtgttgaggaagttagagatgcagatgctcctattcatgtacccactcaagag

SEQ ID NO: 67193 - DNA, 381 bp, Glycine max
  Peptide Sequence Number=SeqID_158878
atgcacattaggccgcagacgcaccgccaccacctcgacaggccagtctccaggccatgcgacctcagtcagcaggggcagggttccgccccttttgcatgccctactccggagcagtttgcatgccctactccagagtttgggcctggagactggcagtgtctctaccagtttagcctcagtcagcaggggcagggttccatcccttttgcatgccctactccggagcagtttggggctgaggtcacatggcctggagactggcccgatgcccaggcaggggaggagcctgcaggatcccccggtgagccagatgagtcccatatggatgaagatatgactgacttgctcggtttcttgggagggagcggagccacgtga

SEQ ID NO: 67194 - DNA, 135 bp, Glycine max
  Peptide Sequence Number=SeqID_158879
atggacacctgtctccgtgtgattggtgatctcatgaatggagttcaacggggtcacaaaccactctttgaggattcacctagtgagtgtggtggtggggctgccattgtgagatatgggctaatatctaagtga

SEQ ID NO: 67195 - DNA, 477 bp, Glycine max
  Peptide Sequence Number=SeqID_158880
atggatctagggatctcccaatcatgtggctctgctccctcccaagaaatcaagcaaatcggtcatctcctcgtcctcgcgggcctcatctgcctcaccgggagcctctgcgggtgcctcccttgcctgggcctcaggccaatctccgggccatgtgacctctaccctgaattgatccggagtagggcatggaaaagaagcaaaaccctggctctgcaggctgaggctaagttggtagagagagtcatgagtctgcacgtgcgccctgtggctcacgggtgcgctttccaaaggaggaaagatgtgcggagtcgccaccaacggaaaacgtcggaaaaactgaaggaaactggtcaaaatgaaaattctgttcgggagttgtatttacgtttgaggaaggtcaacaaaagcggggctcttgctcctacgtaccctccatcgaagaggaaatcagacctacgtagttctctcttaagg

SEQ ID NO: 67196 - DNA, 204 bp, Glycine max
  Peptide Sequence Number=SeqID_158881
atgcctgtttgcgggcgagcgaggcgaggctcacgggtcgacaaaagcggggctcttgctcctacgtaccctccatcgaagaggaaatcagacctacgtagttcttttttaagggtgaatcaagcgattctttttacttggaaggtgatcattttaaggcgttggaccttacaaatgatccatttacttggtaagaaaaactaa

SEQ ID NO: 67197 - DNA, 555 bp, Glycine max
  Peptide Sequence Number=SeqID_158882
atggctgctagtgaccacataattttgcatgatagagttcatattcctatcaagaagagtttattggagctttcatcacaagatgctttgttggcccaaaataagttgttgtccaagcaacttgaagctttaactgaaacactaagtaagttgccaactcaattgcatgctaatcaaactttaccttcttctgttttacacgttgcaggttgcacactttatggtggagctcatgaatcaggctgttgtattcccactgaagactcaacacatgaagttaattacatgggaaacaccctagacaaaattttagtacagggtggaccacctaacaagccacaacaacaagggcctagcttatatgagagaacaacaaagttggaagaaactcttctagccaaacagctagcagaaaaatcttctagtacttttggagctaacactgagcagaatccaaaagaagaatgcaaggctgtgatgacccaaggaaggaaggtaaccatggaggaggagaagaagaaggggaaaatggtggaggatgacaaacaacagttg

SEQ ID NO: 67198 - DNA, 93 bp, Glycine max
  Peptide Sequence Number=SeqID_158883
atggcttcttcagaagcgtcgagtaactgctttgactgtggccgtaacccatcaatgaagatgttcagctgtataggctctgaaaaaccatga

SEQ ID NO: 67199 - DNA, 201 bp, Glycine max
  Peptide Sequence Number=SeqID_158884
atgatatgtccattacgatgccatgaagagatgcatgatgcaatcgaggaacatgccagaataaggcttcactgttatcaagcgagtcggagacccaacatgatcacagatcgacctccactccttatggctcacacagacccggatatagggcctaatatctcaatgtgtgtgcgaggtgtaggtgtcatgtgtgcatag

SEQ ID NO: 67200 - DNA, 150 bp, Glycine max
  Peptide Sequence Number=SeqID_158885
atgggggtattgattggatatgacttgctgatgcaatcctaccccgcaagggcattggatagaaaactccaagtagattgggccaaagatgcaagagaaggccctagggttcttatgagccttagggtagatttcgagcccatggactaa

SEQ ID NO: 67201 - DNA, 1019 bp, Glycine max
  Peptide Sequence Number=SeqID_158886
tctgctcgggctcaaggaagacattctggttggtggagggatctaagaaagttgtatcattatgatgggcagagcatttttcagcattgcatgagatggaaggctatgggacctctatcagtctctccagtggaccattttcttcagttttgtgatggttttggagctgagagaaatcatagtacttactgtggatggtgggttgcgttgacaagtactatatggaagcataggaacttcctcatattccagaacaaacctttcgagccgcagaagggcagcaccaatggtgccttgtatttcctatatccagtaccacttgagcccactaatattttgcaatatgctgacgacacggcttttgagggagaggctctttgggagaatgttctagttttgaaggctttgctgcgaggttttgaattggcttctggattaaagatcaactatgccaaaagtcagtttgggattattggagggatggagttccagcttcgaagagataaaaggggattttccaattggtggaaggatctgaggaagatttaccaccagtctcagcacaacatttttcatcaaaacatggtttggaagataggttgtggtgacagaattgatttctggcatgacagatgggtaggcgaatgcactcttaaacagcaatacaaccaacttttcatgataagcagtcagcaacacaacctcatttcaatgatgggtaatttctcccaggacaattggagatgggatttgcagtggaggagaaatctttttgatcatgaacatgacttggctgtgagctttatggaagacattccatctatatgtattcagagaaatgtgaaggacattatgatgtggaaagctgaacctaacggtgtgtactccaccaagtcagcttatagcctaatgctgaagctaaatgattccggttcacaagacaagctccccaccaaagggaatatgttaaggagacatgtggatattcaagatgctggttgcccactctgtggccaagg

SEQ ID NO: 67202 - DNA, 606 bp, Glycine max
  Peptide Sequence Number=SeqID_158887
atgcacgaaatgggcctcctctgccttaccgggggatcctgcaggcttctcccctgcctgggcctcgggccagtcttcgggccatgcaacgtcagcctcaaactgctctggattagggcatgcaaaaggagtgaaaccctgcccctactgactgaggctgaaccggtagagacactcatgtatttgcacctgcccttggtggttggccgcctgctgggtctgatgaggtggtggcggagcgtctgcggcctaatgcgcatcaccctgcgcctggctaggtgtgcagtacttcttgatgaaggcccaggtgatcggcggtcggatcaccttactacgggtgacgggaaccccgaacaattggcagaggcccgtgatcaatgccagaaacctagggcccaattagacttatccgggtctagagggtgcctggtgggcaggacattgctgagcagcagtgccatgcacgtctgggtcaaggtggtcatgctggtgcgtatgatccgcacccgcctccctgcagcggtccgggcgaaatcctgccccggtgtgtataacaactgggcaatggcctcctcgtcgaacccgtcggccctggtcctcctctag

SEQ ID NO: 67203 - DNA, 378 bp, Glycine max
  Peptide Sequence Number=SeqID_158888
atgtctaaccataagagtactgagtcagccctaaaaaaccttgagattcaagtgggtcaactggttaagcagttagctgagaagtcatccaattgctttggggaaaatactgagaagaatcccaaagaagagtgtaaagttgttgcgacaagaagcaggaagcttgtggcggctcaggatgaagatgttgttgctttgaaggagcaagttgctttgaaggacactactgttaaaaagaagaatgagatgaagaaaagagtaggagtgaaaaagaaagagaaaagaggaaataaaaagcttcagataagggtacgaaagtgccatatcccgtggtaccttccaagaaagataaggaccgccatctggcgagattcctag

SEQ ID NO: 67204 - DNA, 933 bp, Glycine max
  Peptide Sequence Number=SeqID_158889
atggcatccaggaaaaggaaaagcatcgcttctaggcctcaagctcacctgaataccttcttagagaccccagtagttttggagaaggagggccatccttggaagcttttgaggaaagatctcaccactcttgcacagacatggaatgtcctctcctacaacaacctgactcccacttcccacacctctgatcttaatattgacagagccaggttggtttacggcttagtcacaggtatggacatgaatatcggagccctaatcttaggtcagatttctaccattgcccagagtaactcctccagactcggattcccagccttgatcactactctctgtagagctggaggagttacctctgacagtctaacttatgagagcctgagcccagccattaacttggcctacattaagaaaaactgttggaatatggatgatttgacagttaacttcagaggggctaggaaggtaagggctcgaccagcagatattccttcttcttccgcaccacctgctccttccacttctgccactcctacaccagctcctcccatttctgccacccctacaccagctgcccaagactctcagtgctttgaagccatgcttcacaaggtggtagctcctctagggtctattctgtcagtagagcagttcattgagaagagacaggaggctgctactcttgagaggacaccacagaccctagaagatccactctcaccagggatggactcatcttttgctcagcaggtagaagatcctcctacagcagtacatgagagacaagcagatcctcctacacccatcatggagatgccagaagaccctaccacaccagtcctgagactgccacccactcctccagctaccccagttttacatctgacagatgaggaggatatgcaggaccaggacacacaaggcacatag

SEQ ID NO: 67205 - DNA, 504 bp, Glycine max
  Peptide Sequence Number=SeqID_158890
atgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccggagcacgacccggccagttaaggacaggagcgcatcgccggcagaaggacgagccgaccggtgcacaccggagcggaccgatcgacccaacccaggtccactacgagctttttaactgcaacaacttaaattataccgctattggagctggaattaccgcggctgctgcaccagacttgcctccaatggatctcgttaagggatttagattgtactcatcccaattaccagactcaatgagcccggctccctctccggaatcgaaccctaattctccgtcacccgtcaccaccatg

SEQ ID NO: 67206 - DNA, 997 bp, Glycine max
  Peptide Sequence Number=SeqID_158891
atggggtggtcagaataccgaggaagcacttggaggagaaggcgaaggctttggcggatcaagcaaagaaagcctggtcgttgcacacctgctctttatgtatggttggtcttgcacttctttggtcatgaaagtagacccgtctgtcccctgcaaggtcaccgcacatgcactaagaaagtgaaggccaattgggagcaactcttggctagtatggtgaggacatctgttaattggttcccccgatggaagaaaggaagagccggagttttgtcctcatgcgaggggttctcaaacatccccttgatgggaacgaggggttctatcaattataatgttgtccttgccataagacaacttggctaccccatgagaggggcgccgtcagaagaaagtaccacgcctttcatcgcacggggtttcagtgaccccaatgcaatgatattccaaagcgttcaaaaggcatggagcgttgtgcaaagaaaggataacgaacttaggggaagcagcaatgggatcatcagcggatatcacaagtggttgaaggctcggacgcaagagctagattggctctcgaagctaaaggcggggtcctcagagtcgaggaagaggctgaaaccctggagaagagtgatgagaactgagagacgtcaatgtggccacagccgaagcgttggaacaggaaacaaagaggtcccgaaaggaagaatggggttgaaacaagttctgaggggcattgtggggtcaaaaaggagtttatccgagcaattgagcaagatggaagagaacatgtgggccatcatcgaccaatacaaagagaagctaagtctagccacaacccatgaacaaaggctagaggacgagtatgcaaaggtgtcagtcctgttcgctttcaccttgaatgggagtcaagagcttccaagactgctaaccaaagctaaggcgatggcggatgtgtactcggctcccgaggaagttcatgggctcctcgattatt

SEQ ID NO: 67207 - DNA, 135 bp, Glycine max
  Peptide Sequence Number=SeqID_158892
atgaaagggaaacatagactcaaagggattaattcaaggaagcatcaggaagaatcaagccaaggctattgtgcaagcaatcaatggggcaaaacacaccaaacgattatgatgatgactcaaattctcacaaag

SEQ ID NO: 67208 - DNA, 600 bp, Glycine max
  Peptide Sequence Number=SeqID_158893
atggaggttatttacctatgcttgatgaagaagggctcaagaaaacttggtaaagcttggaagaagagtggaaatggtgtctcctttcgtcttgaccagttgatgaagaagaggaagaatgagcgtgaatgtggttacagaaaggctcaagactatggaaaaggttgttggcatgattttgactccatcacaatcacaaacaatgatgtgatagtcgcacgcgtggccaagggaaacagttatggtggttgtggacaaaaagattgtgttttggagatgatgactgatttgggtatggagaacttggtgcttggtggtgtggtagtattggtcatggagaacttggtctatggcaaatggttaggggagatgttagtaccgaccatagaagagtttgaagagatcttgggatgtccgctaggaggaagaaatccatatcttgtttctgggttctatccctccatggaagcaaaggctttggcatatcaaggtgaatgggcttcattcattgatgttctagcactattggtgttcggagtcatcctcttcccaaatgtggatgggctagtggacctagcagcaatcgacgccttcctttga

SEQ ID NO: 67209 - DNA, 420 bp, Glycine max
  Peptide Sequence Number=SeqID_158894
atggtcacttttgggacattttcagcccctgggtccattagaaagcttagggatgaattaaccaactcgcctaggcgagtgttcgtggccggcaagtgtaccggatcgcacaagactttagaatcagaccagtttccactgttgaatgaccctaacaaagcatgcatctacgtgatcaaggatctcacaatcactcacaaactcatctcaagctctcagaacggcttccgcttcgagctcttgtctctgcagatcttcacacagcaaaatctctcagaactctctggaacttggtcctttctctctctagaacttcctaaacatgcaaaagcttcaagccaaggccagactctcatgcatgcagaggcttctcaaggaaaaatgctaaaactccaacaaaaaatcggatttcaagcttaa

SEQ ID NO: 67210 - DNA, 153 bp, Glycine max
  Peptide Sequence Number=SeqID_158895
atggcgtacaagaacatacaaatatcgacatcaacagttgatccaacagggtatgacactagttctacattagaagtatgggattctagtgttggtagtaaaagagaaatccttcccactggtagtgagaaggtggtctctgtgttcccttaa

SEQ ID NO: 67211 - DNA, 156 bp, Glycine max
  Peptide Sequence Number=SeqID_158896
atgtgggtgtcgacggagcggtttccggcagatttcaggtgggaggagaaagagaagaccgatttcaagaaggaggagaaagagaagagggagggcaaggttttcgagcgcgcggttaacatcggttttgaaaaaaccaatgttaacatcaactag

SEQ ID NO: 67212 - DNA, 1089 bp, Glycine max
  Peptide Sequence Number=SeqID_158897
atggcttataggaaaagaaaggcaccctctacacctacccaagccaaatttggtagatctagattcactttccaagatacttgggagagatacactgacattgtggtgcctcgtaagcttttaccaaagaggaatgtggtgagggtgagaggtcatctgattaagtttgatgaggatacgcttaacacatttttgaagacccctgttgttgtggaagagggggaaacaccttgtgcatactccagatttgcactcctgacgggattcgagcttaatgctgatgggcagcctttgaagattctgaggaagaacaagaccacgcttgctcagacttggagcattctttccttttctaacctcatccccactgcccacacttctgatgtcactcttgacagagccaaactcatttatggcatcatcgtgaagatggacatgaatgtggggtacctcatctcccaccagatctcccccatagcacagcatgacacatccagactaggattccttgccttgatcatagctttatgtaaggctaggggagttcaatcagattcgaggtccctggagagcttgagtcctgccattaatttggcttatattaagaagaactattggaatcttgatgatccaacaataactttcagaggacccaggaaggccaggggtaagagacctgaggccccttccacttcagcattagaggcaccaacacctccttcttctatagtacctccctcttcttctactcagattctagttattcctccagtacctttgcagatgccacttccagctcctctctctgtagagccttcagggcttaggttgccctccattatgagcatggaggagtttgatgttcaggtggcctggccaagagaccagccctcttcttttggagggggtggagcctctgcagcccaggagcctatgactgaggaaccaccagcagcaacagaggaggagactactcctgaggagacccaaccatctacaccagttatggagccagagatacaggattcatcggcaactccagcactggatcttaatgaagaccaaccacaagaggagcaggacgtttaa

SEQ ID NO: 67213 - DNA, 354 bp, Glycine max
  Peptide Sequence Number=SeqID_158898
ggtacatcctttgtggtacaagtagagcgtacatctacttgggttgtaatactgagaacaagagagggtacatcttttctggatcagttcaagtggagcgtacatccacttggttgttcaaagagaacaagggagggtacatcccttgtggatctttgcttgtaaaggattttacaaggttattggaaatctcaagaaccggtggttgcttagggactagacaagcgattcctttgagaaacattgatcagagcaggtttcttgagaaaagttttacaacttcaagattcatggcctcctcaaattctctatttctcaaaggaaactccatccataggccacctatctttaatg

SEQ ID NO: 67214 - DNA, 717 bp, Glycine max
  Peptide Sequence Number=SeqID_158899
atgataactaactcttttgagtctagtttcaaaaattcttttgaagccctgtgttatgctgaagattatcaaaacaagaacatatttagcgattatgctagggaagattattttgatgatccttctctaagctcaaaggtcgtttgggttactcaggtttcctattttactcctcatcaaaatgttgtagttttatatcctcctattgatgacatgagatgtcacatgaaaccactccacttgacggctatggtagaagatcaaattattaacaagattttggtcgatggaagggttgcattcataatcttaccaagatctatgttacagaggtttggtagtattgtggaagatttaataccttataacatagtggtgtcaaatttatgtggggagccctcagattttggaaaggaatggatacatagagaaggagcagttccattaatagttcatcaaaaaattttcttttggaatgaagatgaaaaagttgaaatggtggaagttgataagtcatcctatggaatatatgctaactttgcaagtgaaggtggtcaagcaatggcaagagctactccattcgaagttgaagattcattctatgtgaataacaagccaagtgataaaaaatacaagttcttttgttgggatgccactaggggtttccttttaatcaacaaagtcatcgaaaaaatggtcaaagttgaagaatcatga

SEQ ID NO: 67215 - DNA, 519 bp, Glycine max
  Peptide Sequence Number=SeqID_158900
atgcagatcataatgatgggagcttcgacaggaatgccaagggtgaacactcctttatctgaagaggaggtcaatcaagccttgaaagaatttgaaaaggaagaggaattagttgtccgacctgtagggaaaacattagtggaatttttgttgaagaaacaaaagttggctgctaaagccttcgaggctttggagattcgaatgaattttcaaaagattcaggaagtaaatgttaaaggaaaagagaaacagaacataaatataactataagtcaagttcagagcccttatagtttctctcagaggaaatcttatgttcctcatgcaaatgctctgccaaaaaagtggtttcaatcaaggaatgaaagatctatttcacgtattaaagaattcaaagttaataatttgacacttcgaagaggaggaactactaaaggttctagaaaaggatattatgaataccagaatcatccaaggatgaataggaacatgtcaaaaacccagtggagggagcattag

SEQ ID NO: 67216 - DNA, 195 bp, Glycine max
  Peptide Sequence Number=SeqID_158901
atgggtgaggaagagaaaaaaccagaggacaacaaagtggaggagaaaaaagcaaaggatgaagaaaagaaagaagaagagaaaaaaccagaggaatcaaaagatgacaaggaatccaaggaggaatctgcgccgccaaaaatcgtgcaaggcacaacctttgcaatgcatggacactttaagcacgatttctga

SEQ ID NO: 67217 - DNA, 156 bp, Glycine max
  Peptide Sequence Number=SeqID_158902
atggatgccaagcacctcacaaggaccaaagaaaggtcgcatgtcatcaagcaaaggtccccggacgaaattaggggtttatgtgtgtgtttcatgaccaatttttcttactggcaattcagtggcagtgtattgcttaggcttccgtcgaaatga

SEQ ID NO: 67218 - DNA, 254 bp, Glycine max
  Peptide Sequence Number=SeqID_158903
agcttttcatgtctagggtttctagagagagaaaggtccaagttccagagagttttgagagattttgctgtgtgaagatctacagagaccagagcttgaagcaagagccggcttcctggtatggaaagctaaatcctctgttggatcttccctataggtcattcaacagtggaaactggtctgactctaaagtccttgatagtacagggttaagttgtcgtactatcacgaggaatcggggtgcgataacttag

SEQ ID NO: 67219 - DNA, 597 bp, Glycine max
  Peptide Sequence Number=SeqID_158904
atgcttatcaacaaggcccaaaacattacaacaacattgtctcctttcagcaataaggtcatggaattaaagctagcactgcttagtctaattggctcacatccctttgctggaatggatcataaggatccatacatacatttgtataccttcatggaactatgcagtactatgggagcttttgatgaagatgctaaagttgtctacctcatagcttttccattttcattagcagggaaggcaaaatcatggttccaatcacatccaaataaaagccttatggctggagaccacacaataatgcatattctggtccaaataacacttcttttacaggtccttctaacaactaatatggaggttcttcaaataggggtccacaacatcaacaagctcagccaaatagaatgtcaaagatgtaagatacttaaacacagtttatgcaggtatccatcgcaaaacagaagaacacttgatgcaatcctccctaggaagggaccaatcactagagccatgagcaagaggctccaacaggattgggctagagctgctgcagaaggccctagggttctcatgaaccttagcttagatttttga

SEQ ID NO: 67220 - DNA, 478 bp, Glycine max
  Peptide Sequence Number=SeqID_158905
gagtcagagacaagcactcctgggtgaggggccagtggatcctttcgatgagaatgccattaatcaatttctggggcatccactggtcttggaagaaggccagcattgcgagttcagccaggagacgggtgcagatcatgcgcaccaggatgaccaccctcatttggtctacgccatcatgactcaggcaagtgcagggtcagctatagatgtgccaccgcctcctctagaggaggtaccatctctgaggtccatcttcgatcacctgtggaggatagaactccagatgcataggtacatgcagcacgaccccaatcctttcccttggcctacccccgaacagttcggggccatggtgacctggcctggagacgagactgattttgagacgcggccaggacccgtaggagcccttggggatgacggaggagttcaggaggatgaaggcatggctgacatgttggatttcttcacttga

SEQ ID NO: 67221 - DNA, 81 bp, Glycine max
  Peptide Sequence Number=SeqID_158906
atggtgttatcagagccatcgttctttcatgattgggctagagctgctgaagaaggtcctagggttctcatgaacctcagg

SEQ ID NO: 67222 - DNA, 201 bp, Glycine max
  Peptide Sequence Number=SeqID_158907
atggaagccattgaaatcggcccttacatccctactatggtagcaggaaatgcaactatagaaaaacctagggaacaatgggatgaagaagaaaggaaaatggtacaatataacttaaaggctaaaaatataattacatctacattaggcatagatgaatattttagagtatcaaactacaagaatgcaaaagaaatgtga

SEQ ID NO: 67223 - DNA, 231 bp, Glycine max
  Peptide Sequence Number=SeqID_158908
atggcagcggaatggagaaggaagcgagagaggagacaccacttcaaggagaagatgagtctagaagaagctcaccaccataggaggccatggataatagcttggaggaagaaggagataaatgaagggagagggagagaagagcacgaaattttgtgctctaaaagagctctgaaatctaaacccactaatccaagatcaattccaagattctccactaagtgtgcttag

SEQ ID NO: 67224 - DNA, 366 bp, Glycine max
  misc_feature (19)..(19): n is a, c, g, or t
  Peptide Sequence Number=SeqID_158909
atggagtgcctagagggantttgggagaccctcgaaggcaatgagaggtgccgattccgtagcacgattcgactcactgctacttcattggtacatccagaggaacccgcacgcacacttcagcagcctgtggagtggatactacctacacctactccatatcgactagtggagccagttcaagtgatagaggtgtcatcctctgaagaagatcctgctgtggatgctcttgacttacctgaggatgacgaagacccactccttgatgttgatttttcagagtatatcatgtcagcatctgaggcagactctacagaggagagcgtccctggagggacaacgaatagtgaagactcttcatcatag

SEQ ID NO: 67225 - DNA, 186 bp, Glycine max
  Peptide Sequence Number=SeqID_158910
atgggaggattttatttgctcctcaagctcataagcgtgaagttttcaagggagaacaggttaaagaagaatgaagagaataaaccatggaaggagaagcttcaccaccaagacagtgccttggataagaagcttagagaggaagcttcaatggaggaagagaatgagagagagagacctcattga

SEQ ID NO: 67226 - DNA, 396 bp, Glycine max
  Peptide Sequence Number=SeqID_158911
atgacgacgagaagaggagacaaaccaaataggaacgctcacaggatactacgagtagggttcaccatgactaaattcacaaaacatggaataaatcaacaatttcagttaaaacatgagactacaaacgaaagaaagaaaaaaaaacataaaataggaacggaacttgatcgaggacgaggaacaaaccttgatcgaagacgaggagcgaagatggtagtcaaccacgcgcgagaaccacagaggtgctggaaagccttcacgacgatcgactatgacgaagagggagaaagggtagtacaaaatgaaaataacaccatagaggtgctggaaagcctatggagacaatcgactaagacgaagagggagaaaggaagcaactcagacgagggctag

SEQ ID NO: 67227 - DNA, 2211 bp, Glycine max
  Peptide Sequence Number=SeqID_158912
atgtcatcaaggcctgaaattggaaacaagagcaacacacagaacaatgcagaaaataaagggtttgctgaaagccacgacaatgaatttatccctgcaagtttccccgttggtccatgggatgattttgcaatcatgtctgacaatataacaggtctgaaaagatttagagatgaagatgtgaaaccattttctggtttaaattcacctaaaagtcagaatgaaactggaggccaaaaaccttcttcttctactttaatagttatctttgtgtcaacttcccttcaggaagttggtcctagtgtaggtattgaggctagtgatcatatctgggcttcaaggtacttcctcgagagaattactgagcaagctggtgttgtgctctctcttgatccaaaaccaatagaaggtgactggaatcgagcagggtgccacaccaattataggtttttgcccatgtttcttccggatgagtattgcgcagtttactacatcggtgttgacgtaggcaccgatgtaaaaaacacagtttactacatcggtgctgacgtaggcaccgatgtagaaaacgcaggttactacatcgggcctacgtcagcaccgatcccggctgctaaaggagttgcggtgtcagtgctaactaggagggctaacgtgcacattctagcgctacgtcaattttgtggaccctggacagtacataagacccccaagctccgagtccagcttattagcgaaagaggttattcgatgttgagggtggcatcctcgacatgttcaagggttgcaggtttgtcaagcccctcaacttggacaactattgtccaagttgctttgtttgagattctcatgcttgttgttctacaggaaaagtcagtgagcgtgtgttgtacgtgtgcattgcttttttacatgtgttactttgtgagcgggcacatcttagagatgcgttacgtgggttggttgaatcacattatggcacagattcttagtgcgtcatttcaactcctggcaattgctggaggattgcattcttacttaaatgaagttgattttgggggttctattcaacaaccccttgtggatcgtgaagcttctgatggtgagtcctcttcctctaagaggttggttgacccacccatgttggcgagggacaaggtgtttggatgctatagagacatgctaagagagagaaatgacttggctgacaaggtggagagcattgttgcagagaagaaagagcttattgctacggtggctaagtttgctaagcttgaagaagagttactagcgttcaagaaggaagttatggagcagcacaagaagggcttttacaaggtcatcaggcaggccatgttcttcaccaaaggtcttgacttaggtatttttgacccatttaaggacgtgaaggatgagcgagtcctcaatgggtttgaatccttgatggatttgtatgaaatagaaaattcaatggtaggcaatcatctcgagtttgatttcaacctggttgaaggccttgctaacaagtctagtggttcccgcgaagatgaaacttggcaacaaagaggctcactaaggacggaccttgggtttaacgagccttggaccaaggacgaattcatattgggttttggcgaggctcaccaaggaggaccttgggtttatcgagcctttggaggattaaccagggatgcgtccgtctttggttttggtgagactcaccaaggggaaaaccttgggtttgacaagcctttggagatgcgaaactcaccaagggcagaccttaggtttaacgagcctttgaagatgcgagactcaccagggatggaccttgggtttgacgagtctttagagaatcgaccaaagacggcggaccttgggtttgacgagcctttggagaatcgagactcaccaagggcggatgttgggtttgacgagcctttggagaagcgagactcaccaatgtggcaactcgatctctatgatacgattgacaaaggggtgtcaacacatgggcctagagtgtcattatctatcatggttgttgggaaagggttggagttgtctaggggtggctcacgaataagagctaacgaacgtcagggtggacgtagcctggatggactccacaatttacacgtcggattgctggtaccttctattaggagaataggaggggggacctacaaaacaaaggatcctaaaactcaa

SEQ ID NO: 67228 - DNA, 477 bp, Glycine max
  Peptide Sequence Number=SeqID_158913
atgagggcttgtcactcggtttggaactcccttgagactcaggctgatcaccttgggggagagttgcctgtgcacgacagggtgacctcaacacttactgcctacaatgacttccaagattattttgatgatgccaaaaaatcaaggattgagcaaattccaaagattcaagaatcaagtttcaagaatcaagattcaagaataatcaagatcaagattcaagaatcaagagaagactcaatcaagataaggtacatcctttgtggcacaagtagagggtacatctacttgggttgctgtactgagaacaagagagggtacatctcttgtggatcagttcaagtggagggtacatccacttggttgttcaaagagaacaagggagggtacatcccttgtggatctttggcttgtaaaggattttacaaggttgaaagaaatctcaagaactattggttgcttggggactggatgtag

SEQ ID NO: 67229 - DNA, 258 bp, Glycine max
  Peptide Sequence Number=SeqID_158914
atgtttgtgggaatgaaagttctgatgaccaatatgtcaacaacctatcatagaggatgtatgatgaatgcatcagggcattcattaccatggtgcccaatgcatgcaattaagaagagtctaccagcgacaacgtatcatcaaaagacgaaaactctagatgaggcttcactgttatcaagcgagtcggaaacccagcatgactacagatcgacctccacttcctatgtctcacatagactcgggtatagggcctaa

SEQ ID NO: 67230 - DNA, 402 bp, Glycine max
  Peptide Sequence Number=SeqID_158915
atgaataatgaaaatgaagatgaagtcggtgtgaatgaagaagaacatgttgattattctgatgcatttaatacttctcagataatagtacaacttatgtggcttgcattgttggtgtttgctacccaagatgatgttttggagtgggctcgatcagtcgcttatgaaattgaatttttcgcagcaattatgaggtctaggaagaaagattttgttagaagagatactgacaataggaaatgtgggtgtccctttaagcttcatgggaaaccagtggttagaggccaaagttggatggcagttagcattgatgtgtcacacggctcgcttggaaaatcttgggcatcatcaagagcttcttcagcatgttggaatagctctttagctgcatcatccacttaa

SEQ ID NO: 67231 - DNA, 366 bp, Glycine max
  Peptide Sequence Number=SeqID_158916
atgaaacgatgtccgttcgaagccttgggctcaatagccccaatcacatctattccttacatggagaatggccaaggcgctgccaagatgttcaaaggaacaggtggagcattgacattatccacaaacgtctggcatttgtggcattttcttacatggatacaacaatcattttccatgggtcagttgaaacatggatgccagagtggcaagcgcatcggccatttgattctcttccttaggagtgtggtggaaggttatgtcatcaaagaactctgtcagcctcttgatgtaggcctgatagggtatcaacttatgatccctagtctcccattctactctcaactggtgaatcaccaaggctga

SEQ ID NO: 67232 - DNA, 186 bp, Glycine max
  Peptide Sequence Number=SeqID_158917
atgttgatgattaagcctagcatgtggaacaagtctgaatgtacacctcacgaatcaagggaaccttctggacatgatcaagagactaacgacaaagctgatactaagaaacaattctctgaactactgatgaaggcagctagtgattgtggtgctttgacagcatcagtggcaaattttcagtag

SEQ ID NO: 67233 - DNA, 960 bp, Glycine max
  Peptide Sequence Number=SeqID_158918
atggctagagttgccaaagtagtcaaaatctcggcaaaggaattggaccgagtaaagcaaaacaaaaatggagtagtcggagtaccaaggaagtgtttggaagagaaggcaaaagccttggcaagtcaatgcgaatgggctcctttcattgatatcctggcacttttgatcttcggagttgtcctctttccaaacacggatgggttagtggacctagcagtgattgacgctttcctcgccttttaccacagtaaggaaagcccggtcgtcgctatcttggccgacatatacgatacgttcgaccgaagatgtgaaaagagcgaggcgaatagggaccaactcttagctagcatagaaggagtatccattaactgtttgcctcactggaaggaaggaagaactgagattgtattctcatttggaggatttccaaatgttcccttgataggaacaaggggttgtattaactataatcccatcctcgccataagacagtttggctaccccatgagaggagcgctgtcagagaaaggcctcacgcccttcatcgcacggggtttcagtgaccccaatgcgaaagtgcttcgagaagtccatgaggcatgggggatggtgcaaaggaaggacaaagaacttaggggaagcagcaatgggagtatcggcagctatcctccagaagagagcgaagaggtacaagccctaaaagtggagcttgagaaagcccaagcggtcaaggaaaagtttaagtcaacagccgtcagagttcgaaaagtgtatgatgaactgaaagacatcaacgcggccaccgccaaagccttggagagagaaaccaagagggcccggaaggaagaacatggtcgaaacaagttcctaggagctttatggggcagcaacagtgagcttaaactccaaagagacaaagggacagtcgcgagtcaaaggcatggttttgaaagatga

SEQ ID NO: 67234 - DNA, 240 bp, Glycine max
  Peptide Sequence Number=SeqID_158919
atgacccagatggaagaagcagaagaagaagctcaacaagagcctacacaccaatggaacccttttgagtctcttgtgattcagaagatggatgctattcttcacctccatcaagagcaccaagttgatgttcacagttccttagaaaatattaccactagtgatgcaaccctacctctcaagggcattggatacaagactctaagtagattgggccagagatgcaagagaaggtcgtag

SEQ ID NO: 67235 - DNA, 474 bp, Glycine max
  Peptide Sequence Number=SeqID_158920
atggaggaagcacaaatttgggttaagaaggtggagttgccaacattcatggggacagacccaattggttggattgctagggctaaaaaattcttcgaggtacaagaaattccttcgttccataagctgcaacatgcattcatgagcatggagggtgctgcgacacattggttctacatttggagccaaaacaacccagattcagattgggagtcattttccacaactttgatcaaaagattcgtagatcgtcatgagaagaaacacatgttgtgcaagatattgaatgaagaagttgattctcatgcctctcaacaagacaaaaataacatggagggaactaggtcagaattcagtgaagcaaaggctagttcttgggcaagaaaggtggaactagccagctttgatagaaacatagaagggggaactgatttgaagggtaggagttttgagtgtgacagtgatccattgtag

SEQ ID NO: 67236 - DNA, 393 bp, Glycine max
  Peptide Sequence Number=SeqID_158921
atggtggtgcgggcttttgacagtagccgtcaggacttaatcatagtatcaggggaggaagacatccttgtaagttgtccttcttctacaccatatgtggaagccgcagaagaatctttagagacatccttccaagctttggaagtggtaagcaacacttatgtcgagtctcccccggtgcaaccccgctcatccagtgttgcattgatggtagctcgtgtaatgttggggcataggtacgagcccgaaaggggtttaggtcacaatggcgacgacgtggagagcttggtcgagttcaaagagaaccatagaaggctcgggctaggatataagcctacacgtgccgacgtaaggagaagcgccttagaaagaaggggccgaagcatgggctga

SEQ ID NO: 67237 - DNA, 276 bp, Glycine max
  Peptide Sequence Number=SeqID_158922
atggagacatacagaggtatgctccttgacccagtaaggatattaagaaaccaactaggtgttggtggtctggcagctgaggacaaaatgccaaataagcctactgattcaatcttcccaaggaggggacccatcaccagagccatggctaggagactcaaggaagattgtgatgaagctccatatggagcttgtaggccttggatcttcttcattaatggagtcctttgcttcttgaatatcaatggtagcggaatggagaaggaagaaagatga

SEQ ID NO: 67238 - DNA, 717 bp, Glycine max
  Peptide Sequence Number=SeqID_158923
ggtggacccttgggtactagtaccctcaccctcagagggctacgcgccctcgccatcagagggctacgcgccctcaccttcagaggaatacacatcctcaccttcagaggactacacgtcctaaccttcagagggctacacgtcctccccttcagagggctgcacgccctcaccttcagaggactacacgtcctcgccattagagggctgcacgccctcaccttcagaggactacatgtcctcgccttcagagggctgcacacccttaccttcagaggactacacgtcctcgccaccagaggaatgcatgccctcaccttcaaaggactacacgtcctcgccttcagagggctgcacgacctcaccttcagaggactgctcgccctcaccttgagaggactacacgtcctcgccttcaaaggactatacgtcctcaccttcagggggctacacgccctcaccttcaaaggactacacgtcctcgccatcagagggctacacacccttaccttcagaggactacacgtcctcgcctttagaggactacacgtcctcaccttcagaggactatacgtcctcgccttcatagggctacacgccctcaccttcaaaggactacatgtcctcgccatcagagggctgcacgccctcacctttagagggctacacgtcctcgcctttaaaggattgcacgccctcaccttcagaggactgcac

SEQ ID NO: 67239 - DNA, 195 bp, Glycine max
  Peptide Sequence Number=SeqID_158924
atggaaatgatccaaaagtccacttctagtgacaactcccaagggtggtttcatggactaccagcgacaatgattcaccaaaagaggaaaactctaggtgaggtttcactatcatcaagcaagtcgaagacccaacatgaccataaatcgacctccactccctatggctcatacagacccgggtatagggcctaa

SEQ ID NO: 67240 - DNA, 222 bp, Glycine max
  Peptide Sequence Number=SeqID_158925
atggagaattgcactaagcaatcagtacgcatgggctccaaactcgtgggtgaaggatgcatgaacgaaaacgttattcatggggctccaaaaaagggtagagaatggagaattgcactaagcaatcactgtagacaaaggatcaagatgaatgttttgatgatgccaaagtttcacatgcgtctcaaagtctcaaagctttattcaagacaaagaaattaa

SEQ ID NO: 67241 - DNA, 743 bp, Glycine max
  Peptide Sequence Number=SeqID_158926
aacctatcaaagaccacatcatggctgaagagccgagaagactcaccatggaagattattcaagttctaatgtgccacaatttttcaccagcattgctcaaccagaagttcaagcacaaacaactacatatccaccatcattgattcagctaattcacaataatctatttcatggagaagctaacaggtggcttcattcatttaaaggcaatagtcttaagacatgggatgaggttgtggagaaatttctcaagaaatattttcctgagtctaaggctacagaaggcaaagccgccatctcttcttttcaccaatttcccgatgaatctttgagtgaggccttggaaagattttgtgaccgtagtccaagcagctattggacacttctgcatgatgtaccatctgtgggggagctcatgaatctggatgttgtatccctattgaagaacaacccactcatgaagtcaattacatgggaaatcagcccagaaacaattttaatgcaggaggattttctggattccaacatggccagtaatacaatcaacagcggggacaatggaggaaccaccctggaaatcaattcaatagagatcaaggtttctatgtccaaccagaagagaacagagtttgccataaagaatctggaggtccaagtgggacagcttgcaaagcaattggcagatagatcatcaagcagttttatagctatacagagaaaaatcccacgagagtgtaaagct

SEQ ID NO: 67242 - DNA, 918 bp, Glycine max
  Peptide Sequence Number=SeqID_158927
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccagggacttgggcccggtccgccactgaggacgcttctccagactacaattcggacgccgagggcgaccgatttcatggtgggcttttccggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 67243 - DNA, 606 bp, Glycine max
  Peptide Sequence Number=SeqID_158928
atgccctcgcctttagagggctgcacgccctcgccttcagagggctacgcatcctcactttcaaagggctccacatctacgccttcagagaatttaaggtcctctgcccttaaattcttaaccgagacttgcgctcccggttatagggccaatagtttccttttatcagttcctgggccaccccctgatattggagggcgaccaattgtgcgagcacaaccagagagggaggctatcacgcagctactatgcataccggggcatgatttcacctatgcaactacaaagagacgagtgcgggtcatgcgcaccaacatgaccactcttacacagatatggatgacgttgctacttagcaacattccacctgacgaccacaatgccgatctcccccctaaggaaggtagcgcccacaagacacccagtggacctggaggataccttggatatgcatataaacgtgccttggaaatcggttacggtgctgttgtgatggtggttgagttgctgcgatctttcacacgcacaggcaaaggaaaagacagagagagagagagagagatgaaagaacgaggatgtgaatttgtcctgagaaggagacaatga

SEQ ID NO: 67244 - DNA, 375 bp, Glycine max
  Peptide Sequence Number=SeqID_158929
atgggggtgaaaagatcaattagggggtattcttcagcattgggcccatctaggcccatcaagaagcttcaacatgaagcaaccagctcgcctggggcattggaggctaaggggaagcggttcagcacccttggtattcagatttcacttaaaattagtgaggagaacaagaaagaaggagaaaatgaaggccgaggcgcttccgtgaccaattccatgaacattcttcgtcgttcttcgttcgttctttattgttcgtcgatcttcaaccaattagttttcgactttgaagctttgaattcattctatgcacccttaggggtccattcttgctttcgagtttcgatcgattatttaagtcgtaatctcacttaa

SEQ ID NO: 67245 - DNA, 864 bp, Glycine max
  Peptide Sequence Number=SeqID_158930
atggcaagcggacgcgaaatcaaaaccaagatcaagagcgtgcagaacacccgcaaggtgacgcgcgccctggaaatggtctcggcctccaagatccgcaaggcgcaggatcggatgaagacctcgcgtccgtacgcgcaggcgatgaagcaggtgatcggccacctggcccaggccagcaccgactaccagcatccgttcctggtcgagcgcgagcaggtcaagcgggtcgggttcatcgtgatctcctccgatcgcggcctggccggcggcctgaacaacaacctgttccgcaagatgctgggcgaagccaaggcatggcaggacaagggtgcggaagtggacctggtgaccatcggccagaaggcatcgaccttcttccgccgcgtgaaggtcaacatggtcggcagcgtgacccacatcggcgacgtgccgaagctggaatcgctgatcggtgtgatcaaggtcatgctcgacgccttcaccgaaggcaaggtcgaccgcgtgtacctggtctacaaccgcttcgtgaataccatggtgcagaaggccagcttcgatcagctgctgccgctgccgccggctgagaagcaggtcgctcaccacgactgggattacctgtacgaacccgatgccgcgaccgtgctggagcacgtgatgacgcgttacatcgagtcgctggtgtaccaggcactgctggaaaacgtcgcctccgagcatgccgcacgcatggttgcgatgaaggcggcgagcgacaacgccaacaagctgatcggcaccctccagctcgtctacaacaaggcgcgccaggcagcgatcacccaggaaatctccgaaatcgtcggcggcgcggcagcagtctga

SEQ ID NO: 67246 - DNA, 890 bp, Glycine max
  Peptide Sequence Number=SeqID_158931
agcgagtcgacgatgcggattgccaggatcgggcccaggtattcggtggcccagtcttcgtcggtggccggcttggcgtgcggcagcagcgccagcgtgcgggggcagccgcgcagttcgacaccgtgttcggtcagcgccgcggccaggctcggcaggatcgagacggccgccacggcgtccaccagcagggtttccatggcgccgcagatgccgtagcgataggtcttggcattgaaggcgatggcgtgggccttgtccgggtcggcggccgcgtcgatgtagatgtggcagttgccgtccaggtgcttgatcagcggcacgcgcgcctcctgcgacagtcgggcgatcaggcccttgccgccgcgcggcacgatgacgtcgatgtgctcggtcatggtgatgagcttgccgaccgcggcgcggtcggccgtggccaccacctgcaccgcgtcctgcggcaggccggcggcggccaggcccatctggacgatgcgacccagcgccacgttggagtgcagggcttcgctgccgccgcgcaggatggcggcgttgccggacttcaggcacagcgccgccgcgtcgatggtgacgttgggccgggattcgtaaatgatgccgatcacgcccagcggcacgcgcatctgcgccacgcgcatgccgttggggcgcacggtggtggcggtgacgctgccgatcgggtcgggcagggcggcgatctggcgcagcccttcggccatatgggccagtgttttctcggacagcgtcaggcggtcgagcagggccggctccaggccattggcgcgcgccgcggcgacgtccttggcgttggcggccagcaattcggcctggttggctgccagcgcttcggccatggccagcagggcctg

SEQ ID NO: 67247 - DNA, 267 bp, Glycine max
  Peptide Sequence Number=SeqID_158932
atgaagaccaacaagaagtgtgtctgccttattctcaaagacagggatgatcctgatcttggcttgaagattaacatgacaattgctgttggtctcccttctctttgcaaaactcctgataatctctcacagtgctctgttttcaagatacaactaaacaaggttcttgatagcaacaacaacattatggaagaaccagaggtagcagctaatagcagaccagcaaggaaccacaacagacccactcacctcagggattacgtttag

SEQ ID NO: 67248 - DNA, 158 bp, Glycine max
  Peptide Sequence Number=SeqID_158933
ctcatccttcttccagattcttcctcgcgctcaaccgcaagagtggtgcgctcagcagatggcttgctaagccagcagattggcttagcgagaagctaaaaatgagcacttcacaaacttccctaattaacctgaaattgaaaggaaatgattattaa

SEQ ID NO: 67249 - DNA, 409 bp, Glycine max
  Peptide Sequence Number=SeqID_158934
atgactagagacaatccaggtgacttacaaccctttgatcctgaaatagatagaacatttcatagattagttagacatagtgtgcatcttgatttccctaaacattttgtgccttttgagcatcccaagcattctgttactagtgagtatgagcattctgttgttggtaattttgaacatcctgattttgagcattataattttgaacattctgattttgagtattccactaccaattttcatactgaaaatatggctcaacctccacctcgtgagaggactctaaggaaaatggttgcacctgatttcacttatgaaagcttgtgcattcaataccctaatgaggatgtcccatatgttcttaaaactggactgatccacttgttgcccaagtttcatggtcttgcag

SEQ ID NO: 67250 - DNA, 348 bp, Glycine max
  Peptide Sequence Number=SeqID_158935
atggtgaaagttggaacctcttacgtgccgatcaacgtctcattttcgccaaaagttggcccagggcttcccggtatcaacagggacaccaggatttatttattctgcgaagtgctccagtggctttctgttttctatcagctgtccctccctgttcagctactgacgggggtggtgcgtaacggcaaaaagccaccgcccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 67251 - DNA, 492 bp, Glycine max
  Peptide Sequence Number=SeqID_158936
atgaagaacggtggaaaatcttcacgaaatcgcccacggaaacgtctcggaagccttacagaagcgcctcggcttggattttcttcacggaaacaatttttctcactaattttaagtgaatctcagataacaggagggggaaaagagggaggtggttgccacccagctcgcccaggcgagctgggttgcttccaccagaaggcaccgccttctgttggaacttcctgggttgctatttgcacacccctgtttactaaatacaccccctgtttaaaagagggtcgtttgttgagcttagctcatcagtgggctaagcgcacatcaatcgctaagcgcagctttagtgtgcttagcgtgacagaagaatctggcagagcatcaatatcaaggtcacgcgctaagtgcgagatcagtgtgctaagcgcagcagttgtcttcagccaagctcagtgcatggttggcgctaaactcaaatccacttactcgtgctaa

SEQ ID NO: 67252 - DNA, 356 bp, Glycine max
  Peptide Sequence Number=SeqID_158937
gcaagggcgtgtagccctctgaaggtgaggacgtgtagtcctctaaaggtgaggacgtgtagccctctgaaggcgatgacgtgtagccctctgaaggcgagggcgtgtagccctctaaaggtgaggacttgcagccctctgagggcgaggacgtgtaatcctcttaaggcaagggcatgcagccctatgatggcgaggacgtgtagtcctatgaagggaacctattgggtgagaacttctaatctgcccctaggtttgcttgagggaacctattgggtgagaacttctaatctgcccctaggtttgcttgaggtttatgcatggtgcccctcattgccccagtgtagggctttgag

SEQ ID NO: 67253 - DNA, 663 bp, Glycine max
  Peptide Sequence Number=SeqID_158938
atggttatccgcaccttttttcaaccagaggcaagcgagctcgttgacacgcagagactaacgtcatcatctgcaccattgttagccagagacggcgagtccgatgacatgcgggggtaccttatggttatccgcaccttttgtcaaccagaggcaagcgagctcgttgacacgcaaagactaacgtcgtcatctgtacctttgtcatccagagacggcgagtccgatgacatgcgggggtaccttatggttatccgcaccttttttcaaccagaggcaagcgagcccattgacacgcagagactaacgtcatcatctgcacctttgtcatccagagacggcgagtccaatgacatgcgggggtaccttatggttatccgcacctgttgtcaaccaaaggcaagcgagcccattgacatgtcgagactaacgtcgtcatctgcacctttgtcattcagagacggcgaatccgatggcatgtgggggtaccttatggttatccgcaccttttgtcaaccagaggcaagcgagcctgttgacgcacagagactaacattgtcatctgcacctttgtcatccagagacggcgagtccgatgacacatgggattaccttatggttactcgcaccttttgtcaactagggggcaaacgagcccattga

SEQ ID NO: 67254 - DNA, 174 bp, Glycine max
  Peptide Sequence Number=SeqID_158939
atggaagaagcggaaaaggagatcttggagacctttaggaaagtaaaggtaaatctgttccctcacattcctgagaaatgtaaaggacccagtgagtctagaaaacagcccgaagagagagaggagacgccacttcaaggagaagatgagtctagaagaagctcaccaccatag

SEQ ID NO: 67255 - DNA, 240 bp, Glycine max
  Peptide Sequence Number=SeqID_158940
atggctcaggaggagggtacctccacagatcagatacctgagccatcctctgcacctgttcctgaggagacccagccatctacaccagtcacggagctagagcatcctatccaggattcatcagcagctccaggattggaatggtcagataattgttttgatcaagcttgtagccatcagaagagaatgagcatattgattgtgaaggaatgcattaaccgtatcccggtgagagtgtga

SEQ ID NO: 67256 - DNA, 822 bp, Glycine max
  Peptide Sequence Number=SeqID_158941
atgcatgatgcacagatccgtgtcgccattgcgggcgcgggtggacgtatgggtcgtcagctgattcaggcggcacttcagatggagggtgtcgcccttggcgcagcgctggagcgtgacggttcatcgcttctggggaccgacgctggcgagctggcgagcgcgggcaggacgggcgtcaccgtacagagcagtctggatgcggtaaaagaggacttcgatgtctttatcgattttacccgcccggaagggacgctcacgcatctggcgttttgccgtcagcacggcaaagggatggtgatcggcaccaccggttttgacgatgcgggtaagcaggctatccaggatgcatcaaaggagattgcgattgtcttcgccgcaaactttagcgtgggcgttaacgtcatgcttaagctgctggagaaggctgcgaaagtcatgggtgactacaccgatattgagatcgttgaagctcaccaccgctataaagtggatgcgccatcaggcacggcgctggcgatgggtgaagcgattgcccatgcacttgataaagatttaaaagactgcgcggtctatacccgcgaaggccacaccggtgaacgcgtgcctggcactattggcttcgccacggtccgtgcgggtgacatcgtcggcgaacacaccgcgatgttcgccgatattggcgaacgtgtagaaattacgcataaagcttccagccgaatgacgtttgccaatggcgccgtacgctccgctttgtggctaaaaaacaaagaaaagggactttttgatatgagagatgtcctggatctcaataatctgtaa

SEQ ID NO: 67257 - DNA, 273 bp, Glycine max
  Peptide Sequence Number=SeqID_158942
atgactaaagcacgtcaaaagggggtacggaaagaaaatgagggaggagcttgccacccagctcacccaggcgagctaggttgcttcctccagaaggcaccgccttctagagaacttcctggaagaacctcacgaattgtgcaacaatgctttctttcgacttccggcatgtcacagaacttcatggattgcctaacgatgggtgctaagtacctcgaagtggtcaaacgagggtcgcatcccaacaaacgaatggtcccccaacgaaattag

SEQ ID NO: 67258 - DNA, 324 bp, Glycine max
  Peptide Sequence Number=SeqID_158943
atgtttaggcatgaaaatcaagggaatgggggcaatgtggcatgccccattactccagaatacaaactaggcctaaggccatcccctacaacccctcaattcaacgaaaacaagcaacaatccaaggataaatccatcacgtttttgagcaattacatgcaacttagagcaccaaaatacatcaatggaaagctagagatcccaagaatgaggatactaggtttccttgcagtggcgctttccgtttgtccagagctgggcaagggacgacgatctatcggtcgtgaccctagcctctacttgcgtctgtccctaagtacctga

SEQ ID NO: 67259 - DNA, 192 bp, Glycine max
  Peptide Sequence Number=SeqID_158944
atgtcgcggaacttcacggattgtgctacaatgctttcttttgacttccggcacgtcatggaacttcacgaattgcctaatgatgggtgccaactttacaagacgcttctccacgacctgaccgttgggatcttcgagaagatgtctggagtgtgcgcaaagcttccattcccgagagcatttcttatttaa

SEQ ID NO: 67260 - DNA, 591 bp, Glycine max
  Peptide Sequence Number=SeqID_158945
atgtggacagagacgtacctcactcttgaacttctctctctttgcgcactccggcatcagcttcacttgaatgctcctcaaatcaccaccgtcattttgtctcaacgaggattgaggctttggatcgacgaaaaaaccagggaagtcggatacgtcgtcgttttcttcatctttagggattggagcaatttgtgcagagcatgtgagaggagaaggaagaggctcgttgtcatcgtacgaggtgacagaattgaaacggtgatgatgatgatgatgaatcaattgattttgtttctcggcgtcgttttgcaaaagtggcacgtcgttccatgtggcgtcgcatacgggacagacgttggtgcgtgcatgggaaaaggaagtgacgcaggggaagtgaaacgcgtgatcacactttacagtgaggattctgaatatgagaaggttgaattacttattctgaatttgaagctttttctgaagagggagatgttgagcttaggggagagaggagaatttgggtggaggtgcagtgatgatgtggagagaaggcctgggctgacgcagcttctgggggaaggagtagggctttga

SEQ ID NO: 67261 - DNA, 453 bp, Glycine max
  Peptide Sequence Number=SeqID_158946
atgttggttgaattactcgaggtcagcattgaagaggcgaaagctaagacgtttcaatgtcatggctcttatgttcgactatcgtggttgcaagacgtgtatcagatgaagatcgatgcatgtcactggattgtagcagcgcgagcgtatttgttgcatctgcttggatgtacactctttactaacaagagtgccacacatgagcacgtggtattcttggatgcactgcgtaacttgatgcagagtgggacttacgcttggggcactactgcacttgtgcacatgtatgataatttaaatgaggcatcgaagagcacagcgagacagcttgcaggatatatcactctgttacaactgccgaggattatgatgagaggagaccgcacacatgccaatgaacctctagcaagcaactgcccgtgtcgacatatcgcaagcgtctggacagactga

SEQ ID NO: 67262 - DNA, 411 bp, Glycine max
  Peptide Sequence Number=SeqID_158947
atggttggtgtacttccaaagagaagaacactgatgcggcataggaagtcgcaggggaaccgggacacgacgttctatgtgtccccctacgcccacactcgatcaatgctccacgagctcaaatggtatttcttgaagaagaagatcattggcgtgagggaagagtcgcgagttcaagaacgagatttcaggaaccacttaggtggaaaagaggatgaaggagaagctttaaatcagaaaaatggagaaggtgtcgatgatggggtcgtctgtgtcggagaggggggaggggaaggtggaacggttgccaaggtgcaacaagcgtatttggtctccagtggtgtacgtgtgtcgttaggagtatacggtgaagttgggttactattcgtcgccggagaagaagaagaagag

SEQ ID NO: 67263 - DNA, 189 bp, Glycine max
  Peptide Sequence Number=SeqID_158948
atgggtctgttccattcttatttaccttggggtgctgttctgcgggtggcaggcggtggtgacaggggctggaagtgccctgcaaccaggcgcgtacggtcgcgccctgcacgcaggcgtgttgactggtggcctgcccgaggcgccttggtacgcgccctggccccaggcacgtccaagcgcccttaa

SEQ ID NO: 67264 - DNA, 288 bp, Glycine max
  Peptide Sequence Number=SeqID_158949
atggcggaatgggcaacacctattgttgtttatgagggtggtgatgctgctgcagctgcagaagaagccaaaaagagtaaccatgtgcagagaaaattggagaagcgccagaaagatcgaaagcttgatgctcacattgaggagcagtttggtggtgggcgtttgcttgcttgcatttcctctagacctggtcaatgtggcagagctgatggctacattctggaaggtaaggagttggagttttacatgaaaaaactccagaagaagaagggaaagggtgctgcttga

SEQ ID NO: 67265 - DNA, 456 bp, Glycine max
  Peptide Sequence Number=SeqID_158950
atggtttctagagtagggactaccagtaacaatatgttatcaaagagaaaaactctagatgagggttcactattatcaaacaagtcagagacccagcatgatcacagattcacctccactccttatgttcccatggacccggcatcaaagagttatatacaagaacgtaagggaaataaaaggaaaccgacaaaagaggaagtcatgatattgcacgagattacaaggcctaactctctaacaacagttccagtggagtcgccaactgtcgtaacctacccttcggcgagagggcgacgcgagggctcacaggtgcgtcttccatgggaggaaaatgcgcggagtcgccacaaacatttattcgaggaaaatgttgaaaaaaccggaaaggtgtggtctacgaactttaagtgtgaaaggttcgggagttgtttttacgcacagggaaggtattag

SEQ ID NO: 67266 - DNA, 151 bp, Glycine max
  Peptide Sequence Number=SeqID_158951
atggactgaagcatctgattatgttggtccattgggactaaggtggattgtgactagcggcagacaacacatggtgaaggagactatgcttgaggtggggcgtttggtgttgcagctttggcttgggtatggcggtgccctaggaaggtga

SEQ ID NO: 67267 - DNA, 412 bp, Glycine max
  Peptide Sequence Number=SeqID_158952
atggttgaaagacctactagcaactttggagccaacacagagaagaacccgaaggaggaatgcaatgtggtgttgactagaagccagaagagagcatatagagaagaagaatctaaaggagaccagtctgaggaaggaagggtagacaaagaaggagagaaagaggaaaaagagaagaaggaaaaagaagagaaggggctggagataaccatgccatttggggaagccttacatgtggaagcaatgccttccaagattattttgatgatgccaaagaatcaagagttaagcaaattccaaagattcaagaatcaagattcaagattcaagaatcaagtttcaagaatcaagaatcaagaacaagattcaagactcaagattcaagaatcaagagaagactcaatcaagataa

SEQ ID NO: 67268 - DNA, 252 bp, Glycine max
  Peptide Sequence Number=SeqID_158953
atgagggctttcatcactaaaggggatgaaggaaaggtggtttgtgatgaaatgctttcaacaaaggagtctgcccaaatgtatgcaaaacacttggtagagcttgctgttaatttaggctttgacggacgactggaagattatccgaggcgatctgttgttgttgttgctggtgatagaaagtctgatatgtacatggggattgatgtatttggaaagaacacatatggttgtagaatgaggaatttttaa

SEQ ID NO: 67269 - DNA, 393 bp, Glycine max
  Peptide Sequence Number=SeqID_158954
atgattattacacgacctgcaccacacgcaacgttaattgaatggattaaaaagcaaaaggtggacctaagatctcaaggttttggtggaagcagcaatcatgcagatcaggctactcctgttgattctgatgaatcaacatgttcgaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttaacagagtgtgcaggatccacgatgtcggacacgatgtcctgacatccggcccgaaaatactggacacataa

SEQ ID NO: 67270 - DNA, 423 bp, Glycine max
  Peptide Sequence Number=SeqID_158955
atgtgggacacattagctttgatgtatgaaggattgttacaggtaaaatgcaacaagcttaacttgttgacatctattaacactgatacatcttatgatgatgagttcgatgatgaaagctcgggcgaagatgatcaattagccttcatttcaaggaagataggaacacatggaagaaaaggagtggatcagactggaaaggattcaagaaaccatatagagaaagaaagggcaaagataaaagttccaccatatgctatgagtgtaagaaaccaggacacttcaagtcagaatacccagaccctgataagtcaaatcacaagaaaagacacttcaaacaaaaaaaacaagaaagtactgatgagcacatgggaagaactggatgacacatttttcgatgaggagacaaaagaggaagaataa

SEQ ID NO: 67271 - DNA, 423 bp, Glycine max
  Peptide Sequence Number=SeqID_158956
atggagctacatcacttttccaccacctcttcccatgcccgcaggctatttcccttgaacgagggaagccatctttttgcttcactggccaaggaaaaggagaataggttaaggcggatggtgtcttctggaactcccacaatcttcagcgtgttgcagatctcgatgtatgtggcaaagtgcgtgtacagatctttattcggtaggccatggaatagattccattggatcagctggatgagggaatgtgggattagcgggtatgacgatgatcatgcgctgagtgcagcgacatttaggcttagcgagtatggcagcgatcacgcgcctttgagcttcttcatgggccttcttcacgctaagcttggtccggccgctaaacgagacgacgtgttgggcctgtcttgtgcgctaagcgagtag

SEQ ID NO: 67272 - DNA, 354 bp, Glycine max
  Peptide Sequence Number=SeqID_158957
atgacatcctccagtcggtcggaggagaccttggatctaggggagtccgccatgttctctcaacgagagcaccaaattgatagcaactctaggcttcgagggctagaatcctccgaagaattcaaggaaagagggaaacaattgagagaaaagcataatcctaacagaaaggaatctaaggcactaatggcagacaaagctaaggaaatgaccagctcagcacatcacacgaaatcctttaggtatgctgttccttttgggcctgtttactgtatgcacctccttcttgctattagcctccttcttgctatcacatacccaattggttggattgctatggctgaaaaattatga

SEQ ID NO: 67273 - DNA, 147 bp, Glycine max
  Peptide Sequence Number=SeqID_158958
atgaggatgcataatacaactgatgcaatcctccctaggaggggaccagtcactagagccatgagcaagaggttccaagaggattgggctagagttgctgaagaaggcccaagggttctcatgaacctcaggggctccataatatag

SEQ ID NO: 67274 - DNA, 195 bp, Glycine max
  Peptide Sequence Number=SeqID_158959
atggctccttttgataaaaatcaattagtttatgcaattgtttgtgcggaggcaaaccaccaagaggctatgcttgatagctatccggattggcatccaaaaggcaaaactactccaaataccaaggtagacgctacttccaagagtcatatttctactgctgctgcatttgtgaccaagtcaatgagtggataa

SEQ ID NO: 67275 - DNA, 627 bp, Glycine max
  Peptide Sequence Number=SeqID_158960
atgtgggcagttggtgctatattagctgagctttttactttgacccccatatttcctggtgaaagtgaaatagatcaactgtacaaaatatacggcattcttggtatgccagattccactgctttcaccataggggcaagcaactctcagttattggacatagttgctcatgaagttgttccgcctgtgaagctttctaatattattccgaatgctagtttggaagctatagacttgatcacagtggatgcatgggttccttgtccgcccagtgatccacttgagctgaagctgagtagcaagagggcaaagccaaatcttgagctgaaactgcaggattttggccctgatcccgatgattgttttcttggcttgactttaggtgtaaagcctagtgtttcaaactcagatgtggtccaaaatgtatctcagggtgtcagagagaatgtgctattttgctcagatttcaatgatcattcagaccagtcagtattttggacattattatctcctgatcaaaatggaattcataactcagcagagacttcgttgtcattgtcattcagatgcttttttgaacatcatgcctggtctgtagcacttgtgctttcagccgcaaaaatatga

SEQ ID NO: 67276 - DNA, 1017 bp, Glycine max
  Peptide Sequence Number=SeqID_158961
atgcaggaaatcaaaaagaataatgactgtcctcattttctttcccgtgggggatatgatttgctagaaaagaagttgttagacgagaaaatcaagaaaaggcagcatgacgcattgatgactgaaaatccagcactcattgaggaccccccatctcccattaaaagacatgtcaagtggaagatggcacgcacaaaccgatatgggaagatgacatctgaggctgcaagacaaattgctgataaaattgactcgttggaagaacaagtgacacagggtgagtttgtcccccagggtcgtcaagatatatttaacatggccatagggagaccaaatcatggaggtcgtgttcgtgtagctgggaatgagattgaagaagaaaagaagcgaagtctagaggcttggaaaaacgagctgaaggatgccatcattactgacatatttaacagagagaaggtctcagcaccagctaattttcacttaaatgtgttaggtgcacgcgtgagcactaaggaaagcaatgttgaaattgttgtgaacccgtctggggaagaacatgttggtcgtgtaacaccgcctatggggttgtacgtccaaagtcaagattgtacaaagctggtggcgttgggaaaaattcaagatggaccatctaccatacattgcatagcgtatgcagatgatgtcataaaggttagcataaaaaaagtaattgatggtgaagctgaagttccatttgtgacatcagaaattaagtatgtgagagaggccgttaacacattcattgcatggtcattgcctttgcattcaggtatcactccaaacaaagttgtgaatgctaccgaattaaacaatgatgttcctaaacaggaccccttgtgtgagttgattaagacccttgttgagatttacgacaagccagttgagtttgtgtgggatcttactgaatttgggattccaaatcgaaataacatcaagcaacaaatgcttgaacatagccatacttcagttgtggaccat

SEQ ID NO: 67277 - DNA, 453 bp, Glycine max
  Peptide Sequence Number=SeqID_158962
atggaaacaaagcctcataacttgactacaaaggctacaactatattgggaaagagagaattgtgtagtgagaaaagagaaacaaaaaatggaagaagggagaatggtggctttggaaggaaggagagatctgaaatcctcttatcaaataagagaaaatactcagaaaatcctctgatcgaaggcgttgggcttgttgaagatgtcttcggtgcctttgacggtgaggcacgtggcgaaggggactacgccacgtggacgagacgcatgcgtgatggccgagtccttgaaccagaaaagcttgccttgcttgaggaggaactagtagtagtgccatatcttgatgtactcgccctgcttggtgatccagccgatccgctcggggttcaaccagaacttgacaccatcattgtcggtggcgttgtccatcatgtcgatttctgtgtgccatag

SEQ ID NO: 67278 - DNA, 66 bp, Glycine max
  Peptide Sequence Number=SeqID_158963
atggccgtttttattggaatccgtggaaaaggtgatgcaatcctactccgcaagggcattggatag

SEQ ID NO: 67279 - DNA, 603 bp, Glycine max
  Peptide Sequence Number=SeqID_158964
atgttaaaagtggcgaagagaagagtcaaaggaaaacagaatgatgtcaatttttggcaaaagcaagctaataagattattcaagaggacaccaaatcaaaagtgacgtatttttttgggcggtgtcctaattgcaaatggcaatatggtagggggaaggaactgacatgcaagactaaggagattaaaagactcatcatggaaaatgacaacaattatataacaggattgctagggatggagagcacaggtaaaacaacattagtaaaagaagtgggtaaggagcttaagaaatcaaaaaagtttgatcaagtcattgatacttcagtatcatatactcctgacagaaaaaagattcaagatgatattgcaggaccattaggattaacgtcattgaaggattgcactgaatcagagagacctacaaggttgtggagaagattgaccaatgattatcaacctatgattccttactactctcagaacatagaaccacgacctcacacaagaactcagaataccgaggaagacgggaaactcactcgtggaactcacacgagaaagaatagtcccaagggactgagtgttattaattttttatga

SEQ ID NO: 67280 - DNA, 699 bp, Glycine max
  Peptide Sequence Number=SeqID_158965
atgtcgcaagggggatcacaattctcacccttgattgagccagatatacatgtgttaggtgcacgcgtgagcataaagggaagcaatgctgaaactgctgtgaacccatccgaggaagaaaatgttgctcatgtgccgactatggggttgtatgtgcaacgtcaacattctacacacttggtggccttgggaaaaatatgcgaaggagggtctaccatacatagcatagcgtatgcaaatgatgtcgtaagggttagtgttgaaaaagttattgacggtgatgttgatgtcccattgccgacgtcagaaattcagtatgtcaagcaagcccttctcatattcattgcatggtcgacacctcttgtaaaactgatatcagatgaggattcagctattactcaaaataaagtaactaaagctgttcaaaggttgaatgatgttgctatagatgaccccttgtgtgagttgattaagagtctgtacgacatttacgagaagcctgttcagttgttgtgggatgttactaaatttgggattccaaatgtagatgcatccttgttcttaacatatgctgattgtatggaatccttgagccttagtcgatacacaatgcagaggatagaagtggtcaatgtcaagattacattgaaagatgggttaaggaatcccaacgagaggtctactcaggagcttatttga

SEQ ID NO: 67281 - DNA, 561 bp, Glycine max
  Peptide Sequence Number=SeqID_158966
atgactaatgcaaactgtctggaagaatcattgcattcagtctcaaacgggaatctaagagttattcagtccaaaactgatgggaagttggttgagttgaacactcagtgtgcacatgcagacaatggatgtggaagttgcagcagtgaagataatgccatgaatgaggctatacttaatagcaaacttgaagctgtaatctgttcagaaggctatattcttaaacaccagaagattcagtccaagattgacagatgtaagaaagacaagaaatttctagatgatcttaataagaatcttgtgaaaaataaggacatttggaaaacaaagatacttaggattgaagagaggtatgcttttttccgtcatgaagctaggcaaaaaagttctatgaatccagcttcctcttatagatataaacagtggactaaaagtataaacagtggactaaacatggataacatgcagcaagttaattctgaacaaagagatatacctattgaagattttaatgggaggcaagaacttgctggatcttctgaaacttcacaggaaatctaa

SEQ ID NO: 67282 - DNA, 240 bp, Glycine max
  Peptide Sequence Number=SeqID_158967
atgagtctcttccacatgatagtctccccctcgagcggaagccattttcatccacgagtattccatgatgaatggcaacggaatggagaaaggaagagagagaggagacgccacttcaaggagaagatgagtctagaagaagctcaccaccataggaggccatggataagagcttggaggaagaaggagatgaatgaggggagagggagagaagagcacgaaattttgtgctctaaatga

SEQ ID NO: 67283 - DNA, 267 bp, Glycine max
  Peptide Sequence Number=SeqID_158968
atgacatctccaccaaataagcatcctctaacaaatcaaagaagcagaaaaaatgtctttagaatatgtccattggatttaatgatgaaatatgtgcaattccagttgagcttagctcatcagtgggctaagcatgcatcaactgctaagtgcagcttcagcgttcttagcgtgacagaagaatctggcagagcatcaatatcaaggtcgcgcgctaagcgcgagattagtccgctaagcgtaggagttgtcttcagccaggcttag

SEQ ID NO: 67284 - DNA, 798 bp, Glycine max
  Peptide Sequence Number=SeqID_158969
atggatatgaacctgggctatattatttcagctcaaatttctatgatcacccaacatgactcttctaggcttgggtttccagccttaatcgctgctttctgcaaggccaggggagtcatttctaattcattgacattggagagcctcagtccaactattaatgtggcttatgtaaagaaaaactattggaacctagatgacctctcaattaccttcaaagggtcgtgcaaggccaggggggagaggtttgaggctcccccatcttctgagtttcccccttcctcacctccaacacctattccaactgtcccatctgcatccactgatcgaggaccattagattttatatttacacctcagttgcttcattccatgctccagagcctacacagggggcagcccatcatcatgcagagccttcagggcttgggcttgccatccattatgagcatggatgattttgatgtgcaggtggcctggccaggagcccaaccttctccttctggagggggtgggacctctgcagcccaagagcctgttccagcagcagcagagggggaggatgagctcacccctcttgagcctttttattttgatacatatgcacacatggctcaggaggaagggacttccatataccagatcccagagccatccccagcacccataccagatgatgccataccatctgcaccagcatctgagctagagcagcctatccctcaggattcaccaggtgctcaggtgttggatcttaatgagcatgcacaggagcaaccacaggagaaggacatttaa

SEQ ID NO: 67285 - DNA, 261 bp, Glycine max
  Peptide Sequence Number=SeqID_158970
atggcaggacgtggtagggatcagaaccgtgatgtcttagaccgcatcacagctgtgctggaaactctagtgcaggaatgtgatgtggagtcggcagagtatcggggactcatggctttccataagaaccacccgtcgaagtttagtagggactatgatccagaaggtgctaggttatggttagctgagattgagaagattttcgaggcgatgggttgcctcgaggagcataaggtcccttatgcgacgtttttgctctaa

SEQ ID NO: 67286 - DNA, 241 bp, Glycine max
  Peptide Sequence Number=SeqID_158971
atgggtgacaacatcaagggaaaagggacaaatcagggtacatcctttgtggtacaagtagagggtacatctacttgggttgttgtaattgagaacaagagagggtacatctcatgtggatcagttcaagtggagggtacatccacttggttgttcaaagagaacaagggagggtacatcccttgtggatctttgcttgtaaaggtttttacaaggttgaaagaaatctcaaggatcgcag

SEQ ID NO: 67287 - DNA, 87 bp, Glycine max
  Peptide Sequence Number=SeqID_158972
atggaggagatacatgttgaaaaattaagaaacaactatggaggagaagccatggagttgcagcggaagataaaggagaagaggtga

SEQ ID NO: 67288 - DNA, 1122 bp, Glycine max
  Peptide Sequence Number=SeqID_158973
atggctactccacctgactcggctcctcctcctcctcttcctgtagtagcatcacagtcgcaaccacctggggcagccagaccggtggtccacgttgatcctgcgactgggaaggtcgacggtccccacaagaagaaattaagaacatatttggggattgtcgctcgtgataaggtcgacgtgacatacaagacttggaagcaagtccctgctgctcaggaggatattcaagttgaatttgatatccttgaagcatctgacgctgacaacgacattgtggatgacactgtttgtgaaaaatacgacattagcaaggagaaatgggcccatttttgtcagacccacagagacccctcgtgggaggccatccataagcaaaacactgccctccacgtgttgtctcgtgagggttatgaatatttagaacagaagctgatggttgagaagacaaagaaaaaaatggaggaagctgctcaatccgaaagcactgaggctgtcattgaccctccatctcccatcagacgacacgtgaagtggaagatggctcgcacaaagaaaactggacagatgacgtttgagacagcaaaggaaattactgagaagattgatgtcctaactgctgccattgggcgaccagaacaccctggtcgtgtgcgtgctgttggagtcgatgtgaccatcaaacttgcactgcctccagagcctgaggttggtccctcagctgcttgtgtcaacacaaaggggagttgtgttgatccctcagcggtcgatccagacacgggtgactcagacaaatacgggttgtacattaaagaaaatcctccccacctagttgccctaggaagagtttatgagggatccacaatcgttcaaaccatccctttgttgcatgatcaagtgaaggttggtgttgaggaggttaaagatgcagatgctctcgttcctgtacccactgacgaggctattttagtgggacaggcacttaacaccttccttgcttggccgacacatctcataaagcgtttatcagaacatggagttgtgtctccagcaaaacctgcagataggccggatcctgaggtcgatgatcccctatatctgatgacattgaccatcgcataa

SEQ ID NO: 67289 - DNA, 513 bp, Glycine max
  Peptide Sequence Number=SeqID_158974
atgactaggggcaatctaggtgatttacaaccctttgatcctgaaatagatagaacctttcatagattacttaggcatagtgtgcatcctgatcattttgtgcattttgagcattttgagtattctgttgctggtgattctgaacattctgattttgagcattcgactactaattttcatactgagaacatggatcaacctccacctcgggagaggactcttagggagatggttgcacctgatttcacttatgaaagcttgtgcattcaatatcctgatgaggatgttccatatgttctcaagattggactaatacatttgttgcccacgtttcatgctcttgcaggtgaagatccttataagcatcttaaggagttccatattgtctgttccaccatgaaacccgctgatgtcctggaagatcatatctttctaaaagtttttcctcattctcgggagggagttgcgaaagattggttgtactaccatgctcccaggtccatcaccagctaa

SEQ ID NO: 67290 - DNA, 570 bp, Glycine max
  Peptide Sequence Number=SeqID_158975
atgtctggacctggctccactcctggtggtgcccttccgtcaattcctttaagtttcagccttgcgaccatactccccccggaacccaaagactttgattctcataagttgttcgtctttcataaatccaagaatttcacctctgactatgaaatacgaatgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 67291 - DNA, 405 bp, Glycine max
  Peptide Sequence Number=SeqID_158976
atggctccgagaaagctttccttgaaaagatctaggagggacaccgcggctaaagggactagagcgccgagcaccagcagcgttttgaggccatcaaaggatggtcgttccaacgagagacgcgtccagctcagggacgatgagtacaccgactttcaggatgagatagctcgtcggtgctggacgtcgctggtcactcccaaggctaattttgaccctgatatagtcctagaattttatgctaatgcttggcccacagaagagggagtgtgggacatgcgatcatgggtgaggggattttgcccggaccgctgcagggaggcaggtgcggatcatgcgcaccagtataaccaccttgactcagatgtggatgacgttgctgctcagcaatgtcctacccagtga

SEQ ID NO: 67292 - DNA, 882 bp, Glycine max
  Peptide Sequence Number=SeqID_158977
atgaccttagcggctgtttctctgagtgaagtgctggcgcgccgtgactgggaaaacccggttatcaccaacctgcatcgcctggacgcgcatccaccgtttgccagctggcgcgatgaagtcagcgcgcgcgatggccatccctcacctgcgcagcagcggctgaatggtcagtgggccttcagttattttaccgcgccggaagcggtgccgcacagctggctgctacaggacttaccggacgccgcaacgctgccggtgcctgccaactggcagttgcacggctacgatgcgcccatttacaccaacgtgcagtatcccattccggtcaatccccctttggtgccacgcgagaaccccaccggatgttactcgctcacatttaaagttgatgaaggctggttaagccaggggcagacgcgcatcatcttcgatggtgtcagctcggccttttatttgtggtgcaacggacagtggatgggctattcgcaggatagccgcttacccgccgaatttgatctcagccacgcgctgcagccgggaaacaaccgtctggcggtcatggtgctgcgctggagcgacggcagctatctggaagatcaggatatgtggcgcatgagcggcattttccgcgacgtgacgctgctgcacaaaccggacacccgcctgagcgatgtgcagatcgaaaccgcgctcagcccggaatatctgcgcggcgatttacgggtgagtgtcaaaatccatgccggcacgcgcccgctcagtcagtgtcgggtacgcgtcacgctatggcgcaacggcgactgtattgcgcagcacgaacagccgccgggcagcgccatcattgatgaacgtggccactatccggaacgtaccctgctg

SEQ ID NO: 67293 - DNA, 483 bp, Glycine max
  Peptide Sequence Number=SeqID_158978
atgatgataacaatgatagtagacacattaccagttttctactatgaaaagatggtgggctacacaccttcaagctttgctgatttagtcttcaccgacgaaaggatcaaagtagaggatgagaaggagggagaaacctatgctgtgactgccattcctatacggccaagtttcccaccaacccaacaatgtcattactcagccaataacaacccttctccttacccaccacccaactatccacaaaggccatccctaaatcaaccacaaagcctgtctaccacacttccaatcatgaacaccacctttagcacgacccaaaacaccaacgaaggaaggaatttcgcagcgaaaaagcctatagaatccaccctaattctggtgtcctatgatggctggctcccatatccactcgataattcaatgatagccataaccccaaccaaggttcctcaacttccatttctccgaaaaaacgattga

SEQ ID NO: 67294 - DNA, 250 bp, Glycine max
  Peptide Sequence Number=SeqID_158979
atggggacaaatcaaaccggcaagaggttttaccgagtcaaggttaaaggcctatatgccaccagcatcaaggaattagggcggttgatggaacccctccaaatgcaagccttccgcaagatttacggaaagatcttagatagaattgcaactgtggtcaaggattcagccagagggttggaccgcataaaacagtctcgaaacggcatagcgggcctaccacggaagtacctagaagacaaggcgaggg

SEQ ID NO: 67295 - DNA, 555 bp, Glycine max
  Peptide Sequence Number=SeqID_158980
atgcctttaatacaaggtccaacattgatagacgccggatgcctgacgtttcaagaggatcggcccaacgtaaaaacaaacccgctcgccaatcatggagggggagcagttaatgccgtcgggttgggtaagtcgcgcaggtctaagcctttaaaggatgtgacgacccccaggaggtttatctacgaggtcctacaaaaggggggtgtaattccccacagtgggcatgaagaggattcttgtttgttgcatcacaaaaaggtgaaagctatccttgagatgccggaaccccgtaccaagaggcaggttcgagattcatatcacagttcatcgctatttgtgagccattattcaaactcttgtggaagcaatgccttcaaaggttattttgatgatgccaaagaattcaagaatcaagagaaagattcaagagaagtttcaagtttcaagttttcaagatctcaagaatcaagatcaagattcaagactcaagattcaagaataaagagaagactcaatcaagataagtatcaaaaagttttttcaaaactttga

SEQ ID NO: 67296 - DNA, 176 bp, Glycine max
  Peptide Sequence Number=SeqID_158981
atggaagagcctcacaagatcttggcagaagctaaaaaaaagcatgttaagttgaggcatgtgatttttcacactctgattcatggatattgcaagttggaacagtttcatgaggctttgaagttatctgctggtgcaagattatggtgtcgtccaagcgttgatgagtatgacaa

SEQ ID NO: 67297 - DNA, 865 bp, Glycine max
  Peptide Sequence Number=SeqID_158982
gtaccctctagacccggataagtctaacaggaccctggggtttccagcattgatcacgggcctctgccggtcattcggggttcccgtcacacctagtaaggtgatccgaccgccgatcacccgggctttcattgagaagtattgcactcctaggcaggcgcaggggaatgcaccacaggccgcagacgcaccaccaccacctcatcaggctgatcccgctgggtcattaggcacggagcgttatttacgacacttggttcgccagcaggcggccaaccaccaggggcaggtgcagatacatgactgtctctaccagctcagcctcagtcggcagggtcagggtttcgctcctttcgcatgccctactccagatcagtttagggctgaggtcgcatggcctagagattggcctgaggcccaggcaggggaggtgcctgcaggagctctcaacgatgcagaggaggcccgtatggaggaggagatgacatacttgctcggcttcctgagcaagagcctcgcttttgtcgaccgccccataatctctgtcatacttaccctggggtcaggtgacatgaggagatacccaagtggcggcgggcctgatgacatgtggagatacccaaatggcagcgggcccgatgacatgcggagatacccaagtggcagcgggcctgatgacatgcggagatacccaagtggcggcgggcctgatgacatgcggagatacccaagtggcggcgggcccgatgacatgcagagatacccaagtgaggcggcgggcccgatgacatgtggagatacccaagtggttatccgcacttttgctatctctaagactcaaagcatgatagcatgcagagactaa

SEQ ID NO: 67298 - DNA, 141 bp, Glycine max
  Peptide Sequence Number=SeqID_158983
atgaaaagtgataaagcctcacaaggaaaggttaaggaagcatcaacaagaatcaagccaaggctattgtgcaagcaatcaatggggaaaaacacaccaatagattatgatgatggatggctcaaattctcacaaaggtaa

SEQ ID NO: 67299 - DNA, 517 bp, Glycine max
  Peptide Sequence Number=SeqID_158984
agtggtacctgaggatatgtcgcgggggtcaggagaccttggggacgtcaggcgagctcctggcagtcaaccaataaaggaacaaaagtccacgaagcagggaggcttgtgtggcggctggccagctatctatcttgggttgttatctgaaaaattccctctgatcgcgatggcagcacagttgatccatgatcgcgttgtaatggagtgcctagagggtcaacccgcacgcacacttcagcaacctgtggagtggatactacctacacctactccatatcgactagttgagcctgttcaattgatagaggtgtcatcatctgaagaggatcttaaagaggacccagaggagctacctcctgaacctgctgtggatgcctctgacttaccagaggatgatgaggacccgctccttgatgttgattctccagaggatattatgtcagcatctgaggcagactctacagaggagagtggccctggagggacatcgaatagtgatgactcttcatcatag

SEQ ID NO: 67300 - DNA, 762 bp, Glycine max
  Peptide Sequence Number=SeqID_158985
atggctccgaaaaagctttccatgaagaggtctagaaaggaggccgcgggagaaggttccagtaccaccttggaatttgatggtcaccggtttcggagcgccgagcaccagcagcgctttgaggccatcaaaggatggtcattccacagagaaaggcgcatccaactcagggaagatgagtacacaaactttcaggaggagatagctcatagacattggacgacgctggtgactcccatggctaagtttgaccctgagatagtcttagagttctacgctaatgcttggcccacagaggagggagtgcgagacatgcgttcatgggtgaggggtatgccgccaaccaggcaccctctggacccggataagtctaacagggccctggggttttcggctctaatcacaggcctctgccaatccttcggagttcaggtcacccccagcaaagtgatccgaccaccgatcacccgagccttcattgagaagtactgcacgcctaggcaggcacagggtgacgcacctcagggcacgggcgcactgccaccacctcggcaggctgatccggcggagccactgggcagggagcggtatctacaacatttggttcgccagcaggcggccaagcaccgcggacaggtgcagatacacgagtgtctctaccgtttcagccgcagtcaacaggggcagagttccaaccaccacggacatgtatgctctacctcaaagcagtttgcagctgaggtcgcatggcccgatgcctag

SEQ ID NO: 67301 - DNA, 1266 bp, Glycine max
  Peptide Sequence Number=SeqID_158986
atgaattgccctgccgccttgcctgctgcgccccgtaacgaagccgaactgcttcagcgtgcccaacagctggctggtcagagctttgccgcgctggccgcgcagcttggcctgccgatgcctgccgatttacgccgtgataaaggctgggttggcatgctgctggagctgctgcttggcgccagcgccggcagtaaagccgagcaggattttgcgcatctgggcattgaactcaaaaccattccggtcgacgcgctgggtaagccgctagaaaccacctttgtctgcgtggcaccgctcaccggcaacagcggcgttacctggcaaaccagccacgtgcgccacaagctggcacgggtgctgtggatcccggtggagggcgatcgtgccattccgctggccgaacgccgcgtgggttcgccgctgctgtggcagccgaatgcgcaggaagagcagcagttacgtgaggactgggaagagctgatggacatgatcgtgctcggccaggtggagcgcatcaccgcccgccacggtgcgtggctgcaaatcaggccaaaagcggccaacagcaaagcgctgaccgaagccatcggcgaacacggcgagccgatcatgacgctgccgcgcgcgccgcctgcgccgtgtataattcccgtttacttttcgtttaggaatgaaggattcatgtttgactggattgctgatcccaacgcctggctggcgctgggaacattaaccattctggaagtggtgctgggtatcgataacattattttcctgtctctggtggtcgcgaaactgccgcagcaccagcaaaaccgggcgcgccggctgggtctgatgggggcgatgttgatgcgcctcgggctgctggcctccatcgcctgggtggtgagactgacgcagccgttgttttccatcatggaccacgccttttccgcgcgcgatctgattctgctgttcggcggcctgttcctgctgtggaagtcgagcatggagatccatgaaaccatcgaaggcggcgaagaggagcataaaaccaatgtgcactctttcttcggcgccatcgtgcagatcatgctgctcgacatcatcttcagcctggattcggtgattaccgccgtcggtctgtccgatcacctgttcattatgatggcggcggtggttatcgcagtgctgatgatgatggtggccgcgcgcgcgattggtgagtttgttgagcggcatccgtcggtcaaaatgctggcgctggcgtttctgattctg

SEQ ID NO: 67302 - DNA, 536 bp, Glycine max
  Peptide Sequence Number=SeqID_158987
ggatcgcgcccacaagacacatagtggacccggagaagcccaacagggccttggggtttccactctggttatgggcctctgtcagtcctaccgggtgcacgtcccccccagcaaggtcacgccatcgtgacatagggatcgcgcccgcaagacactcagtggacccagagaagtccaacagggtcatggggtttccagctctgattatgggcctctgtcagttctacagagtgcctgtcgcccccagcaaggtcatcaggccccctactaacctagctttcaacaagaagtattgtgccccatgcaggcgcagggcgagacaccacaacagcttggggatggccggtagcgggcaacagacgcaccgccgccatctccaaagcccttcagctcatctacaaaagttggagcgttgcctacgacccgtggtcgaccagcaggcgatcaagtccaaagccaaaggtaagcaaagtactaggtccgtgaccgacaagtcatcacgcgtccagctcgcgacgctaaagaagcgctactag

SEQ ID NO: 67303 - DNA, 150 bp, Glycine max
  Peptide Sequence Number=SeqID_158988
atggctaccattgcattattgagtagatatgggtggtggtgtttggcttcggatgtgcagcaggcgggttttgtggctgatttaggggctgcctttgtggatgattgggtgttcttggctagtagggtggtgggtaatgagaaggattga

SEQ ID NO: 67304 - DNA, 441 bp, Glycine max
  Peptide Sequence Number=SeqID_158989
atggtatttttcgtagaaatagcattcttgcttatttcgatgatcctcaagctgtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 67305 - DNA, 572 bp, Glycine max
  Peptide Sequence Number=SeqID_158990
atggatgaaatagagaaggtgcaagagcagatgaaggccgacccggaggccttgaaagagaaaatggccacaatggtagaggccatgatgagcataaaggagatggtggaggtcagtgcggcttaccaaacccgtgctagagctaaaataatgggtgaagtagagaaggtgcaagagcagatgaaggccgacatggaggccatgaaagagcaaatggcacatgaaattccctaccacaatctagccgacttcgagccttgcctcggatatgccgctgaagggcaagcagttggtggtgtacccctgcaaaacactttggagggccctcagtatcatccacaaccacaaccctcacgttccacaacaagtaaaaaccctcgtgctatggcagaaatggaaaagttggatcatctaaaggaaaggctcagggccattgaaggaggtgaagattatgcctttgctaacctagaagagttgttcctagtacccaatatcatcacctctcccaagttcaaggggttggactttgacaagtacaaggggactacttgccccaagaaccatctaaagat

SEQ ID NO: 67306 - DNA, 218 bp, Glycine max
  Peptide Sequence Number=SeqID_158991
gtcatttggcatagagcggtatttacagcacttggttcgccagcaggcggccaaccacagggggcagatcggttcagggctgaggttgcatggcccagagattggcctgaggcccaggcaggggaggcgcccacagaggctcccggcgatgcagaggaggcccgcatggatgaggagatgacaaatttactcggtttcttgggagggagtggagccac

SEQ ID NO: 67307 - DNA, 171 bp, Glycine max
  Peptide Sequence Number=SeqID_158992
gcattggcagaggagatcaaggcaagatatgataaagcagctgtcaaagttgttgacctgctaaagatggatagtgccagatgttgctgtctatgccaagatacatatatatgctctaccaataaagttgtaattctagttgaagccattctcctaagtcctaatcactaa

SEQ ID NO: 67308 - DNA, 114 bp, Glycine max
  Peptide Sequence Number=SeqID_158993
atgggggatcccatcagcagactctccttccctgaaaaacaccgagactttttcaagtctcacaagtatccagaactacgtaggtctgagttcctcacttggagggatgactag

SEQ ID NO: 67309 - DNA, 471 bp, Glycine max
  Peptide Sequence Number=SeqID_158994
atgcctcaaggtaccttaggtagcaaaaatgcctcaaagagggacgcccctggagaaggctctagcgccatcatagagtttgacagtcgtcgattctggagtgctgagcaccagcagcgctttgaggccatcaagggatggtcgttccatagggagaggcatgtccaactcagggaggatgagtaccctgacttccaggaagagatagctcgcaggcgttgggaaccactagtgacccatatggctaaatttgacccgaagatagtcatagaattctatgccaatgcctggcccaatgaggagggagttcgggacatgcgctcgtgggtgagtggtcactggattccctttgatgcagatgccctcagccagttcttgggcaacccactgattttggagaaagaccagcagtgtgagttcagccagaggaggaaccaggtagacgacttcgatgaggaggtcatcgcctag

SEQ ID NO: 67310 - DNA, 219 bp, Glycine max
  Peptide Sequence Number=SeqID_158995
atgcgcttagcggataggaggaatctagaagggaatctatcacgcaggcacacgctcagcacgtcatcagctcgctcagcgagtcgtttgtcaccttctaggcttagcgcgagtttggcactaagcggaaattcacttactcatgctgagcgcgagaatggcgctaagtgcgatgtcgaggtcagtaagccctttttaagcctgacttgcagagaataa

SEQ ID NO: 67311 - DNA, 204 bp, Glycine max
  Peptide Sequence Number=SeqID_158996
atgtgtctatcggggaaggagagtatgctgatgaaatttagaggaagcactgggttcaacaaaaatagaagaaaatcactcaaagtgtatcaatctcacacagtgcggggcgagaaagtcgctagcgcaaaggattttggttggcaatcaaagggagagggccactttaggtcgtggtttccttttttcttgtttatttggtga

SEQ ID NO: 67312 - DNA, 267 bp, Glycine max
  Peptide Sequence Number=SeqID_158997
atgggatcaagtcaggcgcctttgcttaaaaagaggttctatcaagtcaagatcaagagcctaggagtcaccagtctgaaagagttaggccagttgatgggtcaactccagcgacaagccttttgcaaagcctatgagtttaaagagatcctgggatgccctctgggaggaaggaaaccatatcttttctcagggttctatccctcattggctagaatttccaaagtagtcaaaatctcggcacaggaattggaccgggggaagtaa

SEQ ID NO: 67313 - DNA, 987 bp, Glycine max
  Peptide Sequence Number=SeqID_158998
atggatgagcacagcctactccaacatcccaactcccttcaggctgggagcaagatagtatggcctttcaccatagcgtttattcaagaattgaaaaatgacctgtcccagagagatgcaactcacttccactcttccaccccttgtggatgttgggggacttggttatttttaggaagttctgatgtttgtatggtgcagtttttgtcagtattgaattctgatgcagcatttaacagcgaaattatccgggaatgctatgaagcttttgcattatactgctttgagagatatttgatagcttgcttaggtggtgaggagaaaacaattcaatttatggagaacatgagcctaacagaatccagcattcctcttctgaaagaagcctatgcatatggagttgtagagcacccatttcccttaaatatcttcttggaggattggaatctaggccctgagttctatcaatctgtgaaaattggcattgtacaatatatgatactgaagatgatctgtgcattactggcaataattcttgaatcttttggggtttatggagaggggaagtttgaatggaaatatggagatatgaaaatcattcttgcatctcctcctatctgtttaagatttatggagaattggttattgacatggtatccatacttggcactagttcttaactttagtcagacatgggccctatattgccttgtacagttctatgctgttattaaagataagttgaaacccatcaaaccattggcaaagtttctaacttttaagtcaattgtcttcctgacatggtggcaaagtgtggctgttgcatttcttttttatatgggagcttttagggggtcattggctcaggagttgaaaacacgtatacaagactacatcatctgtatagaatgtgatataaggtggctacatggtcctgtgcattgcacctgtcacacgggcaaccctgatattgggacactatactaa

SEQ ID NO: 67314 - DNA, 252 bp, Glycine max
  Peptide Sequence Number=SeqID_158999
atgaaagatgcggataaccatacggtacccccgcatgtcatcggacttgttgtctcaggacgacaaaaggtgcagaagacgacgcgaggatgggcattctcaccatgggtcaaggtttatggtgagttgggattttggctcaacgcttatagaacggctggacatgatatatgtcagagtgttggtttggccagcgattcagggataaaggggatgtcccacattatttccatgacacacatgcaacaatga

SEQ ID NO: 67315 - DNA, 231 bp, Glycine max
  Peptide Sequence Number=SeqID_159000
atgcggataaccatacggtacccccgcatgtcatcggacttgttgtctcaggatgacaaaaggcgaggatgggcattctcaccctgggtcaaggtttatggtgagttgggattttggctcaaggcttgtagaacggctggacatgatatatgtcagagtgttggtttggccagcgattcagggataaaggggatgtcccacattatttccatgacacacatgcaacaatga

SEQ ID NO: 67316 - DNA, 216 bp, Glycine max
  Peptide Sequence Number=SeqID_159001
atgtgtgtcgcaacctacccttcggcgggagggcgacgcgaggctcacgggtgcgtcttccaagaagggaagatgcgcagagtcgccaccaacgtttatttgaggaaaacgtcagaaaacccgaaaaggtgtggtctacgaactttaagtgtgaaagggtgtttccctcgctcctacgtattcctcaattgcaatgagaaaatcagacctacgtag

SEQ ID NO: 67317 - DNA, 384 bp, Glycine max
  Peptide Sequence Number=SeqID_159002
atgtcttccaaggttattttgatgatgccaaagaatcaagagttaagcaaagtttcaagattcaagaaaaatcaagatcaagattcaagaatcaagagaagattcaatcaagataaatttcaaaggactaactgcctgagatatcttttgtttccccttacaaagattcaaaggactaaccgcctgagaattctttgtcttaacacattggagggtacatcctttgtggtacaagtagaggatacgtctacttgggttgttgaactaagaataagagaggagaacaagggaaggtacatcccttgtggatctttggcttgtaaaggattttacaaggttgaaagaaatctcaagaaccacaggttgcttggggactggatgtag

SEQ ID NO: 67318 - DNA, 726 bp, Glycine max
  Peptide Sequence Number=SeqID_159003
atggcacccaagaagaatttggtggttatgattctaggcattaacgatggacaaaatgccaagaaagtgtttctagaggactccttcatcctagatgatgggttagacaagcttcctagaaaagttcaattcttgccactatgtccatatatgcattgttctaggactgctcgtcaagacaaagtcatcatcagaggcatcgtccaaggaaaagaggtcaccatctctccaataacaaatgttgttgcatctagatgtctagaagagaggtttgtgtttgataaggaatgggagaaggagataacttgggaaatagtggatattatgctctatggtggtccacaaccagttacaaatgataaagttgtgttgagaaggtttctgaggcctacaaacctatcccacatgtgcagacttattcacatattctatatgtgtaaggtgttggtagatgttagtgctgatgtgtctggcatgacactgtctggtggtgcaacacagcttaagtgtatgacctttgtaaaaatgggaattactgataatttcccaaaatatgctcaaaaatatattaagaagaacaacaagaaggaaccaaaggaagaatcacaatctatagtagaccaagccaagaaaaccaaaaagcaacctctatttgatcccaagccttctgaccctaaacctacccaaaagaggaaggctcaagactctactaagtctaaaccttaa

SEQ ID NO: 67319 - DNA, 159 bp, Glycine max
  Peptide Sequence Number=SeqID_159004
atgatgttgtcaagcactggcgctcaagcgcaatgggagttgctcttatgcgtagccgtgcttaagtgcatgatgaatggcagcggaatgaagaaggaagagagagaggagatgccactacaaggagaagatgagtctagaagaagctcaccaccatag

SEQ ID NO: 67320 - DNA, 441 bp, Glycine max
  Peptide Sequence Number=SeqID_159005
atggctgaatcaatgaaaaagagaaagggttcttcctccaccaccgtcgttgttggccatcgccgccatagaccatctgaagcacccatagcactggttcctccttctgtgatcattctagaccctaagtaccttgatcttgaattctttgatggagaaacatttgattgttatcaatttttctattcaaatttgaaaattcatgatggtattctttactctgaggtgcaaaatatacccattgttattaatcagtctttattcttctcattgactaaattacccagtcaaggtgttccttttgagggcactattgttgatgactggaagttcgattactcaagtcatgatgctcgtcgtatggtctatgatgaccaggctaatatgactggtagatttcttgctgagtcattaacctttgactgtcgcatcatgcactaa

SEQ ID NO: 67321 - DNA, 273 bp, Glycine max
  Peptide Sequence Number=SeqID_159006
atggggctctttctaaacaatttccgggatgggtctatttttgacgtgaactttcaaagaaaacgccagcagcaatggcgatttgagcatgcagcaacacgtggagggaaaatcgccagtaccaacgatgatttcgtaccagctggactcgccagtttgactagcaagttgcaccctgtctcgccagacgcagtggcgacatgcactggtgcatgctggtctcgccatgaaaaagctttgctccttcttgtgctgcctcttgctcgtgcgtag

SEQ ID NO: 67322 - DNA, 384 bp, Glycine max
  Peptide Sequence Number=SeqID_159007
atgaatgacttactttatgtcatgtacaacttgaagctcaaaagtaaacaaacaagaaaaattgttgttcttccatttaaagatatgaaatctgatgatgagtggataatagaagagggagatgatattttttatgaagacaatctccaagttgagcaagaggaacctttaggggaaagtggtagcggaagtaatattgacttggttggaggaagtttaaccgatccaactttggatgcatttgatattgacaatttggtgttgaatgacaatgtggaagatcacttctcaactgaggaagagcttgaagatgatggagatgaagatgatggtggtggtggtgatattttagatgattttattagaggattgatggacatttga

SEQ ID NO: 67323 - DNA, 246 bp, Glycine max
  Peptide Sequence Number=SeqID_159008
atggtgaagctcaaagaagggaatattggtgcagcttcagagatcttccagttcttgcttcttcttgatgaaggtatgatcgagaatggtggaaggatcgtagaggacttcaaagttgttgaagatctcaagggttgggttcatctaagacttgacccctcgggtataatgatccaatatgttcacgattaccagagggtgcagcttgaacatcaatctgctactcgattacgaagccatgcttga

SEQ ID NO: 67324 - DNA, 463 bp, Glycine max
  Peptide Sequence Number=SeqID_159009
atggtgccggatgagatcaaattgctaatgatgaaaattgttgctgaatctaaagcaacaaaagaaaagaaaaggagattgaatagtattgatgaagatgaagaaagggctgagggggtggaggcaaccaacttgcaaggacaaaggggttttggttcaaaaggaaaaaaaggtagtgcaagtagtggaagtggcaatgttcgagcaactttgaatcaattgatgaaaaaaaaagagaaacctttagttgatgctcaagttgctgaatttttttacacaagtgtcattccattcaatgctatcaaaaatcctgcatttttaaagatgtgtcagatgatcgggaaatatggacctggctatagacctccatcttatcatgatgttagagagaagttgttgaaacaagcagtgcagaaaactgatgatagtttgcaagagtttagggatgagtggaagagaactg

SEQ ID NO: 67325 - DNA, 186 bp, Glycine max
  Peptide Sequence Number=SeqID_159010
atggttatcaatctcggattggcacatcatggagcaaagcttggagcagcaatccagcatgacgcgagtagctcaggagaaaatgagggctttcgacaagtgagggctttcgacgagtgttctgcgatgatgaggaccagcagtctagcacgacaccagtcagacagagtcgcgagtgagggctag

SEQ ID NO: 67326 - DNA, 213 bp, Glycine max
  Peptide Sequence Number=SeqID_159011
atgtcttcttggttgcaaacactgaacacaagggacgaccaacgttccttgggttcattgcaagaagcaggatttgcttcttggttgatcactggacacaaaaaaccaacgtcttttaggttcattgcaagaagtgggtataacttcttggttgttatcagaggacacaagggaccaacgttccttggggttcattgcaagaagtgggaataa

SEQ ID NO: 67327 - DNA, 1173 bp, Glycine max
  Peptide Sequence Number=SeqID_159012
atggatgttgcgcatttcattttcgggatatttgggaatgcttctggtttgttcctcttcttggccccaatagtgacattctggaggatcgtttcgaacaaatccacagagaagttctcgggggttccttaccctatgacacttctcaattgtctcctttctgcttggtatggtttgccatttgtgtccccaaacaacttacttgtgacaattatcaatggcacaggagcaggaattgaaatcatatacgtctttatattcatctacttcgcaccaaagaaagagaagaccaagattattggccttttctccttcgtggtggcagtgttctctgttgttgttctggtgtcactgtttgctctgcagggcaatgcccgaaagctcttctgtggcttcgctgctgccatattttccatcgtcatgctagtgataaaaaccaagagcgtggagttcatgcccttcttcctctcactctttgtgttcctctgtggcacatcttggttcatctacgggctactaggccgtgacccatttgtggctcctcttcttcctcgttgggttccgactccgcaactcgctttcgccagggctattcaagaggagagagtcgcgtcatcgcgcaagggaagtctgataatgatgggaccagacgactatttaggttgtggtgtttttgttccaaatccatcgaaggttgatgatggtggtctgtcgtggttgaggatggtaagggtcattttgcgtttggctcaggtggtgcggttcttggtaatccgacgtggtggtggtacagtactgggtttggctagtgttgtgttaatgatggttggaggtggaatgcagaaaactatcatggatgccaacctcctccttcctcatcgtcatcctcacccaagcacgtcgtcaactacaccaatgaccttctctaaacaaacgatgacattgatgacgctgacgaggttgaccggccccttcctcgatcttgtcaagtgtcatggtggatccatcttgaggttccatttgaagggttttcgttgctgcactaatggttcttttaagggggggtgggtggtgattggaggagtcatcggaaattgcatcaacgatgtcaaggttcataaggaaaagagttggaggagaaaagaatggtgtgggaagttcaagatatcatga

SEQ ID NO: 67328 - DNA, 567 bp, Glycine max
  Peptide Sequence Number=SeqID_159013
atggtcggtggagctatttcgtggaggagtattaagaagactttgactgctacttctaccatggaagttgagtttgtctcttgctttgaggctatatcacatggtgtatggcttaagagtttcatttctagactaaagtgttcttgtcttgatcttcttggtctctctctcagcagtggtctgcaccacgcttccatctacaccgcaaaagatgtaacattcaaaagggtcatgagtgctgtccctgcgtttgtgtacgtcaccgtggtgtggcaaatatcaagtgttgcggctgcgttagaagactatcacggtttcatcactcccgaggagatggtggtgcaaggatggagtgtgagtcctttggaaggagcagcatttggggttctatgcttcttgttattgtcttgttcgttccctttctggtttgttgtgcaaactgcgttctattttgtttgcaagtcctatcacaatgagaacattgacaaatcagctttagcagatcgtcttgaagggtatgccaataatggaagtccggatgttcagctgaagcaaaaccaagtttga

SEQ ID NO: 67329 - DNA, 1734 bp, Glycine max
  Peptide Sequence Number=SeqID_159014
atgagtgatggattttgcggtactcatttgcagatcatggttaggaccagaggattaggtcgtgccttaggtcaggtcactcgcaaaggtgtgggaagaggagatcatgatgattctgatgattctccacagcgtcgacgacttgctgcattcacacggaggcagcgagtcgctgtgactgcggatcacatcgatgagccagtcatccctgacccagatgttcaggatgacccgatggaggcaccaactgctgtggaggaaattcctgcggacattcctgcggacgcaggcgcagaggaggctgaggatcagcctcagggatttccgggtggtccgagcgacccatctgtgctgacaatgtatgcggatcacgttgcttgcagcgtatggacgggagaggagcgtcctgaattgaagttatcctctcatgggaggaaggtccacagtttaggcaggcctgtccctgccattgagggacttattgctggtacaggactaagtcctctgatcgcgtgttcggtagacaccgacgatcggggacttttgtctgcgtttgtggagcggtggcaccgggagacgtctagtttccatctcccggtgggcgactttcacgcatttgagcccttgcacgtggatgatgcggttcagatgctggtggacttgttgatggtgtctccagagtctgctagggctgagacagtccagtgtcgcgaaccgtacgtacgcctacaatgggtacgtgatatatatcagcgacgatgccaggcaggtcattggacagctgtggctcgtgcatatcttcttcacctactgggttgcactctgtttgctaacaagagtgcaaccaatgtccatgttgtctacttggaggtccttcgtgaccttagtatgacagagaggtacgcttggggagtggctactttggttcatatgtacgaccagctgaacgatgcatccatgagccacagtcgacagcttgacggttacatcacactactgcaggtggattgcgacaaagaagaccgtgaagagaattcgcacgccgtcgtacagggagcgcctggactgactccggatttcggatgtctgttggatcccgtatggggagcatcgggagagagggtcgtgcgccagtttggttacacgcagaccattcctgctcctcctgtcgattcatgggtcttgtatgatgatatacacgacaggtggatgcactacgaggatcatatcgtacctgcaggggcgtgttccagtgactacatcgactggttcttccgcatcttccatcctttcatgacaccaggtcatgcagccccgcagacagatatccctcgtgtgccagagccaggagcatcgtcgacatctgtggaggagcccagacatgcagtggaagtttgtgatgacattgctgagaggttggagcgccatctgaatctaggggtggtcacgcctggctcatcgacacatgaggtgatcgaagaatgtctcagattggccaggagtgtgacacaagaccatctacccgtcattgatgagttggcgaaagagtactcaggaaaaattgcatgcttcaagcttaacaccgatgactatcccaacatagctacagagtatggaatcagaagcatatcaactgttttgttcttcaaaaatggagaaaagaaagaaagcgtagttggtgcagttcccaagtccactttgtccgcaacagtggagaaatatgttgatgtataa

SEQ ID NO: 67330 - DNA, 345 bp, Glycine max
  Peptide Sequence Number=SeqID_159015
atggatcccagtgcaaggcaaaacgccaatgggattggcgatttggcctgcaaaccgccaatgggtctggcgatttggcctgcaccctgcactgccatgtctgttccctgcactgccattcgcagggctagtctgcaccctcaagcattggaactcgccagtttgattggcggttccctacgcaatccgcatatcgccattgaagctggcggtttcagccctcaatgcaccacaaaatttcgtgctcttctcttcctctcccttcattcatctccttcttcctctaagctcttatccatggcctcctatggtggtgagcttcttctaaactcatcttctccttga

SEQ ID NO: 67331 - DNA, 972 bp, Glycine max
  Peptide Sequence Number=SeqID_159016
atggcttggtggcagccaacgaaggtctgcagtgacgatggagaccagtgtgacactcgttggagatgcatcacacatcgtgcacatgaacttaacgtgttgggaaagggtcttgtgatcagtagtgttttgagttggcttcgcatgtggatggtgtggcggtctttggcgatgggcgacagtggtcaaagatttagtggaataacgtctgagatgttagatggcgtgacaacaagtctgagagacattcaggaagagttcataaagttggtttacaaggagactatccttgttgggcattctctggaaaacgatttgttagcattgaatatatctcatgactcggtcattgacacagcagtattatacaaacacccccgaggatcgtctcataaaaatgctctacggtttcttactaagagatttctttcaagggaaatccaacagtcagggaatggacatgacagcattgaagatgctagagctaccatggaattggcactattgaagatcagaaatggcaagaaaaagctcctttctattctgagtgagtctggcaaaatttcctcactgattgatgatatatccgtagtaaaacggtatgcctcagagtcctctcatgcaattccagtgacctctgatgatgtagcacttgcaaaggccaacaaggaggtgaagaatgaaaaggtacattttatctggactcagttttcagagctacactcgtacttgaagaaacaagctgaagattctgagagcttgaataaaagacttgcagagatgattgcaataaaaacatgtcaaaataattttgcaaaagggaaaggcttcaagttaaatgcatctgctgaactgaaggaaattctggctcgcatggacgctagaattcataatctgtatttgtcattacccacaaatgctatgatgataatttgcactggtcatggagacactgctattgtccgcaggtaa

SEQ ID NO: 67332 - DNA, 942 bp, Glycine max
  Peptide Sequence Number=SeqID_159017
atggaactttacggattacgcaatgatgctcttcttgacttccagaatgttgcgggactttacgaattatgcaacgatgctcttcttgagggtcccgaagggaacaaacaagataaccacgaggtatctccacatgctaccagacccttgagtctaacagtagaaacgagattttttcgcggtctcggccggaagacgctgacatctttgggaaaggtacaaatgactatgttagtctctgcatgctaccagacccttgagtctgacggtagaaacgagactttttcgcggtctcgactcgaagacactaacatctctggaaaagatgctgacatctctaggaaaggtgtagatgactataagatgctgacatctctgggaaaggtgcagatgactacgttagtctctgcgtgctaccggacccttgattctgacggtagaaatgagactttttcacgatctcggccggaagacgctgacatctccgggaaaggtccagatgactacatgttaacatctccaggaaaggtgcagatgactacgttagtctctgtgggctaccagacccttgagtctgatggtagaaatgagactttttcgcggtctcagccggaagacgctgacatctccaagaaagacttggggtcttcgaatgacgatgtgcggataactgtaaggtgtctccccatgctactggactcttgggtcatgataggaaaagtgcggggtgaggaagttgccagcgaacaggattttggttggcaatcaaaaggagatgaccacttcaaggcgaggatggaaatactcatctcgggtcaaggtttatggtggtttgaggttttggctcaaatggcttgtagaatggctggacatgatatatgtcagggcgttggtttggccaacggttcagggataaaggaatgtcccatattatttccatga

SEQ ID NO: 67333 - DNA, 300 bp, Glycine max
  Peptide Sequence Number=SeqID_159018
atgcagggtatcacgcgcatggatgctgccctggacgcaatgcgtccacttggatttcggacacaattgattctacgaacggttaatgagcttctcgatgttgcacagggtggagggaaaaaaactggtcaatactctaggcatgttacgggctgcaggtatggtatcaatctggctaaaggtattctggaacatcactcgaaagggatcctagattctgacaaaccaaggaaattgctcgcaaattttcaaattggcaagctcatcataggttatgtgtttgatcaaatgtcaagatga

SEQ ID NO: 67334 - DNA, 249 bp, Glycine max
  Peptide Sequence Number=SeqID_159019
atggattatcaagatcgtatgggagttcaacaacatcatttacctagggatggaatgtacagtcgaattagggtgtggggcaaagttatgaagtccagcaagcttccacaacaagagtttcacagttcaattcaacttaatgtgattcagccaagtgcaattctagcaatttcactttctcttgggcaagataaccctattcaggctgcatctattgggatggttcactactacaaaaagcagttttaa

SEQ ID NO: 67335 - DNA, 198 bp, Glycine max
  Peptide Sequence Number=SeqID_159020
atgtttctaaatcataaggatgactctcttgatatcttctttaaattctataaacgtgttcaaaacgaaaatgatgcaatcctccctaggaagggaccaatcactagaaccatgagcaagaggctccaagaagattgggctagagctgctgaagaaggccctagggttctcatgaaccttaggggctccatattgtag

SEQ ID NO: 67336 - DNA, 579 bp, Glycine max
  Peptide Sequence Number=SeqID_159021
atggcttccatgatggatgccatactgggaatgaaacaactaatggagagtaacgcggccaccgccgccgctgttatttctgctgctgaagcagacccgactctcccaactgtcgcgcaccacccttttccgaacctggtgggacgagagagaagcacatcggggcacatcagcaacccccatctggggtacaaccgaggagcttacccctacggtttaccacctaattacacaccaccagtcatacgtgacgacgagggtcacgttcctcccctcattctcgaaggggagcctcctcgacatccagacgaggtccacgaggatcatcgagaacatgctcagggagacgtcgactcctactccccgttccccgccgagggatcggcacccaattcactacctcagcctaacatcacgggagaacctcggaaccacccaacacagccaatgtttctgtccatgggagggccaccccgggaagtggaaggaaaggggaaactcgatctcattgaagaaagattgagggctgttgaagggttcgatgattatccattcgcagacatgaccgacctatgcctg

SEQ ID NO: 67337 - DNA, 201 bp, Glycine max
  Peptide Sequence Number=SeqID_159022
atgtgggtgtcgagcgaacggtttccagtagatttcaggcgggaggagaaagagaagaacgagtgtaggggtttcaatggcatctccaatcatctttcttccatctctaattccactgccattgatcttcaagaagcaaaggactcaattggtgaagaagatccaaggcctacaagctccacatggagctacatcacttag

SEQ ID NO: 67338 - DNA, 970 bp, Glycine max
  Peptide Sequence Number=SeqID_159023
agggctgcacgtcctcgcctttagagggttccacgtcctcgccataagagggttgcacgcccttgccttcagagggctacacgccctcgcgttcagaggactacaagtcctcgccttcagaggactacacatcctcgccttcagagggttgcgtaccctcaccttcaaaggactacacgtcctctcctttagaggactacatgtccatgccttcaaaggactacacgtcctcgcgtttagtgggccacacgccctagacttcagaggactacatgtcctcgccttcagagagctgcacgccctcaccttcagagggctacatgccctcacctttagagggctacgtgccctcacctttagaggactacacgttctcaccttcagaggggggctgcacgccctcgtcttcagaggactacacgtcctcaccttcataggactacacgtcctcgccttcagagagctacacgccctcgcctttagaggactacacatcctcaccttcagaggtctgcacgcccttgccttcaaaggactacacatcctcgccttcaaagggctgcacgtcctcgcttttagagggatccacatttgcgccttcagagggcttaaggagtgccaactgtgcgagcacaaccagagggaggctattgtggaaccactatgcatactggggcaagatttcacccgtgccgctacaaagagacgagtgcggatcatgcgcaccaacatggcaactcttacacagatatggatgacggattgcacccataagacacccagtggacctggaggagccgaacagggccctggggtttccagctctggttacgggcctctgtcagtcctacaggggatcgcgcctgcaagatacccagtggacacggagaagtccaataggatcttggggtttccagctctgattacgggcctttgtcagttctacagagtgcctgtcgcccccaacaag

SEQ ID NO: 67339 - DNA, 677 bp, Glycine max
  Peptide Sequence Number=SeqID_159024
gagttggggcggttgatgggacctctccaaatgcaagccttccgcaaggcgtacgaaaagattttagatttgaccatagcagagatattcacggaggccgttgtatcactcaccaatactatgaccagcctttgagatgcttcacgtttggagacttccaattagtaccgactgttgaagaatttgagaagattctaggatgtcctcttgggggaagaaaaccgtatcttttctccgagtttattccctccttgagcaagattgcagttgtggtcagggattcggcaagagagttggatcgtgtaaagcaaactcgaaacagcgtagtgggtctaccacggaagtacttggaaggcaaggtaagggatatggcgaatcaagaggagtgggtcccatttgtggacgtattagcattgcaaatctttggggttgtcctctttccaaacgtggacggtttggtagacctagccgcaattgatgctttccttgcatatcactatagcaaagagagccgggttgtagctatcttggcggacttatttgatacatttgaccgaaggtgcgagaagagtagcgcacgggatcatctgctgcttacccgctctttgtgtatggttggtttcgcacctattccaacaagacataagacacccatgtccgctccgaagccgttgctc

SEQ ID NO: 67340 - DNA, 267 bp, Glycine max
  Peptide Sequence Number=SeqID_159025
atgcagaatactgagcattccaagacgatgatgacaaaggtgatgacaaaaagctcaaagatcaatcaaagaataactcaagtaaatcaaagatcaatcaagaacaattcaagagttcaagataagaatcaagaagaattcaagactcaagaagaaagtctagagacaagaatcaagattcaaggttcaagatctcaagaatcaagatcaagattcaagactcaagattcaagaatgaagagaagactctatcaagataagtattaa

SEQ ID NO: 67341 - DNA, 402 bp, Glycine max
  Peptide Sequence Number=SeqID_159026
atggaaaagtcatttgttgggcatccatttgtgagtcgactatcaaatgagaagattattgttgctgatatgacgaagtccatggtgaagccaaaaaatattcttttgacgttgaaggagcacaatgacaatagttatacaacaataaaaaaaatttacaatgccaataggaatgacattacctacaaaacaaataggtaccaactgtcgttgcttgatattattggtgttacaccaacaggaatgacattctccgctacttttgcttacttgggaggagaacgtcttaatttgtctctgatgaatgcattgaaaaatgtattcccagatgctacgaacttgttgtgtcagtttcacattgacaagaatgtgaaggtgttggatcaagtggcctcggaataa

SEQ ID NO: 67342 - DNA, 1175 bp, Glycine max
  Peptide Sequence Number=SeqID_159027
atggggggattaaagttatatgttaacatccctaaatttgaaagaggtaggggtcgagtgcaaccacaatcaacagggggacgagaacacaccaggcttgtcgaacaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgggtgggaaggctaaaaaatcttgcactccttgacagagtagaggagaatatgctatgggactggggattagacgtagtgccgaaatacatcggcgacgacatggtacttctccccggacttaccgaagacaaggcaaaacaaatgatggaggaagggaatgcaggaagggaggtgatgttctactcggtagaaaggtggaacaagaagatgcgtgctgggtctagacttacatgggtgcaatgttggggagtgccgctggtagcatgggacccaacacacttaagggagatcgtgacggccataggcgaggtagtggaagtagacgaggagatggaggatttgaggaagatggacagggcaaggctccttgtaagaacaccgtggaaaccactgattcagcacacggtgagcgtccacattgaaacggaggtgttccaggtacacataatagaggaaagtggaagcagtcccaactggtgccattgccggcggagcacgatgcttagttcatcggaggacatttgctcggaggaaagcgagatggtttcgttatcggaactgatgacggcgaaacctcaaagtgggagccagaaggttgaaatggtggaggagcggagggtaacgtcggaggcggacacagcgccggaggaggataacggcatgcaaggaccgacagcaagcacctccatccagttattatccaatggtcgcatcacaaccagcgaaccactggataataacttggactgggggatagaggaagaaagccgttgcagggtcggtggggaaagcaacggggcaaccaaaagtcaaatggggacgtacggtgaggccagagcagcagtgggagcagtgaccag

SEQ ID NO: 67343 - DNA, 213 bp, Glycine max
  Peptide Sequence Number=SeqID_159028
atggagtcgccaactgtcgcaagctatccttcggcgggtgggcgacgcggggctcgagggtgtgtcttccaagaaaggaaaatgcgcggagtcgccaccaacgtttatgctaggaaaatgtcggaaaaactagagaaggtgtggtctacgaactttaagtgtgaaagatatattttgactgaacaaatgtcgtttaaggcattggaccattaa

SEQ ID NO: 67344 - DNA, 243 bp, Glycine max
  Peptide Sequence Number=SeqID_159029
atgcgcgaaacacaatgtggaccactacgggcacatagaatgaatcgaaaagcttgcaaaataggggaggtggttgccgcccagctcgcccaggcgagctcagctcgcccaggcgagcagggttgcttcctccagaagcaaccgccttctggaggaatattccagagggcccaagcgaattttgtggttgatttagggatggcctttgtggttgattgggtggtgggtaatgagaagggatga

SEQ ID NO: 67345 - DNA, 111 bp, Glycine max
  Peptide Sequence Number=SeqID_159030
atggtggttcctagggcatctcatgtcaatctcataattgcattttgtcgtgcatacacctgcttttatggaaaggttcatcaagtcaaggtaaagaatggaagtaactag

SEQ ID NO: 67346 - DNA, 173 bp, Glycine max
  Peptide Sequence Number=SeqID_159031
atggccccaaggaagcttgcctcaaagagatccaggaaagacaaggtggttgaaggaactagttctgctcttgaatatgacagccatcgttttaggagcgctgagcaccagcagcgcttcgaagccatcaaaggatggtcattccttcgggagagacgcgtccagctcaagac

SEQ ID NO: 67347 - DNA, 189 bp, Glycine max
  Peptide Sequence Number=SeqID_159032
atgggaatacttgatgaagtttccttgactgatttatgtttgggaactactttagtcttgatggactctcctaaaacttccataacaggtctatcgttattgtctcttaactttggtagttggtattgggttgtgggaggtatactagatgtggtatctaaaccttggagatttacagtagggaactag

SEQ ID NO: 67348 - DNA, 273 bp, Glycine max
  Peptide Sequence Number=SeqID_159033
atgaaggcccaagtggagaaggacaaagcccccgagtggagaaggatgaaggcccaaacttatcaaggtaatccttgtggcgtctaccctgacttatcttccttcactggaagtagcgtctacccagacttatcttccttcaccggaagtggcgtctaccctgacttatcttccttcaccggaagtggcgtcatccaaaccttcgtagcctgtatcaagcgatccgctcctactcaggttcacatcatctggtatcagagcttcggctcttga

SEQ ID NO: 67349 - DNA, 280 bp, Glycine max
  Peptide Sequence Number=SeqID_159034
atgccgacatctccggaaagggtgcagatgaccacattggcctctgcttgtcaatcgaacttggggtctctgaatgacgaggtgcggataaccgtaaggtgtctccgcatgctaccggactcttgggtgatgatagcaaaaggtggggtggtcgacaaaagcaggatgaccacattggcctctgcttgtcaatcaaacttggggtctctgaatgacgaggtgtggataaccgtaaggtgtctccgcatgctaccggactcttgggtcatgatagcgaaag

SEQ ID NO: 67350 - DNA, 1284 bp, Glycine max
  Peptide Sequence Number=SeqID_159035
atgaccctgcgcgtggcgtttatcgacgatcatgacattgtgcgttcgggcttagtgcagctgctgtcgctggaagccgatattcaggtggtgggcgaattcagcggtgcggcccaggcgcgcgccggcctgccggggctggaggtggacgtttgcatctgcgacatttcgatgccggacggcagcgggctggatctgttggcggacattccctccggcatccgcgtggtgatgctgtcgatgcacgataacccggcgctggtggaaatggcgctggatcgcggcgccggcggctttctctccaagcgctgcaagccggaagatttgatcaccgcggtgcgcacagtcgccggcggcggcgtttacctgatgccggaaatcgcgcagcagctggcgcgggtgagggtcgatccgttgacccgccgcgagcgcgagatcgcgctgttgctggcgcagggccaggaggtgcgcgagatcgccgccgccttggggctgtcgccgaagacggtgcatgtgcatcgcgccaacctgttcgccaagctgggcgctgctgctgttcccgttcggcctgcgcatgggcattttgctgcagagcccataccgtttctggccggggatcctgctggccgatctgctgctgatggcgctgctggcggatcagttcggctacggcccggcgctgtgggcgtcggtggcggtgctggtgttgacggtgctgctcagcctgctggcctcgccgtggctgttgcgccatcagcagagcgacagcgaatggcgctggccactgttgcagggcgcggtggtgggcgccgccgccttgctgcaggcgctagtgtggcagctggtgagcgcatctggctgcagcagcaggtgaacgccgccgagctgcggcgctttgcgcctttctgcctggccattcctatcgtgttcatgtcttaccgctacggctggcagggcgcgctgttggcgacgctgctcaacggcgtggcgctgatggtcaacgagccgccgcagccggagtcgcaccgcgatctgctgctgtcgctgctggcccaaagcctgaccgggctgctgctgggcgtcggcattcagcgccagcgcgagctgaatcagcagctgaggctgcggctggcggagaaccgccagctggcgcgggcgctggtgacggcggaggagcaaacccggcgcgaggtggcgcgcgagctgcacgatgaggtggggcagaccatcaccgtgattcgcacccaggccagcatcgtcaaacgcctggcaccggagccggcg

SEQ ID NO: 67351 - DNA, 1320 bp, Glycine max
  Peptide Sequence Number=SeqID_159036
atgaccaggtggaactggtcaggactggtgatgtcggcacactggaggcgcagcgacctgcacgcttcctcgaccgcgcccgatgggcggcgaactgcgcagcgattgggcgcagctgtcccagcagtcgcgatcaccgcactttccggcgcgccgcgcatcggatggcggcgatgctgcgcggcgcccgatcgtgcgcaggcctggccgcaccccgtgactgctggtgttcctgcccggccagcgcgaatcgccagcgcgtgcaggccgggctgcaggacgctggacggcaacgtccgaacaggcgcgcgtgctgcaggcggccagcgatggcgccgccgcgtggtgctggccaccaatcgagcgccgaacctcggtgacctgcccggcgtgcgcgtggtgatcgacagcggccaggcgcgcgagccgcgctacgaccccaacagcggcttcacccggctggacgtggtggccagcgcaggttcgttcgaggcacgcgatgcgctgctgctgcgtgccgcaccggtggacgtaaggccagctgccgcaaggcgtggccggagcggcttcgtcaccgaagatgtggaactgggacagcgagcgccgcgccctggaactggccctgcgcagacccgtttcgaccgcatcgtactggacagccgctcggccggccgggtcgatccgcagcacgccgcgcaggcgctgaccgacgcggtggccgagctcggcctgcaggcgctgccatggaccgaaggcctgcgccagtggcaggcacgggtggaatcactgcggcgctggatgccggagttggatctgcccgactgcagcgacgcggccctgctggccaaccgtgcgcagtggctgcagcccgcgttcgccggcaagagccgtctggatgcgctggacgagtccagcttcggcgaggcgctgaagtcgccgctggagtggtcacagcggcagctggtcgaacgccatgcaccgacccgcatcaccgtgccgtccggactggagcggccgatcacctacgagttggacagcgaaagtggcgagccgttgccaccggtgctggcggtgaagctgcaggaactgttcggcctggctgatacgccgcgcatcgccgatgggcgcgtgccgctgaccctgcacctgctgtcgcccggtggccggccgctgcaggtcacccaggacctgcgcaacttctgggaaaacacctacgccgaagtgaaaaaggagatgaagggccgctacccgcgccatccgtggccggatgacccgtggacggccacggccacgcaccgggccaagccacgcgggacctga

SEQ ID NO: 67352 - DNA, 1452 bp, Glycine max
  Peptide Sequence Number=SeqID_159037
atgcattttcgcgccattacccgcatcgtgggcctgctggtgattctgttctcggtaaccatgatcctgcctggcttagtggccctgatttatcgcgacggtgccgggcgcgcgttcagtcagacgtttatgatggcgattgtcatcggttcgctgctgtggtggcccaaccgcaaacaaaaaagtgagctgaaaccgcgtgaaggctttctgattgtagtgctgttctggaccgtgctgggcagcgtgggggcaatgccgtttatcttcgccgagcagccacatctgtcggtgaccgacgccttcttcgaatccttctctggcttaaccaccaccggtgccaccacgttagtagggctcgactcgctgcccaaagcgattctgttctatcgtcagatgctgcagtggctcggcggtatggggatcatcgtgctggcggtggccattctgccgattctcggcgtcggcggtatgcagctgtaccgcgccgagatgccgggaccgctgaaagataacaaaatgcgcccgcgcattgccgaaacggcgaaaaccctgtggctgatttatgtgctgctaacggtggcctgtgcgctggcgctgtggctggcgggcatgccgatgtttgatgccatcggtcacagcttctcgaccatcgccatcggcggtttttctacccatgatgccagcatcggctacttcaatagcccgaccattaataccatcgtggcgattttcctgctgatctccggctgtaactacggcctgcacttctcattgctcagcgggcgaaacctgaaagtctactggcgcgacccggaattccgcatgttcattggcgtgcagctgacgctggtgctgatttgtaccctggtgctgtggttccataatgtctattccagcggctggcaaaccctcaatcaggcgtttttccaggtggtatcgatggcgacgacggcgggctttaccaccgacagtattgcgcgctggccgctgttcctgccggtgctgctgctgtgttcagcctttatcggcggtatggcgggttcgaccggcggtggcctgaaggtgattcgcattctgctgctgtgcaagcaggggtcgcgcgaactgaaacgcctggtgcatcccaatgcggtctataccattaagctgggcaaccgtgcgctgccggaacgtattctcgaagcggtgtggggctttttctcggcttacgcgctggtgtttctggtcagcatgctggcgattatcgccaccggtgtggatgacttctcggccttcgccgcggtggcggcgacgctgaataaccttggcccgggtctgggtgtggtggcagataacttcacgtcgatgaatgatgtcgccaagtggattttaatctccaccatgctgtttggacgccttgaagtgttcacgctgctggtgctgttcacgcccaccttctggcgcgaataa

SEQ ID NO: 67353 - DNA, 146 bp, Glycine max
  Peptide Sequence Number=SeqID_159038
atgcactggcaccgattgatagctcatggtgctgctgggtatgcgaaacctccttctttgccatcagccatgtactcatcaggctctcagcgtagggcaataagcgctcgcctgctgaagtcagccggatattattgcggtgacgg

SEQ ID NO: 67354 - DNA, 1521 bp, Glycine max
  Peptide Sequence Number=SeqID_159039
atgtctttatcgaaagtattaacacgcgcggcgctcggagtgcaggctccactggtgacgattgaagtgcatatcagcaacggtctgccagcattgacactggttggtctgccggaaaccaccgtcaaagaagcccgcgaacgcgtgcgcagcgctattattaatagcggtttcacctttccggcgaagcgcgtcaccattaatctcgcgccagcagatttacctaaagagggtgggcgctacgacctgccgatcgctatcgccattctcgcggcctcagagcagctgccaggcgataagctggcccattatgagttcctgggtgagctggcgctaaacggcgcgctgtgtggcgttcaggccgcgattcctgctgccatggcagcgctgcaggccggacgtcagatgatcttagcggagcagaatcaacaggatgtcggcctgatacaacagggtgaaacgctggtgggcaagcatctggtggagatctgcgctttcctgcatagccagacggcgctgacggtcgcccattaccagcctgaaacggtgccgcacgagcagcaggacctgagcgatattattggccagcagcagggacggcgcgcgctggaaattaccgccgccggtggccataacctgttgctgctgggcccgcccggcaccggtaagaccatgctggcaacccgactgcccggcattatgccgccgctggatgaccaggaagcgctggagtgcgccgcaattgccagcctggtcagcagcggtacgctacatcatcagtggcgtaaacggccgttcagagcgcctcatcacagcgcatcgctgtatgcgctggtcggcggaggatccctgccgcggccgggcgaaatttcgctggcgcacaatggggtgctgtttcttgatgaactgcccgagtttgagcgcaaagcgctggatgcgttacgcgaaccgattgagtccggtgaaatcgccatttcccgttcccgcgccaaagtcactttccctgcgcgctttcagctgattggtgcaatgaatcccagcccgacgggccattatcaggggaatcataatcgctgcacgccgcagcaggtgctgcgctatctcagccggctgtctggcccgtttctggatcgcttcgacctgtcgctggagattccgctgctaccgggcggctcgcttagccagaagcagcagcacagcgaaaccagcgcgcaggtgcgcgcccgcgtactggccgcccgggcgatacagatggcacgcgcgggcaaagtgaatgcgcagctgtcgaatccggagatcgcccgtgattgtgtgttacagcagcaggacgcggaatggctggaggagatcctgaatgcactgggattatcggtgcgtgcatggcagcgcatcttaaaggtggcgagaaccatcgcagatttagcgggtgaacggcagattacgcgtcagcatctgcaggaggcggtgggatatcgcagtatcgatcgtttactgatttacctgcataaaagcctggaatga

SEQ ID NO: 67355 - DNA, 544 bp, Glycine max
  Peptide Sequence Number=SeqID_159040
atggccgagcatcacaagaagctccatattgttgtgtttccatggctagcctttggtcacatgggcctttattttgagcttgcaaaagtcatatctcaaaaggaactcccactgccccatgttgatcaactcccagaaaatgttgaggccacagtggacattcctcagcacattgttccatacctcaagaaggcttatgatggtcttcaggaacctttgactaagtttctggagagatgcaaacctgattggatcatattcgactttgcaccatatgacaccctgaagggttctctagtgtttgctctaagaagctgcatggagattgaagcatttggaagtgaagtgacactgagtgatgaagaatttactaaggctgctatgggattagaactgtctggatttccatttttttgggctctaaggaagcaaaatacctcagctattgagtcacaagattgggttctgagtgagttcaaaagggggatggtgtggagaacatgggccccacaattgaggattttagtgcacatgcctgttaggg

SEQ ID NO: 67356 - DNA, 321 bp, Glycine max
  Peptide Sequence Number=SeqID_159041
atgttctgccctcctccccctatttataggggaaaacagggtggtggttgccgctcagctcgcccaggcgagctgggttgcttccaccagaaggcaccaccttctgttagaagatcctggaaggcccaaaactttacggattgcgccttaacacatcctttcaactcccgacatgccgcgaaatttcacggattgcctaacgatgggtgtcaagtacctcgaagttgtcaagcaagggtcgcaccccaacaaacagatgatccctggacgaaattagggtatgatagttgcccctctttacttgtcttttattggagataa

SEQ ID NO: 67357 - DNA, 213 bp, Glycine max
  Peptide Sequence Number=SeqID_159042
atggcgatggtgtgtggtgacaagtcactggagacaatggaggagccaccgaaagggagaaaaactccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 67358 - DNA, 519 bp, Glycine max
  Peptide Sequence Number=SeqID_159043
atgttggtcaatgcctatgacacattgaccgaagatgcgagaagagtggagcaaggattgtctgtggcacacccgctttgtatgtatggctggtttctcacatttttcgccatgaaagtagacatgcatgtcccctacaaggtcaccgcatgtgtgccgagaaagggaaagcaaattgggagcagctcttggctgaatgcctcaaagcattcaaaagcatggaatgcgactcaaagaaagtacaaggagcttagaggaagtagcaatgggatcattggcggttatcacaagtggctgaaggctcggacgcaagagataacttggctcccaaagctaggagtttcaagtgaggatgaggctgaggtccctgaggaaagtgaagaggtgcaagccttaaaaatggaactggaaagaacgcaagtagtcaagcaaaagttcaagatgacagccatcagagtcagaaaggaatgtgacgagctgagggatgtcaacacggctacagccgcaacattggaatga

SEQ ID NO: 67359 - DNA, 276 bp, Glycine max
  Peptide Sequence Number=SeqID_159044
atggactccatgatggaggccatgttaagcatgaagcgaatgatgaaaagcaatgtggctgcaattgctgccaccagtgccgctgccaaggtggatcctacccatccatccgccataaaccaagcgaaccagccaatcctgaacatggcaaatcaaggaggagaagtgctaggcatcacaagtggtccacacatggggcataataggaatgcttacccccccaactacacaccgcccaatgatatgacctctaaccctgaccttgattatggttga

SEQ ID NO: 67360 - DNA, 186 bp, Glycine max
  Peptide Sequence Number=SeqID_159045
atgaatgagttgctgatgcaatcctactccgtaagggcattgggtagaagactccaagtagattgggctagagatccaagggaaggccctagggttctcatgagccttaggcttctcaaggaggttttctcaaagaagcttctcaaggaagttttctcaagaaagcttcttaaggaagctacctag

SEQ ID NO: 67361 - DNA, 162 bp, Glycine max
  Peptide Sequence Number=SeqID_159046
atgtttccgtgggtgatttcgcaaagattttcaaccgttcttcgtcgttcgtcattcgttcttcgtcgttcttcggtcttcaaatcggaatacgtaggagcaagggaaacaccctcgtcgaccgcaaaaagacaaaaatataaaaagaacaaaaagaaataa

SEQ ID NO: 67362 - DNA, 1737 bp, Glycine max
  Peptide Sequence Number=SeqID_159047
atgatctgtcttgttcctttgcaaattcctaagagaccccccctcccacccaccaagagacacaatcattcagcactttcccattggtgtatttctcaccggaagagagcaaaagaaatagttgaaacttgggataaattgttcaatgcttcccagaaagagcagcgtgtctcttttctatacttggctaatgacatattgcaaaatagtaggcgaaagggcagtgagtttgtcaatgaattctggaaagttcttccagcagctctcaggcatgtctatgaaagtggtgatgaagatggaaggaaagcagtgaccagactagttgacatatgggaagagaggaaggtttttggttcacgaggtcaaggtcttaaggatgatgtaatgggcaagaatccccttccatctgctagcaatggaaagagttcaaattctatcaagatagtgaagagggatgcccactcagtgagaataaaactggctgttgggggtttgccagagaaaatactaacagcatttcagcccattcttgatcaacatcttaatgaggaagcttccttaaacaactgcagtgctgctgtgcgtgaagtgggtaaagttgtggaagatgttgaaaatacattggctcaaggtgtaacttcttcaggtctaattgtagatggttttggaaggatggttggtggctacagtagcaatgctgatggtggttggcttgggtgtgtgttggtgaccgtggaagtggggatgggaaaccagttaggatctactttggtgaatgacttacaagagcaggaagaaaagcttaaacaatatatggagcaacttgaaaatgcggaggctgcaagggattcattgctttctcagcttaagcatgcacttcaggaacaagaatcaaggcaagagctcgttcacacccagttgctagttgcacgaagccagatcaagaaagtggttggtatcaggaagcagcttaaccaagcagcagaagccacaaatccatctcagcctacttctgtatcatatgctcctttccaaactactgaagatgatagcaagaaggcagcagcagctgccgttgctgctaagcttgctgcctctgcatcctctgcccagatgcttacatctgttctttcttctcttgttgcggaagaagctgcctccttgaatggtagcttaaattctacaggattttcatcaggattacctattttcaacccagagaaaagacccaaacttgaaaaaccaacacctgctcatgatgctagcaattatgatatggccaactctcccttttatgccactatgcaacagccatcactggcaaatgtaccacttgcaccgtcagttggcatgcaagctgtgtctcaagccagtcaattacaacctgcatttgcttcaccaccccctcccccacttcattctttggcaaatcaaccatcaaatcaatatgtccaatcaactggtttgatggctgggggaattccttatggatacagatcaaatagcctaccacctccacctccacctcctttgccgccacacatggcaataggtttatcaatgcctggcactcaaccagcacagcagcaacagcagtctccaccgggattttacaggccacctggcatagggttttatgggaaaagccacccatcaacaccaccaccagtacctaggcacatgttcctctgggaaattgctgtgaaagttgaggattttccagcaggggctgtgtaa

SEQ ID NO: 67363 - DNA, 264 bp, Glycine max
  Peptide Sequence Number=SeqID_159048
atgaagaagagtgcaatgtttccaaaacctatgaaggaagatgaccttttcagaaaccatgtcattttcgatgatggaaacaatattaatggtggcgactacaagcaatttgcgattgcacgtgctaatgcattgggctcgtggctcggcgagaacaactccatcgcgcattgggtggggtggggaaacctctcagacgttgacatgtggcagtcaacgtctgaggttaacggtcaatgtccaattgaggcgtccggggactaa

SEQ ID NO: 67364 - DNA, 1344 bp, Glycine max
  Peptide Sequence Number=SeqID_159049
atggaggggaatctaaagcagaagttgctgagcagagagaaaatatcagaagaagaagagaatttatcattggtgaagagggtgtgggaagagagcaaggtgatgtggatagtggcagcaccagccatatttactaggttcaccacctttggcctcagtgttataagccaagcatttattggtcacattggttcaaaggaactcgctgcttatgctcttgtattcactgtcatcatacgctttgccaatggtattctgttaggaatgtcaagtgcgttgtcaacactttgcggacaagcatacggtgcaaaagaatatgacatgatgggagtgtatcttcaaagatcatcgatagttttattcttaactgcactctgccttcttccgttgttcatcttcacaagcccaattttgactctcttaggccaagatgagagcatagcacgagtggcaagaaacgtttctctttggtcaattccaatcttatttgcttatattgtgtcattcaactgtcagacattccttcaatctcaaagcaagaatgtcataattgcattcttggcaacattatcaataatcattcatgtgtccctctcttggctattcacaatacaattcaagtatgggattcctggtgcaatgatttcaacaattttggcatattggattcccaatgttggtcaactaatatttattacatgcggttggtgccctgaaacatggaaaggtttctcttctttagcattcaaagatctttggcctgttgtcaagctttccctttcagctggtgccatgttatgtcttgagctctggtacaacacaatattgattcttttgactggtaatatgaaaaacgctgaggttcaaattgatgctctatccatatgtattaacatcaatggatgggaaatgatgatagcatttggtttcatggctgcagcaagagaaaaagtagcttatctctttacttcaaacgaagatgtggctactgctgtgggggatttgtcacctttgttagcagtttctttgttactaaacagtattcaacctgtactctcaggggtggctgttggagcagggtggcaaagcattgtagcatatgtgaacatagggtgttattacctcataggtattccagttggaatagtgcttggtaacattattcacttgcaagtcaagggtatttggattggaatgttgtttgggacactgattcaaacaatagtcctaactataatcacctacaaaactaattgggatgagcaggtaattatagcccgtaatcgtattagtaagtggtctaaggtggaccttgaccgtgaaacagttacatcagataattag

SEQ ID NO: 67365 - DNA, 330 bp, Glycine max
  Peptide Sequence Number=SeqID_159050
atgttgggatgtgtggtggctactgtaaaccatctggaggatgctgagaacctcaatttgaacatatttcataagcatacccttgccaacaactttgtaggcctttacgattcccagtctctccaagatgcccaaatgctagagccagtggcatcactcaaacgtttgcacattgctgcaaacaacttccatttcgtgttgaggagtcttgagtgtcaaattgccttattgctcttgtgtgaccagatttctcaaaggttgaaaccagatggtattgacgctaaggtgaatggcaagtggcatctttttactgttgcaagacaagaatga

SEQ ID NO: 67366 - DNA, 1020 bp, Glycine max
  Peptide Sequence Number=SeqID_159051
atgtcgggtctgtataactccaacttctcaccagtgagggctgcttctcctcagattagaaccaacccagaagtcgacagtcagtaccttacggagttgctggcagagcatcagaagcttggtcccttcatgcaagcccttcccatatgcagtcgtctcttaaatcaagaaatattaagagtttctggaatgctgtccaatcaaggttttggtgactttgacagactgcggcatagaagccctagtcctatggcttcttcaaacctcatgtcaagtgtcactggaacgggattgggtggatggaatagtcttcagcaggagaatgcaaagaaagtcaatcctgttcgtggtaaaagcaaaacatgttggctatatgtgagccaagctaaaccaccacccttgaggctgcaattaaggcagcccctaaagaggccgcaaccacaactaagaggctggctaggggtgattgcaattaaggtggcttttcaacaaaatagattacgcggaactcctggaatggcaatggactggcaagttgcacctgcaagtcctagttcatacacagttaagaggattttgcgcttggaaattccagttgatgcataccccaacttcaattttgttggaaggcttctgggacctagaggcaattctctgaaacgggtagaagcttctacaggttgtcgtgtgtatattagaggaaagggttcaataaaagatccagacaaggaagaaaaattaagaggaagaccaggctatgagcatctcaatgagcaactccatattttgattgaggctgatttacctgctaatattgttgacataaggctccggcaggctcaggaaattatagaagaactactcaaacctgtggaagagtctgaggactatattaagaggcagcagttgcgtgaattggctatgctgaattcaaatttcagagaagagagtcccggaccaagtggaagtgtatctccattcaattccagtggaatgaaacgagctaaaactggccgatga

SEQ ID NO: 67367 - DNA, 327 bp, Glycine max
  Peptide Sequence Number=SeqID_159052
atgggaagaattaattgtgtgggagatgggattgatgttggcaaagccattgaagctgtgacctctgcggtgatgatgctgattcacattcacattcctgctgttcatgatgccaacaacaactcaacgctgttatttgcattcatcccttcaaggccaactcacatcacggacactccagtcccttgtcgtgtccagtgtccgacacgtgttcgtgtcagtccgacaccgacacgacacccatactacgttctatattttggatattacaagtgttcacgtgtctgtgtcgtgtccggtgtccgtgtcggtgttggtgcttcatag

SEQ ID NO: 67368 - DNA, 678 bp, Glycine max
  Peptide Sequence Number=SeqID_159053
atggcagaccatagagggcaatacacggcgcatactgcttataatctaatgagggggacagaagttgacgggatacaggatgaggccttcgaggagctgtggaaactaaaagtgccagctaaatatgcagtatttgcttggagactactcaggaataggaaaatcatccccatctggtgggaatcattatcatgggtgaacatctctacagctttctcgaatgacccaaagcaacatttcctccaacatgggttgataatggctggggggatacgaaccactagatggaaatgttggtggctggcagtaacttggagtatttggcagaagaggaataagattatattctccaatgactccttcgacgctaacaaagtgattgatgacgcagcattcctattgtggacatggctatccaatttggagaaggacttctcactacatttcaatcagtggtctagtaacattagagaaggacaacaacgggaacgctcagagaggaataagcaagcagaggttgacactttggtaaattctggtggtagcatacacgaccggtatgctttgctgtggaaacagcaaatggacaggcaattagctcagcttggttctgcaacaggagtctataaaacacttgtgaagtaccttgttggggttcctcaggtatggctatcttaa

SEQ ID NO: 67369 - DNA, 375 bp, Glycine max
  Peptide Sequence Number=SeqID_159054
atggcttctacagagggtctggtgcccataactagggcctttctggcctcttattacgacaaacacccttttactcctctttctgctcatgtctccacactttcttctcagattcgttcaatggctaatgatttcctcactcagcatcctcctatccaaggagaacgcatcttaattaatgaagctgatcagcaacccccgcataaaatggatgagaacatgtggaagaatcgagagtacattgaagaaacaatttttttacttcaaagttctaattggccagaggcggtaccacctaaccttttactcaaatgtcttggtggaaatcataaagcaaaccctaagtctataaaatgtgtgttagaaactacataa

SEQ ID NO: 67370 - DNA, 141 bp, Glycine max
  Peptide Sequence Number=SeqID_159055
atggccatggaaaaggaagacgaagacggcaataacaacgttcttgtcactgaagagggagaatttcaacaactgcctataggaattggagccaccaagctaggtcccttaaagtgtgatcaagctgcttatggatgttaa

SEQ ID NO: 67371 - DNA, 801 bp, Glycine max
  Peptide Sequence Number=SeqID_159056
atggtgaatagatttggtatttctgactgttgccactattctccagctttcagtgctaatggaagttcatcagagaatgcaagaattggtccacagagatatcatgatacaactggcagcagaagtggccacagatttccccatcatcctccacagtaccatagctttcatcatcaagtacagcctgcacaattgatcagaggtcactccttcaacattcatcctcccctaactgcaccttcgtatagagttccaacaaatccttcacacggtttttcaatcctcatgcatgatgcgtttgagatgggtgctaggcgtcctggctttgcaccatttgcaggtgctcgcatacacctgtctcatagaggcaacttgcacgagatgataactcttatacatcaaaatcttcctcctgcggtcttttttcctggtgatgatgttgctttactggttgaccatcatactgatatgcacttggacactgaagatatgtcttatgaggcaagtgagcagattggcaatgcaaaatcgggtttatcagagaaaacaattactagtcaaatgaagaccaaaacttatatactacctactaatgcaactaacttggaggaggcagcttataaggaacaggaaactgatctctgcataatatgcctggaagaatataagaacaaagagaatattggaattcttcgatgcgagcacgaatatcacgcagattgttttaggagatggttacttgagaaaaatgtctgccccatgtgcaaatcagtagcattgactcctggagaaaaacaatga

SEQ ID NO: 67372 - DNA, 207 bp, Glycine max
  Peptide Sequence Number=SeqID_159057
atgggtgagattgttaatgttaggctgcttggaatcaatgcattgtatgactcaagtccaatgtcaaatgagcaagagctggctaattcatcagtggagtatgatcctttatatgatgcagataaaggtttcaaagtgatgccgtcatctttccatgatatcagtgatattgagttccaggaaaattggggacgtgtttggtattag

SEQ ID NO: 67373 - DNA, 355 bp, Glycine max
  Peptide Sequence Number=SeqID_159058
gctttacaccggaatccatgcaaaaccaaagcccaaattcaagagcggagctatatctgaatcaacaactgctctgaatgtggatcagacaaacacctctgtgattagtgctgacatcaaaaccacaccggcgagtgctgcattgccagcagccaccgcaacaagaggaaataatcaggaacaggcagcagcggctgttaatggttctaatgctgccgctacagtcatttctgctgctgcttctgcaccccaaaagaaggaaggtggacaagcaaaagctcagttttacaatttgatagagaaagaggaaggagtggagatatggtctcctgggttcaacatttgttttatataa

SEQ ID NO: 67374 - DNA, 684 bp, Glycine max
  Peptide Sequence Number=SeqID_159059
atgaaagcccttcttggagcacacaatgtttgggaaatggttgaaaaaggctataaggagccacaagatgagacttcactatcccaagcacaaaataagattttaaaggattcaagaaagctttcttcatcatctatcaagcatttgatgatgatgcgttcgagaagatttctgttgcaacatccgctaaagaggtatgggataagcttcaaacctctcacaaaggaaaagacaaagagaaggaagaaagtcaaggaaatgagagaagtcaatgagaccgaggtagaggtcattgtcacagccgagggcaagttggacgtggcaacaatggacgtggcaacaatggacggggttcaaatttcatcaacaacagttacgagaaaggaaaaagttcaacaagagaacgtggaagaggctatgcaagcacaagatatgataaatcttaaacccgatggtataattgttaaaagattggtcactatgcttcagaatgtagattcgccaagaataaagttgaggaggagactaaccatgtggagcaaaaaagacgagaagtttgaaacagtgctcctaacaagtggagacaatgaaggtagccaagaaaacacatggttccttgacatggtgcaagcaaccatgtgtgcggaaaaagaagcatgctcgtggatcttgataactcgataa

SEQ ID NO: 67375 - DNA, 1708 bp, Glycine max
  Peptide Sequence Number=SeqID_159060
ggctggttttacattgaacatcattgacactcctggtctcattgaagggggatacatcaatgatatggcacttgatataataaaacgtttccttctgaacaagaccatagatgtactgctttatgtggatcgcttggatgtgtatagagtggacaacttggataaggtagtcgccaaagctataacagatagttttggaaaaggaatatggagcaagactattctagcactcacacatgcccagttctctccaccagatggattgccttatgatgaattcttttcacaaagatctgagtctctcttgaaggttcttaggtcaggtgccaggataaagaaggaagcctttcaggctgcttccattcctgttgttttggtcgagaacagtgggagatgcaacaaaaatgacagtgatgaaaaggttcttccaaatgggactgcttggattcctaatctagtccaaacaatcacagatattgcattgaaccaaagtgagtctattcacgttgacaagaatttgattgaagggccaaatccgaatcagagaggaaaattatggactcctcttgtgtttgctatccaacacattcgtttacttttgtctgttctacgaatgaacttggatggtttttcttatactgtaattgctggtagtctgcggcataggaatttgtttgtgactgagaggattgccttgtatgctggttctaaagaaaccgtcctagagcgtgattttggccgcaacatcaaggttctagctctagtattgttgtggaattaccaaatagggtggatcaaatttgatgattttgctttgttgttcttgcaaaattcagcaggaattgatttttaccaacaggttagtataactacgtatcaggcaaagaagttttcgccggctagcatggtgccgcataaatctcaaggtggtgtggagcagcttgcaaatgctggggttttgggaggatctgctgtaaaaattgccgctgcacctgctgggggaagtgggaagcagcgtttgaggtggacatctgatcttcatgaccgttttgtcgatgccattacacaacttggtggaccagatagagcaacaccaaaaggtgttcttagagtgatgggtgttcctggactgaccatttatcatgttaaaagccatttacagaaatatcgccttgcaaaatacttgcctgaatcaccagctgatggtaaagactctaaagttgagaagaggaattctggagacagcatttctggcgcagattcttccccgggaatgccaatcaatgatgccctaagaatgcagatggaggttcagaaacgtctgcatgagcagcttgaggttcaaaagcaattacaaatgagaattgaagcacagggtaaatacttgcaaaagatcatagaggaacagcagaaattaggtagtaacttgacaacctcggaagcacttcccttgtcccatgatgagcaaaatcatcctcagtcagaggcttctggatctagtgaggcccttgcaagcactgtgtctccacttaaaaaacagagaattgatgatggttccaaggatggcttcactgcttcccaagtaagaaatgctgcacaaaagaatgactgcaatgttggtcagttggatccaaacttgtatgatgatgctgggtttgaatttgatttggagacaaaaaaggatgaagataatgagagtggacagtaa

SEQ ID NO: 67376 - DNA, 951 bp, Glycine max
  Peptide Sequence Number=SeqID_159061
atgggatctcaaagtggggcaacccaagaccaagagccaaagactggttctttgaccagacaagggtctttgtacaatctcacccttgatgaggtgcaaaaccagcttggaaatttggggaaacccgtaggaagcatgaatcttgatgagcttctcaagagtgtgtggactgttgaatctggaacggatgcgtacatgcatcatggtggtggtcaggtggtttctgctggctcatctttgaatccagaacaagggagcctaacattgagtggggatcttagcaagaaaactattgatgaggtttggagagatatgcaacaaaacaagagtgttggtaaggaaagacagcctacacttggtgagatgaccctggaggatttcttggtgaaggctggtgtgtctaccgaaccctttcctaatgaggatggtgctatggccatgtcaggggttgattcccaacataacacattacagcatgcccattggatgcaataccagctcacttcagtgcagcagcagcagcagccacaacaacagaatagtgtgatgccgggtttttcgggttttatggctggccatgtggttcaacagcctataccggtagtgttgaatacggttcgggatgcaggatactctgaagcattgccatcttctttgatggctgccttgtcagattcacaaactgcaggtaggaaaagggttgcctcaggtaatgtggttgagaaaactgtagagaggaggcagaagaggatgataaaaaatagggaatccgcagctcggtcccgggctagaaaacaggcttacacacaagagctggagattaaagtttcccaattagaagaagagaatgaaaggcttagaagacagaatgagatagagagggcattgccaagtgcaccatcccctgaccctaagcatcagcttcgcagaactagttcagctcccctttga

SEQ ID NO: 67377 - DNA, 1521 bp, Glycine max
  Peptide Sequence Number=SeqID_159062
atggagccttcactcctactttcttcaccttcatcatccacccctttacccttcttcctctcaaacacacttcctttccattcaaaacccaaactttccaccaagttcaattgcaccctccaaaagtcccatttttggggctcaaatttgagttgggtcccatcacaatcacaccatggaagaccaaaattggatgcagtgaggccaataataacagcagcggtgaagagaaggaaagagcttccctttgacaacgttatccagagggacaagaagctcaaattcgtgctcaaggtaaggaacattctagtgactcaaccagatagggttatgtctcttaagacccttggtaagttcaaaagggatttgggtcttgacaaaaagaggagacttattgccgtgttgaagaaattcccagcagtgtttcagattatggaagaaggggttttctccctgaaattcaaaatgacccctgaagccgaaaggctctattttgaggaaacgagggttaggaatgagatggaagagttggtggttgtgaagcttaggaagttgttgatgatgtcactagaaaaacggattttgttggagaaaattgcacatctcaagacagatttaggtctcccgcaagagtttcgtgacaccgtttgtcataggtatcctcagtacttcaaagtggttgcaactcagcgtggtcctgctttggagttgactcattgggaccctgagcttgcggtttcagcggctgagctagcagcggaggagaaccgcattagggaaatggaggagcagaatttgatcatagacaggcctcccaagttcaatagggtgaagcttcccaagggtcttaatctttccaagggtgagatgaggaagattatgcaattcagagacttgccttatttttcgccttactcggatttctcagggctgaggccggggtcacgggagaaggagaagcatgcttgcggagttgttcacgagattttgagtctcacgcttgagaagcgaacactggttgatcactttacgcattttcgagaggagttcagattctctcagcagctgagggggatgctgataaggcatcctgatatgttttatgtctctcttaaaggagatagggattctgtgtttctgagagaaggttatcgggattctcagttggtggagaaggatcgattgttgcttataaaggaaaagcttcgcaccctggttaatgttccacggtttcccaagggacctgcacgcaggatagttgaagatagcatgagagaaagcgatggcagagaagatgaaagtggccaagaggaagaagaatggtcagaagatgttgataatttattgagtgatgatgactggagtgatgaagatgatgatgatttgccgccagattttgatgaggatggtgaactattggaaattggacaaggaaagactattaaacaagactcaagacagaatgatgaaatggtccttcttcctgtatttgcagatggtcgtcctagagaacaatggtga

SEQ ID NO: 67378 - DNA, 1062 bp, Glycine max
  Peptide Sequence Number=SeqID_159063
atgatgaaaaaaatcgacgtaaaaatacttgatgcgcgcgtaggcaaggaattcccactacccacctatgcgacctctggctccgcgggtctcgatctgcgcgcctgccttgatgacgcactggaaatcgcaccgggcatgaccacgctggtgccgaccggcctggcgattcacattgccgatccatcactggctgccgtcatcctgccgcgctccggtctcggtcacaaacacggcatcgtactgggtaacctggtggggctgattgactccgactatcagggccagctgatggtttcagtgtggaaccgtggccaggatagcttcacgctgcagcctggcgatcgcctggctcagctggtgtttgtaccggtggtgcaggccgaatttaacctggtggaagattttgacgccagcgatcgcggcgcaggcggtttcggtcactctggccgggtgttgaaggtcatggcagaaaaaaaagtcgcgaaacggaatcgtcgcgaagagattttgcaggcgctggcgcaaatgctggagtcgggcgatggcagtcagcgtatcaccaccgccaagctggccgccaatgtcggcgtttcggaagcggcgttatatcgccactttcccagcaaaacgcgcatgtttgatagcctgattgagtttattgaagacagtctgattacccgcatcaatctgatcctgaaagatgaaaaagagacgatggcgcgtctgcgcctgatcgtgcaattgctgctgggatttggtgagcgtaatccagggctgacgcgcatcctgaccggccacgcgctgatgtttgaacaggatcgcctgcaggggcgcattaatcagctgtttgagcgtatcgaagttcagctgcgccaggtgatgaaagagaagaagatgcgcgacggcgaaggtttccagactgatgagacgctgctcgccagccagctgctggcgttctgcgaaggtttgctgtcacgctatgtgcgctcggagttccgctatcgcccgaccgccgatttcgacagccgctggccgctgattgccgcacagctggtttaa

SEQ ID NO: 67379 - DNA, 138 bp, Glycine max
  Peptide Sequence Number=SeqID_159064
atgtcgcggaacttcacggattgcttaacgatgggtgtcaagttcctcgatgcggtcaagcgaaggttgcatgccatcaaacaatggtccccggacgaaattagggccatcctatgcccatcatggggatttaattga

SEQ ID NO: 67380 - DNA, 357 bp, Glycine max
  Peptide Sequence Number=SeqID_159065
atgcttactacctcaaaagattggaaagccgtttccaatgactcctctgcggattccacatacggcatagaggaagaacaacttactaggacatcttcctcgcctgatactatgaccaaatgtccttccactacaaacttcagcttttggtggagtgtggaggggacgactcctactgagtggatccatggatgccccaaaagacaactgccctatctatactgggaggtcaatctctcccctcacctctcgacgactgccatcgaaggcacggaccaccatggaactcggcctcaggtgggaggcgttaaatggcaacttcttcaatgtgctcttgggcatcacattcaggcttga

SEQ ID NO: 67381 - DNA, 264 bp, Glycine max
  Peptide Sequence Number=SeqID_159066
atgggtaaggactggggtcctggcgctgctgatgcatggtatactgataaaagctctcattcaactgcacttggcccctatgattggcctcctactggtcatccaaatgccgcatgtagagttccatcctctgcatgtgagcagagatggactctagagatggttgctactatagaggtagcggtggtgcatctgtggctggctgctactgctggtcctgccccagctgctgtgcctgccttggcatgcagtacttttctatga

SEQ ID NO: 67382 - DNA, 276 bp, Glycine max
  Peptide Sequence Number=SeqID_159067
atgaagcaattcctcaacaaggaaacagaagaagatctcgtgaccactcccaagaacgtattgacccaatggcttcgtgtggaagcaatgtcttccaaggttattttgatgatgccaaagaatcaagagttaagcaaagtttcaagcaaagattcaagaatcaggtttcaagtttcaagattcaagaaaaatcaagatcaagattcaagactcaagattcaagaatcaagagaagactcaatcaagttttactctctggtaatcgagtactggtag

SEQ ID NO: 67383 - DNA, 704 bp, Glycine max
  Peptide Sequence Number=SeqID_159068
gagaagccaaaaggtggctccactcatttaagggtaacaatttgaaaaccagggaagaagttgttgaaaagtttctcaagaaatatttcccaaagtcgaagattgcggaagggaaagctgcaatctcgtcatatcatcagttccctgacgagtccttgagtgaagcgttggagaggtttagaggggggaaaataaagttgaagacccctgaagaggcaactgagctaattgagaatatgtcagcaagtgatcatgccattctgcacaacagagttgtaccatctgtggtgaggctcatgaaacaggccaatgtattcccagtgaagaacacactcaagaagttaactatatgggaaatcaacaaagacaaggatatactcaaggatgattttcaggcttccagcagggtccttataactaacaaggacaatggagatcacaccctggcaatcaattcaacaaagaccagggtaacaatgtcaaatcataaaagcactgagtcagcattgaaaaaccttgaggtccaggtggaacaactagccaagcagatagctgacaagtcatccaacaattttgtggcgaatacagaaaagaaccctaaggaggaatgcaaagctgtgatgataaggagtaagaggtttgtggaggcggaggatgaggatagtgtcgtgcccaagaagaaagctgtggaggggatcctctag

SEQ ID NO: 67384 - DNA, 214 bp, Glycine max
  Peptide Sequence Number=SeqID_159069
tggtcctgcggtcattgcgggaaagtcaattgtgctgaagcctcgaactcagcttagttgctgctatccaccatattttccttcatctattggaaaccttcaaggctgctatggaagagtgctagaggaaattatccatgggcctacaatgaagaactctgtcctccctaacccaggagttgaattcccaccacagaggcataacttttggtag

SEQ ID NO: 67385 - DNA, 159 bp, Glycine max
  Peptide Sequence Number=SeqID_159070
atgatagatgttgatggactaaagcacaacctcttgagcattactcaactatgtgacgaaggcttcaaaattgaattcaacaagaattgttgtcttattagtgaaactatgttcggtgagtttgtccacattggtaagagcatagggttgcgcatataa

SEQ ID NO: 67386 - DNA, 270 bp, Glycine max
  Peptide Sequence Number=SeqID_159071
acttatcaaggtaatccttgtggcgtctacccagacttatcttccttcaccggaagtggcgtctacccagacttatcttccttcaccggaagtggcatctaccctgacttatcttccttcactggaagtggcgtctaccctgacttatcttccttcaccggaagtggcgtcatccaaatcttcgtaacctgtatcaagcgatccgctcctactcaggttcacatacagcctgtatcaagtgatccaccccgtaaggttcacatcatatga

SEQ ID NO: 67387 - DNA, 141 bp, Glycine max
  Peptide Sequence Number=SeqID_159072
atggccgtcacctggaacggtaaactgttgctggtgaaggatatcgatgtccagagcccgagcgcgcgtggtgccgccacgctctataagatgcgtttcaccgatgtgcgcaccggcctgaaagttgaagagcgctcaagg

SEQ ID NO: 67388 - DNA, 927 bp, Glycine max
  Peptide Sequence Number=SeqID_159073
atggcacggcccttcaatcaggccgatatcgacgcgaaaatcggccaccgcattgatggcgtcctggctgttgccgacgctcagctccagcggcagcgtgggaaaatcacggcgatacgcggcgatcatccccggcagcagatagttgccgatggtgctgctggcaaacaggcgaatcgctccgttgtcttctttaaacagctgttcgatctcaatcgcctgctccagcagcccgaccgcacgcggatagagcagccggccgtgctcgttgagcaccagccgtttgccgacgcggtcaaacagctgcacgccgagctgactttccagatcggccagggccgcgctgaccgccgactgcgacagcgccagcacctgcgaggcctgagtggtggagccgcttttcagcacctcggtaaacacttcaatctgacgcagcgtaatgtgcatgcgtgctccttacatggcgtaccgtttcaccagatagatcaccaccgccagccagatcagcagcatcagaatcaggccgctccagctgacgatctttttgccgcgcgcccgttgcacctcggcgcgttcggagctgctgatgcgcacgtcgcgcggcagcagacgcagcaggatcatcacgccaagcgggatgataatcgcgtcatccagcaggccaataatcgggatgaagtccggaatcagatcgatggggctgagcgcataagcgacgatgccaaacgccagcagcttaaaccaccacggcgtacgcggatcgcgacaggcaaaccacagcgtcagcacgtcccgtttgatgagcttcgcccagcggcgcaagcgcatgaacattgttgcccttccttatcacttattccggttgattataaatatattatcaatttcacttttaagccagccaggcgcacgctaaagcctcactga

SEQ ID NO: 67389 - DNA, 1826 bp, Glycine max
  Peptide Sequence Number=SeqID_159074
tggatctgatgccgccacagaaaggggaagtgctggtgcgcatcgtggccaccggcgtgtgccataccgatgcttacaccctgtcaggtaaagatccggaaggcgtattcccggcgatcctcggtcacgaaggtggcggcgtggttgaagcggtgggcgaaggcgttaccagcgtggcggtcggcgatcacgtgatcccgctgtacacgccagagtgcggcaagtgtaaattctgtctctccggcaaaaccaacctgtgtcaggcaatccgcaccacacagggcaaagggctgatgcccgacggcaccacccgcttctttaaagacggcaagccgatcttccattacatgggcacctcgaccttctctgagtacaccgttgtaccggaaatctccctggcgaaaatcagcaaagaagcgccgctggaagaagtgtgcctgctcggctgtggcgtgaccaccggcatgggcgcggtgatgaataccgccaaagtgaaagaaggcgacaccgtggcgattttcggcctcggcggcattggcctgtcggcgatcattggggcgaaaatggcgaaggccggtcgcatcatcggtattgatatcaacaccagcaagtttgacctggcgcgcaaactgggcgcaaccgacctggttaatccgaaagattttgctaagccaattcaggaagttatcgtcgagatgaccgacggcggcgtggacttctcttttgagtgtatcggtaacgtcaacgtgatgcgttccgcgctggagtgctgccataaaggctggggcgaatcagtgattatcggcgttgccggtgccggcgaagagatttctacccggccgttccagctggttaccggtcgcgtatggcgcgggtcggcgtttggcggcgtgaaaggacgtactcagctgccgggcatcgtgcaggattacctcgacggtaagtttgcgctgaatgatttcatcacccacaccatgccgctggaagagatcaacgaggcatttgagctgatgcatgaaggcaaatcgatccgttccgtgcgctggcgtcatcagtccgccgtgctcaactgcccgatgacgttcagcatttttctgccaccgccgcgcgacgacgcgccaccgccggtggtgtggtttctcgccgggctgacctgcaatgatgagaacttcaccaccaaagccggtgcgcagcgcgtggcggccgaactcggtctggtgctgattatgccggacaccagcccgcgcggcgatgcagtggccaatgacagcgggtacgatctgggccagggtgccgggttttatctcaacgccacgcagcaaccgtgggcggcacattatcgtatgttcgattatctcagcgaggagctgccggcactggtggcggataacttcaagctgagcaatcgccagtcggtaatggggcattcgatgggcggccacggcgcgctggtgctggcgctgcgcctcggcgggcgctttgcgtcggcgtccgcgtttgcgccaatcgtcaatccgaccgaagtgccgtggggacagaaagcctttgccgcctatctgggcgacgatcgccagacgtggcgcgagtgggatagctgcctgctgatgcagaacgctgaacatcgcctgccggtactgatcgatcagggcgatagcgatcagttcctcgccgatcagctacgcccggagcggctggaagcggtggcgcgcgagcagaacttcccgctggagctgcgtatccagccgggttatgaccacagctacttctttatcgccagcttcgtggaggaccatctgcggttccacgcgcagcatttactggcgtaa

SEQ ID NO: 67390 - DNA, 1114 bp, Glycine max
  Peptide Sequence Number=SeqID_159075
atggcgaggatagcaggagtggtcaagatctcgaaacgagaactagaccgagtgaagcaaaataggaataggattgtagggataacaaggaagtgcttgaaggagaaggcagaagctctggccagccaaggaaagtgggcatcattcatcgatgtattagcattgctagtgtttgggacaatactatttccgaatgtagataggctggtggatctagtagtgatcgatgcttttcttgcttatcaccatagcaaggatagcccgatcattgctattttggcatatgcgtatgatacatttgacttaagatgcgagaaaagcattgagagggttgtctgttgtacacctgctctttatgggcgtccattagttggttcccacaatggaaagaaggatgggcaggagtgttatgctcatgtgaagggtgcgccatcggaggagaccatcgcacctttcatcgcacgaggtttcaatgaagctaatgcaaagacacttcagagggtatgtaaggcatggaatgaagtggaaagaaaagataacgagcttaggggaagtggcaatggtgtcataggcggctatcacaaatggttgaaatcaagaatgcaagggataacatggctcccaaagctaaagagtctgagtagggaagaggctaaagtgcctgatgagatcactagggtctggaaagaatgtgatgagcttaaagatatcaacatgaccacggttgaagcgctagagcgggaaatgaaaaaagccagaaaggaagagtggagtaggaacaagtttcgaggggctttgtggggcagcaagaagtttgagagaacacagttgagcaaaatagaaggaagtatgttgataatcattgaccaatataaagagaaggtgaacctagctgctagtcacgggcagatgctcgaagatgaaatggcaaaggtgtcagccttacaggttgaaatggaggcgagagaaggagtgatagagttattgcataaaaaaaccatgaaatggatagacagatttgctctcactctgaatgagagtcaagagcttccaaggttgttagctagagccaaggcagtggctgacacgtactctactcccgatgaagttcaca

SEQ ID NO: 67391 - DNA, 702 bp, Glycine max
  Peptide Sequence Number=SeqID_159076
atgtgtttgcagaacaatgaacaatcaccagatgaacaagaaaccgatgcatttgctaagtggatcctagacattggagatggaattattggacacgaaagtgatggctatttgataattgaaatccctgaggaccaattgataactcaatatgatgatccaatccatgccatagttaactcaacattcccagatttaactcagcatcacaatgatgctcagtacttcaacagcagggtaatattagcttcaaccaatgaaatagtcgaacatgtcaatgattatatactatcattaatcccaggtgaacacatggaatacctaagttctgactctatagacaaatcaaaaaccattgaaagttgtcattttcaaacaataactactgaattccttaattcattgatgacatctagcctgccaaatcattgtatcaagcttaaaataggaactcctataatgcttttaaggaacttagaccaaactcaaggcctgtgtaatgacactagattaataattacaagactggagaagcatgtaattgcggctgaaatcatttctggcaaaaattcaggccatatggtttacattccaagaatgtccatgtctccttcacaatcaccatggccttttaaacttttaagaagacaatttccaatcatgttatcttatgcaatgacaattaacaaatctcaggaatag

SEQ ID NO: 67392 - DNA, 165 bp, Glycine max
  Peptide Sequence Number=SeqID_159077
atggataagagcttgaaggtaggagaagatgagtggagggagaaggagagaagaagctcgaaattttatgcctcaaataagctatcgttcatcccactaatccaagatcaagtccaagattctccactaagtgtgcttaggtgttatgaggcatgtaaagcatga

SEQ ID NO: 67393 - DNA, 129 bp, Glycine max
  Peptide Sequence Number=SeqID_159078
atggcgagggagaaagaaaacgaagaagcagaggcatggggacaaaaacgaagaagcaggggcatgggagaaccaacaaccacaaaggcgttgatcgaggccattaaacaacaaatagatgtttattag

SEQ ID NO: 67394 - DNA, 1476 bp, Glycine max
  Peptide Sequence Number=SeqID_159079
atggctaactacttcaacacattgaatctgcgcaatcagttagcgcagttaggcaaatgtcgcttcatgtcgcgcgatgaattcgcggatggcgctagcttcctgaaaggtaagaaagtggtcatcgtcggctgcggcgcgcagggcctgaaccagggtctgaacatgcgtgactctggcctcgatgtgtcttacgcactgcgcgctgaagccattgctgagaagcgtgcgtcgttccgtaaagccaccgaaaacggttttaaagtgggtacttacgaagagctgatcccgcaggcggatctggtggttaacctgacgccagacaagcagcactctgccgttgtgcaggccgttcagccgctgatgaaagacggtgccgcgctgggttactctcacggtttcaacatcgtcgaagtgggcgagaccatccgtaaagacatcaccgtggtgatggtggcaccgaagtgcccgggtaccgaagtgcgtgaagagtacaaacgtggcttcggcgttccaacgctgatcgctgttcacccggaaaacgatccaaaaggcgaaggcatggcgattgccaaagcctgggctgcagccaccggcggcgaccgtgcaggcgtgctggaatcgtccttcgtggcagaagtcaaatcagacctgatgggcgagcagaccattctgtgcggtatgctgcaggccggttcactgctgtgcttcgacaagctggtggctgaaggtcacgacgcggcgtacaccgagaaactgattcagttcggctgggaaaccatcaccgaatcgctgaagtttggcggcatcacgctgatgatggatcgtctgtctaatccggcaaaaatccgtgcttacgcgctgtctgagcagctgaaaaccatcatggcaccgctgttccagaagcacatggatgacatcatctcgggtgaattctcttccggtatgatggctgactgggcgaacgacgacaaaaacctgctgacctggcgtgaagagaccggtaaaaccgcgttcgaaaatgccccgcagttcgaaggcaaaatcgacgagcaggagtactacgacaaaggcgtggtcatggttgcgatggtgaaagcgggcgttgagctggcattcgaaaccatggttgacgcgggcatcatcgaagagtcggcttactatgaatcgctgcacgagctgccgctgattgccaacaccatcgcccgtaagcgtctgtatgaaatgaacgtggtaatttccgataccgcagaatacggtaactacctgttctccttcgcagccgttccgctgctgaaagagttcatgaccacgctgcagcctggcgacctgggcaaagcggtagaaggcacgcaggtggataacgcgcagctgcgcgacgtgaacgaagcgatccgccagcatccaatcgaagccgttggccgcaaactgcgtggctatatgaccgacatgaaacgcatcgccgtcgcgggctaa

SEQ ID NO: 67395 - DNA, 207 bp, Glycine max
  Peptide Sequence Number=SeqID_159080
tgtggcggtcacgctgcgcgtaaacaccacaccgccgcgcttaatgcgccgctacagggcgcgtcccctctccattcaggctgcgcacctgtgggaagggcgagcggtgcgcgcctctttgctatttcgccagctcgcgaaagggggatgtgctgcaaggcgattaagttgggtaacgccagggttttcccagtcacgccgttgtaa

SEQ ID NO: 67396 - DNA, 697 bp, Glycine max
  Peptide Sequence Number=SeqID_159081
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggggaggggacgaatcaaagcgacaagggctgaatctcagtgggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttgggggggccgaggccccctactgctgctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 67397 - DNA, 486 bp, Glycine max
  Peptide Sequence Number=SeqID_159082
gcaaatggtacaccacccagttctcctcctcctcctcctcctcctcctcctcctcctcctactggtgcagcatcacattcaccatctaccttgaaacaaacaagaaaagccacacgcctaggatcattgacgactagaccagttggggaagaaaaacccctagtccatgtggatcctgcaatcgggaaagccgacggtccctacagaaagaagttaacatgtttggggatcgccactcgtgataaggctgaatttgatatctctgaagaatttaatctgaggacaaaaaagaaaatacttcagattgtgggggagcggtggagacagtttaagtttgatttgaagtcgaaatgggcacttgcagccgacaaggatagtgtcgatgacactgtatgtgaaaagtatggcattagcaaggagaagtgggcccaattttgtcagagtcgcagagacccttggtgggaggatgtgcgaaagaaggcatag

SEQ ID NO: 67398 - DNA, 147 bp, Glycine max
  Peptide Sequence Number=SeqID_159083
atgacgttggatcaagtgagggtccttttcctcggatacggttcaaattacattatcgtccttggcagaaaacataaaaataaatgcggtggcctgagggaggctgtgttggtggtttgtggtggcttggctattccggcactctga

SEQ ID NO: 67399 - DNA, 570 bp, Glycine max
  Peptide Sequence Number=SeqID_159084
atggggggtgggggtacaatcgagaagggcaaggtcaaagatattgaattgaaaggtcacactgatagtgtggatcagctatgctgggaccccaaacatgctgatttgattgcaactgcatcgggtgacaagactgttcgtttgtgggatgctcgaagtggaaaatgctctcaacaggcggaacttagtggggagaatattaacatcacttacaaacctgatgggactcatgtagctgttggtaacagggatgatgaattaacaatactggatgttcggaagttcaaaccaattcataggcgcaagttcaattatgaggtaaatgagatttcttggaacatgacgggtgagatgttctttctaacaacaggaaatgggactgtggaagttctctcttacccatctcttcgacctcttgacactctcatggcccatacagctggttgttattgcatcgcaattgatccagtaggaagatattttgctgttggaagtgctgattcccttgtaagtctgtgggatatatcagagatgctctgcgtgcgtaccttcacaaaggggatcctctag

SEQ ID NO: 67400 - DNA, 306 bp, Glycine max
  Peptide Sequence Number=SeqID_159085
atggtgctggaaaaaattgaccatattggatcttggactttcagcatagtggtggggaggcgttctttctggtgtgagtgtggcattactagtttcctgatagaagaaagtctaatggcacattcaacaagcttgatctttatgggccgcagttttagtccacttcctaaaaccaaagtcagtgtatctggaaggcttgtctccagatcttcagcaggacttcgcattcaagctgtgcaagagaacggtggaccacgaagactagtggacattattagacttgtgcctgagctctcaaggaattaa

SEQ ID NO: 67401 - DNA, 1428 bp, Glycine max
  Peptide Sequence Number=SeqID_159086
atgtcccacaacgagttcttctggatatgtgtcttgttggattactgtgtttattgtcctcttggtctattgctcctacctcctcttgttttaggggtggaattatgtgttgttgttgaggaacattatcacaacaccatcgttgtcatcgtcatcaccactgttattgtccatcattatgatgatgacaactgtggtgatcatgttcctcaacaacacgcacaattacacgtgagcattcgaggcagaggttgtagccaagaggacaacaagaggagagtgtgtcccacaacgagttcttctggatatgcgtctttgttggactactgttgtttgtgtttattgtcctcttggtctacggctcctacctcacctcctcttgttctaggggtggaattatgtgttgttgttgaggaacattatcaccacaccaccgttgtcatcgtcatcaccactgttatcgtccatcattatgatgatgacaactgtggtgatcatgttcctcaacaacacgcacaattacacgtgagcatccgagaccttgctccaattttttgtcgtgtcccatctagtgatttaggacattctggtgatttccatcatctcccctgcttcccctctgctaagaatgatctgctgagtgctgacattgttttccataaatttgctgatggtggtgatgggcgtgaaatggctgcaaaacgccagcgcactgttgatccaggatcttcattctatggtgcttccactggttccaattttatgtacaacccatctccttatggatatgtcagccaacctcctcctccaccttttcctgttgttcggctgcgtggccttccctttgattgtactgaaactgatgtggctgagttcttccatggtctagacatagtcgatgtcctttttgttcacaaaggtggcaagttcactggggaaggcttctgtgttctggggtatcctcttcaagttgactttgctcttcaaagaaacagacagaacatgggtagaagatatgttgaagttttcagaagtaagaggcaggaatactacaaggcaatcgcaaatgaggtttcagatgcccgaggtggttcacctcgtcgaagtgcttcccgggccaaatcatatgatgaaggaaaagattcagctgagcacactggggtgttgcgactaaggggattgccattttctgcaagtaaggatgacataatggaattcttcaaggattttgggctgccagaggattctattcatattataatgaattcagagggaagaccttctggggaggcttatgcagaatttgcaagtgctgaagattcaaaagcagcaatggtaaaggacaggatgacacttggcagtcgctacatagagttatttccttcatcacccggtgagatggaagaagcaatttcaagaggacgatga

SEQ ID NO: 67402 - DNA, 1089 bp, Glycine max
  Peptide Sequence Number=SeqID_159087
atgtatgctccaaagcatttaaaaacaagttatggaaagacctttgatacattggagggagctgatccgtcaagcttagccaataaggttgctaaacttgttgactctaatcctgtcatgctttttatgaaaggaactcctgaagagccaaaatgtggatttagcaggaaagctgttgatgtgttgaaggaagagagagtcaagtttggaagttttgatgccctatcagattcagagcatgagagtggggaactgaaggaagtttttaaagatcatggaattgataccattaatgaagcaaaagagaaaggagacggcaaaggtggcatctctaaatctactgatttgagtacaaccttatcctctcgtcttatgaaaggaaaaccagatgaacctaagtgtggtttcagtaggaaggtagttgaaattctccagcaagaaaatgttccctttgagagttttgacattcttactgatgaagaagttcgtcaagggcttaaggatagcatgtcaaggagcagcacacaggcatgtgcagcttgtaagtaccaacgcaggaagtgcgggtccaactgcattctggcgccttattttcctcatgatcgccaaaaacagttccttaatgcccatcgtttattcggggttggcaagatcaccaacatgattaagcccctcgatcagcaccacagagacttagccatgagcacccttatctacgaatccgacatgcgcgcccgtgaccccattggtggttgctacagcctcgtcctccaattgcaatctcagatcttttacgccacccaacaacttcatcttcttcttcaacaccttgcttatttcaaatcacaccaaccttcttctaattcctctgacatagtcaataatgtcactcctcagccgcctgacccccttgaacaaactccacaggaacagcagcaacaacaacaatgttttaactacaatcttttgcaagaagatgatatcaatatgtgggccattcagaattctttatctcttttgtcacccttgtccttagagaataacatcaatcaagatcctgttgttgatcatggatcgcactctctctaa

SEQ ID NO: 67403 - DNA, 1176 bp, Glycine max
  Peptide Sequence Number=SeqID_159088
atgtctgattattactttgatgaggaggagatgcaagagttgctgaaggagaatgatgcgccagtctctgatgacttctttaacgattttgccgctcaagattcgtcccctccagcggatgagattcttcccgccgatgaggttcttgatcctcttcttgttcctacttctcatatggttcatacttcttctgccactgctccggatcctgctcctcacctgattccatctgaggagacattgccgagcagccacccgcaccacttgctgcggcagaatatggagtccaatcatgtcatgttgtccggtgactcatcccatcacaagaaatacgaacattggacaatagaagaacataagtcattcctctttgggcttgagataatgaaagagaaaggatggaaacagatttcagagaaatacgttccatcaaaaactctaaaacaagttgccagtcatgcccaaaaatacttcaaacgcaagaataccccaatgaaagagaggaagagaagaagcatccatgacataactttagaagacattcatatgactgatacttcccatattgataaacataactgggttccacttcctacaaattttgcggtgcagccacatactccccacattgatcaacctaattgggttccaccaactccaaattttatagtgcagccacatactcccagtattcatcaacataattgggttccaccaactccaaattttatagcgcagtcacatactccccgtattgatcaacatacttgggttcctcctgctcctccaaattttgcggggcaaccacgtagtgctcatattgatcaacttaactgggtttcaccacctccaaattttgcaccacatactcctcttgttgatcaagataactgggttccaactcctccagattttgcagtgcagtcacatactccccatattgatcaacataatttggttccacctcctccaaattttgcagtgcagccacaccaaatgcaacgagcacaacatatgcagcagttcaacttacatgattcatctcctcaaatggatgaatatagaaattttaatagtttccatccccagaatgagttggatcttattgcacaacagatccttgaatataagaagaacaagttcaaccacaaaaacaatgagggatcaagtaggtag

SEQ ID NO: 67404 - DNA, 987 bp, Glycine max
  Peptide Sequence Number=SeqID_159089
atgtcgtattcaaggagatcaaggtgtttccattttccatttcataggtattctcgttctccttctccatacaagcgatacagtaggtctgtgtccaggtctctctcaaggacaagctccagaagccgttcaaggagtttatcaagagatgcagaaaatccaggaaacaatttgtatgtgacaggattgtctcctaggatcaccaagagagaactggagaaacatttttctgctgagggaaaagtgatagatgtccatctggtagttgatccttggacaagggaatcccgtgggtttggctttgtgacaatggagactcttgaggaggcagatcgatgtgtaaagtatctgaatcgctcagtacttgaagggcgtgtcatcacggtggagaagctcaacggcgttctccaagtgactctcctcgtcgctcccctagctattctccttatagaagaagctatagccggtctccctattcttcagaccgaagtaggagtcgttcttactctcctgactataggaggaggaagtcaaactatccatatcactctaggcgaaggtcatactctccatactacagccggtacaggtcttattctcgatatgatcgacacaggtcatattctcgctcttgctctccttatagcaggtcacctgtcagcatccgcgacagatcatactctccttatgactcacgatatgactcaccggatgatcactcctacagaaggcaccattacagatctgtttcacgaggtgcctcgcctgatgatcgctattatagaaggcaccattacaggtctgtttctcgaagtgcctcacccaggccaaggagaaggtcaaggaggagctactctcggagtgccactcctgtttcaaagaggagcaactcgcgaagtgtgtcccccaggtcaaggaagagtcattcaagaagctccaagaggagtggcaaatatgagaaacactactcaagaagcccgagtgtga

SEQ ID NO: 67405 - DNA, 705 bp, Glycine max
  Peptide Sequence Number=SeqID_159090
atggctgggaggcgtcttcgtgatgcagtgaagatggtgctaactagtgaagaagattttgaatttgatgacattcacattgttatagcagggttaactaatacttattcacagtacatcactacatatgaagagtaccaggtgcaaagatatgagggtgcttctacgctatatggcccacacacactcagtgcatacattcaggagtttaagaaacttgcagaggctctaatctatggtgaacctgtagaacctggtcctctacctcctgatctcctggagaagcaaataagcttacttccacctgttgtgctggatgcaaccccccttggtgtgaatttcggggatgtttgtgccgatgtaccacggaactccaccttcaagagtggtgacatggtgacagcttcgttctggtccgcgtgccctcgtaatgacctgatgactgaaggcacctttgcactggtggaatttctccaagaaaaggatgcttggattcctgcttatgatgatgatgatttctgtctgcgctataagtggtcaaggccttccaaactcagttctaggagtaaaggaaccttggaatggatgataccgcagggtgtgactcctggtgtgtacagattaagtcactttggtgctgcaaagggcttatttggatcaattcatcactttacaggttcatccactgcgtttgtagtagcctaa

SEQ ID NO: 67406 - DNA, 1500 bp, Glycine max
  Peptide Sequence Number=SeqID_159091
atgccagtcatcgccgctaagcgcacattgagatcccacccctcatcgccccctcgcaaatcgccccgccgatgcaccgccgcaacccccaattccactccaacgatgaacagattcggcgccgacgaaaaccgagctgacccggaagctgtgaaacccaagtggaatcccaaagacggtgagcaattgaagagggtgaagctggcattgcacttgtccactgcgccgtcttcggtcgtgtgccgcgaggaggagcagaatgtggttttggagttctgcaaggggtgcgttgagcaccagaaggccgggagtctctacatatgcggctgtcccggaactgggaaatcgttatctatggagaaagtgaaagacaaattactcaattgggccaaggaggcaggtcttccacagccagatgttttgtctgtaaattgtacaacctttaccaacacatcagatattttcactaagatacttgggttaaaccaaacacagggtaaaaaggtttcggctacgcccttacagcaacttcagaacatgtattctcagaaatcgtctaacaagaacatgacattgatagtagctgatgagttagattatttgataaccaaagacagaggcgtgctccatgatcttttcatgctcaccacctttcctttttctagatgtatattaataggtgtagcgaatgcaattgacctagctgatcgatttcttccaaggcttacatcattaaattgcaaacctattgttgtaaattttcgggcttactctaaagatcagatcctcaagattcttgaagaaaggttaaatgaacttccttacactgtcttccaacagcaagccatggaattatgtgctaggaaagttgctgcagcttctggtgacatgcggaatgctctttgtatatgcgggagggcaatagagatgcttgaagcagaaattagagagtctgcctgcaatttgaatacttcattggaagagatatcatcctccagacaaaatcttgctacagctcctgattttatgaaaaaacgagaatttgagactgtaaggactgatcatatggcacgtgccttgtccaagacatatagatcaccagtggtggatacaatacaatctctgccacatcatcagcagattgtactctgctcttctatgaaacattttcgtggagccaagaaagatacaatccttggagagttgtataaatcgtatgtgggggtatgcaaatcttgtataattcctccagcgggaatcttggaattttcaaacatgtgcagagtgctaaatgaccagggccttattaaacttggacaatctcgagaggataaattgagaagagtgtcgcctaaagtagatgagggtgatattacttttgcattgcagataagtttatttggttctaaccggtgtcttcattatatgaagtggtatactcgaagcgtggagttgaaatcactagtccaaaattttcacccaagaagcaaaagctgttag

SEQ ID NO: 67407 - DNA, 762 bp, Glycine max
  Peptide Sequence Number=SeqID_159092
atggctcaagatggtgcccatgcaaacggtgcgttcgagggtgcaatttgtgaagatatcgtcgctgggactcatattctgcttgtccgtggtggggggcaacatctccctccgctaccttccggtgtcgttcaaccaggccatcggcgccaccacgccgttcttcacggcggtgttcgcctatttgatgaccctccggagggagggttggctcacggagaaccaagttttcatctatttggattcataatgtgcatcgcagctacagcagccagggcactcaaaacagtacttcaaggggttttgctgtcttctgaaggggaaaagctcaattctatgaaccttcttatgtacatggcaccagtggctgttgcattccttcttccagcctcaatcataatggaggaagatgtcattggaatcacaatttcacttgccagagaggattcaagtattttgtggttgcttatgttcaattctgcattggcatactttgtcaatttgaccaatttcttagtcacaaagcacaccagtgcattaacacttcaggtactaggaaatgcaaagggagctgtggcagttgttatctccattttgatattccgaaatcctgtatcagtgactggaatgtttggatattctctcacagtcattggagtcatcctatatagtgaagccaagaaacggggttcaatcatcagcagtgaagagaatcagcgtatgggcgatgttagtgctcggcttgacatatctaggaattag

SEQ ID NO: 67408 - DNA, 309 bp, Glycine max
  Peptide Sequence Number=SeqID_159093
atgatggttcgaggggcgatcatgttcacgcaacaaagcgacattggtggctcaacgggtgacgacaaagggttggagaaggaagattctggagttggatggaaaaatggaaaagacaagtgtggggaagagggaagcgaaggatcagaggagagcggcggcggcggtgcggagaaggatttgtgtgagttaagttgttatgattcatgggcatctgcactaattactgagcttgatcagttcaagaatgaaaagtataaacaaatgccgtccggttccgttaacattgatctcatggatgagtcttga

SEQ ID NO: 67409 - DNA, 249 bp, Glycine max
  Peptide Sequence Number=SeqID_159094
atggttcaaatgaaaattgacaatttcaattacacgcatggagggactgcggagccggcagttgaagcggcggtcgaggagtcagacgttgggggaggggacgtcgtgggtggagccgcagaggaagtagatggtggggtcgaggacaacgtaggtggagtcaacggcgggggaaggggagtgaggagggggttattagggtttgtacggtgtgaagcatttgaagaaaagaagagtcgcgtaagctga

SEQ ID NO: 67410 - DNA, 1236 bp, Glycine max
  Peptide Sequence Number=SeqID_159095
tcttatattgtatacttaggatggcattctcatggcccaaacccttcagcaagtgatcttgagtttgcaacaaatccccattacaaattattaggctcacacttgggaagccatgagaaggccaaagaagcaatattttattcatacaataaacacagcaatggttttgctgttgtacttgaagaggaacatgcacaagacatagcaaaaaatccaaatgtagtgtctgtgtttctgaacaaagggcatgaattgcaaactactagatcatgggaatttcttgggctagaaagtgatggagtggttcccaaagactccatatgggagaaggcaagatatggtgagggtgtaatcattgctaacatcgatacagagagtgaaactgcgtcaaaccttcgaccacctcttctcaccgtcatcgccgcagcgttgggcaacatcagtttctccgtctctgactctacgtggtatgctattacctcagcgttgacttaccttcgcggaatggcagctgtttcatctgctatagttaacagagggaaaactccccctttacccgtatttgttttgagaatggagtcaaatcaggcagcttcttccatggacgttgacactgtcccatctgaagtcaagcttttgccaccaaagccaaaatttgagcctttgaagcctcatgagatgtctgatggtcaggttcagttccgcaaggtgaatgttccacctcatcgatatacccctctcaagaaagcttggatggatatctatactcccatatatgaacagatgaaaattgatgttcgtatgaatttgaagggtcgtagaattgagctgaaaacaaggcctgatacccctgatattagtaacctgcaaaaatgtgctgattttgcccatgctttcatgctgggttttgatgtcatagatgccattgctcttttgcgtttggatgagctctacattgagtcctttgagatcaaggatgttaaaacacttcgaggcgatcacttgtctcgtgctattggaaggttatctggtaaaggtggtaaaacaaagttcgccattgagaatgcatcaaagacaaggattgtgattgctgacaccaaaattcacatattgggatctttttccaacataaagattgccagagactctctctgtagcctgatcctgggatctccggcaggaaaggtgtattcaaaactaagagcagttactgccagattggcagaaaggttttga

SEQ ID NO: 67411 - DNA, 660 bp, Glycine max
  Peptide Sequence Number=SeqID_159096
atgtattggatagcatacaaatgctttctgtatcaagaaattgattttttcaggcatttgttgatagtggagctcagtctaccattatatcaaaaagctgtgctgagcgtcttggctgcagaatggagtcaaatctggcagcttcatccatggaagttgagactgtcccatctgaggccaaagtttgagcctttgaagcctcatgagatgtcagatggtcaggttcagttccgcaaggtgaatgttccaactcatctcaaaaaagcttggatggatatctatacgcccatatatggacagatgaaaattgatgtccgtatgaatttgaaggctcgtagaattgagctgaaaacgaggcctgatacacctgatattagtaacctgcaaaaatgtgctgattttgtccattgctcttctgcattgagttctttgagatcaaggatgttgtctggtaaaggtggtaaaacaaagtttgcaattgagaatgcgtccaagacaagaatcgcgattgccgacaccaaaattcacatattgggatcttttgccaacataaagattgccaggttatgtctcccaagaatgaggatttgtgacgatgatgttgttgaagcaaaaggtaaaagggaaaaagacaaaggcttggctaattttcgatggtag

SEQ ID NO: 67412 - DNA, 624 bp, Glycine max
  Peptide Sequence Number=SeqID_159097
atgtcatctatgatggaatattccaaaaatcaaaacagccggcagccactgcttcaacagcgtcgccgccgtcgtgggctcgtttcactgttgccacaccttaagccatatctcgacgcgccgtcacggttggtttccctctcacccaggcttattgctggctcatcactggtcagttcaggattgacgatggaagcgatagtgaaaaaatttcagtcaaaattcaggaaagttagggaagaaatgagtcgatgggatgagcttcaatcttgcttaatttcacagtttaggaatgcttctcatattgttgataggttgcaggtgcttcaaaattccaacaattatggtgttctaaattgtgccagtggcctgaaagatgctcttttggtaaagcagattgaatctttgaggaacatcttggtttccatgagaaagacattggaagaatttcattgtattgtcttatctcttgacaaaattcaccgtgatagtagacaacaagtgaaaggtggttcttgtcacctgaacatgaaacaattgcagcaacaaattggcatcaaacctagtcttatttattgcttggatagcctgatgtttatacacgagatatacaactctgagtaa

SEQ ID NO: 67413 - DNA, 252 bp, Glycine max
  Peptide Sequence Number=SeqID_159098
atgataacagggaaggatgaagaaaaagaaaaggaaaacaaaggcaaagaggcaatctatgacagtgatcttggtgcacttcagcaactcttggttgatcaacccaatctccaaactgaggaagttcctgcgtatttcagaaagacaggacctgatatcaccttgatacagagccgactttgtcttaataatattgtaccttggagttctgcccttttttattcctttctttctggggtaactatcatttaa

SEQ ID NO: 67414 - DNA, 216 bp, Glycine max
  Peptide Sequence Number=SeqID_159099
atgttgccgcaactacaactggagcaactcgaactcagcggtgacaacttcgattccgcgtcggagctctcctccgatggcgacgatccattagccgatgatttcctccaaggaagcaatgacgatgaaggtgcagtggctaacacaactacaatgttgtctcgcccatggtactggcagaatgctgctctttcgctgatgatcgtggcgaaatag

SEQ ID NO: 67415 - DNA, 4353 bp, Glycine max
  Peptide Sequence Number=SeqID_159100
atgggggtcggtggacctatgcattggagcgtgctaaagttaattgaccgtggtcaatacagcaagaatgaacatctctctgagacagttgctgcagcaacttctatactgtcctatgtagaaccctcattggttctgccatttgtggcatctcggtttcgaatggcccttgagacgatgactgccactcaccagttgaaaattgccgttatgtcagtggcatttgtcgggcgttcactattttatacatctgtatcagcttcctccatgaaaccaattgatcttggtggtggtgatgaaacattcattgatcttgtgggggtttcattatccaatgcattacttggcatggatgctaatgaccctccaaaaaccttggctaccatgcaattaattggttccatattttcaaatttggctttattggatgataaaattgatgacctatcatttatgccgatgatccgcttttcagagtggctggatgagttcttatgccgcctgttctccctacttctacacttggaacccggcagtgttataaatgaaggtctgcaatcatcagcagcaacaggaactttcctggttgatgatggtccatactacttctgtgtgcttgaaattctgtttgggaggctttcaaaatcactgtataatcaggctttgaagaaaatttccaagtttgtgaggacaaatattcttcccggtgctgttgcagaggttggactgctttgttgtgcgtgtgttcactcaaacccggaagaagcagttagtcaacttgttgagccaatattactgtctgtgatatcttctttgaaaggaacaccacgcactggatttggaggaggaggaacttttgatgcttctgcttcatcaaaggttagatccagcatttcaccagctcttgaggcttcaattgactatcaacttaagatattgtctgttggcatcacatatggaggtccagcgatcctccgctacaaggatcaattcaaagaagctatcttcttggcttttgactcaccatcttggaaggttaatggggctgctgatcatcttcttcggtcccttcttggaagtcagattcattattatccaatagatcagtataagtgtgttcttagtcaccctgatgctgttgctctagaagaatggattagcacaaaaggtttttccactgatgaaaagttgatcccaaagtggcatattccttgtgatgaagaagttcattttgcaaatgagcttttagacattcacttcaagtcagctttggatgatcttttgaaaatatgccagactaaaatccatgccgaccaaggagacgagaaagagcacttgaaggtgactcttttgcgtattgaatcatcgttgcaaggacttttttcttgtttgcccgattttgtcccagactctaggaatggaatggttgaagattcaaaccatatgtttttaattgccggggccacaggttgtactgttggtagtactgctctgagagaaaaagctactgaggttgtacatgcagcctgcaaatatgtcctggagaaaaaatcagatgacagcatcctgttgatactgattattcgcatcattgatgctttaggaaactatggaagtttggagtatgatgagtggtctagtcacaggcaggcttggaaattagaatctgctgccataatagaaccccccattaatttcattgtgtcatctcattctaaagcaaagaaaagacctaggtgggctcttattgacaaggcatttatgcacaatacatggaggtcttcacaagcatcctatcatctttaccgtacaagtgggaatttctgcccatctgatcatgtgactatgttgatggatgatttgttgagtctctcgttgcatagctatgaaactgtccgcctgcttgctgggaaatctctagtgaagctgatcaagagatggccatctatgatttcaaaatgtgttatcactcttacccataacttgcaggataccaatgccaaggaatatgcagtgttggggtcctgttcagtccttgcctcacaaacagtactcaagcatttgacaacggatccaaagtcattctcttcatttatcttggcaattctttcaagttcgcatcatgaatccttgaaagctcagaaagcaattaatgagctttttgtgaagtacaacattcaattttctggagtatctagaagctttttcaggatctcagacaaagaaaatcatactggtgggctggggttttcagatttggtttctcagattggctccatgagttttgattctactggcttgcattggagagataaggccaagatagagtatataattgaggtgcaaccctcatctcatgagctagcttttggtgttgagttaggaccaaactcacattctaagatgatatcagagcttatcctagatccattaaacgagacacccgccatgtataacttgatggctaatagagtgctgctcctgctggctttggcatctaggaaccatccaaattcatcttctaaaattctgagtgaaactgctggacacttcctgaagaatttgaaaagtcagcttcctcagacaaggatacttgcaatttcagctttgaatacactattaaaggaatctccatataaactgtctcatggtgagaaatctgccgtacttgaggatttgcaagaccatgtcaaatcatcacttgaaggaactttaacgcaaacttttcaggaagagggtttcttcaatgagacactgactagtctttctcatgttcatataataactgatactgaaactgcttcaagaggaggtcagggagattcaagtttccaaagcttagcagacaaatccataactcgtttttactttgaattttcggcttcatggccacgtacgccaagttggatctcctttttaggaagtgatgataccttttattcaagttttgctcgtatttttaaacggctagtacaagaatgtggcatgcctgtcgtattggctcttaaaggtgcagtagatgagtttataattgctaaggagaggtctaaacaatgtgtagctgctgaagcgttggcgggtgtgctacattctgatattgatggtctatcaggaacatgggaaagttggctgatgcctcagttgaagaacatcattttagcccaatctgttgaatcagtttcagagtgggcatcttgcatacgatatgcagttactggtaaaggaaagtatggaacaagagttcctcttttaagacagaaaattctggattctttgatgacacctttacctccaacagtagctactacagtaacagccaaacgatatacttttctggctgctgcacttatagaaatatccccacagaaaatgccagtagctgaaatccagctccacaatacacttctgaaggaagttcttggtaatatgtgccactcatcagcccaagtgagggaggctctaggggttaccctttctatattgtgctctaacattaggctctatcattcaagccgtcatgataatgcacaggatgagagaaatgacaatgttgatagtttgatgaaagatgaaagctgggttcagtttcttacagagcgagcagctgaagcagttgtcaacattcagattgctacccaatcagataaagtagtgaatcctgtagattcaagttctcaaaatgggcatctagatggtgattcacaagatgacattaaatggatggaaacgtctgggagatcctcatatctgctcgacgtgcttgtgggacttctatatcctgtgatttgcttgcaggaaacatcaaataaggatttgtcaacattagccaaggtagcatttgaattgcttaaatggatgattgtttgggaacctcaccttcagaaggctgtatctgtgattcttactgctgccaatgattccaactggcgaactagatctgctacattgacatatctgcgcacattcatgtacagagaacatgctgcagcagttttagcaggcctaatgaagggcggagatgaagatcttgctagagatttccatgatagagcttataaggaggcaaatattgtacagaagagaagaaagtcgagaaatgcaagttctggattatcaatagcatctgttcatggtgctgtactagctttggtagcttctgtattatcagccccatatgacatgcccagttggttgcctgatcatgttacactacttgctcgcttcagtggggagccatcacccgtgaaatctacagttactaaagcagttgcagagttccggcggacccatgctgatacatggaatgttcagaaagaattatttactgaagagcaacttgaggtagttatctag

SEQ ID NO: 67416 - DNA, 132 bp, Glycine max
  Peptide Sequence Number=SeqID_159101
atgaagaggaaaagcttgaagtctccagtactccagaatacctctacttggccactagtggctaagttgaaggaaaagataaagatatgggtgatgcctgtttcgaagaagaagaggtgggggatcctctag

SEQ ID NO: 67417 - DNA, 270 bp, Glycine max
  Peptide Sequence Number=SeqID_159102
atggatcatttaaggttcaacgccttaaaaggaccacctttcaagctattgtcctttgggacaaatgtgagaggtgctaataccttcctcaaaggtaaatacaactctcgaatctggaatattcttcatgaccggtttccttcggtttttccgacgttttccacaaataaatgttggtggcgactccgcgcattttcctcctttggaagatgcacccgtgagcctcgcctcgctcacccgcaaaaaggtgatctagttattcctaaataa

SEQ ID NO: 67418 - DNA, 345 bp, Glycine max
  Peptide Sequence Number=SeqID_159103
gaaggtcagctccgccagaacgacgctggcaatagcgacgcccagcgcgccaatggtgccggtaacaccggtgagtggcgtgagccaggcatacagcgcgacggcaaagccgatgagtgccgccagcagcagcagaagtcccttaggatgaaagcacggaaaacagcgtgtactgatgagtcaatgcggctgttgttcgccggcgacgatgatattcaggctgcccgccggatgagagcagagcaggaatcagataaaaatggggaatttgtaatgacaggcggcacggcaaggatgttgattaccgacgctcaggccgcaggatatttaaaccctgcggactga

SEQ ID NO: 67419 - DNA, 258 bp, Glycine max
  Peptide Sequence Number=SeqID_159104
atgaacccgggtatagggccccttttttactcaaacccgcgagcgaggcgaggctcacgggtgcgtttttcaaaggaggaaaaaagcgcggagttgccaccaacgtttattggtggaaaacgtcagaaaaaccgaaggaaaccggtcataaagattattccaagttcgagagttgtatttacatttgaggaaggtcaacaaaagcggggctcttgctcctacgtaccctccatcgaagaggaaatcatacctacgtag

SEQ ID NO: 67420 - DNA, 390 bp, Glycine max
  Peptide Sequence Number=SeqID_159105
atggattatcaagagtatcagaggtcatcacacttgtcttgtgccgatgctcagacaagatcatcgccaactcgacaaacacgtcatagcacagatcatccaaccaattgtcaaaacctaaccatctccatcaagacattgattgcagagatcaaaatgttcatgaattataccccatcttacaagaagacatggacacatcccatttcttttgcctgcgtcacattgcacaaaactttcttcacggttatgcatacacggagaagatgcactggcgacatcttggggatattcgtgcgaataagccaagtgcaactaaatggcttgatcaattacccaaacaaaaatgggtacaatgctttgatgaggggaaacattggggacatatga

SEQ ID NO: 67421 - DNA, 1782 bp, Glycine max
  Peptide Sequence Number=SeqID_159106
aaacaagccggaggattaattgcaaaaacagcttctgacagcaactcattctacgttaatcagagatggttagggggtatgctcacgaattggagcacaatgaagttgtctatagcgaaattaaaagagcttgaagctcgggaaacggatggtgggctcgacaggcttccaaagaaagaggcggccctatgcaagaagcaaaaggaacggctcgagaagtatctgggtggcgttaaagacatgatgaggctgcccgatgttgtggtgattgttgggcaaccggaagaaatgaacgcagtgcgggaatgccgcaagctcggcatacggagcattaccgttttagacacaaactgtgaccctactgtggcagatctctttattcctgctaatgatgactcagtcacttcattgcgcttccttttacaaatcttttcagatgccattttaaagggacagaatcttgcctgcccgttcaacgaaacgcccttaggcgtgggcgtgcattgcgaagcaatgcaaccccgtccgacggaacgcctttgggcgtgggcccctgcctctgtgaggcgtgtgaggcctgtgaggcaagggcgtttcgctgaacgttttcggcgtcccgtgcatcccataggaatgcagggacggcgggagaagccagaagagagagcaactgacaaaaccaagcatcacaatgtttcggcacggagatggggaacaggggagcctattctggtattacctggtaacaaactcctattcaatgaaactggcggcgaagccgtttcaagcaggcctcacaggcctcacaggcctcacaggggcaggcctcacaggcctcacaggcctcacaggttccgtcacgggttcaggcgcttcgaacaggcctcacaggcccaagggcgttccgtcggacgggctcgctgtttcgctgagcccctggagctcttgttacccgtagaatcgaggattcgatcaaccttactggccttgggcatggtggttttaattggcctctcagccaatcagcctgcacaaagctatccggtctttgcacaacagaattacgccaacccacgggaagcaaatggtcggattgtgtgtgccaattgtcacttggctcagaaatcagttgagatcgaggtgccacaatcagtgctaccagatactgtttttgaagcagtggtaaagatcccctacgatcaacaggtgacacaagttcttggtaatggcaagaagggtggcctcaatgtgggtgcggtccttatccttccagagggcttctctgcagcaccggccgacagaatacctgaggagatgaaggctaaagcagggaaactgtattttcagccgtatgcgtctgacaagaaaaatattctggtggttggcccggtaccgggtaagaaatacagtgagatggttttcccattgctttcaccagacccttccaaagataagaatgtctctttcttgaaatatcctatctatctaggggcaaacagggggagaggtcaggtttacccagacggctcgaaaagcaacaacactgtttttaatgcgtctaccggtggaaccatctctcaaatccagcctgtcgagaagaagggaggatttgagataaccatcgagaccgggaatggtgaaccaatcgtcgacaaagtgcccgcaggtccagatctgattgttaaggttggccaaacaattcaggcagatcagccattaaccaacaaccctaacgtgggtggatttggccaaaaagacactgagattgttctccaaaaccct

SEQ ID NO: 67422 - DNA, 447 bp, Glycine max
  Peptide Sequence Number=SeqID_159107
atgaatggggggcgaatgctgaatcctgatactagtgtaaaggttttctttgagcatgaaatcgatatggtggcagctttcatggatgagattgatggggttcagattcacctttctagcttggattacctcacttggagggctgatcctactgggtcttattccacaaagtcagcatacaacctcttgatgggtgatggaagttctgataatgaagacaaaaacaattgctggaaacggagagcaaaacctaatggatacacaacaaggagcgcgtaccttttgatgcaaggcgaagcaactgaggaaaatagtgatggagtgtttacggagttatgtaaattacaaatcccaccaaaagcagctatctttgcatggagattggttaaagacagactgccaaccaagcttaatctaagaagaagacaaatacagctcaagggttaa

SEQ ID NO: 67423 - DNA, 288 bp, Glycine max
  Peptide Sequence Number=SeqID_159108
atgatagctaggggagcgaatgggattagataccccagcaatcctagcggtaaacaatggatactaggtgttgtgcgtatcgacccgtgcattgctgtagctaacacgttaagtatcccacctggggagtatactgtcggtgataagccagaggaaggtgaggatgatgtcaagtcatcatgccctttcttccctgggcaacacaagtgctacaatggacgggacaaaggatcgcgatcccacgagggtgagctaactccaaaaacctatcctcagttcagattatag

SEQ ID NO: 67424 - DNA, 492 bp, Glycine max
  Peptide Sequence Number=SeqID_159109
atgccaataggaactagttcccaaaggctcaaccttataagaaagcatgaggttgactctttaaaagggtctctcatcccaaactcaaaagataggacattggatcttggaaattggcatataaagagaaatcttcggggacgtgataattcatgcaacctcaccccatcttttgcaaatctcttcggggactccctcagactgctacccttggattcgaaaggaatcctaaggagtttgcatgaacgactaacatcagatgtaccctattatcacaattgtctttggccatctcccacgagctcttggtccaatgagttttcttatcaaatgtgcaagtgcaaacctcaggaatccaaactcaaaagaaaaattagtcattccttgatctacatggactttattgggcttgtaacgatgtcagggggtaagagggctatgaaagaaaggatcaaagaggctcaaagagtgtttaagggttatattgagtaa

SEQ ID NO: 67425 - DNA, 297 bp, Glycine max
  Peptide Sequence Number=SeqID_159110
atgggctcaaaaatttaccatgaggttcatgagaacactaaggccttctttagtagctctagctcaatcctcttagatcctcttgctcatggctctggtaactggtcccttcctagggaggattgcatcaattccattgtgacaggctcaatcttaactgtttcacaagcgagaagtcatgtgtctaatgataattctctgtggcacatgtgtcttagtcaaatgagtgaaatggatgaaactttcaaaggtagtgcgtaccagaaaggtcgcttggactgcgtccattctgattaa

SEQ ID NO: 67426 - DNA, 356 bp, Glycine max
  Peptide Sequence Number=SeqID_159111
atgcagacgaagataaggccaatgaagaagatgataaacgcagaacaccaagaaaaacacaatcaattaggagaacaagcagtaacaaccacaaacaaacatccaaagtggccatcatcaaagcagaaagaaggaagaagaagaaggataacttacctcgaaggagaagaagaaggaagaagcagcaacaacagaaagaagagggaagaaaacgaagaaggcacggtcatggtcacggcaacaacaacggaagtcacgacacggtcacggcggaaggcacgacacgatcagcagcagcagaacacggagccgaagaggaaggagaaaggagagcagaggaagataaatagtgactt

SEQ ID NO: 67427 - DNA, 204 bp, Glycine max
  Peptide Sequence Number=SeqID_159112
atggctcaacctccacctcgtgagaggactcttatggagatggttgcacctgatttcacttatgaaagtttatgcattcaatatcctgatgagggtgaagatcctcataagcatcttaaggagttccatattgtttgttccaccatgaagccccctgatgtccaggaagatcatatctttctaaaggctttcctcaatctctag

SEQ ID NO: 67428 - DNA, 387 bp, Glycine max
  Peptide Sequence Number=SeqID_159113
atgaaggccgacatggaggccatgaaagagcaaatgaccacaatgatggaagccatgatgagtatgagaaaaatgatggaggtcaacacaactacagtcgttgtagcaagtaccgccacagaggtggacctgactcacccatctggcctcaaccaagtaaatcgcccagcctcgaacatggtaggtcagggaggcgaagcattgggaagtgcaggcggcccccattttatgcaggtccagagcaagcattccttcccacgatatggctgtagacaaaggatcaagctgaatgttttgatgatgccaaagtttcacatgcgtctcaaagctttattcaagacaaagaaattaaagatattcaagacggatgatcaagacagtctctag

SEQ ID NO: 67429 - DNA, 438 bp, Glycine max
  Peptide Sequence Number=SeqID_159114
atgtctaagaataaggtcttgaaagagcataacaagacttttgtaaattggtttaaagatataatctttggtgacgataatgcttttgaaatgttaaggaagttagctaatgggcctaaaagaaatgttataacttggcaaggatacggtatcaacaacttccagtcccagatgcaattgcaaatgcaatcacagggtctcacactgcctcttgaggttgaggttggtccttcttctgctcgtgtcagcataaaggaaagttgtgtcgatcccttggggcaagacccaaaaataaaagactcggacaaatgtggcttgtatgtcgatgaaagtcttcctcggctggttgttgttggaagagtttatgaggggtccacaattgtccgtaacattcctttgggcaatgatcaagtcaaggtcggtgttgaggatgtttga

SEQ ID NO: 67430 - DNA, 276 bp, Glycine max
  Peptide Sequence Number=SeqID_159115
acttatcaaggtaatccttgtggtgtctaccctgacttatcttccttcactggaagtggcgtctaccgtgacttatcttccttcaccggaagcttccttcatcggaagtggtgtcatccaaactctataacctgtatcaagcgattcgctcctactcagcgagcgtttttaaataaaaactgcgcaatgtcggatgaaaaatatcagtcggggctatttcacgaccgttgtcggctattgagttttctattcaatccctggatgaaatatgcatga

SEQ ID NO: 67431 - DNA, 413 bp, Glycine max
  Peptide Sequence Number=SeqID_159116
atggctaagtacgacccagagatagtcatggagttctatgccaacgcatggcctacagaggagggagaggagtcaggcctcgggcttccacgaggaggccatcagccagctgttgtgcattccggcacaggactttgctcggagcatagcggggagatgggcttcccaatgccgaagtgtcagctggtctatgccatcctgactcaggtgagagtacatgttgcccagctgatctcagatgctatgtatcagtttgcagggataacgcctcctagacacccagtggacccggagaagtccaacatggccttggggtttcctactttgatcacaggcttgtgccaattcaatggagtgtcagtcaacccaaccaagctgttggacaaatgtggcctcaattatcttaagaaggg

SEQ ID NO: 67432 - DNA, 202 bp, Glycine max
  Peptide Sequence Number=SeqID_159117
atggcaaacaacgtgtttgcttcgtgcccctattttagggacctatatgggagagagctaaaagggttttttgtgataattcccaaggtggtcatatctctcttgatggtctctagaggtatcatcccctttgaagaacatattgcggcagtagggactactagcaacaatatgttatcaaagagaaaaactctagatgagg

SEQ ID NO: 67433 - DNA, 618 bp, Glycine max
  Peptide Sequence Number=SeqID_159118
atgacaactaccggaagatcagagagtattaatgcatttattaaaagatttataaattctcacacaagtttaagtgactttacaaagcaggttgatgtagcgattgatgatattaagcaaaaagaagaccatgacataatgttagaaaagtgcaaaagaattaacttgaagcttatgtcacccttgcaagagcaagctcatggtgttcttacaagatttgcttttcagaagtttcaagaggagtttgaaagtatttttcttcataaagattgtcatgaaatcccttctaactacttgccgtcacgatggcggcttcaaacatcacatgacgatgatgaagtagatccccaacaagtcaatgttgtctttgaggaacaagtcgatgttgttcactgtcctccaccttccaaaacaaaaggtcgtcccaaacgaagacgtcttaaaggtggaaaagagctatcacataacatgaatacttgtggattgtgcaaagatgtaggacataatattgttacatgtcctctaaaagaaaatactcaattttctggtcacacaaacaagaagaaaaaaatttgtaaagatgcaaatttaaatccaattcttcttccaaaagtttag

SEQ ID NO: 67434 - DNA, 147 bp, Glycine max
  Peptide Sequence Number=SeqID_159119
atgaagaaacaaaaatggaagagaagcggaagacaaaggagaagaggtaagaggcggcgccatccactagggaataagccatggaagaaggagcttcatcaccaagatgagccttggataagaagcttggagaggatgcttcaatga

SEQ ID NO: 67435 - DNA, 138 bp, Glycine max
  Peptide Sequence Number=SeqID_159120
atgtttctcatgagagggaatacttgtacttggggggatgtcactcaatttggaacttcttttgagactcaggctgatcatcatgggggggcggagttgtttgtgcacgacagggtgacctcgacacttgttgcctag

SEQ ID NO: 67436 - DNA, 285 bp, Glycine max
  Peptide Sequence Number=SeqID_159121
atgtggaagccatcaacaaaagaaaacaaaagaggttggccaagtccattactgatgaagaccttggtctggacaactttggcatttcaaggaaaatcaagaagatcacgattaaacaatagaagaagaagaaaacgaagaaatagtcccaaaggcctaggatcttcttcatcaatggattcctttgcttcttggaagatgaatggcaacaaaatggagaaggaagagagagaggagacgccacttcaaggagaagatgagtctagaagaagctcaccaccatag

SEQ ID NO: 67437 - DNA, 501 bp, Glycine max
  Peptide Sequence Number=SeqID_159122
atgcatcctacggatatccaatccttaactgatgatctttcatccgttagcaagttacatgaacaaatgtacttgcatgatcaagccctcgcatacccttctagtttgcatatatctagggcaattgacatcaagatggttgttgatagagtttaccctcgtttaccagtatgggatgtttccaaaaagaagggatttgagatgtattacaaggagcagatgccctcgtggcagatgaagttgatacggactcctgatgctcatgatgcgaggactttttggagtaagatagagttgatggttttcaaaaatcctcaacctttggctatgatgaaagtgatattgttgtgcactgcaacgttgttcaagtgttacgacctcctaggaagtatcactttgataatgcttgcgtctggttcaccaaagatgatgacagttactccttcatccaaagtcttctcaagcttcccaccattcaatatgaaggaacctataacttga

SEQ ID NO: 67438 - DNA, 870 bp, Glycine max
  Peptide Sequence Number=SeqID_159123
atggagagagattttctgggtctgagctcaaaagaaccattggctatgatgaaggaagagatgaatattgatattggaagcaaagacacaggcatgaatgagaatgaagtttatgatggttcctttgtggttcccaatcaagcaatttcagtttccatgggacatccatccctaaagaatcattttgcaactgttggtcagaatatgaatgttgctactgtgaagcaaccactactcggaggaatacctgttacggtgcctcattcagttcatcccattgttggtgctgttgctggaatgaccgaaacacgcgtgaaaccatccgtacctgctcctaaacttacaatcttctatgcgggcactgtgaatgtctttgaagatatctcccctgagaaggcacaagctatcatgttgttggctgggaatggcttatcagctggttctaatgaggcatcacccaatgttcaggcgccctgcttgaagttggcagtaggtgatggtgtgcctgttagtcaacccataccaccctgctccggtctttcaagtccttcatctgtttcttcacatactggttcaccgtcagggagtggttcaagtagcaatgatgagtttctcgcagctaaaacatctggaggtaccacttcctctgttaacaaagtggagactccgaaagtagtcaacacaactaccatgctaacatcagctgtgccacaggctcgcaaggcatcattagctcgatttttggagaagcgcaaggaaagggtgatgaatgcagcaccatataacctcaacaagaagtctgagaatgtgccacagcagaatacaatggtttctaacatcactgcaagcgcaggagattacttcagataa

SEQ ID NO: 67439 - DNA, 438 bp, Glycine max
  Peptide Sequence Number=SeqID_159124
atgacggatgtggaatctaatagggcggtggtgcaagagaaagagggagaggcttctcgcgagaagaacgtgaaagtacgtagaacttctcctcctgcaaacgagccaagcccgcagcctagaccagtgtcagaggctccctcgtggggtcatcatactgagaggacgcaaaacaggcctccaaggcttaaaggaaccttgacaaagaagccagatgtccattgtgggtcattcacagaaaccaagacaatgcagggtcgtccatgtagaaggacacaatggtcaagcggacatgcttcatgcgatgagggttattggaaggggaaccggtgtgaggagtttaacgagttttactacattaaattctgggttgttgttgttggggagaactggttggagaaccaaaaggaaggtgagatcctagagttcgaggactag

SEQ ID NO: 67440 - DNA, 342 bp, Glycine max
  Peptide Sequence Number=SeqID_159125
atggtcacaggtggccacatgggtatcatgaagacccttgtgcgggtgtgcaaaaatttcacttggacagggttaaggaaggatgtccaaacatttcttgcagcttcaagaactattccaattaagtggaacaaagctacacatgagttctgcataccacctgatgtagctccatgtgaagcttgtaggccttggatcttcttcatcaatggagtcctttgcttcttgaagatcatggcagcagaatggagaaggaggaaaggtgattggagactccacttcaaggagaagatgagtcaaaaacaagctcatcactataggaagccatggataagagcttga

SEQ ID NO: 67441 - DNA, 93 bp, Glycine max
  Peptide Sequence Number=SeqID_159126
atgaaggctgtggtttcaaggttgcgcaacaatgagggctacggcttagggtttcaagcatggtcagaggctcctaaggatcaggagctctga

SEQ ID NO: 67442 - DNA, 648 bp, Glycine max
  Peptide Sequence Number=SeqID_159127
atgggtcaagagggaatcactgtagataaggatatgatcaaagaagacggttgtgaatttcctcaacagttttggcaatgtcctcatcaaccattaatatctggtggaatccctgccgaatacgcgcggagtcgccaccaacgtttatttgaggaaaatgtcggaaaaaccggaaaagacgtgatctacgaacttttaagtgaaagcactggtgaggacaaagggctttggctaacgcggatgaggccggagtcaaggaggaaggaggttgatgtggtgggtgatctggcgtggagggggaagggtggttggtttgaggaagatggaggaggttcgggttgcgggttagagtgcactgaaagatggaataaggtggaggtggagttggtttggatcatacaccgaagttgtttaggggatgaagagaggttgtatctcggtcaagggaaggttgaggaactttgcaacacatggttagacgaagctatgtgtgctaccattatcgataaggacagtgattcaagtgtgattgatgaagtcgtacactcgaaagtggctaggtctggtgggtttgaaggtggagaatcagggggtggggcaagagggatggtggcggtccaggattttatcttcctggagtttggctaa

SEQ ID NO: 67443 - DNA, 798 bp, Glycine max
  Peptide Sequence Number=SeqID_159128
atggctccaaagaagctcccggccaagaggtccaggaaggatgctactggagaaggttctagtgcagccccacaggcagatgtggactttgatagacataggttccggagtgtggaacaccaacaacggtttgaggccattaaaggctgctcgttcctcagagagagacgatggattccctttgatgagcatgccatcaatcagtttctggggcatccaccggttttggaggaaggccagcactgtgagttctcacagaggaggagtcaggcctccggcttcgatgaggaggctatcaatcggttgctatgcgtgccaaggcaggactttgcccagagcgtagtagggagacgggtgagtgtccatgtcgcccagctgatttcagatgttatttaccagtttgcaaggattacacctcgaagacacccagtggacccggagaagtccaatagggccttgggatttcctactatgatcacaggcctctgtcaattctgtggagtggcgggtcaggcttcgcagcagccaaatgaggaccagcagcagccagctacagatgcaccaccgccgcctctacaagaggcggctaatcacagaggccaggtgcagcttaacgataccttttactggtacaacatgcaccaacagagccaggacccccatcctttcccttggcctaccctcgatcaatttggggccacagtggcctcgcctggggattgggtcaattttgagacgaggttgggacctgtaggagctccggggggctgttggatcaagtggcctcggaataattaa

SEQ ID NO: 67444 - DNA, 251 bp, Glycine max
  Peptide Sequence Number=SeqID_159129
catcctctccaagcttcttatccaaggctcatcttggtggtgaagctccttcttccatggcttattccctagtggatggcgcctcctctcacctcttctcctttgtcttccgctacatctccatggttgatgaagagagaaagggagaagaagaggtggctctaagttcaagaatcagtagggcactttctgaaatactgagagagctaaacaagaaagtaccaggtgccctcatcaaaactcgcctctag

SEQ ID NO: 67445 - DNA, 282 bp, Glycine max
  Peptide Sequence Number=SeqID_159130
atggcaaacaatccttcaagtgcacagaagaaagaaaaaacttctaagaggaagcaagcacaaggattattaaagttggtgcaaatgaaagaaactttttatcaagagttagtcaaggttttctacacctatgcacatgctgaccttgaaggtaacctcttctctactataattggagtagacatggtcattgacactactgtatggaaggaagtagttggcctggacatgggtggagcccgcaagtttgatgaaacacctaatgagtacaacaagatgtag

SEQ ID NO: 67446 - DNA, 639 bp, Glycine max
  Peptide Sequence Number=SeqID_159131
atggctccacctaaagagatatcaattatcgttcaccacaatggtcagattgtagacaactcggttcacaaatcgatgtactcatgtgcgaacccaatatttctatatcttattcctcaaccacaaccacaactaccatctccacaaccattattgtacaacaaccttgaaatacaaaatgcctttgacatttatacttcatactcacaactattatcccaaaatgattcttttttatgcccaacaaacctcatttcaccaacaaaactatcattcatcacaatattttacaacatcaccccatcacaacaaccacagacacaaatatcaaacccaaatgaatattccatcactaatgaagatcccattatacgatttcacgaagaaaacatgattgattttagtgagcatgaggatcaagagttgtttcatcacaacaatgaccaaagtgatgacgagggtgttgtcataccaacgtcacctccgttgcaatatcaccaacctaagtgtccagtggagttgaacattgaccacctaccacgatacattgatcaccatcattttgttcagcaacaagaccgtgtacaaccaccaactagtgcactcagggttggcatgaccttcaatgaaaaagcatag

SEQ ID NO: 67447 - DNA, 231 bp, Glycine max
  Peptide Sequence Number=SeqID_159132
atggagaatgttcaggaaaggtatgtggagaacttcaagtatccaaaagatggttcatcaccaaagtccctaagatatattggaagcatggtggctgatgttcaccgcacattgctttatggaggtatttttctgtacccagctgataaaaagagtccaaatggaaaacttcgtatgttgtcacaccaattcaatcttatggaaatggtgattctaggaaaagagctatga

SEQ ID NO: 67448 - DNA, 351 bp, Glycine max
  Peptide Sequence Number=SeqID_159133
atgaaggtcgatatggaggctatgaaggagcagatgacaatgatgatggaagcaatgatgagcatgaggaagatgatggaggtcaacatcgctacaactattgctgccagtactgctattgagaaggactcaattcacccgcccgatttcaatcaaaaaggtcgtccggtcttaaatgtagcaggtcaaggaggcaaggcgatgatgaatgcgtatgggcctcattatgtccaggagaggctgagggccattgaaggaggaggaaattatggctttgttgagatatcagaattgtgcttggtacccgatgtggttattcctccaaagttcaaggtgtcagatttttggtaa

SEQ ID NO: 67449 - DNA, 180 bp, Glycine max
  Peptide Sequence Number=SeqID_159134
atgagtgacatagaacaagtgatgcaatcctatactgcaagggcattggatagaagactccaagaagattgggccagagatgcaagagaaggtcctagggttctcatgagccttaggggggaggtaggggtgggaataggccaggccggctcacaggggcctacgacttggcctacataa

SEQ ID NO: 67450 - DNA, 183 bp, Glycine max
  Peptide Sequence Number=SeqID_159135
atggcggtagaatggagaaggaggaaaggtgattggagacaccacttcaaggagaagatgagtcaagaacaagctcaccaccataggaagccatggataagagcttggacccaactaatccaagatcaagtccaagattcttcactaagtgtgcttagatgtcatgaggcatgtaaagcatga

SEQ ID NO: 67451 - DNA, 147 bp, Glycine max
  Peptide Sequence Number=SeqID_159136
atggctaagagattccaagaagattggaccaaagatgcaggagaaggccctagggttctcatgagccttaggggctccatagtgcagggaggctaccctagtaatgtaggatttttcatcccttgtattttagggcacctagactag

SEQ ID NO: 67452 - DNA, 384 bp, Glycine max
  Peptide Sequence Number=SeqID_159137
atgagaaagagccccaaccaacatttattccaaaacggaacatatgagggaaagtttccttcaatactgctaccaattgaagttcaaaacatccatagaagcaagcatggaagtgactctggtgtctacgatagtgaaggaagcaagcatgctcgaacacacccaaattctttaacatctgatgaattgatggggatgcttgtggcaaatagagttcctaaggattacgctggatggcttgctagctacacggagtggaagatcctatatgttcttggcaaagacaaggatggtttactgcacaaagagactattcgagctgtttatgatggaagcctctttgaaaaaatggaaaaggaacactcagacaagaaagcgaaataa

SEQ ID NO: 67453 - DNA, 237 bp, Glycine max
  Peptide Sequence Number=SeqID_159138
atgttgattgatgttggaagtgcattggcatgtgcatgttgtgtatgttcgtggggggcgaagtgcactgaccttccagggtcgttggcacttgctttgggccacattcatacgttggatgttgtgtatgttcgtggagggcaaagtgcactgaccttccaaggtttttggcacttgctgtgggccacattcatatgtcgtatagagtgtatgtcatgggggggtgggatcctctag

SEQ ID NO: 67454 - DNA, 153 bp, Glycine max
  Peptide Sequence Number=SeqID_159139
atggatcacttagcgcttctatggccgcaaggaaatgagcttagcagtgacgtgtcgcgcttaaccattgaatacgatggcgagcagcttagccttggccagcttagtggaccaaatcagcctgagatgcaagggttgagcgctaagcgctag

SEQ ID NO: 67455 - DNA, 1101 bp, Glycine max
  Peptide Sequence Number=SeqID_159140
atgaccacagataaattggtggaaatcataggaagtataaagcaagagttgaggaaagaggtagaagacgaaaacaaatggattattgacataatgcaaaagcagttggatgcgatcaagagtgaaccgtctatccctgatgtattggatgcacgtgtcagcaccaaagaaagttgtgccgaggctgctgcaaatgttgttgctaaggagcggtctacacttgatgcttctattgtgcggttatacattgtgtgtggcaacagtacacaggtggtggctttgggaaaaatgtatagagttggtggcattatacacaatgttgcttacgcagatgatgtagtacgggtttgtgttgagacaatttacgatggtgacgccagtgtcccgtttcccactgcagagattcagtatgtcagggacacgagtagcacattcattgcatggcccaaacatctagtgaagcctatagctgatgattcaaatcataatgtgcatttgccacttagacgtcttggtgaggctgaggttgcagctgaagctgatccgttgggcgaattgatgaagacattgttttgcgtgtacaagaatccagtggaagtgtcgtgggaggcgacgcaatttggacttcctaatgttggggcaaaatttttcatcacacatgctgatctagcagaaataatatcaggtgacaagtgtttgaacatctctatcctgcagctgtggaccatggcacattggcaactatttgttctgtgtccaagggaaaacatgattgtttggttttgttctctaaggaagaagccagatattaacatcaaagccgcaattaacagtacaatgaagacaataaccagttcttccgaaggcatgtctaatcaagctgcacctcgatgggttgaaccaaagagtcatgtccaaactggagggtacgagtgcggatattatgtcatgcattggatgtggtgcatagtgactggtggattgaaggatgactggaacaagtggttttctgatggatcaccgttagacgtggaggccatcaccacacttcgccagaaatgggcaacattctttttaagtattaggaaaagcagatgctaa

SEQ ID NO: 67456 - DNA, 411 bp, Glycine max
  Peptide Sequence Number=SeqID_159141
atgggactgatagggaatgcaacagctccaaaagtgtatcaatactgcagtacaaagaaagttttaactatgcaaagactatatggagttcctcttactcacctacactccataagttcattagtttctaatccagaaaccagccgtataactgctctcaatgtgtggaattgttggtcgtatatcccctacaacctaggctgctatggaagtcttcttaggaccactgctattgaagattatgcctcaatgacatcttccttaattgaaatgggtgctacaaatcaggatgttcatgctaaggcatttgtcaaagatttggaaaaaagtgaatgcgtattgttgcttatatttttgcactacttgtgcgtactatgcaacagcaggaattggacacttaaatacttgtag

SEQ ID NO: 67457 - DNA, 606 bp, Glycine max
  Peptide Sequence Number=SeqID_159142
atggcactgggttctgaccagactcctggggaagcagatcgatgtcactctgagggcaggaccctgaagtattgcagggtgcgaggacaggtcattcgatttgatgttgagaccattaacgacttcctcgacaccccagtgatcctggttgatagagagggctatccggcatactcccagtacctgagcatttatccagaccatcaggccatcgcagccaccctgtgcacaactgggggcaagtttgttctgaatgtcgatggcgctcaggaggttgtctctaacactctgatttttgagtcactaagccatgtgatcaacttggcttatattaagaagaactgcgtccacttcagcactactagacgcgcacaacctgatgctccagtccttatactagggatagcagatcatcatccagggcctgcatcggctgtctcttcacctgtagatggacccgctgctcacgactccagaggcctacattcagggggagagccttctggagccgaagatgatgccagcattgatgaggatgtcattgcagacctggcagccaccaactggggcccatggtcagacttcggcggagacacaagtccttag

SEQ ID NO: 67458 - DNA, 177 bp, Glycine max
  Peptide Sequence Number=SeqID_159143
atgagttttgaagaagcaaagcttcatagtgaatcaaaggtgattcaaaggtgttttgatgataacaatgatgatgaaaaaggtgatgacaaagaacaactcaaagatcaatcaagaacaattcaagagttcaagataagaatcaagaagaattcaagattcaagaagaaagtctag

SEQ ID NO: 67459 - DNA, 252 bp, Glycine max
  Peptide Sequence Number=SeqID_159144
atgaactttttccagacatcaatactaggtcgaaaagctctttacggaaggggcagaggcaactgcagaaccttgagaggcgtgaaaattcctaggaatttcagattattgcaagagcttgagagaggtgagaagggaattggggatggaactgttagctatggaatggatgacgctgacgacatatacatgcaatcttggactgggactatcattgggccccctggtgtaagctgctctctgcttttctga

SEQ ID NO: 67460 - DNA, 603 bp, Glycine max
  Peptide Sequence Number=SeqID_159145
atggttgaccattgctcattgggagacgacctaggatcacttcctagatactgtatttttaatgtttatttgattcgggtacggcctcgatcaaatttggcaccgttgctggggagcagtaggccaaagtgcatgactaggggaaatctaggtgatttacaaccctttgatcctgaaatagatagaacctttcatagattagttaggcatagtgtgtatcctgatcattctgtgcattttgagcattgtgagcatttggagcattctgagtattctattgcgagtgattctgaatattctaattttgagcattcgactactaatttttgtactgagaacatggctcaacttccacctcgtgagagggctcttaggatgatggctgcacctgatttcacttatgaaagcttgtgcattcaatatcctgatgagggtgttccatatgttctcaagactggactaatacatttgctgcccaagtttcatggtcttgcaggtgaagatcctcataagcatcttaaggagttccatattgtttgttccaccatgaagccccctgatgtccaggaagatcatatctttatgaaaaagaggatgagatag

SEQ ID NO: 67461 - DNA, 618 bp, Glycine max
  Peptide Sequence Number=SeqID_159146
atgtatctcccaattccacaggcattcaaaattgtcgaaacagatgcatttgatataggttatggtggcatactcaaacaaagagtccttaaccaagagcataatacatcaagggcacctcaaattctctacctaactatctcacccgtgaatttttacagaaaaacggtaatgccacctaaggcaacagggacctccctgaggggagacaggagttcagggaaaagcttcaagttggctctaccagagtcacctatcaagaaaagttcatcaacatcttctgggtcaccgacccagactgggtcattcacccagaaatccaaaattgaagggtcatcgatccaaatagtcaccatcaaacctaattcatctactcaggaatcccccaaacccgcaactggaaagcaaatagcagtcgactatgcatggtcaatacaaacacttcaggcccttcaagaaatgggtctggccaaacttccacaattgaccaaaaagacttgggcagacatggcctcagagtctgatgatgattctgaaacaagtctacaaaacattattcaagactccaaaaattccaaaacgattgtcgattctaaagggaaacaaaccctatcataa

SEQ ID NO: 67462 - DNA, 534 bp, Glycine max
  Peptide Sequence Number=SeqID_159147
atggctcatgagaaccctagggccttctcttgcatctttggcccaatcttcttggagtcttctatccaatgcccttggggggctcgcttgcctctagttgacaaaggtgcagatgatgacgttagtcactgcatgctaccggacccgttaattaggcaagctttggaaaatgttgtttttcaccttctcgctaagccaatatgttggcttaatgagcgtccgctaagcgcaacactgctaggctatgcgcgaggaagaatccaaaagacgatgagctatacaggttcgctgagcgcaccgctccaggtcatcaagcgcaccgcttcagctcatccgctaagcgagagaagtgcgctaagccaaaatccagtaatgtgcactaagcgaacgagcacgaacaaggccacctatttaagcctaaaattagattttgtgaatagagtttggactgggattcagagctttgcatgtctagggtttctagagagagaaaggtccaagttccagagagttttgagagattttgctgtgtga

SEQ ID NO: 67463 - DNA, 114 bp, Glycine max
  Peptide Sequence Number=SeqID_159148
atgggtgccaagcacctcacgaggaccaaagaatggtcgcacgtcatcgagcaaaggtccccggacgaaattagggtaatcgattaccagagagtaatcactctggtaacttaa

SEQ ID NO: 67464 - DNA, 240 bp, Glycine max
  Peptide Sequence Number=SeqID_159149
atgccgcatctagagcctcattatgatttggagtttaggttgactccaatagggtacgacaatcagggaaacgttcttagctaccgcatggagctagtgagaatagttgaagttatcaaggatagaggagaccattccgatatgaagaccaaggagattgaggagtacaaagaactattgtgtcagttagagccttcgtctgaaaatgagtatgatgatcttcctaaggtcatgtcctag

SEQ ID NO: 67465 - DNA, 90 bp, Glycine max
  Peptide Sequence Number=SeqID_159150
atgagtgggaaaattcctatagatgtaaggtcttgcaaacctaacaaagtacatgcaccttgcgggattgtggtggtcatcatcgagtaa

SEQ ID NO: 67466 - DNA, 411 bp, Glycine max
  Peptide Sequence Number=SeqID_159151
atggaacttggccttagatgggaagcgttaaatggaaatttctccaacatgcttttgggcatcacgtttaggcttgagccattgtcgatgagtactttggccataacgtgtttcatgcatttgactgacatatgtaaagccctgttatgtcctctcggtggggatttcctcttcagcgaaggtgaggtagttgttagctgtgatgttattgacaattcccccaaagccttctatggagatgtcttgggctatgtgagcttcattcaagacctttaccagcaaagctcgatgaggctcagagctcatgagcagtgtcgcaacctacccttcggcgggagggcgacgcgagactcgcgggatgcgtgttccacgaaaggaatacgcgcggagtcgccaccaacatttatttga

SEQ ID NO: 67467 - DNA, 489 bp, Glycine max
  Peptide Sequence Number=SeqID_159152
atggttacaaccagaggtttggttcgggctttaggcagggttataggaagagccttagggagagaagttagtggtgatgcagatgaagcccctcagcggcgaaggcccacaacatctgcacataggcaatgggaagctgcacctattgatgaggatgttgagcgtttggattatgcagttgacgagatccaagaacagcctgaaggggcaactactgatgatgcagttactcatgccgaaggttttctaggtaggccccatgatacatcattttttatggactatgttcatcatgtggcagtgacagtttggaatgaagaggaacattctgagttgaagttgtcctcccatggaaggaaagtagagaaatttggtaggcctgctccaaagattgaagacttagttgctaccataggattaagtcctctgattgcatgttccttggacactaatgatcggagacttatatctgcttttgcggagaggtga

SEQ ID NO: 67468 - DNA, 433 bp, Glycine max
  Peptide Sequence Number=SeqID_159153
cagctctagcccaatcttcttggagcctcttgctcatggttctagtgattggtcccttcctagggaggattgcatcaggatgtgactcttcacatttgaatttgaatttcaacgttcaaaggcactgcaagcttcatgatgaatcaagattgattcaaagatgttttgatgataacaaagatgatgacaaaggtgatgacaaaaaactcaaaggtcaatcaaagaatgagttcaagatgttcaagatagaatcaagaacacttcaagattcaagaggaaagttgaagaagatagaatcaagaacacttcaagattcaagaggaaagttgaagaacacttcaagattcaagaggaaagttgatttcaagaatcaagaatcaagattcaagattcaagaatcaagagaaggcttaatcaagataagtatgaaaag

SEQ ID NO: 67469 - DNA, 462 bp, Glycine max
  Peptide Sequence Number=SeqID_159154
atggatgcatctgtcataggttatggtgacatccttaaacaaagagtcaatagccaagagcatgtcattgcatacacatcaaagcattggaatccagcacaattaaattattcaaatagtatatcaagggcacctcaaactctctaccggacaaccttacccatgaattcttacagaaaagtggcaatgccccctaaggcaacggggacctccctaaggggtggttggaatccaagtagaagtctcaagttggctctaacagagccaaacacaaaaacaaactcttctgactcaccaatccagcttaggtcttctacccagaaaattaaaaaagaagggtcgtcgacccaaatcatctcagtcaaacctgagtcattcgctcaggaacctcccaaatcggaaaccgccaaacaaacatcgactgactatgcttggtcaatcaaaacacttcaggccctctaa

SEQ ID NO: 67470 - DNA, 1359 bp, Glycine max
  Peptide Sequence Number=SeqID_159155
atggacgacgatgcgttacgtcgcgggcagccaacctgccatatcaaatatggcgaagacacggcgattctggccggcgatgccctgcaaaccctggcgtttaccattcttgcggaccagccgatgcccggcgtaagcccgcaggatcgcattgccatgatttccgaactggcgcaggccagcggcgtggccggcatgtgcggtggccaggcgctggatttagccgccgaaggccaatccgtggacctgaaccagctggagcagatccatcgccataaaaccggcgcgctgatccgcgccgccgtacgtctcggcgccctcacagcaggtgcagcgggccgcgaagcgctgccgcagctggatatctacgccaacgccatcggactggcgtttcaggtgcaggatgacatccttgatgtggtcggggataccgccgttctgggcaaaacccagggcgccgatcaggcgctggggaaaagtacttacccggcgctgctgggactggataacgcgcgggccaaagcgcaggatctctatcgcgaagcactgggcgcgctggaggtgctggcggcacagtcttttgatattgcaaaatacccgacactggcgttagcaggcacggttcaggaattacgtttactgcctaaagaaaaacttccggacctgtgtgacgagctgcgtcagtatctgctggacagcgtgagccgctcgtccggccactttgcttcgggtctgggcgtcgtcgagctgaccgtcgcgttgcattatgtgtacaacaccccgtttgaccatctggtgtgggacgtcggccatcaggcctatccgcacaagattctgaccggccgccgcgaccgtatcggcactatccgtcagaaaaatggcctgcacccgttcccgtggcgcggcgaaagcgaatatgacgtgctgagcgtgggccactcgtcgacgtccatcagcgccggtctcggcatggccgtggccgccgaacgcgaaggcaaaggtcgccgcaccgcctgtattattggcgacggcgcgattaccgcgggcatggcgtttgaagccatgaaccacgccggtgatatcaagccggacatgctggtgatcctcaacgacaacgaaatgtcgatctctgagaacgtcggcgcgctgaacaatcgcctggcgcagattctctcgggaaaaacttattcacgcctgcgcgaaggcggcaagcgcgtgctgggcggcctgccgccgatcaaagagctggtgaagcgcactgaagagcacctgaaaggcatggtggtgccgggcacgctgtttgaggagctgggctttaactatatcggtccggtcgatggtcacgatgtgctgacgctg

SEQ ID NO: 67471 - DNA, 53 bp, Glycine max
  Peptide Sequence Number=SeqID_159156
atggatttcacaaagatagtggaaatctcaagtgggttgcttgagtactggac

SEQ ID NO: 67472 - DNA, 279 bp, Glycine max
  Peptide Sequence Number=SeqID_159157
atgcagactcgccagttgttctgcactcttgtagggataagctcatccctttcattcttaatcactatgaggcctgtcttcttaggaaccacttggactagactcacccactggctgttagaaatgggagtcgcaacctacccatttgtgggtgagcgaggcgaggctcaccggtcgacaaaagcggggctcttgcttctacgtaccctccatcgaagaggagatcaaacctacgtagttctttcaaaaggggcaaatcaagcgattctttttacttga

SEQ ID NO: 67473 - DNA, 309 bp, Glycine max
  Peptide Sequence Number=SeqID_159158
atggctggaagtgacattgctattattagagatagagctcacataccaacaaataaaagtcttctggaacttacatcacaagatgcgctgttggcacagaacaagttgcagggtgtgccatctgtggtggagctcacaattttggctgttgtatccccaatgaagaaccaactcatgaagttaattaggcaagtttgtgaagtgttgattttgatctgctcgctaagccaatctgctgactcagcgagccatccgctgagcgcaacactcctttggctgagcaagaggaagaatctggaagaaggatga

SEQ ID NO: 67474 - DNA, 846 bp, Glycine max
  Peptide Sequence Number=SeqID_159159
agggctacacgccttgccttcgtagggctacacgtcctcggcttcagaggactacacgtcctcaccttcagaggactacacgccctcaccttcagaggactacacgtcctcgcctttagagggctacacgtcctcaccctcggaggactacatgtcctcccctttagagggctatacgccctcgccttcgaagcgctacatgccctcaccttcagaggactacatgtcctcgccttcagagggctacacaccctcccttttagagggctatatgccctcaccttagtagggctacatgccctcaccttcagaggactacacatcctcgccttcagaaggctacacgtcctcacctttagaggagtacatgtcctccccttcagagggcttcacgccctcgccttcataggactacatgccctcaccttcagaggactacatgtcctcgccttcagagggctacacgccctcaccttcagaggacttcacgtgctcaccttcagagggctacacgccctcaccttcagaggactacacgcccttgccttcgtagaggactacacgtcctcggcttcagagggctacacgtcctcaccttcagaggactacacgtatgcctcgccttcagagggctacatgtcctcgccttcagaggactaccagtcctcgccttcaaggctacacgtcctcgccttcagagggtacgtcctcaccttcagagggctgcacgcccttgccttcagagggctacacgccctcacctttagagaactacacgtccttgccttcagagggctacatgtcctcgccttcagagggctacacgtcctctcatgcgaggactag

SEQ ID NO: 67475 - DNA, 162 bp, Glycine max
  Peptide Sequence Number=SeqID_159160
atggcgtttttcctaagctacacgaaagcaaagaccacatttcgagaagatccaatggttaacgaaggctgggcagcgtttttaccgaggcagcttcatgtagttttctctaaaagcttcattaagaggctttctccagaagcttcatcgtggcttctttga

SEQ ID NO: 67476 - DNA, 259 bp, Glycine max
  Peptide Sequence Number=SeqID_159161
aaagaactacgtaggtctgatttcctcatcccaattgaggaatacgtaggagcaaagtctcttatgacgggcgtgtggggtgctaataccttccccgtgcgtaaatacaactcccgagcctttcacttaaaagttcgtagattgcgtcttttccggttattccgacattttcctcaaataaacgtttgtggcgactccgcgcgtattccattcatggaacacgcatctcgcgagtcacgtgtcgcccttccgccgaagg

SEQ ID NO: 67477 - DNA, 336 bp, Glycine max
  Peptide Sequence Number=SeqID_159162
atgactaggggaaatccaggtgatttacaaccctttgatcctgaaatagatagaacctttcatagattagttagacatagtatgcatcctggtcattttgtgcattgtgagcattctgagcattttgttgagggtgattctgattttgaacattccactactaatttttatactgagaacatggctcaacctccacctcgtgagaggactcttagggagatgactgcatctgatttcacttatgaaagcttgtgcattcaatatcctgatgagggtgttccatatgttctcaagactggaataatacatttgctgcccaagttcatggtcttgcag

SEQ ID NO: 67478 - DNA, 1425 bp, Glycine max
  Peptide Sequence Number=SeqID_159163
atgcgccagatgcagagcgagctgggtgctgcgatgtcaccgcacctgagtgccatgctgcagcgcgactggcgcgcggagcatttcaccgacgccaacaccacgcgcaaaaagctctgcaaccagctgtggcgctttatgcagcgctacgacctgctgctgtcgccgacgctagcggtgccgccgtttgcgctgcacatgcagggcccggaagtcattgatggccgcatggtgcgcagcgatcactggctgtcgttctgcttcccgttcaattttaccggtcagcctgccgcctcggtgcctgccggcttcacggccagtggactgccgatcgtgccgcttttgagcgcatccaaccatggaatcatcactatcctgctgctattggagttctccatgagtaacaaatcttcccctgcgctggagcaggagttcgagcatgagccggtgccgcttagccatcgccactcgacgggttcggtgtcggcggtgtggtttggctttccgatgatcctcaccaatgcgctgttcggcggcattatcacctggcatctcggcttctggccggcactgctggcgattttgctgggtaacctggtgctgtttgcctatgtcggcgcacttagctggttcgccgggcataccggtatgaacttcgcgctgcaggcgaagcggacctttggcaccaaaggctatatcctggtgtccggctttctttctaccgtggtgataggctggtacgccttccagaccggcctgaccgggacggtgatcaaccagacttttggctggaacgcgctggcggtcaccgcgtttgccatggtgctgtatactggagtcacctttcttggggtgcgggcgctgtcggtgctgggaatgattgccgctccgctgtttgtggtgctggggctggttgcgctgtggctggtgagcaaggatcatgatttcaccacgctgacccagtggcagggcagtccggcagccgctggtgccatgagcatgggcacggcggtcaccatggtgattgccggctttgcggattccggcaccatgacagcggattttacccgctggtcgaaggacggcaaatcagcggtgatcgccgcgttttccgcgttcccgctggcgaatgtgatttcctatctgtttggtgtggtgattgtcgccgtcggcgcggcggtcgatccgctcagcaacggcggtaacttcctgccgctgctgatggggcacggcatgctgctctccgtcattgcctttctgtttgtgtttatcaacctcggttcggtgtgcacgcactgcctgtataacggcgcggtcggtttcagccatctgttcagcagcaaaaatgcgcctgtggacgctgatccttcggggccatcggtggcgtgctggcgctggccggcgtgtggtctctggatcctttga

SEQ ID NO: 67479 - DNA, 1107 bp, Glycine max
  Peptide Sequence Number=SeqID_159164
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagtggcgctcaaggaattggagaagagaaatgctttcaaagatcttactgcttaccagtttctaattacattgtatgggcgaacgggtaacttatacgaggtttatagggtgtggcgttcacttaggctggcatttcctaaaactgcaaacataagctacctgaacatgattcaggtgttagttaacttgaaagatctcccaggagcagaaaaatgtttccgggagtgggaatgtggctgccccacttatgatattcgagttgcgaatgttttgatacgggcatatgtaaaattagatatgctggagaaggctgaagagctcaaggagcgcgctcggaggaggggtgccaagcctaatgccaaaaccttggaaatctttatggattactatttgctgaaaggagactttaagttggcagtggattatctaaacgaagcaatatcaatgggtagagggaatggtgagaagtgggttccatcgtcaaggatcatcagtatcatgatgaggcattttgagcaagagaaggatgttgatggtgcagaagaatttctagagatcttgaagaaatctgtggaatctccaggggtggaggtgtttgaatccttgatcagaacttatgcagctgctggtaggatcagttcggctatgcaacggcgattgaagatggagaatgtggaggtgagtgaaggcacccagaagttgcttgaggcaatttctgtggagtga

SEQ ID NO: 67480 - DNA, 363 bp, Glycine max
  Peptide Sequence Number=SeqID_159165
atggttagaaccagagcatccgcacctaggcaacgggaagttgcccctgtttctgaggatgctgctgatattagtgaggacgtacctgcacctggtgcagaagctgttgatggtgttgagggatttgttgttgatgatgttgagggattcccaggtgggtcgcatgacccattagtgctgactgagtatggtgaccatgttgcatttagcatatggaatggagaggaacgccctgaattgaagttatcctcccatggaaggaaagttgagaaacttgggaggcctgctccagaaattgaagggctagtcactgccacaagattaactcctttgtgttggaacaagtggcctcggaataattaa

SEQ ID NO: 67481 - DNA, 624 bp, Glycine max
  Peptide Sequence Number=SeqID_159166
atggtatggtggcagaggtgggggttggcaaggagatgtttggaggtggaatctatgttggcggagagtttggtttcaatgggagcaagcaatagcacaacaatttttggaggatattggacaaatatcaccatcctaaaacaagggggatgtgcaaaaaggtatttgatcaatataagaggtagtaaggctaacttggcttgctacacgtgcttcgttctcatccacgaacaaaacaatatcgtttgttggcgttgccacgatgacttcgttgaacatgtcacctcccccaacgcctcaacgtcggacgaggagaacaactttgagttaaactacgacgatttcaacagcaagggtctttgcccgctgccatccaccatgtcgaagttcttgctaggattagtatttgactggttactagagcaggttttgcagattgagatcaacggcctcgggagggcagagaatccatcgacgtcaaaggcggtgatagagtcaatgccaacggtagaaataaccgagtctcatgttgtgctgcatccaccgcgccttgacctaaactccaccacacctttagcccaacagagggcaacccaaatcaacaacaacctagatttgaaatag

SEQ ID NO: 67482 - DNA, 381 bp, Glycine max
  Peptide Sequence Number=SeqID_159167
atgggaaattgccaagctgtggatgctgcagcacttgtgatccaacacccatctgggaagatagagaggttgtattggccagtgagtgcaagtgaggtcatgaggactaatccagggcattatgtttccttgatcataccattggctgtgcctgatgatcaagggcagatcaatcaggagcagcagaaggccgtgctttttacgcgcgtcaagctgctccggccaaatgagactctcacccttggccatgcttataggctggtcactactcaaggttgtgaaggcagtgaaagcaaagaaacatgcaaagatgaggaagccacaggtgaaggcaatggagggtatgcaaatagtgcagctggaaaagccagtttcagatag

SEQ ID NO: 67483 - DNA, 411 bp, Glycine max
  Peptide Sequence Number=SeqID_159168
atggtgtgccaaaagggattgctaatcggtatctgcaatcttgagaatacgaagcatattcttagaagcacaccgaaacgacgcgtaggaagaagaccaatgaagaacaacaagaacgtcatggttgatgctccaggaaatgacgactttctgagagacacgatgattggtgggttcacgatattcaatttcttccttcaggagttgattgataagcaagggaaggtatcaaaggttaaagtgcttgaatataacaaagattcaattctcatctacaaaggttggcctaaatttaaaaggctaaatgaaatttacaatgaaagggagataatgtttgtttatgtgggtgaccataaatttcatggtaggttcttcaaacaagatccagagcttgcaagagttaatcagtaa

SEQ ID NO: 67484 - DNA, 537 bp, Glycine max
  Peptide Sequence Number=SeqID_159169
atgccaacttcaacacctacttcatcccctcattttgttgtgcgcgtggagggagatggcggtgttccaaacgacgacatttcggtgcggcggtgggatttggaggaagagttggtgggcgaaggggagggagaggcaggtgccgtagagtcggaggaaggcagaggagacgaaggggttacgaaggaaggaggacttggcggcatgggcgtggagagaggtggcgaggagggggaggttgagggtggtgcaggactggagggtgagggagaggaggagtctatggaagcttctagggcacgaaggagagaagagcttcatcaaaaaggtggaggaggagtggaggaaaatggaggtgactggacgaaaaatattgtcaaagatttggatgagctagacttaaaggaggagggtgaagagctaaatgaagaggaaatggttgaaggagggagatcaaaactcaaaatgtttccactccttggtgaaatagaggcaaagaaggaatattatgctaagggggataaacatagaaggaag

SEQ ID NO: 67485 - DNA, 306 bp, Glycine max
  Peptide Sequence Number=SeqID_159170
atggtgactcattctcgcaacagtaccttcaatttcttggctttttggttgaacatgtatgtagatgttagatgtcgcagtggagatcttgtttgcggggaggaagacgatgaaagggatccccgtagctgtgcagtaactggagagtgcgacggaggtagtggccgtggttgtggaaggtgcggtgtcgaagagaagaagaaaaaagtaaagattctcctcggatgcttgactcgttttgaaacagatgaaaatgatgcattgaagatgagattaataggttgccaattgcaaccaccaatttag

SEQ ID NO: 67486 - DNA, 402 bp, Glycine max
  Peptide Sequence Number=SeqID_159171
atggacgcatccattgtgcttagggaaccaaagaagtgccataaagacatgtgttactccctcttcatcgacagcaaaagggtcaacccgatactattcatcactgtctacaagctcatcggtagaactgaggctaccgtcctccccaccaggtatgttgtcgagatcaatcacaccatgtggcacatccacgacaacttgccctgtatggacaacgacaacctctgtcgtgaaaagccaaacaaccatagggtgtttagcgaggacaaccacgtcctcgttggtaacaatatacagagtttgctgatagtaagagaatattacatcaaaggttcagcagaactcttcaacaagagatttagtcttccattacaagttagcaactttcagcacaaaggatag

SEQ ID NO: 67487 - DNA, 2622 bp, Glycine max
  Peptide Sequence Number=SeqID_159172
atgcgaagatgtttgaaacctaaagaagctttgttccgaaactccaagaaccaacgtccttcatctcactctcaaattcaaaggaacactattaatcaacatattagtaacgacaacaacacccatatccttgacaaccttacccgtttccatgtcgcacgtaatcaagtcgaacatgctcgccatgtgtttgaaaaaattccaaagccaagtgttgttttgtggaacatgatgatccgagcttatgcttggaatgacccatttctacaatctattcatctgtaccaccgcatgttacaactcggtgtcacacccactaacttcaccttcccttttgttctcaaagcatgttcagctctgcaagcaattcaagttgggagacaaatacatggccatgccctcacacttggcctgcaaactgatgtctatgtttctaccgctttgcttgacatgtatgccaaatgtggggatttgtttgaagcacaaacaatgtttgatatcatgacccacagggatcttgtcgcgtggaatgcaatcattgccggtttttcgctacatgttcttcacaatcaaacaatacacttagttgtccaaatgcagcaagcgggaataacgccaaattcttcaactgttgtatctgttctacccacagttggacaagctaatgccttacaccaggggaaggctattcatgcttactctgtaaggaaaatcttcagtcatgatgtggttgttgcaactgggcttttggatatgtatgccaagtgccatcacttatcttatgcccggaaaatcttcgataccgtgaaccaaaagaatgagatatgctggagtgctatgattgggggatatgtcatttgtgactccatgagagatgctttggccctttatgatgacatggtatatatgcatggcttgagccctatgccagccactcttgcaagcatacttcgagcatgtgcaaagctcactgatctaaataaagggaaaaacttgcattgttacatgattaaatcagggataagttcagacacaacggtgggaaactcactgatttcaatgtacgccaagtgtgggatcatagatgactcacttgggtttcttgatgaaatgataacaaaagacattgtgtcttatagtgctatcatttcaggatgtgtgcaaaatggctatgcagagaaagctatacttatttttcggcagatgcagttgtctgggaccgacccagattcagcaaccatgataggcttcactgcaaatacatccatttgtaatgccattattgacatgtatgcaaagtgtggaaagattcatatcagtcggcaagtttttgatagaatgaagaagagggatattgtttcgtggaatacaatgataattggttatgccattcatgggctatacatagaagccttttcattgttccacgaattacaggaatcaggcttgaagctggatgatgtgacccttgttgctgttttatctgcatgtagtcattcaggccttgtcgtggaagggaaatattggtttaataccatgagccaagacctcaacatcttaccaaggatggcacattatatatgcatggttgacctcctggcccgagcaggaaatttggaggaagcatactcctttattcaaaatatgccatttcagcctgatgtccgtgtatggaatgcattgcttgctgcatgtaggacccacaaaaatattgaaatgggtgaacaagtgtcaaagaagatccagatgctgggaccagaaggtactggaaattttgttcttatgtctaacatctatagctctgtaggtagatgggatgatgcagcacaaattagaagcatacaaaggcatcaaggttacaagaaaagcccaggttgcagttggattgagatctctggggcaatccatggatttattggtggggatcgatcccatccacaatcagtatccataaataacaagttacaggaattgttggtgcagatgaaaaaacttggatatcatgctgattctggttttgttctccatgatgttgaagaagaggagaaggaacagattctcctttatcatagtgagaaaatagccattgcatttggaattcttaataccagtcccagcaaccccattctatacgagatgcaagtcgatttcatcattttgagaatgaaatctgcaattgtcaggattactgcaatggcaaaagcatgcaagtcacatgaagaaatcttgagtggagctaccaaacatggtttgaaggctctgcagaagtgccatttgcttgaggaagctgctcatgctcctgctattctagctctttctagacccatcggctctgagtggaaagagaaagtcgagaatctacaagtggaacttcagcaatgctacaaagctcaatcttggctgtctgagcaacttgttgtggaagtagctgagtccagagcttcaaaagcattggttcaagagaaagaagatgcagcggcttatctgcagaaggaattgactgaattgagggaaggatgctctcaattaaaggtggacttgggagaaaagattaaatctctagaagtggttgtcagtgagaaatctgaacttaaaagcacaactggagcagatgactactaa

SEQ ID NO: 67488 - DNA, 129 bp, Glycine max
  Peptide Sequence Number=SeqID_159173
atgtggtgttttggaagattgtggagagaggtgcagggtgaggtgcagtttgcactcaaggccaaagatttgcacgagagcttgcgggacatgctgtatgaggtgcagttgtgtattgctgtgacttaa

SEQ ID NO: 67489 - DNA, 483 bp, Glycine max
  Peptide Sequence Number=SeqID_159174
atggagcatcatcacctaagacttattctcctactcttgttcctgttcctacccaacacctgcttctctttctcatttcaaactccttcaagcaatgaattctcgaatcaaagttcttcctctctgaagcagcagattctggagctagctaatagtcccagcacggtgaaatggatgaagagaataaggagggaaatccacgagcacccagaacttgcatatgaagagttcagaacaagtgctgtcataaggcgtgagcttgacttgttgggtgttgaatacaagtggcctgtggctgggactggtgtggtggccaaaattggttatgggtctcctccttttgttgctcttagagcagacatggatgccttgccaattcagctagtgtctcctttgatgccacaaggacacatgtgttggacatcgttagtatgtctgcatggtcctgtttgtgggtatgaagctctggctggttttggctag

SEQ ID NO: 67490 - DNA, 327 bp, Glycine max
  Peptide Sequence Number=SeqID_159175
atgggttttcgtaagcaaaaatgcttccagaatagtcattccgaagaaggaggagaaagaaaagaaaaaaagaagagaagggtgaaggagccacttaccttcacagaaggaggaaggacaatgagagagtgtgagaatgagggggcgtgggggaaggaggagtcaccacgagagggagggaatggatgtcgtcatgggggtgtgctgttgcgtgttgagagaaaggagaagggagggttgttattggcaccagcgatagttgctcttggcacccacccgcatatattagctgcccttacttcttgccctagccatagctttccttaa

SEQ ID NO: 67491 - DNA, 1587 bp, Glycine max
  Peptide Sequence Number=SeqID_159176
atggggaagacagcagcttccaatcctgctttgcaagtgtctgtttcatttggtagatttgagaatgattccttgtcttgggagaaatggtctgctttctccccaaataagtacttggaagaagttgagaagtgtgccactcctggatcagttgctcagaagaaagcttactttgaagctcattacaagaacattgcggctcggaaagccgaattgctggcacaagcgaaacagatggagaaagattctcctagatcacaacgtcaaaatggtgaagatctgagttgtaacacttgtgggactgatgcagaatgtgatatgtcctctactcagggttctagtgaaggggttaagcaagaaaccaattcaattggtgagattgttaggactgatgtgagtaatttaatggaggatgttgcagtttcaatagattatcaaggttcatcagttgagggagagaaagagaatgaagaactggaaagcagattaggtagttcccagatagataaacatgaagaagttgtctgcgttgaacaaggaggaagtaaagaagaaagtcctaacactgaagctgaagatgtgaaggaaatttcacacaatgtgaacaatgagcctgcaaagacttcagaaaatgaagcaaaatatgtgacattggatcatccaaaggtatctaagaaggttacccctgtgaacagagaaagcaatgcaacaaaggcgaagaagaaatcgatgctatctacttctaagcctaaggcatcccaattttccacccctagaagttcaaagcctacatcaactcccaccaagacattggcatctgcctcttcaactaaaaggggaatttctccatccatatctgggaggaaaattaattccacttcagagaacagaaaagttccaaataaatctttgcacatgtcccttagcttggctccaagccaacctgatcctgcttcgcatactacaatgaggaaatctttgattatggagaaaatgggggataaggacatagtcaaacgagcattcaagactttccagaacaatttcaatcagccaaaaacttctggtgaaaacaaatctttggtaaaagaaaaggttccttcaaaggtgacagagtcaaggaatccaacatctataaccttgagaaaggaagatggacagtcacctaaggttgacagtatggatagaagaagtgtgaatgctgttcgaactgctttcggcctaaaaggtgacgttaaagcagagaaaggaaaagagtttccgagaaaaatagatgaaaaatttaattcaaaagaggtagaaagaacgcatcttcaactgaaatcaaagggggaaaagataaaacatatttccaaagccacacacttgccagcttttcactggggtcagaaagcatcaaaaagtcatccagaaaagtcaacttgtgttctacaacttaatagtctggtgattgtaggaaaggggatgttaagattgagaaatggaggtagcctaaaatcaagagatgggattgaatacatcagtgggcgtctaagatctatatgttcagaggaaatgcttatggctacaactcaagtcacactatga

SEQ ID NO: 67492 - DNA, 4556 bp, Glycine max
  Peptide Sequence Number=SeqID_159177
gatttggctcttacgagggcgatctgtgtgcaattttggggctggaaatcttgctcgcgtttcatgcttttgtgaatttccctgcggttagatctgcttcctgcttgttgcttttgttcgaatgtgaaagaatgaagaggtcaagggatgatgtttacatgagttcacaactgaaacggcctatggtgtcttctagaggagaaccctcggggcaaccacagatgacgagtggcggtgctcagaaactaaccacagatgatgccttggcatatctcaaggcagtaaaggacatgtttcaagataagagggaaaagtatgatgactttctggaagtcatgaaggatttcaaggctcaaagaattgatacatcaggtgtcattgcaagagtgaaggaactgtttaaagggcacaaagatctaattttgggatttaacaccttcttgccaaagggatatgaaattacacttccattggaggatgaacaacctccccaaaagaagcccgttgaatttgcagaagccataaattttgtgggcaagattaaggctcgttttcatgacaatgaccgtgtttataagtcatttctagacatattaaatatgtacagaagggaagccaagtctattgctgaggtttacaaggaggttgctgcacttttccaggaccatgtggatcttcttagggagtttactcattttcttcctgatacttcaggaacagcctctaatcactgtggtttggctcgaaattctctccttcccgataggagctctgctatgccaataattaggcaaatgcatgttgaaaagagagaaaggaacatagcttcacatggtgatcgtgacctcagtgctgaccatcctgatccagaacttgacagatgtttgattagggccgataaggatcagaggaggcatgatgagaaggaaaagggcagtagagattatgatcatgatggtatatctcgcaagcggaaatctggtattagggctgaagactctggtgctgaaccattgcatgatactgatgaaaattttggcatgcaccctatctcatatgcttgtgaggataaaagttctttgaaaagtgctccagtgcttggttaccttgacaaagtgaaggagaaattaagaaatcctgaggattaccaggaatttttgaagtgcctaaatatctacagcaaggaaataattgcccgacatgagttgcaatcattgtccttttggcatgaaggacacggaccaaaaccagtgaaggtagaggacagggatcgagatcgtgatagggatgatgggatgaaagaaagggaccgcgaatgccgagaaagggacaaatccaatgcaattgctaacaaggatgttttggttcctaagacatctctgtacgccggcaaggataagtatgcagcgaaacctataagtgagcttgatctttcgaactgtgaacaatgcactcccagttactgtcttctaccgaaaaattacccaataccaccagctagccagagaacagaacttggtgcagaggtgttgaatgatcattgggtttctgttacttctggcagtgaggactattcctttaaacacatgcgcaaaaatcagtatgaggagagcttatttagatgtgaagatgacaggtttgaacttgatatgttgttagagtctgtaaatgtggcaactaagcgtgttgaagagctcttagaaaaggttaatgctaatataattaaaggagatagtccaattcgtattgaggagcacttaacagctctaaatcttaggtgcattgaacgattatatggtgatcatgggcttgatgtaatggatgtgctaaagaagaatgcatctttagctttgccagtcatattaacccgcttgaagcagaaacaggatgagtgggcaaggtgtcgttctgattttaataaagtttgggctgaaatatatgcaaagaactatcacaaatcacttgatcaccgtagtttctactttaagcagcaggatacaaaaagcttgagcactaaagtcttacttgcagaaataaaagaaattagtgagaagaaaagaaaagaagatgatgttcttcttgcaattgctgctggaaacagacagcctattattcctcacttggaatttgtgtatcctgattcggagattcatgaagatttgtatcaactcataaaatattcttgtggagaaatgtgtacaactgaacagttggataaagcaatgaagatttggacaacatttttagaacctatgcttggtgttccttctcgaccccaaggtccagtagatacagaagatgttgtcaaggctaataagaataattctgccaaaactggcactggaattgatgatggggatagtagtcctgcaacaaatcctaagaatttaaacactaatagaaatggggatgagaactttccatcagaacaatcaaattcctgcaaacaatggcaaacaagtggggataataaggttaaagaagataatcatcttgatttggaacgctcggcacataagaatgaaaccttgggaagtagtacacagcatggtaaagtgcatataaatgcatccacgactgatgaagtatcaagagccaataagcaagatcattccattgaacggttggtgaatgctaatgtctcattgaccttgggtatggagctaattagtagaagaacaaatgtggataatgcatcaggacttactgctactccatcaagacctggtaatatttctggtgagggaggacttggtttaccttcattagagggtgctgattctacaagaccagttacatccacaaatggggccatcaatgaggacactaaagttcacagatatcatgaagaagttggacacttcaaaagtgaaagagaagagggtgagttatcacctaatggtggagactttgaagaggataactgtgaagtttatggacatgctggtttggaggcagttcataaaggaaaagatggtaccatttgtcgacaataccaaaatagacatggggaagaagttcgtggtgaagctggaggagaaaatgatgctgatgacgaaggcgaagaaagtccccatagatcaatggaggacagtgaaaatgcttctgaaaatggtgatgtttctggtactgagtctgccgatggtgaggagtgttctcgagaacatgaggagaatggagatcatgaacatgataacaaggctgagagtgaaggtgaagcagaaggaatgactgatgccaatgatgttgaaggagatggtgcctcattgccatattcagagcgctttcttgtcactgtaaagcctctggcaaaacatgttcctccagtgttgcatgacaaacaaaggactgttcgagtcttttatggaaatgattccttttatgtgctgtttagacttcatcagacattgtatgagaggatccaatctgcaaaggttaactcatcatctgctgaaaagaagtggagggcttctaatgatacaggctctagtgatcaatatggcaggtttatggatgccctttacaatttactggatggttcttctgatagtacaaaatttgaggatgagtgtcgagctattattggaactcagtcatatgtcttattcacattagacaagctgatatataaacttgttaaacagcttcaggttgttgccaccgaagagatggataacaagctgcttcaactatatacatatgaaaattcaagaaaacctggaagattcgttgatttagtttatcacgaaaatgcccgtgttcttctccatgatgagaacatatatcgtattgaatgttctcctgcacctacccaattgtcgtctattcaactgatggactatggatatgataagcctgaaatgactgcagtgtcaatggaccctaatttttcagcctatctgcacaatgacttcctatctgttgtccctgacaaaaaggagaagtcgggaatttacctgaagaggaataagcgcaagtatgccattagtgatgaatattcaagccagaccttggatggactacaaattatcaatggtctagagtgtaagatagcttgcagttcatctaagatactgaagattttttacatcaaacaagaagaaaaaggagaaccttgtatcagagcagttcatgccatggacaggaaaagtccccaatcatttgttcaagcagagcacaacggtcctgcaaattattttcaatttgaagatggtattcattttgagcccgagatgttcgctagtggcagccaccaccactccctctcgtcacgcttcgaggactacagggagatttttgcttggatttttcggcactcgacaccaccagtgaggttttctttgactcccgaaatgttgcctgtgacaactccgaaatcttccacgacttcgacggcctcaacttttgactctcttacaatgacttgtttcgcagcagcatttccgaagaagacgatgatgaagaagaaaaagaagcctaatatgaatgaatgcagtcgtggtcttaatgtttgcacttttttaccgtttggttatgaatatttgattactgcatga

SEQ ID NO: 67493 - DNA, 462 bp, Glycine max
  Peptide Sequence Number=SeqID_159178
atgtcactgccagaccttatcacccacattatcattgaagataaaaataggaagaaaagtgctacaacaaggaccaaagcaatgtctgccaaggcaaacacgccaggacattttgctcctcagtgcatgtacaaagttgtgagaaatgacaatcctcctaagcctagggctaacctggttgaaggagatgacattattgtagcggtcatttctcaagtgaatgttgtcaccaatgtgaacaaatggttgaactactctggttcaaggaaaggggaaagttttctcaagcttgcatttgggaaaacactggctttgaatgatgtcttacatgttccctctatcagatttaacattgtttctgtagcattgttgggaaagggtctttttatactcaatgttcctgaagtgattaataagaatgtatcttcttctgcttacttgattgattcttatgatatatga

SEQ ID NO: 67494 - DNA, 2694 bp, Glycine max
  Peptide Sequence Number=SeqID_159179
atgaagaggtccagggatgattcttacacgagttcacaacccaaacggcccaaagggtcttctagagaggaagaaccctccgggcaatcacagatgacgactggtgatggtcagataccaaccaccaaagatgccttggcgtttctcaaggcagtagaggacgcgtttcaagataagagggaaaagtatgattactttatggtaatcatgaaggatttcaaggctcaaagaattgatacaataggtgtcatggaaagagtggaggagctgtttaaagggcacaaagatctaattttggggtttaacaccttcttgccaaagggatataaaattatacttccattggaggatgagcaacctccccaaaagaagctcattgaattgaaagaagaagccataaattttgtgggcaagattaaggctcgttttcatgacaatgaccgtgtttataagtcatttcaaaacatatgtatgtgcagaaaggaaaccaagtctatcactgagatttaccaggaggtttctgcacttttccagggccatgcagatcttcttgaggagtttaatcattttcttcctgatataccaggaactacctctactcagtacgcttctgttcaaaattctctccttcatgataggagctctgccatgccaacaattaggcaaatgcatgttgaaaagagagaaaggaacatagcttcacatggggatcatgacctcagtgctgaccatcctgatccagaacttgacagttgtttgatgatggctgataaggatcagaggaggcgtggtgcaaaggaaaatgactgtagaaaagggagagacagaagagaacaggaaagggatgatggggattatgatcatgatggtagtagggagcatttatctcacaaacggaaatctggttgcagggctgaagactctggtgctgaaagcatgcaccctatctcatatgcttgtgaggatataagttctttgaaaagtatgtgtagtccagtgtttggttaccttgaaaaagtcaaggagaaattacaaaatcctgaggttttccaggaatttttgaagtacctatatatctacagcatggaaataattaccagacaagaattgcaatcattggtgggcaatatactgggaaaatatgcagatcttatagagggatttgatgaattcttggatcaatgtgagaaaaatgagatcttttggcatgaaggacatggacctaaaccaatgaaagtagaggacagggatcaggatagggatgacaagatggaaaaaagggatcgcaaatgcctagaaagggtcaagtccaatgcaactgctaacaaggatgtttcagttcctaagatgtctctgtatgccagcaaggataagtatgcaatgaagcctataaatgagctggacctttctaactgtgaacaatgcactcctagttaccgtcttctaccaaaacaatacccaatactgccagctagcgacagaacagaacttgatgcagaggtattgaatgataactgggtttctgttacttctggcagtgaggactattcatttaagcacaggtacaaaaaccaatatgaggatagcatgtttagatgtgaagatgacaggtattctgctttccaattgatgaaagaaatttattttgtagtacaagctctaaatcttagatgcatcgaacaaatatatggtgatcatgggcttgatgtagtggatgcgctaaagaagaatgcacttttagctttgccagtcatattaacccgcttgaagcagaaacaggatgagtgggcaaggagccgtgctgattttaataaagtttggtctgaaacatatgcaaagtaccatcacaaatcacttgatcaatgtaatggtactgcaattgccaagggtcatggtggccatcatgttggatttaccataatgaatcctaagaatttcaacaacaatacaaatggaaatgagagtgttctattagaagaatcaaattcctgcaaacaacggcaaacaattggggataataaggttgaagaggataattctcttgattcagactgctctgcacataaaactgagactgaaacctttggaagtagtacacagcatggtcaaatgcatttaattgcaaccaatcttgatgaaatatcaagagccaaaaagcaagatcattcaattgatcggttggtgaatgctaatgtctcaatgtcctctggtatggagcaaagtaatagaagaacgaatgtgggtaatgcatcaggacttactgctactcctccatcaagacctggtaatgtttctaatgagggagggcttgatttaccttcattggaggagacattgtcacaatctgtctcgcaagaggaagttgctgatcatgaccacaatgatatccttggtagaaccttgaatgtccctaaacacttaggccgtgacaggggattgggatttgaagtgacacagaagattaatgtctcactccaacaaatgccactatctattacaaatgggcatgtgcaacaaatccagaagggcttggttgacctcaaaaagggaacgaacaagttggaaatggaagtgcaaatgcaaatgaataaggagccacaggaagaaggtctgggtggcctaagtggtataaatagttgcacacctacagctactcatataccagaggtaattattaaaccttataactactaa

SEQ ID NO: 67495 - DNA, 333 bp, Glycine max
  Peptide Sequence Number=SeqID_159180
atgactaaaatggatgccatacaatatatcaaggaagttcaatatacatttcgagacaagagggaaaagtttgacaagtttatggatgtcatgaaagattacaaacttcatagaattcgtgttggggttgttgtaacaaaaatggaggagattcttaaagaccatgaggatctgattttaggatttaacaagtttttgccaaaaggatatgaaatgctacttctacctaagggtgaaatccaatttgaggacgctgtgaaatatgtgaacaagattaaggtgacaaaattgttaaatttttggcatctcatacaatatgggacattggattga

SEQ ID NO: 67496 - DNA, 1623 bp, Glycine max
  Peptide Sequence Number=SeqID_159181
atgatacaggtcgcagaacttattgaaaatgatctcattttaattggtagcacagccattgaagacaagcttcaagagggagtaccagcttgcatagagactctgcaaagagctggtattaaaatttgggttcttacaggggacaagattgaaacagcgataaacatagcctatgcatgcaacttgataaacaatgagatgaagcaatttgttattagttcagaaactgatgaaattagagaagttgaagacaggggtgaccaagtagaaattgcacggtttattaaagaagtggtgaaaagagagctgaagaaatgcctcgaggaagcacagagctcttttcaatccctacgtggaccaaaattagcacttgtaattgatggaaaatgtctgatgtatgcgttggatccaagtttaagagtgatgctgctgaatctcagtttgaattgtcacgctgtagtttgctgccgagtttctcctttacagaaagcacaggtcacgagtatggtcaagaaaggtgcacaaaaaataacacttagtattggtgatggagccaatgatgttagcatgattcaagctgctcatgttggggttggcataagtgggatggagggaatgcaagctgtgatggccagcgattttgccattgcacagttccgttaccttgcagatttgcttcttgttcatggccgatggtcatatttgcgaatatgcaaggttgtgatatacttcttttacaagaatctcactttcactcttacccagttttggtttacatttcaaactgggttttctggtcagagattctatgatgattggtttcaatcattatataatgttatcttcacagcgctgcctgtaatcattgttggattatttgacaaggatgtcagttcatctctatccaagaagtatcctcaactatacatggaaggaattagaaatgttttcttcaaatggaaagttgtggccatatgggcattcttttctgtataccagtctctaatatttttctattttgtgagttcaacaaatttaagtgctaaaaactcagcaggcaagatatttggactctgggatgtcagtacaatggccttcacttgtgttgtaataactgtcaacttgcgactgcttatgatatgtaattcgatcactagatggcattatattagtgttggtggaaggattagcactccttatgatcgtcaggagaatatttattttgtcatatatgtcttgatgagtacattctacttctacgtcatgctatttcttgttcctgttgctgcacttttctgcgactttgtttaccaaggggttcaaagatggttcttcccctatgattatcagattattcaagaaatgcatagagatgaggtagatagcactggtagagcacagctgctggagatagggaaccagcttacaccagatgaggcaaggagttatgctatatctcaactcccacgcgaattgtcgaagcacaccggatttgcttttgattcacctggatacgaatccttctttgccgcacagctcggtgtatatgctccacccaaggcatgggatgtggcaagaagagctagcatgagatcacggtcaaagactgggcagcaaaaataa

SEQ ID NO: 67497 - DNA, 792 bp, Glycine max
  Peptide Sequence Number=SeqID_159182
atgtcggggatggcgagactaacaaactggtataaacttcaaaacgctgcgtttcactcccccgtcctcgcgttgcttcgaaaccctaaccctatccacggcattcctccgctcgccgtcgacgccgtcaccgtcgcgccaactgccgcaaaccgaataaaccgaatcgatctgagagaagaagaagaagaagacgcgatctcggagatcgagcagctgatggagtgcaagcctctgtcggagtcggaggtgaaggcgctgtgtgatcaagcgagggcgattctcgtggaggaatggaacgtgcaaccggtgaagtgccccgtcaccgtctgcggcgatattcacggccagttttacgatctcatcgagctgtttcggattggagggaacgcacccgataccaattatctcttcatgggtgattatgttccacatgaaggaccaatgtgtgatctcttgtggtctgaccctgatgatcgctgtggatggggaatatctccacgtggtgcaggatacacatttggacaggatatagctgctcagtttaatcataccaatggtctctccctgatatcgagagctcatcagcttgttatggaaggattcaattggtgccaggacaaaaatgtggtgactgtatttagtgcaccaaattactgttaccgatgtgggaatatggctgctatactagaaataggagagaatatggatcagaatttccttcagtttgatccagcgcccaggcaaattgagcctgacaccacacgcaagactccagattattttttataa

SEQ ID NO: 67498 - DNA, 924 bp, Glycine max
  Peptide Sequence Number=SeqID_159183
atggatccgggcgcgatgatgaacgagggttccttcgcgaacaatgcgagcggtaatacggcgccgtttagcttggcggagatctggcagcagttcccgccggcgattagtggcggcggtggattggggctcagaagcccgcagttcggtcacgggccaggagggcagtttggggatttcaccaccgggccgagccacggactcggacccagtaacagcagaaagcggcgcgactccgaggaggacgattccgctaagggcgtgtccaccagcaatgccgtgaatgagggtgatggaaaacgtgttaaagggaataggaacgagggtggtggtgatggtggtaataataaaggtgaaggtgaagtcagttcaggaaagcctgcggagcaaagcgctaagccagcttcggagcctccgaagcaagactacattcacgttcgagccagaaggggtcaagccactgatagtcacagtcttgcagaacgagctcgaagggaaaagattagtgaaaggatgaaaattcttcaggatttggtccctggttgtaataaggttattgggaaagcattggtccttgatgagataattaattatattcaatctcttcagcgccaagttgagtttttgtcaatgaagcttgaagcagtgaattcaagacttaactctggtattgaagcgtttcctcctaaagattttggtcagcaagcatttgatcctgctggcataccattcggttcgcaagctccaagagagtatagcagaggttcttcaccagactggttacatatgcagataggagtagcacccagaaaacatcaatggtatactcagggaagcaagtacaatgggcacctcattcccattttctacactaggcatggagctgtcactgtttttcacaggactgcttcagtttctatttaa

SEQ ID NO: 67499 - DNA, 484 bp, Glycine max
  Peptide Sequence Number=SeqID_159184
tgcttcaggatgtgaaagaaattggagtgtgtttgagcaaattcattccaaaaaaagaaataggcttgagcacaagaggttgcatgatttggtgtttgtcaaatacaaccaacaattgaagcaaagatataatgcaagagatgaaattgatccaatttctcttaatgatattgatgtatgcaatgaatggcttgtgggagagatggatcaagatgatgataatgatgctagaaatgatttggcttcgggggttggagagtgtaggatgtatactaggcggaaaaagcaaaaaacaagaagcaaaaaagaagtccaagacaatgatgaggatctagatgttgaggagaatattgatgttgaatttgaagaagaagaaatcatggtcaattttgaggcgtctgatggggaagagggagagggagatgctccattaccatatgataacaacgaagatgattatgttgggattggagaagatgattag

SEQ ID NO: 67500 - DNA, 282 bp, Glycine max
  Peptide Sequence Number=SeqID_159185
atggcgaagagtgatgagttgaagctaatgggtaaatggtcgagtccttatgcgatgagggtgaagattgccctcaacatcaaatcccttgaacatgaacactttgaagaaaccatgataagtgtcatagagcaaaggtatgagaggaaacttctggttgaagcaaaggctcctgctttggtgaaatgggctgagagatttgttgttgaccctactgtgaaggggcttatacctgagactgataagcttgttgagatttccaagtctcttcagatcaaatga

SEQ ID NO: 67501 - DNA, 684 bp, Glycine max
  Peptide Sequence Number=SeqID_159186
atggcatcatcatcatcctcaagtaatcttgaagaaaggcacgaggtgttccttagtttcagaggtgaggacacaagaaagactttcacgagccatctacatgctgctttcaaaaggatggaaattaatacctacatagactacaaccttgagcgaggggatgaaatatcagggactcttcttagggccatcgaagatgcaaagctctctgtgattgtcttctccaaaaactttggaacatccaagtggtgtttggatgaggtcaagaaaataatggaatgtaagaaaacaaggagacaaatggtagtgcctgtgttttatgacattgagcctacccatgtacgaaatcaaacgggaagctttgcaagtgcatttgctagacatgaggagcgatttatggataggccaaacaaggtgcaaaaatggaaggatgctctccgagaagcaaccaatctctctgggtgggattgctccgttgataggtggcattgtggcttggaggttgtggatatatgggcgactaaggttggtggtggtgatgtatgcagtgtggtttggatgatgcctggggtcgtcaacgctatgatgattgggtgcaaagtggttgatggtggtgatggtgataatgatacggggaagactaggggagaagaggagaaggaagaagaagcttgcattttgtga

SEQ ID NO: 67502 - DNA, 244 bp, Glycine max
  Peptide Sequence Number=SeqID_159187
atgtccgaagaagttgatatggattttcaaaatgaagaagaagattgtggtgtgaatgaagcacatgttgattgttcagatgcttttaatacttctcaggtctttgaaacccgagaagatgttttgaagtgggctcgaacggttgcccatgaaaatggttttgttgcagtaattatgaggtctgatacatatactggcagcagaggaagaacttcatttgtcttaattggatgtgaaaggagcg

SEQ ID NO: 67503 - DNA, 1043 bp, Glycine max
  Peptide Sequence Number=SeqID_159188
acactgaagagctattccctgttgcaagctcaacgagattttttaccgatatgcattatattctaaaagttatgtctattgggaatgttcgcacttcatgctaccacaggctacgatttcttgaggaaaaattccgccttcatctgttactaaatgcagatagggagtttctggctcagaagggtgcaccccaccgagatttttacaatatcagaaaagttgatactcatattcatcattccgcttgcatgaatcagaagcatcttgtgcgcttcatcaagtccaaattaagaaaagaatctgatgaggttgttatctttagagatggaaaatatatgacccttaaggaggtttttgagagtttggatttgactggtcataatagcttaaagccaccaaaatttacaggaaggtttctggctgaagtaacaaaggaagttttgacagatcttgaagcaagcaaatatcaggtggtgggatttgatcttgtagatgatgaaagtaaaccagaaaggcgtccaactaagcacatgcctactccagctgagtggacaaatgaatttaatccagcatactcttattacctttattactgctatgcaaacttgtatacactcaacaagctgcgtgaatctaaaggaatgaccacaataaagttgcggcctcattgtggagaggcaggtgatagtgatcatttggctgctgccttcctcctatgccataacatttctcatgggattaatttgcgtaaaactccagttttgcagtacttgtattatcttgcacaggtcggattagctatgtcaccacttagcaacaattcccttttcttggactataaacgcaatccattaccaatgtttttccagcgaggtctaaatgtctctctctctactgatgatcctttgcaaattcatttgacaaaagagccactgctcgaagaatatagtgttgcagcaaaggtatggaagctctctgcctgcgacctatgtgagatagctagaaattctgtgtaccaatctggattttcacaccaagcaaag

SEQ ID NO: 67504 - DNA, 381 bp, Glycine max
  Peptide Sequence Number=SeqID_159189
atgactagagaagctcaactggtgaaccttttggagcaacctatgcaagtagagcatgtcaagcatgttgaccaagtccaggatgaaaatgttaacccagtacaagtaacaccaacaatctcaagcaaagaaagggtgttccagaacggtcttttggcttccgaaaaaggcttatggaaaacccactccaaaagaaataagtgcactttggaacaggcttttcggaatgatcttttggcttatggaaaaggtggtttggaaagaccttttcagaagcaacaagagaggcacttctgcgctagaagttttggcattgagagttggaagaatactttagttggagaagaagagaagaactcaaaagtggatgcattacaataa

SEQ ID NO: 67505 - DNA, 963 bp, Glycine max
  Peptide Sequence Number=SeqID_159190
atggctggtgagaagctgcatgagggttcaagcatgacacttttgctccaaaaagaaaggcttacatgctcccctgaacttattcgatctttttgggttcaaaactctgaatcttcttttcaaggttcaaaatccttggctaatgttgtgaatgtcacgcaaaggcccttctttcaagggcttgagaaagaagagaacggtgaggatgaggactttggggtgtgcctaaatcaacccggtaagaaaaggaggctcacaagcaaacaagtgcagttccttgaaagtaacttcgaggttgaaaacaagcttgaacccgaaaggaaggtccaacttgccaaagaacttggcatgcaaccaaggcaagttgccatatggttccaaaaccgtagggcaaggttcaagacaaaacagcttgagaaagactatggtgtgttgaaagctagctatgacgtactcaaaagggactatgacaatctccttcaggagagtgataagttaaaggaagaggttaattctctcaagaccagattgattcccagagagcaagaggaacagaatttggatgatacttcctgtgatgctgtcaactcacagcataaagagcagaaagatttaatcacaaacacagtttcagaaaatggatcaaaagtgccacttcctgttacggtaacaagcaaacaggaagatgctaattcagctaaaagtgatgttcttgattcggatagtccacatttcactgatggaaaccaattctcacttatggagcctgcagattcctcccatgccgtcgaaccagaccactctgctttctcgcaagacgaagaagacatcctcagccaaaacatcttgaccatgccgttcttaccaaaggttgaagatgtctgctatgatgaaccacatgaagattcttgcagctttcggttcccagttgaagatcaaaccttctgtttttggtcttattga

SEQ ID NO: 67506 - DNA, 168 bp, Glycine max
  Peptide Sequence Number=SeqID_159191
atggtgatgataattgatgatgataatgatggcgacatcatggtggtggctacaacggtgatcatggtgataacaatgataacgaaaaaggtggtggcgattgatgacgatgtggttgcaatggtggtcatggtggtggcaacaaccgtcgtgatggtgatagattaa

SEQ ID NO: 67507 - DNA, 81 bp, Glycine max
  Peptide Sequence Number=SeqID_159192
atgcaactgctaactgctagcagaggattagcagtagcagttgctaatttacaggactactacaatggttcttcctattaa

SEQ ID NO: 67508 - DNA, 437 bp, Glycine max
  Peptide Sequence Number=SeqID_159193
gctccggacttgatgatggagggtgcatgaacaacgttaggcaatcaattcatggggctccggactcgatggcaaccaattcatggggctctggacttgatggtggaggatgcatgaacatcgctaggcaatcaattcatggggctccggacttgatggcctctgccaatccttcggagttcaggtcacctccaacggagtcgccaactatcacaacctacccttttgcgggcgagcgaggcgaggttcatgggtgcgtcttccatgggaggaaaatgcgcggagtcgccaccaacgtcgacaaaagcggggcttttgctcctacgtatcctccatcgaagaggaaatcagacctacgtagttctttcaaaaggggcgaatcaagtgattctttttacttggaaggtggtcatttaaggcgttggaccttaaaatga

SEQ ID NO: 67509 - DNA, 663 bp, Glycine max
  Peptide Sequence Number=SeqID_159194
atgttatttgggtatttaggtattggtgactgttgtttgttaagcgtcggtgtggcaaccacaagttctcctgtgatgtctctttctttagctccatcggttcccccctcggccatgttggtgtcggcgttgccttccacctcgtctcacccaacatttctttggatcacatatacactttctgcaatgttgattcgctgttggagaaatttggcgattttgaaggagaataggaaaagagtagagtgtcctaaggtggccaacaccattgtcaccattgctaaggctctgaggtcgaaccatcaattgttctccaaggttggcggtgttcttaccaagctgttgctcaccaggttagatgttgatgagttgctcgagcagtgcaagggcttgtggagggagaagaatgaattggctgacaaggtggagagcactatgacagagaaggacgagcttgccaaggtggtggcggacctcgaggctcggttgaaggagtcaaagtccaaactggaggagtctgagcttagggcgtccaaggaaagagtggccaacaaagaacttgaagaggagctactgatgtacaaaaagaaggttatggagcagcttgaaaaaggatttcataaggctgttaggaagcaagaccttggcggtgtaggaagctag

SEQ ID NO: 67510 - DNA, 504 bp, Glycine max
  Peptide Sequence Number=SeqID_159195
atggagtgtaatgctacctctaggttgagattttggatttggacaataatgcgtccaaacctgtccatgaattttcggagagattcatcatctgcttgtcgcagactggccagagcaaccgatgtcatacgatgtgaccggttggttggatattgcgaattgaaatgcttgacgagagtgttgaagctatcgatggaccttggagggagtccaccataccaagttaatgcttcccctttgagggacgttgggaagaccgaacacaagattatgtcatcattggtgtatagattcgcctgggaaatgtgtgagcggagtgctcatcgccttgggggcgtctggcacaagcctccagctaatcatggtcagcctttagctttccaaactcctcctcatggtgtcgctccatctctgcaatgcagttttggagttgttggaaagtatcagtatctgtcatggttgttggggaaggattggagccttcaaaaggggtctcgcgtctaa

SEQ ID NO: 67511 - DNA, 744 bp, Glycine max
  Peptide Sequence Number=SeqID_159196
atgacaagaaaaagaaaggaattgcacttaaagcctcatcttctattcaagaagaaagtgacagaagacttaaatgaaataaaagaagatgatgattttagtttctttgtaaagagattcaataagttgctaaggaacaaagtaaatcaaagaagaacaaatttcaatccaaagaaaaaaggagaagactctccttctattccaaagtgctatgaatgtaataaacctggacatctaagagttgattgccccagtttcaagaaaagaatggagaagtctgacaagaaaaatttcaaagacaagaaaacaaagaaagcttacattacttgggaagatagcgatatagattcatcaggagattcaaaaaatgaagtcgtgaatctgagtctcatggccaaaaactatgatagtgaagaagagggtttcttgaagaaaagttggtacattgatagcagatgctctaaacacatgacgagagatgcatcaaaatttactcatataccttccaagaaaagtggacatgtgacttatggagacaacaacaaagattttttagaagatatgcgcattcataaggaagggcacaacgacaaaggaaatggaaataatgaagactctcaaattgatgaaactaaaacaagtacatatacagatcttccaaaagagtggagaacttcaaaacatcatgctcttgataatatcatcgttgacaacttgacactctctcaaagatgcatgcaataa

SEQ ID NO: 67512 - DNA, 165 bp, Glycine max
  Peptide Sequence Number=SeqID_159197
atgagtatggattgtatgggtgaaaagaaggtagggggcacgggaagagggaggggagtgggaaaggtgagctcggtgaaggtgaaggggccggtgatcattgttgcggtggttggttcgtcggcggcggcatacgaggcacgcatttgtgttgggtgtgcgtga

SEQ ID NO: 67513 - DNA, 324 bp, Glycine max
  Peptide Sequence Number=SeqID_159198
atgacctctactcatgatgtcctgctatattataacgggaggtggaacatgtcacgccaacatgagttagttggttactcgttcacaagaaaaaatcccaaaaagtttgacattccttccagatgtaccatggatgaactgaaggatttgatcaagcaagttgcgcctcatgggattcccccttatggtattcatgaaacacaaacgggtaatacggatcaagttgatccgcaagaaccatacgtatgcttctcatggatcaagttgatccgtaggacgcatacagatcaagttgatttgtatgtctcttacggattaagttga

SEQ ID NO: 67514 - DNA, 1272 bp, Glycine max
  Peptide Sequence Number=SeqID_159199
atgtcaaagaatttaaaggctccggatgaaagctctcagttttcaaaggtgcaatctccaaactcagcaaaatcaagtatttcctctaagagtcctgacagaacaaagattgcttcaattgacgatcagtatgcaattatggtgtcttgtcgatgcaattatacagcatcaagattattctttaagcaagcaaccagttggcgaccacgttcatcgagggatattataatctctgttgcatctgagatgtcaggagagtctcctggaccttatgaaagaaattctcaacttcctgtgcaggttttaactcttcaagcttcaaatttgacatctgaagatctaactttgacagtgcttgctccagcctcatttacttcacccccttcagtggtctctctgagttcacccattagtccaatgagtccttttattggtttcaaagagtttttaggaaggataagtgttgaaagacatgttggtgccacccagggggggagctttacttctcttataaaagacaatgagaaacaaaatgatgatgtccgacctcagtcagtttcagtgaatgatgatgtcatttctagttctggcctaagttgtacacatctttggctgcagagtagagttccactcggatgtattccatctcaatccacagccaccattaagcttgagctacttccattgaccgatggcataattacacttgactctttgcaaattgatgtcatggaaaaaggtgcaaagcatgtgttctcacaagcattattgttaagaagtttggtttattttgtgcattccgttatcaaaaacagtttccctgctctgcaaatattgataatcaagatgcaaaatgccaactatgatattgctcagtgcagtagagaagcaaatatggacgatttgtttacttggatatcgaattgttcttccaacatacacttaatggcacaaagatgtatccgactcttcagagtgaaagcaatgaatcgcctcgcgattcatagcattaggcagctgcaattcagtgagtttcaattgatcatcagtggaggaagccttcaacaacaaaacagaatgaagaaggagcaacagagcaaaacaaggaagaagaaaagagtacaaaaaaggaaactcacaggccccgataccttgatgattatgtggctagatgaagttgagctggcagctggcagcagggtagtgctcctaggatcttcttgtcgactgagtggcacaatttcgttaggattatattccttttctttgtaa

SEQ ID NO: 67515 - DNA, 804 bp, Glycine max
  Peptide Sequence Number=SeqID_159200
atgcccacccctgatgcatttgtctccacgacaaagggtaaggagaagtccggtaaccccaagaccggggagcggtcagcgtggcgtacccttttatgtaacagcggtaaaatcctgagaggcccaacaagccacgaagggctcgaacagactgcagagtgggccaatgttggattgcttctactttggtcgacacaggttctacacctcgcttcgaaacgatgtggcccaagtattccacttgctggatggcaaatgagcattttgaaagtggatagagtgattcgtgtctcgcgaaggtgggagggttgtcagagattggaagagaaaggaaaattggttaatcaaggaggtgatgttggggtgggtgttttggggaggtgtaactggggagaagaccctgatgtggaaatattagctagcaccgtgagtttgaagcattcgccgaagttgcgggggagtgatgccatcatgggatttaagtcattgaaccccgagaacaatgtcggcgccgcacaggggaagcacatgaaggtccaccgtgaacactcgtccatgcacatacaacgcaacgttgaggcagacctggcaacattcaagctcattgccatttctgacaagcaccctcaaggtcggagaggactgagcttggagacccaaggatttgaccacgcgtttttgcataaaattgtgcatactgccttcgtcgaccaagatcaccaccagttgatgagaaatccggccacgtttaatgatgggttatttggtgggtcgggtcggtgcgggttatctggaagtgggtag

SEQ ID NO: 67516 - DNA, 209 bp, Glycine max
  Peptide Sequence Number=SeqID_159201
tctcttacattgagattattgcgttgcacactgtttttggtcggctagttgttgaaaccgctgtggggtttggacaaaaggatctgtctcgtgaagtctggccaaagggggctgctgtagtggaacagtttagtgaagcggctgtagcagacaaaaatagcgggctgaataccggccgtagcagatgctatagcagcgccatgtgttga

SEQ ID NO: 67517 - DNA, 432 bp, Glycine max
  Peptide Sequence Number=SeqID_159202
atggaggagaatgtaggaagtgagagggacgaagagggttgggagagatttgggggtgagtttgtgtttttggctaagctgaagaaggaactagagaagggggagaaggatgaaggaatgattagggaggattgtcactgtccaaaagaggaactacaatcaacagtagctatcaaagaagtctttggcaaacatgatgatgggcttgaacctggtttccactgtgtgccatggttcttttgcactcaagtagccggttacctttctttgcgtgtgcaacagctagatgttcgctgcgaaaccaagacaaaggagatcggtgcgtcctcaaaatccaattcggtttttgttccacatggaccaggtgctgtgagagatattgcttcacaatttagagatagtcttcttcaaggaaaggtggctcagtcatga

SEQ ID NO: 67518 - DNA, 303 bp, Glycine max
  Peptide Sequence Number=SeqID_159203
ggtatccgtgtttgtggcaaaagcttcaaactttggagtgtgaaacttgtgtggtttgcaagaggcaaagctatagttacagttattgttgttgttggagttgaagagggtgagagtggaagcggaagtgagagagaatggctttggcctggaacggtgaatggaaagttctctttctcttgtgaagtagtggttgaagcagaagagaggggtggtggtagtggtggagatactcatgcaaagcaagggactagtagcacatcaccgaatgaacacctcgatcaactgaaaaactggatttga

SEQ ID NO: 67519 - DNA, 540 bp, Glycine max
  Peptide Sequence Number=SeqID_159204
atgagaacgatgcacgactttggctccaaagaagacgcctccctttgtctgggagccatacacaacaactgtgatggcagcgttgcctctaattgtgtggttggaagtgtagtctggttcgcagtggtgccactgatttgtttccatgttgaatggcaccaacccgatagagttttacggcaatttggattgcaacaacctatttccgggtgttcttcgcaaccgcagaatctccatggcataacgctcaaaggcaaacaagatgaaaattggcataaaacaaatatgtttgtcgacccaaacaatgcaaacacaattacattgggtgaagttgtggagactttacagtatatggtgtcaccacaagggaggaacacttggacaattgatgatctcgtgccttacgtggaaaagttagcgattatatgcaaagagcaagagagaatcactgagtcagtgtcacatggtccagcatcagagcgtgaattcacagcacaagagtttcacattcttcagtcaagtgttgaaactcgagcatag

SEQ ID NO: 67520 - DNA, 522 bp, Glycine max
  Peptide Sequence Number=SeqID_159205
atgaagacctctccgaaatcgcacacggtggtcaatgtctcagcatatcagtgttacagttgtggattctgtaagcatctcacagaaacatgtatgcgagtggggaattctgatatctatggattcctcgagccacagtccattcagagatctgggcaatcgcaatttgagtctgaaagttacataaagagttggatgcaaagttcacaatgcgatgtctatcttggagcctacctaaatgggttccactgcagaggacactggcagatggtggtcatcctgcccaaggacctagttgtctggttttgttcattgcataacaggccagacaactaccttaagggaattattaatagtgctatcaaaggacttgatgatgctccacagcctaaatcaaaggcttctgctaggtggattgtcgtcaagtgtaatagacaaaaaggaagtactgagtgcggctactatgtgatgcactggatgtccaccatcattttaggaacttttaggaataattgggaaacg

SEQ ID NO: 67521 - DNA, 333 bp, Glycine max
  Peptide Sequence Number=SeqID_159206
atgatggttaacctctcaatgcttccacccatcttctctcaggagtatttgattgaggatccattaactccactattccatacggcttcactctttgatgctttttgtcatggtaggccttcaccttctgcttgtacaacttggatgaatcataagcattcagccgcatttcctccagctccaagagctacagcttcctcttctcacccgataaaacttcatcaaaattcagaaactttaaagcccaatatgccttatgttccatctctactggcaagtggcaggctttgccatagaccatttgaaatggggacagtcctatgggagttttga

SEQ ID NO: 67522 - DNA, 285 bp, Glycine max
  Peptide Sequence Number=SeqID_159207
atgcagggttcaaggtctggcacagttgctacttgcggtgctgttagggttcatgaagaaccttttcctgctcgtgcaagcctcggtgctagaagggctggtcgatttctgcgagcgcagcagagagtcgagagacatcatgttcttgttggtgcaaatgcaagcttaggtgttgttgttggtcgtgcgtttgacttgaccacgttgagtgactattacgatctcacgtatgaacttgagaaattgcttgagatcagaggagagctgcgctcacaagacaaatgg

SEQ ID NO: 67523 - DNA, 330 bp, Glycine max
  Peptide Sequence Number=SeqID_159208
atggaagtatggatattgatggatgaatgcgaagaaggagagatggggactgcggcggaacttgtggaggcgcacaatgagggtgtccttgtcgttgagctcagtggggcgatgcggcatcacacaatgagagcaaatgtagtcatgggaaaaggagacggaagcaaagcattttgttttgttaacaaaaaagaatatgagggtgtcagagaagatagggtaggtgagggtgtccgagaagataggttaaatgttgacggtttaaaaggagggtgttttcgagacgacgtcgcccagggtattgtcaagggttgtcatagtttgcaatag

SEQ ID NO: 67524 - DNA, 369 bp, Glycine max
  Peptide Sequence Number=SeqID_159209
atggacaaagatacattgaggtatagtgggcagaaaggtttgaagaacctagggaacctagcgagtggtgactatctgacatttagtgcactcatttgggcttatccttacaaccaacaacttttaggtactgatgctaaggacactaagccatttgcagacttagcatttcttgtagagagagtcaacatggtcgtgcacaataatgcagattacgtgatacacctgtcatactcgagtctaccttgtgctagtagaaactccaaattgagtgctcgttaccatagaccaccattaacctgctatgtcccatggagatttacatctcactcagttgttatgaggactttcatgcgtatcttggactag

SEQ ID NO: 67525 - DNA, 255 bp, Glycine max
  Peptide Sequence Number=SeqID_159210
atgtctccatcagttgaggagattgtaatcaatggtgcttatgttgttgttgaggagaagaagaagatgagaaagagaagcaacgtgggagtggaactctattgccattgctttgacatcttactctttcttcttctcagtttgatgcacagttgccaatgtttagcggaatggagaaagaagaaagatgatatgagatgtcacttcaaggagaagatgagtcaagaacaaacttaccaccataggaagtcatag

SEQ ID NO: 67526 - DNA, 1101 bp, Glycine max
  Peptide Sequence Number=SeqID_159211
atgacgcaaataaaggataaggagattaggggaaggaacaatgggatcatcggtgactatcacaagtggttgaaggctcagacgcaagagctagattggctcccaaagctaaaaacctcaagtgaggaagaggctgaaacccttgaggagagtgaggaggcgcacgcctgtaaaggggctttgtgggaaaacaatagtgagcttaagcttcggagggccgggagaaaccagtcgagagtcgaaggcatgatatttgaagacaagttgaagacttgccaaagggaagcaagagagagagtgatcgattcattacacaaagaagcaatgatgtggatggataaatttgctttccccttgaatgggagtcaagagcttccaagactactagccaaagccaaggcaatggcagacatgtactcggctcccaaggatgtagtaaacaccataactaaacacgctttaaggcacccttatcgaatccgttccaaaactagagtcatgggtgacatagaagaggtgcaagaacaaatgaaggccgatatagaggccttgaaggatcaagtggcttccataatggaagccatgttaagcatgaagagaatgatggaaagcaacatgaccgcagttgccgccgctagcatcgccattgaggtgaatcctacccatccctctgccataaaccaagcaaaccaacccgccccggacatggtgggacaaggaggaaaggtgttgggcagtaccggtggtccacacttggggtataataggaatgcttacccctacaacttaccccccaattatacgccgcccaccacgcacatgcctaacaagaacgttaattctgccgttcccgttacctttgagggtcaacaaccccaacctgtaggaggcacccgtgaagaacctcgggagcgtgctcaaggggacttcgacccatatcccactttcaccgttgaaggaccggcatttaatgctatgcctcaacccaataccgcgggagctcctcaaccccgccctctgcagccgctgcatttctcagtagagggccacctccggcagtggaagggagagggaaacttgatctcatcgaagagagattaa

SEQ ID NO: 67527 - DNA, 2076 bp, Glycine max
  Peptide Sequence Number=SeqID_159212
atgacggggaagtctgacttgttgtcgatccgcgttccctacaagaatctccaccacgattcctccgcccccgaactcgaactcgtcgacgtcaaccaccgcaacttgccaccatcaccgccaccgccaaatcactctccctcgccgccgaacaacaacaacatcaacgctccgttgcttcatctcgttctcagttgcaccgtcgccgccggcgtccaattcggctgggccttgcagctctctctcttgacgccctacattcaggtccctctccctctccctctccctctccaaccgaataattttgaggtttcgtcgttgaccagatccttccctaatcggaaccggatcctctatgacgttgggaataggacatgcgttttcttcgtttatttggctctgtggccccattacaggtcttgtggtttatgctttgttcttgttggtttggaactagaaaatcacgtatgtgtctcaatttttcataaggttcaaccatgcgttggtatttggagtgataaatgtacttcaaggtttggcagaagacggccgttcattctggcaggatctcttatgatatgtctggctgtgatattaatcggattttctgctgacattggatatgtattaggtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaaaatacgctggcattgtctttgggtttggctttggctttgtttatgtgttttactgttgttctttctatgtttgccgctgattattatttcaccctttctcacctatgcagatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctag

SEQ ID NO: 67528 - DNA, 222 bp, Glycine max
  Peptide Sequence Number=SeqID_159213
atgggggcatcttgggttggaaaagtgccatctccctcatctatgacctccataggtgtggcagcaggagtgtcctcaggcgtctcctctagtgttgcctcttgcttcggctatggctcctgggctgtaggagcctcacctccccccgtagaagaaggctggactcctggccaggccacctgggccataaagtcctccatgctgatgatgggccgatgctga

SEQ ID NO: 67529 - DNA, 564 bp, Glycine max
  Peptide Sequence Number=SeqID_159214
atggcaagggacaacaaactacaatctttagatgtttgtgacctaaaactaaaactcataagtgataggcaatcttatggaagattatataacttgccaaatactactgaagctgatgctttgattgttggtgacaagcatatagttgatggctacactatgattgagtctcaaaaactcaactatgttagacaacatcaacaggaactcagagttgacaagtacatgaatttgaatgcatgcaataatgatcccgaaacacatggcaatgagaaaggaaagagaattataccgccgagctcctttgttggttgtcgtaggtatatggaacaactatattttgatggtatggaaatttgtggccatattggatttccagacctgttcttgacattaacatgtaatccagcatggcaaaaaattcaacgaaaagttaggaaatgcaatctaagacatgatgattgccctgatgttgtctcacgaatatccaaaatgaagctcagtcatttgatgaatgatctcaaaagtggacatgcctttggtcccattgttggatgtaagtaa

SEQ ID NO: 67530 - DNA, 1053 bp, Glycine max
  Peptide Sequence Number=SeqID_159215
atgtttcgcaaggaaaacatgatctctgaattgcataccaagaaaggaacttggaagatagcagtacaaatcactgatatgtggcacgttaacaagcacaatggtaaacaagcaatagaaatggtgttcatggaccaaataggtgcaaagattggtgtcactctttggcaagaactgtttcctgaatttgaggtaaagttgaattgtggttctacacatgtgattcagaacattaaggttgttgaaaatcattctgaatacaaagtgagtaggattccatttttggtttacttggtgaaaactacttctgtgagggaggtcgaacgtcctgagattcctactaatgtccatgttattactccatttgctaatattattgatggagtagtaccacgtgacactttagttgatgttgttggtgttgtggtcgaagtcattgagcgtaaaacagttaatcctacatatagagttacaatcaagttgagggataacaattatagtgatagggatatgatcttgacttgctgggaggaatatgctcttccacttgatgatgctatagagaaaaatcattttgataggaagccattggtggttatgttaacacttgctaagatcaaagatcctaaaggtataccattctatgctcgcagactatcagatcaaggaagtgtttctcaatcacaatatagtcaatattcccaacgaagctctatggacaagttcttgcataatgctcaaatggtgatgttaggtgaaataagcaggctgagacaaaatggggagaaggccaacttccatttctgggatggaacatgtatcaaaatctttggcaaaactgtcgatcagtgtcgccaagaattgattgtaagtggtgatgacatcaaggttttccctccttgtgttgatgaattattgggaaagacttgggctgtcaggttcaagtaccgtgtacaaatgcatcaatcatctgtgttggatgttactgaagatgaagatcttattcagacaatgacatcaacaattgctctgcaggggctaaacattttatga

SEQ ID NO: 67531 - DNA, 276 bp, Glycine max
  Peptide Sequence Number=SeqID_159216
atgggttgtttgggttgcaaacctatccgaaatgggtattccaaaattccatccacaaatttcagaataggcattctggaaggcactgaacattctggaacattggagcatgttcaacctgtggtggttgatgagcctatggtgattgatgagcttgtggagcttgttaagcctttgaagcaacaggacccaaaagccactgatgtctttcctggtgggcttgaggacacatcattgttaacctcatatgtcgatcacatggctcgaagcttatag

SEQ ID NO: 67532 - DNA, 1662 bp, Glycine max
  Peptide Sequence Number=SeqID_159217
atgacgttggtgagccaggtggaatacctaacttctctgatgaagttggtcatgaagagcttgcccacttcttctctaactgctttgtgtcattcttgtcccatcttcctcttattctgtgataatgacattagctatgcatctgtgctcaaggatggtgaggtccgtgttgagctgtatacactggccaaacactttgtccatgctcatgacttgagtggtaccatccactatggggtgaggtttcgcaggctccctggtgggaggataagtggggaacttaatcttcaaatgcagtatggatatgatggctccgagcttgttgagtgttttcctgccaatcaaagaaaagtaaaagagttggccttgaccgaaggtggccataaggttgacataacctctggtctatactcattttcttgtgaagccaaggagtggactggcatgagactggatgtgaaagtgataggaagtagacttcgtggtgatggagaatccacccgcaatggtgttgattgcacttttgatttgtcgggtgatgttcttaccaaaattcggagccatggcacgtcaaggtggacctggctaagtagggtccgaacttcacacatcaggtgggctcctgttcttgtggaggttgtcgatcgtgtctcaactagagatgtcttttccttcctcagtcttccactttgtctcttcttttgtccacgtcatgattcctatgttgatcctcttggtgtcctccgactcttgcttctgcctagtggttgtccagcctctaagcaaactaggctaggtacccagccttatttggtcacatctaaccctagcctgggaggacatggtggaggtatcttgataggggtgtgtaacgctcgtacttgggcccttttgggagaagatggcgcttgttcggcttgtgcctcttgtctgacttgtgtgattcagtcttgtacgagtgttgagctaacaacttcttcagctactaagaaatatagaagtaggggtactcctggcctgggtcggctcaaaattggcggtgtggctatggtcttcttgaaagccaagaaagattttttgcaagtctcatcctataaggaagcttgttcgcaagtcgctatgaatcttcaatatggtactgcatttgtcggggtgcatgtcatatttacagagttccccgaagacttattccaggtctgccatgtgttgggttatgctttgagacttgacgaccatgtcatccacgtatacctcgacatttcgtttaatctgttgtttgaagactcaatccatcaatcattgagtaagcatccaggaagcttaacacttggaatctttggggaacgccttgttcatatcagtgtagttagtacacatttgtcatttgtcgttggctttttttaccatgacaacgctggcgagccaagggtagatggaaaacttgtggcaaataatgcagctatggattcccgtcatgtcagatggttgctaagcaaacaaatctgcatttttgtgttgcatgtcagcgatgtgctggtgctcatggttggtgaggttcctactgagctgcgtatacaacccaagtttaggttcgagctgcaacttgatgagctctttgatgagttttgggcatctattaaaggtgttgtctcatggatctaa

SEQ ID NO: 67533 - DNA, 2946 bp, Glycine max
  Peptide Sequence Number=SeqID_159218
atgacttcacacgtcagtccattgaaaacccaaccgttaagggttggacgtctgtgctcctggaccaaggctgacatggaagttagcttgcaggcaaaagaggttgtcaaatctcgaaggagattgtttgatgttgaaggtaatagccttgtcaagtataagggtgacgagtcagtcgagcccctaagcatggacaagtgttgtccgatatcgagagtggtagcctcaacaagagtgaaagttgcagccaagggctgcatcgtggtgcaaaaaattagggcaccacttcagctcccgctagttaacgaagagtctgactcctctttaaatgcagtggatgatacttgtcatggtgcctctaacaacgaatcctcttcctcggagaggttgagggtttcatgtcgtgctggtggaggcacctctcacctccatgggagggtgcaaccttccactgcttccctggtcagggaacctgtcccagtcactgtgattctcaccccttctgcttctatgggagcaagcataagtgttggggatgttaagtataaatcctctatcacctctgtggcgagcattgctcctctgcaatgccaagtgaaactggaaagccctgaggactcctacaagatagtcttcagtctcattctccccttgacctctttccagtgtgctcttcttgagtacttgaatgtggccccttcccaactccacccaaatagttgggccatgcaagattggttgggttccttgaacagcatgtccataaagctattcaagtttgactcgaacatctttcgacgtttcaatgaccgtttcttcaaggtcttagctattgatgtcatggctgatggtttgccaccgatgttcaataaggacggggagcctcgcttctcgttctattggcagaataaccccacatggttcaagtcatttgatgaggatttgttgacccttgaggaaagggtcgacaaggctatcttggagcagttaccgacctcgctggatgcgcagaccattttgtcgctttcctcagcgagcgatcccctcactgccttggacgataaatgttttaccttgtcttcctcttttgtcaaacctgttggtgggactatgcccctattcgatgttgctcttgtatctagagaagggggacaacctgctgttgaggttggcgctattgctagtgatgctgaagttgcccacgaagcttcttcctttgtgttgactaagaggaagcgggatgacggtgttggaatgttgggccacaagaagtcgagggctctttttagcctttgtgccctgaggcaagctacagggttaacacctagttcgggttgcccttcaagtttacaagatgtgcctctggctccactgaccgtcgaggctcctacttctgttgttgttgttgttattgttactcctatccctcgacctcctcttgttgtgtttgttcaggaggcctcttttgctgctgaagttagtgcgccaactacttcggctagttttgttgtggctcctttgtccaccgttgttgtacccttgttgagtgtcgatgtggcaaccacgactgctcttgtgatgttgtctcctcctttttcagctctaccggttccttcgtccactgtgttggcgttggtgtccacctcttttcacctccatgtttccttggaccacatttacacttccagcgatgttgattccctgtggggcatggggtacaagcctgaacaaaagaccttgataggctttgtgtcagccttagataaaaatctgattcaatcagatggggtcaagcatgccacaaattctaccaagagcgccactactcaaaatgtttcgagagtgaagtgtcccaaggtggtcaacgccagtgttgcctttgctaaggtcgaaaagaaaaaggacatggttggacaagtggagggcattatagcggagaaggatgagcttgtcaaggagtctgagctgtgggcagctagggagaaggaggtctacaaagagcttgaagatgagctaataatgtacaagaaaaaggttatggagcagcatgaaaaagttttcaacaaggccgttgggcaggtcaggttcttctccaaggaccttgacttgggtctttttgaccctttcaaggacatgaaggatggtgttctgcttgacgagaaagatattgctactgaggaggaggccgaggaggagcaggatgctgatgatgccgatactcaccaagggaaaaccttgggtttgacgagcctttggagaatagatcaaggacgcgaatgtcctggattttggcaagactcaccaagggtggaccttgggttttgtgaactgttggagatgcgaggctcaccaagggaggaccttgagttttatgaaccttttggagagttgaataggaaattgtccgtcttgggttttggagagactcaccaagggagaagaaccatgggtttgacaagcttagagactcaccaaggacagaccttgagttttgcgaaccctttgaagaaacaacctatgagactcaccaagggtggaccttgggactcaccaaaggtggaccttggatttttcgagccctttgtagaaccaaccaacgacgcgtccatcttggattttggcaagaataaaaagtatagccttgtgtcttgcattaggtcaattgaagtagaacttcgggcttgttatgaccttgaattagccttcccagttgagaacaagctttctccctcggggatattttctggctttgcctcgaactcgccacacgaggtcgtcgggttgaaaggctcgtggttgaacctttgtattgtatcttcttactgctcgaagcttggtagcttcttccctgatcctgttggtaaagagtttcattggtcgttgtctggggtgaacaatagtaggcctagagtatactgtggagttcctctttctatagatccttag

SEQ ID NO: 67534 - DNA, 76 bp, Glycine max
  Peptide Sequence Number=SeqID_159219
atggggctaagctctagcttatttaggaatcttcttatggaagcttctcaaggaggtgagcttagttatgagaggg

SEQ ID NO: 67535 - DNA, 111 bp, Glycine max
  Peptide Sequence Number=SeqID_159220
atgtgggagtttaggcaaaggttggaagttacatggaagttactaaaacttccatcaacggttggaagttacatggaagttactaaaacttccatcaacgacaatttttaa

SEQ ID NO: 67536 - DNA, 240 bp, Glycine max
  Peptide Sequence Number=SeqID_159221
atgggtattaaacattttgaagtggtcaaacgaaggtcgcatgccgacaaacaatggttcccggacgacattaggctgggtatatctgcctgccgcctgactcaagggtcaggatcagcagatgttgtgcttgtacgaattaccgctgggtatatctgcctgccgcctgactcaagggtcaggatcaacaaatgttgtgtttgtacggattaccgctgggtatatccgcctgccgcctga

SEQ ID NO: 67537 - DNA, 360 bp, Glycine max
  Peptide Sequence Number=SeqID_159222
atgaccactcttatccggatgtggatgacgttgctacttagcaacattctgcctagtgaccaccactttgatcccccctgccgtaggatcgcgcccataagacaccaagtggacccgaagaaatccaacagtgtcctggggtttccagctctgattacgagcccctgtcagttctacgaaatgctcgtcgcccctaacaaggtcatcaggcacccccccgaggcaggcgcaaggcgaggcaccacaacagcctggggacggccagcagcaggcaacagacgcaccgccaccacctccagagttcacctcagctcatccacaaaaaggctggagcgttgcctacgacacatggccgactag

SEQ ID NO: 67538 - DNA, 870 bp, Glycine max
  Peptide Sequence Number=SeqID_159223
atggctgtcatggacagtggacctatgtttttaaaggccatcgattgttcaaatgagatcaaagacaaggatttcattgccaaacatatgagggagagattcaacccgcaattgaagaaaggactccaagagatggtcattagtgaccaatggtcttcttataaggaagatgatgttgcaaaggctaaatttgtgaaagatactttgttggatgataaatggtgggataaggttgattatattctttctttcactagccctatctatgatgtccttagaagaactgatacagaagcttcatctctccatctagtatatgagatgtggaattcaatgattgaaaagaatagcactcttctccattgtttagctcattccttaaatcctagtcatgaatggctaagtgaagattctaatcaagttcgtccacatcaagacatggaactcacttgtgaaagattaaaatgctttaagaggttctttcttgatgttgatgtaaggaggaaagtgactattgagtttgccaacttctcagatggaaaagaaggttttgatgatcttggttctttaaatgatagagctgaagatttagtatttgttcatagcaacctacgacttctctcaaggaatactccacaatatcatcaagaggaaactaaaatgtgggatgtaactggagatgattttgaatcacttgatgattgtggtattcttgaaattgctagattgtctttagatgaaccagagttagagggtgcaaatgatgggagaacgattgaaacccttttgtctcatctttgcggatggacttggaggatcatgggttacaatggtgttgttgtgacgacgatcaagggaggttgtcgttag

SEQ ID NO: 67539 - DNA, 603 bp, Glycine max
  Peptide Sequence Number=SeqID_159224
atggaggtgtttggttcgcttgcgggaaacgacaaggagaagacgaagaagaacccgtccaatcgtgcgtgtcctgttgttcaaccgtgtccggtgacggcggaagcaacagacaccgcgtgtgtccggtgcgaatctgatgcgggacacgccgatgaagagtttaagaaggcaaaacaccatcataatctggggactggtttcgtgaagatgtcgtatttcaaagagattgacaagatcctcataagtgaggaaagaaacagaaatacaaagttatccttcctcttatcaatggtggcctcctctcaccataatatctctattgatcaaaatgcttatgctaatactaagaaaagtacaccattgccaacaccaagagtgacgacaacaacaacaaacaagggccttgaactgattcttattccaggacacaaggaagaatgcaagaaggtgtgggaaacccaagaactactcccaacctctctaaacactaaacacttttgctttgcaggtccttacccccttacactagattatgaagccattagtagttggtttcctacctatgagaatgagcaccttataatccacacaaactattag

SEQ ID NO: 67540 - DNA, 147 bp, Glycine max
  Peptide Sequence Number=SeqID_159225
atggcgaaaatggcgaagaagctcagaagaagcaggaatggcgaggaagaagcagaagaagtagaaatggcgaagaacacaggattggaagggagaaaggagaatgaacagtatggccgtatggggcccaacgagtatgagttatga

SEQ ID NO: 67541 - DNA, 1206 bp, Glycine max
  Peptide Sequence Number=SeqID_159226
atggcaacattcaaagacgaaaaagaagaagaagaagctcccatgcacgtagacatcttagaggccatattctcacacgtgccactcatccacctcgtgccagcctctcacgtgtcgaattcctggaagcgtgcggtctccacctccctccgccacgtcaagcccgccaagccctggctcaccgtgcacacccagagcccccgtgccccgcacgtgaccaccaccttcgcctacgacccgcgctcgcgagaatggttccaaatccacgcgccgagtcccaaccacaccaccgccctccgctcgtcgcactccacgctcctctacacgctctcccccagagaattcaccttctctctcgaccctctcaagctcgcctggcaccacgcccgcccaccgcgcgtgtggcgcaccgaccccaccgtcgcgcgcgtgggaaccaaaatcatcctcgccggcggcgcgtgtgacttcgaggacgatccccttgcggtggaggcgtacgacgcggagtcacacgcctggctccggtgcgagcccatgccggggattctcaaaggctcaaccgcctccacgtggctcaccgtcgccgtcgccggagacaagatgcacgtgacggagaaaaactccggcgtgacgtgctcgttcgactgcggcacgatgacgtggcagggaccgttcaacttacgtcctgatcagagcgttttccactgcgtaacgggaacgatacgcggtcgtttaatggtggcgggtttagtgggggacgcggagaacgtgaaggaggttaagttgtgggaagtgaaaggagggttagggttagggttagggttagggtttgaggaaataggagcggttccgaaggagatggtggtgaagttagtaatgggtgaaggggattgttgctgttgttggggtgtggcggggtccattgaggtgaattggattggggattatgtgtattttcagaaccggatggaaccggaggagatggtagtgtgtgaggttgtgaatggaaggtgcgagtgggggagcgtgaggaatgtgacggtgaatgatgtgagtcgcatggggagaatggtgttttctggtggccatgtggggcttgaggatttgaagagggcggaagatgatgaggaacattttcatgctttctcaagcacccagaagagatgttatgatcaagcaaactctaaatcaaacgcaatctga

SEQ ID NO: 67542 - DNA, 99 bp, Glycine max
  Peptide Sequence Number=SeqID_159227
atgtgttcggttctgtgcaagaaagaaaaggactacctatataagcatgaagttttagccgcttcaagaagctgggacttggctttgatatgcttatga

SEQ ID NO: 67543 - DNA, 357 bp, Glycine max
  Peptide Sequence Number=SeqID_159228
atgaagggaattataggagcgtcgtaccgggcacgttgtgatgatttgacggtcatagacgtgtgctggtttccttacagtgaccatcgaggggttagggggtttgagatgatttcatcgttccaggatatctgcggattacatggagtggcatgtgaccagcccagacatgcacctgccccaaaccatgaggactacatgcagccggacatcccacaggtttcggtggcatttgacccccctcgacatgtagtgggacaaagttacatgatatcacgcaagattgcgatcgccagggggggtgccaacgcagatggaagtgttagggctcgacaaagacagcacacagagcattga

SEQ ID NO: 67544 - DNA, 366 bp, Glycine max
  Peptide Sequence Number=SeqID_159229
atgaagaaagaagcatttaatcaaacaccttgtaggcaaaaactagacagtgctagacatggggagaatcttacacaaacttcattttgttgcaagcaagctctttcagaaaatgtaatcgaaaaacgaaatacagagaagatgaaaagttttgaaatggacttggctggctccaggggtgctgttttggctaataaaggacctaccatgaaggatggagttgagaaggatgaggacaatgaagatgaagagtatgatgatgactatgagagtgaatacataaaaagaaaaataagaaacaagctgccaatggcaccgggaataaacttggcaaagctgcagaaagttcttgctctagtaccatga

SEQ ID NO: 67545 - DNA, 258 bp, Glycine max
  Peptide Sequence Number=SeqID_159230
atgatggagatccaacaagccaactcaaagactctttgtgtgatattggagatgacagtcttgtttagatttcaagatgtgcttgaaattgttgaaactggaattaaagaaccaggtgcaagttccactgaatcacagagagcaaagcacaaagaagcaatcagaaaggatgggaaaacactgttcttgatccatcagtgtgtagatcccaacatctttaagaagattcaagcatcatctttagcaaaggaggcatag

SEQ ID NO: 67546 - DNA, 150 bp, Glycine max
  Peptide Sequence Number=SeqID_159231
atggagcgagcaggagaagtagctacagagcaaggtcctggaggcggagatccacctctacaggcaagggaagggccccatggcggttttcaagtcggcgttgggcggctgggagcaggactagctcgaggtcagggaggatatccttga

SEQ ID NO: 67547 - DNA, 1287 bp, Glycine max
  Peptide Sequence Number=SeqID_159232
atgggtgttgaattatatgagttttggtttgttggtattttgcttggaagttcggcactttgtcctggatctctcgccaagttagtatacttcacaaaagatgatgatcatttggttgatggcgaggaagggatatctcatagaaaggctttggagaaatccgacagcagtaagcaatatcctgttcttaatgggaagctcaattttaagaagtttgaaacaagcaggataaatgattgcatagagtttatcaagtccatgaaacttcatattggaggtagtcagccacaagaaaatcctggaagtcagccaatagctattaaggccacaggtggtggtgcatacaaatatccagaccttttcaaggaaagactaggaatcattcttgacaaggaagatgaaatggattgtcttgttgcaggagcaaattttcttcttgaggtggtccaccaggaagcatttacctacatgggtgatcaaaagcaatttgtacagattgacccgaatgatctgtatccctatcttcttgttaatattgggtctggtgttggcatgattaaggtggaaggagagggaaaatttgagcgagttagtggaacaagtataggcggaggcactttctggggtttaggaaagcttttaaccaagtgcaagagttttgatgagctgctggaattaagttatcgggggaacaatagagcggtagatatgcttgttggagatatttatggtggaatggactattctaagataggtctttcatccactgcaatagcctctagttttggaaaggcaatttctgataataaggagcgtggagactacaaacctgaagatattgctcgatctcttctaagaatgatctcaaataatattggacagatctcttacttgaatgcccttcgctttgggctgaagaggattttttttggtggattttttattcggaggcatccttttactatggacacattatctgttgctgttaatttctggtctaaaggtgaggctaaggcaatgtttttgcggcatgaagggtttctaggaggtgtaggcgctttcatgagttctgacaaacatggcctcaaggaattattggccaatcaagtggtgcaaagaagtcccagcaagttatcctttgccgtggataaaacattgcatggttcaccagatggagagtttaatggagatgaaaagaataatattgatgcggcatatgaaattggagggaaagtaggacacgacaacaacattcagtcaatagctcctccgctgcgggatgagtga

SEQ ID NO: 67548 - DNA, 927 bp, Glycine max
  Peptide Sequence Number=SeqID_159233
atggtgatttgggcttgctatgggaaagatggagttgttgggctggttggggccctgacaatgataatcctcgagggttaccaacatcgtgaagccacgaaggggactcaccaaattgaagagatactattgtttcatggtcataagaagaagcaaaaagagggagcgagagttgtgaatagcagtttgcacggccaagaccttgatggtcgaacatcactatccacgaagcgtaaacctgcaccgaccgtggtcgtggtggaggcggtggcttcggtggtggtggtggaggtgacggcggcggatacggtggttgtgggagggaggcaagggaggagccaaggggcacaaggtggtgttgtgcgacaacataactttcttgaggattgtttacggtactctgttacctacactaagtacgttaagaggaaaacgggtaccatggtggatgttgttgccgttctcaagaggcaaggtagggtgaagtggtgctacaagcttccccgtagtgtctcctctgctagtaagcgaagccagcaaggatgcgagatgttggcatgggaggcgtggggaggaagatggaaagtgaagagtgggatggtgaaggctcagtcgttgaagaaggtcgtcgattgtggaggccatggtgtcaacggcaacgaccaatttgagtttattgttgagttcgctcggtaccaaacaagccaagaaaacgtgtgcgggtgctctcaaaatcaatcccaagggattgagctggatgtacaaaaggataaggggtgtgcggaaacgaaggggataggtcctacaaaaatgggtgctggtgggtggctatgtggaatggatgtcgtgggaagaggtggtttgggctggcatgacagccatggaaggcaaccactggagcttaatgaaagcactaaattgttatga

SEQ ID NO: 67549 - DNA, 828 bp, Glycine max
  Peptide Sequence Number=SeqID_159234
atggctggaggatcatacgaggaagccattgcagcgttgacgaagcttctcagcgagaaagccgacctgggtggtgtcgccgccgcaaagataaaacagctgacggcggagctggataccgccaccgcaaacgggtcgacgccgtttaacccggacgagaggatccgaaccgggttcgcccacttcaagaacgagaaataccagaagaacccggaattatatggcgaacttgccaaaggccagagtccaaagtttatggtttttgcttgctcagactctcgagtttgcccatcccacattctggatttcaatccgggtgaagcctttgtggtccgaaatatcgccaacatggttccaccatatgacaagaccaagtattcaggaaccggggcggccattgaatatgcagtcttacatttaaaggtggagaatattgtggtcattgggcacagctgctgtggaggtataaagggcctaatgtctatcccagatgatgggaccactgcaagtgaattcatagagcactgggtccaaatttgcactccagcaaagtccaaggttaaaacagaagcaaacacattagaattctctgagcaatgtaccagctgcgagaaggcaattatgctatatcgtattgaaaatttcttgctcacttcaatgcaggaagctgtgaatgtatcacttgggaacctattgacatatcgatttgtgagagatgcagttgtgaagaaaactcttgccttgaaaggtgcacattacaatttcgttaagggcacatttgagctgtgggatctggacttgaaaatctctaactctgtatccgtttaa

SEQ ID NO: 67550 - DNA, 825 bp, Glycine max
  Peptide Sequence Number=SeqID_159235
atggatttccctcatgatgtagatcaaccttacgagacgcattcaagtgtaattctcatcgagcgacgggtagaatccttttcagacgacttaaatacgcaacaagatattataagtggcaaagtaactttcactactaaaaaaagtgtgttttacgatgcgcatttaaattcggttgtcccaaaaccgtctttgtttgagggcggtagcaatttggttgttcctctcctttcactcgcttcactcctctctcctcttcccaatgtcttctctcatgctctctcatctagtgagtttgcgatgagagtcttcaagttcctctccgaacatagcgactttctggcggagagagaaaaggccaagaagaagaagagagaggacctcaaggcctcgaaggagaggggaaaatccgacaagaggttaaaggaagagaaggaacctaaagccgaagacaccaacaaagatgaaagcacctccaaagttccaaataaaggtaatggcttggattttggagaaatactcttggacttaatcacttcaagagaggcctacgcttatctgcttaatgtccttgctcctaaacattgcagtccggtcaccttggataccaagaatggcaatgaaagggcaaatctggttcttgatcacacagagagaatgggttgcaaaagatacttcaccccaagggatgttgtagaggatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 67551 - DNA, 222 bp, Glycine max
  Peptide Sequence Number=SeqID_159236
atgacgcgtggtggtaacccagggtcgttgaatcacaacatcggttttatgaccgtctttgaaggccggcttttctacatcggttgtctagctacaaccgatgtagaatgggttgatatctacatcggttccaaggctaaaactgatgttgaatgggttgatatctacatcggttatcagtcaaccgatgtagaaagtgaaagatttctacatcggttatag

SEQ ID NO: 67552 - DNA, 369 bp, Glycine max
  Peptide Sequence Number=SeqID_159237
atggaaagtagtatagttgatgcttcggctgcttcaagaaaacgtagaagagatgaagaggaggaagaagaacttgaacaagtatttttcattattgttagtgttgtcactatgcttttggatgcactgacttggtatcatgacaaatactttgttaaggaacttgcccgaaatttggaattagaaaggcatagtttcctcaatcgtctatacaggggaacagaaactgattgcattgaacaattaagggtcagtaaaaaggcatttttaagctttgtagaattttacaagagaaagggcaattgttattgtagatccatggaaacaattagtaggcaattcaagaatgtcctgcgagctataatgaaa

SEQ ID NO: 67553 - DNA, 696 bp, Glycine max
  Peptide Sequence Number=SeqID_159238
ggtgacggaggttggaaaaggtcagcattgaatgctgcagccgcagtgttatctacaagcttcaatgttaatgtcacatcagataatgtcaaaaaccgtatcaaattatggagatcgtggtatgggattgtaagtgacatccttggccagagtggatttgattgggatggcactaagcacatgatcacagttgagaatgaaaatgcttggaatgaatattgcatttcgcataaatcggctaaaccgtttcgatacaaggtgcttcaaaactgggatgatatagtggatttgtgtgctaaagatagagccaccggtcatggagctgaaactgctatggatgttgatgaagcgatgagtagagaaacaaatgaagtggaattcatggggttaggtgttactgccatagatttagaagaaccaagctctaatacaaaaggaaaaagacaaggaatagcagcttctttggataaaatggcgaactcttttaaccgaatggtggaaaaaatggatggtaaagttgatgatgaagatattcaagaagtattacgtgaggcagctttgataccagatcttaatagacaacaatgggctaaagctattaaatggttagctgacgatccaaaacagttagctattgtgaaagcccttccaattcaccaaaagacagattatgctttaacacatcttggagaatga

SEQ ID NO: 67554 - DNA, 476 bp, Glycine max
  Peptide Sequence Number=SeqID_159239
attcatctaaaaccagtgaggatttgataaagaccacactgacagtgcatgcaaagaaaccattgcaattcaaggtcagagctgtggtgacagtgaggaataagatcaaagaggatttcaaagagactatgttgaagcatttggatgccatcaatgatagcataggaacaagaaatgttgtgctggagcttatcagcactgagattgatccaaaagcaacaacaagaaaccagactgagggaaataaggatcttaaccacaatgagaaggactatttgcttcctaaagtagttgaattctctgaagagaatagacatgggggaaaagacacatctaaggtagagctttcagccaatgaaggacttaactcaaacaaagcttacaggaataaatcattgatgacagagaagtggaaccttggaaccagaggaataattcctccatgtcttttaccccttgtctgcaatccatggtag

SEQ ID NO: 67555 - DNA, 375 bp, Glycine max
  Peptide Sequence Number=SeqID_159240
atgagtgagggagagaggaacttaccagtgagaagaagaaatgtcacggagagggacgctgctgagagggaaagagagagagagtggtgtgctgagagggagagagctcgtatattaatttcaaagactggggaagggaaaaaagggtgcgtaggtggagttgcggtgccattgccaccattgcagcggtcatcgccagaaataagagcagaaagacacgataggaggagatatggagtgtgtattcaaactctgaaattgtctcatgtgccggagatgaagggggaggcactgccactatcggcggtgatgtttgatgaagcaggaatcgggaaagagagtgggaaagggatagaatgggaaaagggaaaatga

SEQ ID NO: 67556 - DNA, 693 bp, Glycine max
  Peptide Sequence Number=SeqID_159241
atgggggaaccacttcataacattgataatgtcattaaagctgcagatataatggtggatgagcaagggcttcagttcagtccccgcaaggtcaccatttcaaccagcgggcttgttccacagcttaaacgtttcctccatgaatcaaactgtgcattagctgttagtttgaatgcaactactgatgaggtaagaaactggatcatgcctataaatcgaaagtacaagctggagttgcttcttcagacacttcgagaggagctttgcttcaaaaagaactacaaagttctatttgagtatgtgatgcttgaaggagttaatgacaggtccttctctagtcactgccctcatcaggctctttctcttgtcactcttgatgcgcttaaccagagtgtcatgcacatcgatggagatgcagagaggcttatcgagcttgtgaagggaattccttgcaagattaatcttatctcattcaatccacacagtggatcattcttcaaaccaaccaaagatgaaagaatgattgaattccggaatacattggctggtgcaggattggtagtcattttaagacttagtagaggtgatgatcaaatggctgcctgtggtcaattgggtaagcctggcaccattcaagctccattgcttcgtgtaccagagcaattccaaatggcaattggaagttcagcttga

SEQ ID NO: 67557 - DNA, 720 bp, Glycine max
  Peptide Sequence Number=SeqID_159242
atggaggaacaacagcggcaacaacaaaaaccaaagagtcctctccccattgactggagccggcagttccaaagtgactcgccgccgcgcgactacgacatcctgccggcctcctcctccgccgatcaggacgacctctccgctattcccgatcacaagctcagggagtcgattcagagcaagaagagaaccctcgacgttaccggcaagaatttgcccgacaaaggcaccaagcttcgcgctaccatcgaccgctaccagcaggaacttacccaccgggagcaacaaaagcgtcttcgccaggaagatgacaaggaccggaagccgcaacccggacaagcttcaagcacagatgctgttactgagggtgtgtctaatgacttgagagaagagaatttgttgtctcaagctcagtcacaatccacttttacatcttgctttgttaaacaaatggaagataatactaattgtacagcttctgatgcatttagaaaagagatgtcacttttcaaacatagtgactaccagaaaatacaagacaagggtgagcctagaagaagaaagagacatcgatcatcatcaagacaactgcagtttcaatgccccagtaaactttccaaacgtaatacttttagtgatggtaaaacttgcagagcaacttccagttttggtctgcggaataatgggagaaatctgccaagatgctacccaaaagtgtaa

SEQ ID NO: 67558 - DNA, 411 bp, Glycine max
  Peptide Sequence Number=SeqID_159243
atggcatggtcactgccagaccctaatttcgtccggggactgtcattcactgatgttttgattctcgctagccaaactgggttgttcgacactagttaccgcacaagacgaaagatcgttcaatgttttaaccaggaatgcgaaagataccaaaaaggaggggcaaaaagctcgcccaggctagcctctggctcacttgggccctcaaaagacttcaggatgaaggaactggctcgcctgggggagctgaggaaggggttccaacattcaacattgagagaaattgagaaaaataagagagaagaagaagaagaaagaagaggaaacaaggccgaggcgctaccgaatcacgactgtgatcaatccctgcgccatttctcgctccgtgttcttcgtttgtcattcgattag

SEQ ID NO: 67559 - DNA, 189 bp, Glycine max
  Peptide Sequence Number=SeqID_159244
atgatgagcatgaggaaaatgatggaggtcaacccggctgcagttgccactacaagtgtcgccactgaggtagatccgactcacccgtttggtcaaggatgggaagcattgggaagtacggtcagcccccattttgtgcaagtcgagagcaagcatcctttcccaccgtatagcctgcctcccaactaa

SEQ ID NO: 67560 - DNA, 251 bp, Glycine max
  Peptide Sequence Number=SeqID_159245
atggaaatgtacccatttacttggattgtgattggaatgcagaatgaagcaaggaagatcctttgtttgaccgcttcaaggtactgggcaccctttgttacacaatacgtgaagttccgtgacatgccggagatcaaaaggaagcattgttacgcaatccgtgaggttccgcccacttgggccttccaagatgttcctccagaaggcggttgcttctgcaggaagcaacctggctctcctgggcgagctgg

SEQ ID NO: 67561 - DNA, 231 bp, Glycine max
  Peptide Sequence Number=SeqID_159246
atggaggatggcgcccctcctcgacgccactggtgcatggcatcacgaagtgaggccgccattgggacagaagcaatgacggtagcacagaagtggcccacgatggtggcatccaaatggcgcaatgtaattggtctatttgccttcctcgggatccatgctgctctgccgtctcctccaaagacctttttttttttgcttttatgcactgtgctgtctctcttgacctaa

SEQ ID NO: 67562 - DNA, 141 bp, Glycine max
  Peptide Sequence Number=SeqID_159247
atgagacaaggatggaagagagagggaaagagaaaggtagaaggaatgaatgaagaatgggaaaaaggaaaggaaggaagaaaagggacaataacaaatttggagaggccaatatcaacttcctttgcttttagttcctaa

SEQ ID NO: 67563 - DNA, 1410 bp, Glycine max
  Peptide Sequence Number=SeqID_159248
atggggcaagctgcgtatttttctagacatcatgatgttgagcaagagtaccactttggcttttatgtatctgtaccagagaagttgagatggcctgttctggtgatagcaatacttgctgcagttgtgggaagccaatccatcatcactggaactttctcaatcatcaggcaatgctctgcattaagttgcttccctagagtgaaagtagttcacacttcatccaaagttcatggacaagtatatatacctgagatcaactggttgttgatgctcttgtgtttggctgtaactattggcttcagagacacaaagcttatgggcaatgcatcaggtttggcagtagtctcagtgatgctggtgacctcatgtttgatgtcacttgttattgtaatctgctggcacaagaatgttatgcttgcaattgggtttgttctcttctttggcaccattgaggctctgttcttctcagcttctgtgatgaagttcttggaaggagcgtgggtgccggttgctttggcatttgtgtttttgtcagtcatgtgtgtgtggcactacggcactctcaagaagtatgaatttgatgtccaaaacaaggtttcactcagctggttactcagccttggccatactttaggctttgcaagagtacgaggaattggccttgtgcatactgagctagtgtctggaatccctgctattttctcccactttgtgaccaacctaccagcattccaccaagtcctggtcttcctatgcatcaagcatgttccagttccacatgttagacctgaggaaaggttcctagttggtcgcgtcggtccaagagaattcagagtctataggtgcatagtgaggtatggataccatgatgtccacaaagatgatgatgagtttgagaaagaccttgtatgcagcatagcaaagttcattcaagcaggaagtggatgcaataagaactcttcaaattcaaatgatgagcctgaaaagggaggtggcaaaatgacagttgttggaacatgttcttgtactatccaccacaccattttggttagtgagaataataattatgctcatgaggttgatcatgtggacttagctgagacatcatcagagtcacataaaattattaaaccaaagaaaaaggttaggtttgttgtgcctgagagtcctaagattgacaccggtgcaatggaggagttgaaggaattaatggaagccagggaaattggagtggcctacattataggacagtcctacatgagagccaaaccagggtccagcatgctgaagaagttggtcattaatttagggtatgaattcttaaggaagaatagtagagagccctcctatgaacttagtgctcctcatgcatcctctttggaggttgggatgatgtaccaagtttaa

SEQ ID NO: 67564 - DNA, 887 bp, Glycine max
  Peptide Sequence Number=SeqID_159249
gtattgagagcggaagcgactccggtaaggagctgtcggatggtggaggacaacagaaacgcacttcgtttagagatctgatgatgggccaaaaagcaccagtggcacctagacctaaggtggaccttttgaagtacgaagatggtaatcacttgaagccaaaagttcatttggacaagaaggttgtggaaggtttatctaccccttggcaagacgcgttggtgatcaagcttttggagaaatttgttggttttaatactatgaaggataggctcacaaggctattgaaattttggatatttatcttgaatatttcatggtcaagtttgataatgagaatgacagaaggaagggtacattttctggggctaaatattgtgttttatgatgaaagcatactattggcaatgccaacaacgatagggatgccaatgaagggagattttggcttcaagatcattggtatcgagttgaataggaaggcctccataggatttgtgctacatgcggctactatggacactttgcgagagagtggagacaagagtacgacaatgccgccagaaaccctagttgctaatccaaggaatgtttcaaccaacaattctgcaactagggccccacaaatagatgatgcattacatggtatcgagcccacaacgttcttacaacaaaatgtgaatgttgaaaccagtttgaacatggatgaagacacaattgctccacaggcagatatggaagtgatatatctctcatatcgtggaacattcgtggtgcagttggttgctgcacctgctatttatgtttcccctaatccaacactgtgtactcaagtgtgggatcatcttatggccttgggtgataccattacaggcccttggataatg

SEQ ID NO: 67565 - DNA, 577 bp, Glycine max
  Peptide Sequence Number=SeqID_159250
atgggtaagcacaaacttctcttgctggccctcactctccaccttctccatgtctcagctgcaccttccgctacttccccagcaaaaattgttagtgggtttctctccaatgccgtgcctgctttcaccaagtgggtgtggtcgctcaaggccaccaccaaaacgggtgtggatctgatgggttttgaagcggtttcgagcaggtcgatgatgaagttcgagagtgggtacaacgtggagactgtgtttgatggaagcaagcttgggatcgagccttatgctgtggaggtgttgcccaatggggagcttctcattcttgattcggctaatagtaacatttataggatttcatcctcgctttctttgtgtgcacctgatgaagataatgttcgttgcaattgtgcagacagccgacccaagctggttgcaggatcagctgaagggtattctggacatgttgatggaaaactcagggaggctaggatgagtcacccaaaggggataactgttgatgaccgaggaaatatttatgttgcagatactacgaatatggcaattaggaaaattagtgattcag

SEQ ID NO: 67566 - DNA, 249 bp, Glycine max
  Peptide Sequence Number=SeqID_159251
atggaaaaaggtgtgtctcacattcacgcgaaaagggttgaagcttatgttcaagatggtgtcgagaaaactgtgggttacactaaggtttacaacgtgcagagaaaaccatgggtgtgggcgtggaaaaagttgtatgatttacgaaaaaggaaaaagatgtgtcttgcattcacacgaaaagggttaaaacttatgttcaagatggtattgagaaaactgagttacaatgaggtttacaatgtgtag

SEQ ID NO: 67567 - DNA, 288 bp, Glycine max
  Peptide Sequence Number=SeqID_159252
atggaaacagtggcaacaaatatctcgaaatggaaagggaactttgaaaccaatctctttgttgccgatgtaaatgcgaaagccccgctgtcaatccttgattcggaagttctagctagctgggaaggtccaactcgttggaacgaacttgacgaagagtctgcttcaatgtggaagagattcaagaagaggtgttgtgtgcgcacaactaaggttcaagaagaagcaagaggtcccgcgtgcgcacgattagggttcaagaagaagcaagaggtcctgcgtgtgtga

SEQ ID NO: 67568 - DNA, 669 bp, Glycine max
  Peptide Sequence Number=SeqID_159253
atgagtgttgaagataatggtggcttacgcgtgcttgcaatcaatatcctaggaagattcttgtcgcacaaagacaacaatatcagatatgtgggattgaacatgctgatgaaggctgtaactgttgatgctcaggcagtgcagaggcatcgtgcaacaattctggaatgtctaaaggattctgatgcttcaattcggaaaagagctcttgaacttgtttgtattctggtgaatgaaactaatgtgaaggccttaacaaaagagctagtagaatatctggaagtcagtgatccagatttcagggcagaccttactgccaaaatttgctcaatagtttcaaagttttccccagagaagatctggtacattgatcaaatgctgaaggttctgtctgaggctgggaactttgtaaaagatgaagtatggcatgccttaattgttgtgataagcaatgcttctgagcttcatggatatacagtaagagcattatacaaggcatttaagatgtcagctgaacaggaaactcttgttcgcgttgcagtttggtgcatcggagagtatggtgacatcttaatcaataatgctggaatgcttgatgtagaagatccagtaactgtgagtgaatggtttcttcttgaaagtttatgcataatatatactgttgcttaa

SEQ ID NO: 67569 - DNA, 457 bp, Glycine max
  Peptide Sequence Number=SeqID_159254
tgaagtggcgaaactgcctcagcaattatcttccggaagaaggtcttccggaaagtttccggaaataatttttccggaaagtttccggaagaataatttgtgtcttccggaaatactcacagacaatttccggaagaacgtcatccggaatgtttcctggaagaagcttcttccggaagaattccattgtcttccggaagaagcttcttccggaatatttgaagatttggtggtcccgtgttccgtatttgaagttttattagtggctgttgttcctattttgtcggaggtccagaatgaccacttccggatgaaggtcttccggaagttacgaaggccaattccggaagaaggtcttccggaagaccttcatccggaagtcgtgaaggccaattgcggaagaagttcttccggaaactacttccggaagcacttcttccggaattggccttcgtaa

SEQ ID NO: 67570 - DNA, 945 bp, Glycine max
  Peptide Sequence Number=SeqID_159255
atgacggtaatgatattggaggataagtttatcatgtctcgcctattacattccttctctcgcatttcatttagatctaacttatcttcatcctcttcttcaatgatgtcacccaaaaacaacaatttgctcaatgagcatgaaaaccaaacccatgaggtcgccccaaaacacaatctttttgatgaggaagtccgattcgaagacatacatcaaaacatggatgactggaacatcccaaaaatccctcaggatacgttgtacattcctgaaacaattaaagacaaatataattttgattatataatcaaaacaatagaaaataatattcctctaggacaagacatagggaaagaatttcatttgctttcaaaaaattcaatttatgaacatagccgtaaatacaagtatttacatatcggttgtgtccaagtagccatcaagcccttaattgatatgggcatagatgcaatagttttaatgtgccttagagatattaggcataacaagtttgaagattccttaattggaacagtagaaacaagcttaggacaagaaacattcttgactctatttttaaatatccactttcatggccttgacatgaaaaaaggatcaattccagcagctttgatctataggattcagtacaaagtaatgaatacttgtgcatctagagtcctgttaaaacctcaaagaggagaaaaaactttgtttatcactgatatgacaatggctaacgtttctctcctgcgaaaaataaaatgggatgaagtaactcttcccgaaagatgggttatggataaggccacgttgtctgttccccgacccactccaaccatagagcaaattaagcaggataactccggtaaggtagaaataaccttcaataggagaaattctttttcatcaagaatagaagtctctaggtctgaatatgagtaa

SEQ ID NO: 67571 - DNA, 491 bp, Glycine max
  Peptide Sequence Number=SeqID_159256
acattgaagagaagatcaataatttgcttatagaaacctcggaggaagaaacagaaacttcatcctccgtgctctctgatgaaaacctaaacataatccaacaagatgaccaactagcatcaacagatgatgatgggcaaatcaatactctaacaagagaacaagatctcttgtttgaagcaatcaattctatacccgatccccaggaaaagaaggtttttctggaaaaactcaagaaaacattagagtcacagttcgatacttcaaaggcagctccagaccaggtcaagaactggttccaaatccacccagaattcctaaaacttgctgatccagaaacatcattatttttgaataaaaaatctcagctagcagcatttctggctggatccaaatctaaagaaattcttgcaaagaatctgaacgaagtcctccctccatctacttcaacaggaagaagaagaagaaaaaccttcaaaaaaggaaattga

SEQ ID NO: 67572 - DNA, 360 bp, Glycine max
  Peptide Sequence Number=SeqID_159257
atgtctatatataaaacttatactgaatttctttattgtggtattgctcagcatctgctagcatatgttgtgactgacaggaaaccagttaaggacaagccaactgcggatagtggaagcaagtctaggggaagtgccaagcaacatgcaactcagcatgaccagattcccgaagtcttttggaatctcgctgcagagctgattattgccgaggtcgagtttgccgacatcgacggggatctcgcaggcagggatctccccgacaatgtctttccattcagcgacgacaagggtggtgagggtgtcgatgtcgaagttgaggcaacaattggaacccgtccacgagttgaagaggccaag

SEQ ID NO: 67573 - DNA, 885 bp, Glycine max
  Peptide Sequence Number=SeqID_159258
atggttaaaactagaggtcttggtcgtgctttagacccagcaataggaaaaaccctagggaggagacaagggagtgatgatgaaaatgatgtgttggatcaatcaacaacccaagtagatgtaccctctacttgtaccacaaaggatgtaccctccaatgtgttaagacaaatatctcaggcggttaaacctttgatactttgtgaatggggatacaaaagaattctcaggcgggagaagggagacacaaaagaattcaggcggttagtcatttgttcttttggaaaagggagaagagagacaccaaaagaattcaggcgaaaactttggaaagcttttggcacaaagaagaagaagaagttcaaagagattcaaggcttgcaaagacctaccgcatctactcgcaggaagcaacagcaagagcgtgttcttgaggatcctcttgcgactgatcctcctattgatgttgagggttttccaggcggaccccatgatacactagttctaagagattatgaaaatcacattgctcccagaatctggaatggagaggaacatcctgagttgaagctatcttctcatggaagaaagatggctaagttcaggaggtatgctctagagattgaaggccttgtggaaactagtagtttccatttgcccatcgaagaggtgactatcaccttggatgacgtcacatcgttgctacatctgcttattgtaggggcattccacagcttcgagcaattttatgtcgacgacgctatcaatatgctggtggaattactcgaggtcaacgccacagaggcgagagctgagacgattcaatatcatgactcttatgttcgactatcgtggctgcgcgacgtgtatcagatgaaaatcgag

SEQ ID NO: 67574 - DNA, 96 bp, Glycine max
  Peptide Sequence Number=SeqID_159259
atggcggcagcggcacctgatgaggcagacatcgatgtgcatcattttcgacgtgcaatggaacagaagtgtatgttgttgcttaagaatgtctag

SEQ ID NO: 67575 - DNA, 303 bp, Glycine max
  Peptide Sequence Number=SeqID_159260
atggacgtagaacagcgggtgtatgatagtatcatgtctgaagaagttgatatgaatgttgaaaataaggaagatgctggcgttaaagtagaacacattgattactctgatgcctttaatacttctcagttgtttgctagtcgtgatgaagttttacaatgggttcgatcggtagctcatgacattggatttgttgccgttataatgaagccagacactaatactaatgttcgaggaagagcctcatttctgttgatagtttgcgaaaggagtggtacgtataagcctaagaagtataatttg

SEQ ID NO: 67576 - DNA, 1548 bp, Glycine max
  Peptide Sequence Number=SeqID_159261
atgcgccacagagataccgtgtcttggaacaccataatttctgcttatgtaagctccggtgaccgggacaccacatggaaaatcctcggtgccatgagaaggtctgcacttgcatttgaaagctgcacatttgggagcattctcaagggtgttgcccgtgctggcgagctccagctcgggccaagtgtgggagagttgacgatggatacgttgtattccaaagcatgccagtgtgcaattacgtgtcatggaatacgcttgttgccggttactcatgagttggttgacaatgcagttgattgtaaaattgtgaaacatgggctggaattgtttaacactgtctgcaatgccactatcatggcttattcagagtgctgctccttcgaagatgctgagagagtgtttgatggtgctgtccagtgtcgtgatctggttgcatggaattccatgcttggtgcttacttaatgcatgagaaagaagatcttgcatttaaagttttcgttgatatgcagaattttgggtttgagcctgatccttatacatacactgggattgtcagtgcttgttctgtgcaagagaataaaacttgtggaaaatgtttacaagggttggtgataaaaagcagtcttgactattctgtgccagtttctaatgctttgattaccttgtatatcagatttaatgatagcatggaagatgcatttagaatattcttttccatggatcttaaagattgttgcacttggaactccattttggtaggatgtgtacaaggtggtttgagtgaagatgccttgaggttatttttactgatgagatgtctggtcatagaaattgaccattatactttttcagctgtcataagatcttgctcagatttagcaactctacagttaggtcaacaagttcaagtcttagcacttaaagtaggctttgataccaataattatgttgggagttcgttgatcttcatgtattctaaatttgggatcatagaagatgctaggaaatattttgaagcaacttccaaagatgctgcaattgtttggaatccaatcatctttggttatgcacaacatggacaaggaaacattgcacttgacctcttttacttaatgaaagagagaaaggtgaaacctgatcatatagcctttgttgcagttcttactgcgtgtagtcataatgggctggtagaagaaggctgcaactttatagagtctatggagtctgattttgggcatcttaagaaggcaaaagctttggttgaaacaatgccttttgaagctgatgaaatggtgttgaaaaatttattaggtgcctgtagattttgcgttgatattgaattagctagtcaaatagcaaaaaatttgctagagccggagcctgaggagccctgcacgtatgttatactctccgaaatgtatgggtgtttcaagatgtgggatgagaaggctagtgtaacaaggatgattcgagataggggagtgaaaaaggttccagctttcaaggattctgtactgtacacagtgtcttttgacaagatgtga

SEQ ID NO: 67577 - DNA, 306 bp, Glycine max
  Peptide Sequence Number=SeqID_159262
atggtagcctttccctctatagtcttggactctgggaaatatttcttcagaaacttttccagaacttcatcccaagtcttcaagctattacctttgaatgaatgcagccacctcttggctcctccaaatagtgagaatgaaaataagctgagcctaacatcatcttctggcactccagcaattctgactgtgttgcaaatttcaatcctttctgctctgttccttctacaagttgcttcgatttccaagtctattggaaccaaattacctgcagaggactttctatgcatacacaaccaagcataa

SEQ ID NO: 67578 - DNA, 385 bp, Glycine max
  Peptide Sequence Number=SeqID_159263
atggaatgcacgcacgcacgctctcgctttgtgttgttctcttctccgtgttgttgggcctcattgcgtcaaacgttgcagggatttgctaggggcacccagcagcattgctggtgcacccagcaaattttcaaaatggcaaaaatgcccttcagcctttttgcgaactttcttcggctggcactcgcggaagaagaactgcggaagaaccatcttccgtggaactacgcggaagaacttcttccgccagagtcaacggaagaagaaatgacgaacaaggacaaaggaaaaggcaaggaggtcgccagaaaaggttctgccggcaagcgcaagggcgccttcgacgattacaagaccggtggtggccaaaagagaaacaagcgag

SEQ ID NO: 67579 - DNA, 1119 bp, Glycine max
  Peptide Sequence Number=SeqID_159264
atggcggcaagccaaaaatccgccataaatttatggtggatggctcctttctctttctctctcactcactttctttctctgtacaacttggaagctttctctctctcaaagcagcaaggtcctccaccaccaccacctccaatctccgtctttcacacagagagagatactatgtgtttaaacaagttttgggcttttggtggtaatgtggtgtctcactatatgaaagttgcagggattgagggaccaaaaagcctaggtttgcatactctatatgattgtcgtgcatgcactatttatgatgcaatgttctatggaaattggattaagtatggtatcaatctggctaaaggtattctgaaacatcactcgaaagggatcctagattctgacaaaccaaggaaattgctcgaagattttcgaattggcaagctcatcacaggtttgaacaagttttgggcttttggtggtaatgtggtgtctcactatatgaaagttgcagggattgagggaccaaaaagcctaggtttgcatactctatatgattgtcgtgcatgcactatttatgatgcaatgttctatggaaattggattaagtatggtatcaatctggctaaaggtattctgaaacatcactcgaaagggatcctagattctgacaaaccaaggaaattgctcgaagattttcgaattggcaagctcatcacaggtaatatacataggttgcaggttggcaagatagaagcagagaaaatgcttattcaaatggttgaaactgagttagagaagagaaagcaatggggcacatataaaggaggatttagggggcagtcccacttttttgggtactccgtctattttagatatatcattcttagagttgtaagctatgaagggagatgtggcttgccaactaattttgattctacttactgctatgcattgggttatggtgctgcaaccatccttcaaagtgggaagacaggattaatatcatcagttggtaatttatgtgctcctgtagaagaatggactgttggtggaactgcactctcttcattgatggacgtggagaggagacatggtaaattcaagcctgttatcaaaaagatcaattga

SEQ ID NO: 67580 - DNA, 210 bp, Glycine max
  Peptide Sequence Number=SeqID_159265
atgaagtatgaagcgaaaaaaaagagtgaagaggttagcaagtctgaacggaaatcatggtatggtgttgcaacctacccttcggcgggagggcaacgcgagggctcacgggtgcgtcttccaagggaggaagatgcacggagtctccaccaacgtttattcgaggaaaacgtcggaaaaaccggaaaagacgtggtctacgaactttaa

SEQ ID NO: 67581 - DNA, 336 bp, Glycine max
  Peptide Sequence Number=SeqID_159266
atggataagtgccaaagacgatctccacaaacacgatctccacaatgtggttgcagtcacggaagcacaggcgactttgacacaaggagaaagaagaagagcgatagggttcaagtgcaaggagaaagaagaagaacgatagggttcaagcgcggatatgtcattgcatactcattgattattgcacttgcatcttcagcctcttgtatatcatcttgtaaaatggaaagcaagaagagccccaaggaggaatgcaaggtagttgtcactcgaagccagaagaaggaggatgctaaagctgacagaaagttgcaggacgtgagcaaaatggaatga

SEQ ID NO: 67582 - DNA, 429 bp, Glycine max
  Peptide Sequence Number=SeqID_159267
atgcatacctcagacgaaatagcaagaacaaccactaacaaaacttcaaatacggaacacgggaccaccaaatcttcaaatacttcacgggaccaccaatggaaagcgcaaaagggaccaccaccgaaagcaaccaaccaaaatgaaagaaagaaagcgcatttattcattaaaaaagtaaaaggacatcttccggaagaagcttcttccggaaacattctggatgagatccttccggaaggagtttctgaaaacttccggaaatcagaaattcgtcttccagaagaaggttcttccggaaagattccgaaaaagggtcttccgaaaagtttccggaaaaagcttcttccggaattagatttactgaaggacagtttcgccacttcactgtttgctgggtgcccgagcaataatgctgggtgcacgtaa

SEQ ID NO: 67583 - DNA, 267 bp, Glycine max
  Peptide Sequence Number=SeqID_159268
atggcttgtgggatgagcgaaaaaagtgagatcagtgaaggaggtgcaaatgattcaatggctagtgtgggagatgtgatatttgtcaagctttgcggtagctcatggtggcctgcacagtttgttgatgacaatagtgttaataagagtgttaaaacgagcaaactaaccaaacgatttccaggagacatccttgttaggcattatggaagctatacatcctctgttagagcctactgttgcactttggttctgttttttgagtga

SEQ ID NO: 67584 - DNA, 897 bp, Glycine max
  Peptide Sequence Number=SeqID_159269
atgaagccaaggggttacatagaatccgatcatgtacaagatgatgtgccttaccaagttgaggaaaagtcacatgtcaatgaagtcattgaagttgaaagtatttctggattgcaagatttaagaggtggagttgaagaagtaaactctgctaatttgttgacaaatgaagaagaatcggctaatttgaatggagaatcaaacaatattgaacaagacaatgaaggggaattagaagatgactttgagggtacatcctttatggtacaagtagagggtacatctacttgggttgttgtgactgaggacaagagagggtacatctcttgtggatcagttctagtggatggtacatccactaggttgttcaaagagaacaagggagggtacatcccttgtggatctttgcttttaggcctcccgatgttgcaaccttctccacctccaactgaagctaggccatcttcatctgatgttaatgcacctaaaccatctccagtacttgcatccacattatctctatcctccgttgatgcacgtggactatccccagtacctacatccacaccttccccatctccgcctgtgggcaatttgcctatagatgaagatgttgaagaatttgaggctagactatctcaagctaggtctgatgctgcatcaagtgttggtgaatcccaactcattcccttagaccctactgaagaacaaagacttaggagtcggtgttgggttgcagatgcaggaccaaagcgtaagggacgcctttatggtattggagaccttgctcatagttacaaatgcggaagtggcagcttcatgcagcatactcaaggatcttccagttgcgctgaagatgctacagagattaaccgcctgagggaggagttgcgttaa

SEQ ID NO: 67585 - DNA, 348 bp, Glycine max
  Peptide Sequence Number=SeqID_159270
atggcgccaatggtggtggcgctttccggcaggccgtgccacgtggcgttggtgtcgccattctcgctggcgacttggctttttcctatgtggcattggagtcaccattcttgctggcgatttggccatgcatggtgcgtggccccagtcaaagtggcgcgttgctttgccctagggttgcagctaggtttgcaggttgcagctaggtttgtaggttgcagggacgtagtggtagggtcagggacgcagtggcaggttcagggatgcaacaggtttagggatgcagtgttgcagaggggaaggcaccattggtgcttgcgcattgcaggcgagaggcgccattggtga

SEQ ID NO: 67586 - DNA, 717 bp, Glycine max
  Peptide Sequence Number=SeqID_159271
atgcatggcgccaatggtggtggcgctttccggcaggccgtgccacgtggcattggtgtctccattctcgccagcgacttggctttttcctacatggcgttggagtcgccattcttgctggcgatttggccatgcatggagcttggcgccagtcaaagtggcgcgttgctttgccctagggttgcagggactcagagttttcagtgctttttcagatggcagatgcttttggcagctgcttttcaggttgcagaaaatgatgtggctggtggttctatgtttcattctgcaaattctcttacatcatgtggaaataatttatctaataatgaggcacaaccggcaagaaattttagcaatttacatggtgacaaagatgatgatgatgatgattatcttgtgtctaactcatacgttgaagactctttagacgaagatgatagtgttgacagtatatctgatacaggcgatgaagtcaccgagatgattcaaccaatgagaattgttcacccaacagaaggtatagaaggaaatcaaaatccattttggaattatgctttgcattataacaatatcaactggagttatcctgatgaggaggacatttgcggtttggagatgccatcgacttttaatgttgggcaagaattatatgttggcatggaatttgatagtaaagatgcggtcaaaaatgcagtcaaacaatatgttatgaag

SEQ ID NO: 67587 - DNA, 519 bp, Glycine max
  Peptide Sequence Number=SeqID_159272
atgggagaccaaaaatatgatgaattgctcacggtggaggtggagattggatcatttctgaccagctcacacgagtggcttactcaccccatcattggccataaattgaatggtcagaactatacccaatgggtaaggtcaatccacaccaaggaaatatgctggatcattcatggaaaacctttaaaagccaggcagttcaaaagcaaggaaggcagaggcaacacaacctttaaccatcaacaagttgagttattctccatgtccccaaacttgtgggaatttcaaattttggagtcggggaaggcgattgacaatgctgaagagtgtgttggactgtacctccttcaagttgagaaactagaagaaaaactcaagaatcattcttatgtagcagcaacagttccaagtagtgataattttttcatgttgtggcactatagattaggccaccgaaatttcatgtacttggaaaaaatgtttccttcattattcaataaaaacaagaaacatatttag

SEQ ID NO: 67588 - DNA, 309 bp, Glycine max
  Peptide Sequence Number=SeqID_159273
atgattcatgatcttggacaagagtctcttcaacaagcacatgcccctatgtatgatacattggaaagtgattcgaataagctttttgtatcagaggtgcaagaggtcgttgaccttgttgccaaatatgggtggagtgataaaagcttcactttactgcttaaggtagtgcaggatatgcttctagaagaaaacatgttgccaaaaagatactatgagatgaacacaactagaaaatatagatttagcatcgctaacttaacatcgatttttgataaaaccgatgttaacataaacgcggtggcataa

SEQ ID NO: 67589 - DNA, 687 bp, Glycine max
  Peptide Sequence Number=SeqID_159274
atgctggatgcccaagcaataatgttggtgcacctagcatcaccaaaatctacttccacgaggaacccatatactgtttctccctcaaatctgggcggcattggtgatcatgtttctaacgtagtcagtgtggtcggggcagtccacatgggcgtggtggtgattgtcggtctcataatccacggtggtggcgttgatagtaatatcgcgagcgcgctcctccggggcggcgttgatcgcatcgtattttttgcgagtgttgttgccgagggcggcaagggccatggtcagggcgacagtaaaggtggtcttgttgtggtccacgaggccgatggcgaaggggagcggagaacggtgcggcggctgcgccacaagactctacgcttgctgcgaatccgttgcttattgctctctctctcacctagttttgcatcaattgcttttgcttatgcacgggttttgctcaaagttagtggagaagcacttgctggagaccactctcagaacattgaccctaagataaccatgaccattgcaagggaggtggcagtgactcgccttggcattgagttgcatgcatttgtgtatttgaaactaaagttcctatgcataaaacaaccaaaaatattatcagctcttttccaagtgatcaactttcctatttgggctaaacatttctctttctaa

SEQ ID NO: 67590 - DNA, 1488 bp, Glycine max
  Peptide Sequence Number=SeqID_159275
atgcagaacagcacagcaccagcaccctcccagtcccagctgcactggccctcactctccaccttcctcaacctcagagatccaaagcccaaacccaccctcctcctctactccttcctcttcctctccctcctctccctcaccctcatcctctccctctccttcacctccccttctccccactccggcccggaccccttcctccaccccatcttccacacccacaaaccctccaccccctcccctccctccctcgcctacctcatctccggctcccacggcgactctccccggatcctccgcctgctccgcgccacctaccaccccctcaacctctacctcctccacctcgacccctccgccccccacgccgatcgcgaccacctcgccctctccgtccagtccgaccccgtcttcaaggccgcccagaatgttcacgttgtcgggaggcccgacttcgcctaccacaaaggctcctcccctgtctcgctccgcctccacgctgccgccattctgctccgcctctcgcagaactgggactggttcgtcagcctcgctgccgatgcttaccctcttgttacgcaagatgatcttctccacatattgtcgtttctgcctaaggatatgaactttgtgaatcattcaagttatattggatggaaagaagcgaagaaattgaaacctattattgttgatcctggcctgtatctctctgaagggactgaaatgttttatgctacacagaagagagaactccctagtgcttaccgtgtttttacaggaaaatctttcttgatggaatcatgggacttcattcatatgttccttactgttccaaagaaatccactgttggaaacataaaaaacttcgtaccccattgcccagaggctcttcgctatgcgaaggcattctatggtcacacaaagtacctatcatacattgaagggtatagattttgtttttaccttcttataggttcatctttttctatcttaagccgcagtttcatggagttctgcatcttgggagaagacaacctcccaaggattctgctgatgtattttgcaaacacaccttcatccttgtccaactatttccctacagttctctgcaacgctcgacagtttaataggacagtcataaatcaaaacttattatatgctatccatgacagccatagaaatgatcttagaccactcaattccactgattttgatgacatgattcacagcggagctgtctttgctcaaaagttccagaacgatgatcctgtgcttgatctcattgaccaaaaacttttgggtcgaagtcctagatcaattgttcccggtggatggtgcttaggtgagcctgggaacaacacatgtctaacttggggtgatgccaagatcttgagacctggtacaggttcccaacggcttgagaaggccattgttgaattgctggctaatggcactttccgatcgcgccagtgcatatatgaatga

SEQ ID NO: 67591 - DNA, 561 bp, Glycine max
  Peptide Sequence Number=SeqID_159276
atgataaattcatacaaaatgcaaaaggggcactggagtatgtcggtggaattgtgcaaagcttgccgcaaccatgtgaagtttgttttagtatgttatttggtgcttggtattggtttacaaaggttggagaatgatcgtaatgtgttgtctatgtgccaaattgggcttgctgatccaaaaaaagaagtgcatgtatacttagaaaatgttgatccagaggggggtcctgttaatgaaattggtgcagaaaatgtggttgaggatgttgctgaagagtgtactcagaatggtattgaagatatggatgttgatggtgctaaaggtggttcggatgatgaaaatgaagtagttggaactgttgagttgaaacctgaagttgttggagttgaaactgaagttaacaatggtgcagatgatgatgaagttaaagaacatgatggggatgttgagttttcttatcattctaaaagtgacccaaactatgtatatgtgtcttcagaagatgatgaacaatcaagtgacacattggcagatagttaccagtctgaagaattttag

SEQ ID NO: 67592 - DNA, 309 bp, Glycine max
  Peptide Sequence Number=SeqID_159277
atgacaacggaagtgatccacggtcacaactctgcagcgcctcgactccacttttcctctactccttcttcttttgtgttttctctgggaaattcgcccaggcgagttgtagcttgcctaggtgaattgtggcttaatggtgaaggcatccactcgcccaggcgagttgcttgcttagggttgaagttactttttagcctaagcgagatggatgctagcctgggcgaatttagggtcaaaaaccttcatgaaaaaaccattttgcccttccttttggctttgtttctagatctaacaaacaaccattaa

SEQ ID NO: 67593 - DNA, 309 bp, Glycine max
  Peptide Sequence Number=SeqID_159278
atgaccaacaccatgcaaaataccttcaagagggtagattttccacacccactgggtccaagaatcatccaaaactgcccgcaagaaagagatgaacaatccttaagaactgaagagaggtggtggctctggcgctgcaacgagaaagaggcgaaattgtgccgtttggggcaggatagatggagaaatgaggaagtgtgcggaaaaggggttcttgaagggtcaaggagaagatacaagcaaaatatgaaactcaaaaagattaaaattacatatttttgtattaggagggcaggtgtttacaattaa

SEQ ID NO: 67594 - DNA, 139 bp, Glycine max
  Peptide Sequence Number=SeqID_159279
ggctcaaattgaggagtctcaaaagtcaaccatggcaaggtttttgcatggtctcaatagggatattcaagacattgtagagttgcaccactatgcctctttggaggatctcatttatcaagctatcaagatggagtag

SEQ ID NO: 67595 - DNA, 363 bp, Glycine max
  Peptide Sequence Number=SeqID_159280
atggactttctaaagctaattttattaagagtttgcatgagaagagggaagcacaaattgagaaaaagatttaacaatatgctagatattccaataaggggagaaagaaaatggttattagtctgggtgattaggtttacttccaaaaggaaatctaaacttcaagaaaagggagatggtccttttcaagttttaaagcgcatcaactataatgcatataaaattgctttaccactagactatggtacctttgacatcaattcgagggcgaattattcccaagaaggagggtatgacagaggactatccaaggaggaagagtttggcttaggtggactcaacatggatggaccaatcacttga

SEQ ID NO: 67596 - DNA, 1326 bp, Glycine max
  Peptide Sequence Number=SeqID_159281
atgcatgacatatgtctgaacatgccaccaatggttcaaaccttcgacccagaggacctgttcaaaaggcgttgcatatgggtgaacggacccgttatagtaggtgctggcccttcaggtcttgcagtggcagcatgcctcaaagagcaaggtgttccattcttaatcctcgagagagcaaactgcattgcctctctttggcaaaaccgcacctacgatcgcttaaagcttcatctcccaaaacagttttgtcaattaccaaacttccctttccctgaggacttccctgaataccccacaaagtttcagttcataagctaccttgaaagctatgcaaagcacttcaacatttccccacagttcaatgaaacagtgcagtctgcaaagtatgatgagacctttggcctctggagggtcaaaaccatcaggaagatcaagaagttaggagaagcctcttcaggttgttgtggtgctgttgagtgtgaagttgagtacatttgcaggtggcttgtcgtcgccaccggcgaaaactcggagaaagtggtgcctgagtttgaagggttgggagagtttggtggccatgttatgcatgcttgtgactataaatctggggagggatatggtgggcaaaaagtgcttgttgttgggtgtggaaattcaggcatggaggtctcactggatctttgtaaccacaatgctaacccatcaatggtggttagaagctcagttcatgtgttgccaagagaagcttttgggaaatctacctttgagcttgctgtgatgttaatgaaacggtttcctctatggatggttgataagatattgctggttctggcacgtttgattttggggaatgttgaaaagtatggtctaaaaaggccttcagtgggtcctttggagctcaagcacactgcagggaagacccctgtgttggacattggggcccttgagaaaattagatctggcaaaatcaaagtggttcctggaatcagaaggttcttcccagggaaagttgaacttgttgatggccaagttcttcagattgattctgtggttcttgcaactgggtatcacagcaatgtaccatcatggttgaaggagaatgatttttttaccagtgatgggactccaaggaacccatttccaaatgggtggagaggcaaaggtggtctttatgctgtagggttcacaaggaaaggtctttctggtgcatcattggatgcaattaatgtggctcatgacattgccaagaattggaaagaggaaaacaaacagaagaggaaaacagtggctgcacgccacaggagatgcatatcacacttctaa

SEQ ID NO: 67597 - DNA, 795 bp, Glycine max
  Peptide Sequence Number=SeqID_159282
atggaccccaaaaagaaaattgtttgctcagtaatcagtggtgctgaagattctctacacatgcaaatatgcaaatcatggcaacaatcagttgtaaaatatagattaactccttattattgtcctttgttgggaagtatcattatctgcaccttctcagcgggcttcaataatggaacctcaactcttcatgctattattggcacctcgaaggctctagggttggagggctttatcttagttgcaaacccaaactatggtgattatattgcagagccaatcccttttgcagtttctggtattatgatccctcgtgtagatgatgacaaggtaatatttcagcattatgaagaacaaacaaagagggataggaaaggaactaccacagaatttggtgctatggcaactgtaggagaaggaagaattgcctctttcacagggagatcacctatagttagtagattttcttcaacgagtccaaatataattggcatgcacaataatcttgcagatgtacttaaaactgttcaacaaaagaatcatggactagctatggaggagttgattaacaaaacacaactctctcccaaaataatcccaacgtcatcatgtcggctcggcggctcctcaacagaatctcacttcctacaccctactgctgtcattctgctaccacgaacatggttcgtgatcatcacatgtatcaagtacacgatacaaaattgcaagcgtgagttcattataaatagaattaacacaaaaaccaaacaatcacaattagaagaaacacattaa

SEQ ID NO: 67598 - DNA, 237 bp, Glycine max
  Peptide Sequence Number=SeqID_159283
atggctggtgattggcctttcattagcgacgaaagtgaagttaccgcctctctaacagtcaagataagttattgggaagaattaaagtctggtatttttggtgatataagctggtatagaataagttatcctggagcagaaaattcaactgcattggctactcctcaaggatttcactcaaaacctagtatccaatcacaaagaatagggaaaaattccctgaacgaatacatctaa

SEQ ID NO: 67599 - DNA, 768 bp, Glycine max
  Peptide Sequence Number=SeqID_159284
atgttgctttctaagctgcgaaaggcttcaggaattggaaagtctattgagaatcaaacaagtaaaagggatgtttctacatctacggaggatttagcaagcgaagatcctgcttctaactcttccaacccagaaatcaatgataatgctgctgaggcctctagtttgtcctcagttactgaaactagacactcatcttttggagtttctcctgtgaatattcctcacgatcagatgagaatgattgagaacattaatgcacttatttctgagctggcattggagaaagaagaattgataaaagccttgacatctgaatcatctgagtgttctaggatgaaggaaatcaacatggagttgtcccgaaagcttgaggtccagacacaaagattagagcttttgactgctcaaagcatggtcaatgaaaatatttctgcaaagcaaccagattctcgtgctatgtatgagaacacctcatatgcagatgagggtgatgagggtgttgggatggattatgaagctctttcctggtggaccttcaagacggagaaccagcaaacttctttgattggatttacattagacttgtatttgttgtcaccaaagtcttactcaactgttaggaaggatcatgaagctgttccccagtatgccactaaggtcaagaatcagaacatttcaatcccagatccacgagtaacatgtcgacaaaagtctactgagttgctttttgttcttgtaacctcctcaacacactggaggtcgtaa

SEQ ID NO: 67600 - DNA, 276 bp, Glycine max
  Peptide Sequence Number=SeqID_159285
atgatcaagtgcttaacgcaggttttcgcgctaagcacgcctttgggcttcttcgtgcgccttctttgcactaagcttgagttggccgctaagcgaggagacacgttaggaaaccatttgatgcaagctccattggagcttgtaggcctaggatcttcttcatcaatggattcctttgcttcttggaagataaatggcagcggaatggagaaggaagagagagaggagacgccacttcaaggagaagataagtctagaagaagctcaccaccatag

SEQ ID NO: 67601 - DNA, 291 bp, Glycine max
  Peptide Sequence Number=SeqID_159286
atgccgcttagccccatgatattggttaccttggctgacaacgagctgatgtcggtggcctcttccttcctttcactcggagatgcatacctccacgggactacgtggctgtttcggtatggaaacggaataggtttaactaccgaggggtatcagagcttttggggagctgcgcctttggtgaaatataccaccaaaggcttagaccttccaacacttctctcatctgcagactgcatacatatatgcaactcttccctcccctcatcgccgacttccagtcggccttga

SEQ ID NO: 67602 - DNA, 420 bp, Glycine max
  Peptide Sequence Number=SeqID_159287
atggtggcccgagtgatgttggggaatggttacgagcccggaatgggtttaggcaaggacaacggcggcagaaccaacttgataagcgccagaggaaaccgtgggaagtttaggttaggctataaacccacacaagcggacataaggaaaagtgttgcaggaaggaagagcggaggtcaaggctcacgattaagacaagaagtcaaagggggcccgccctgccacataagtaggagctttataagcgcgggtctagggcacaaaggccaagtcattgcgatatgcgaagatgattctccgagtgggtcggatttgataaaagaagaagtaaagaaacaatttgacactggctttctggctgttgctcggtacccggaatgggttgccaacattgtactagtccctaagaaggatgggaag

SEQ ID NO: 67603 - DNA, 309 bp, Glycine max
  Peptide Sequence Number=SeqID_159288
atgactaagtttgaccctgatatagtcctggagttttatgctaatgcttggcccatagaagagggagtgcgagacatgcggtcatgggtgaagggtcagtggattccctttgacgcaaatgccctcagccagttcctgggtgacccgctagtgtttgaggaaggccaggagtgcgagttcagtcagaggatgaacagggccgatgggttcgatgaggaggccattgcccagctgttatgcaccccggggcaggatttcgcccgaaccgctgtagggaggcgggtatgccacccaccaggcaccctctag

SEQ ID NO: 67604 - DNA, 441 bp, Glycine max
  Peptide Sequence Number=SeqID_159289
atgacattgctacttagcaacattctgcccagcgaccgcaatgccaatctccccctgcaaaagtatcagttggtctgtgtcgtcccgacatggggatcgcacccacaaagacacctaggggacctgaagaagtccaacagggccctggggtttccagctctggttacgggcctctatcagtcctacagggtgcccgtacccccccggcaaggtcacgtcatcatagggatcgcgcccgcaagacacctagtggacccgaagaaggccaacagggtcttggagttgccagctctaaatacgggtctctatcagtcctacggagtgcctgtcacctccggcaagggcatcaagccccctactaatcgagctttcatcaagaagtactgcgcccccaggcaggcgcaaggcgaaacaccacgacagcattgggatggccggtag

SEQ ID NO: 67605 - DNA, 171 bp, Glycine max
  Peptide Sequence Number=SeqID_159290
atggggtgtgaaatctaccctgaggttcatgagaaccctagggccttcttcagcagctctagcccaatcctcttggagtctcttgctcatggctctagtgactggtcccttcctagggaggattgcatcaaggcgggtcgttacaaattttctcagaagatttatttctaa

SEQ ID NO: 67606 - DNA, 204 bp, Glycine max
  Peptide Sequence Number=SeqID_159291
atgattatgaggggccaaaatatttatagtagccaagatgaagctactacttccccttcttctagtgaaagtgaagaagcaaaaggggaagaatccagcgaagaaatctatccccaagaagaaggacaacctttaataattaagcaggagtgtaaggacgtgttgaaggaagaagcccaaagtttcaagaacctctggatttga

SEQ ID NO: 67607 - DNA, 433 bp, Glycine max
  Peptide Sequence Number=SeqID_159292
ggccctggatccccgcactgatcacaggactctgccagtcgttcggagtccccgttgcacctaccaaggctcagggtgatgctccacaggccgcaggcgcgccaccaccacctcatcaggctggccaggctggggcatttgacatggagcagtatttacgacatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacac

SEQ ID NO: 67608 - DNA, 189 bp, Glycine max
  Peptide Sequence Number=SeqID_159293
atgggagtgatggctagatggaatgatcgtgcgatagccgatgcccttcaagccttagctcaggctatagggaatccaaacaggggagaagctagtggagctgttgagtaccaagggttggatcgcatccaacgaaacaacccttcttctttcaatggaggatacaaccctaatggtgctcagaactag

SEQ ID NO: 67609 - DNA, 399 bp, Glycine max
  Peptide Sequence Number=SeqID_159294
tattgtctatgcaagatctcctacaggtactctagttcctttggacttagaaatagaagctacactaagaaggaacatggatgagaggagaaggaaactgttgcaagacagaacaattgcgtccattcttgaggaggagacttatttttctgattcattatcacctgattcaccatcatcaagggaatctgctaatcaacattctaaaactactaccatggcagatgagcatgatcagaggactacccttgaggactattcaagattacctaatgaagatccctatgcacacttggcaacatttattgagatttgcaatactgttaagattgccagtgtaccagatgaagctatcagacttagccttttctcattttcactggcaggagaggccaagag

SEQ ID NO: 67610 - DNA, 387 bp, Glycine max
  Peptide Sequence Number=SeqID_159295
atgggatcaaatcgaacacctctgctcaagaaaaggttctatcaagtcaaagtcatgagcttagaggtcgccagtttacgagagttggggcaattgatgggtcaacttcaatggcaagccttcctcaaagcctatggtaagatttgggacctagctatgatagaagtctccgtgtgcttgacatttgaggatttccagctagtgctaactgtggaagagtttgaagaaatcctaggatgcccactgggaggaatcttttctccggtttctatccctccatggccagaattgccaagcgaaggccttggcaaatcaaggctgtcataccctaatttcgtccggggacctttgctcgatgacgtgcgaccattctttggtcctcgtgag

SEQ ID NO: 67611 - DNA, 228 bp, Glycine max
  Peptide Sequence Number=SeqID_159296
atgaagaacgaacgaagaacgatggaaaaccttcacggatttgctcacggaaacgtctcggaagcgtttaaggaagcacctcggctaggattttcttcacggaaacaatttttttcacccaaaatagatgaaatgcatagcataggggaaaaggagaaaggaggttgccgcccagctcgcctaggcgagctcagctcacccaggcgagctaggttgcttcctccttaa

SEQ ID NO: 67612 - DNA, 192 bp, Glycine max
  Peptide Sequence Number=SeqID_159297
atgggtagcatgaacatgatgaccatttggagtggaagtgagttagtgaagatgagacatgatcagttgctccagaatctaatatccaagagtggaacacgaatgtcataccctaatttcgtccggggacctttgcttgatgacatgcgacttttctttggtccttgtaaggtgcttggcacccatcattag

SEQ ID NO: 67613 - DNA, 297 bp, Glycine max
  Peptide Sequence Number=SeqID_159298
atgacatgcagagacacccaagggttatccatacacacatttatgctaccccgacctgtgagaagtcaggtagcatgcagagacaccctatacggtaatcgcacacatttcgaagacaaaaatgtcttcaatcattgcatgccttcaaaggcgacaatgtcctcacacatttcaaagacgacaatgtcttcagtcattgcatgccttcaaaaggcgacaatgtcttcatttacatttcgaagacgacaatgtcttcagtcattgcatgccttcaaaggtcacaatgtcctcatttaa

SEQ ID NO: 67614 - DNA, 576 bp, Glycine max
  Peptide Sequence Number=SeqID_159299
atggttcattatagtgagggagtgtgcatcgaaacaaatataggtgggtcaaagaaggaagagattggagagtgtgtagccaatgaaatgctttggataggtttgcattactcaaataaagatattcaagcttccacatacttgatacccattctacattttcagctaacagaggttcgacaacagaatgacctccaaggccaagatacaccaaattggagagattcccaatctgagatggaattgtttcattggcggcatacgccaggtcaagatacaccaaatttgagagattccaaatctgagatggaatctacccatagaatccagtatcagagaggtcgaggtgagtcaaggaagtcattgtcccaaggaaagaaggaattgacatacctgctccaagtaaataattgccgctcaagtccaagtaattcaaatgctttaaatcagccaaacaaggacttatctctccaccaaagctccatctccaataagcttcctcatcggatgcaatgtagccatcatcgaaagcagaaggtgaactgtggaggtgaagctgaagaagatgggaagtaa

SEQ ID NO: 67615 - DNA, 1720 bp, Glycine max
  Peptide Sequence Number=SeqID_159300
atcacgtcttttccggtttttccgacgttttcctcaaataaacgttggtggcgactccgcgcgtattcctttcgtggaacacgcatcccgcgagtctcgcgtcgccctcccgccgaagggaaggctaaggctgttcccaggtaagctgaagtccaagtggtcagggccgtttaccataaaagaagttagagctcatggagcaatggaattggtggaccctagagaagggagcttcgagaagaaatggatcgtcaatggccagcgcttaaagccgggtgccaatagcaaaactcaagtgggaagacccgcgcttagcgcgacacctagcgctaagagcccaggtaggattgtggttcagaattgtgttaacctaagctgcagggatcatcacgctaagcctttccagaggcttagcgacgcgctcatcaacttcagcgaacacgctaagcgcgtgcttgtggcgctaagcgcgtgcctccttcagcagacagacgcgccaagcgcggggctgggcctcagggcccatcagcctcgctccttgcttcgggcagcccccttctactctcctcacccctcttctattgcttctcgcaagcttcgtgccatgcccacatcgggggaagcatccaactgggactcttcccgctttacatcagagattgcttggcacaggtaccaagacaacattcagctccggaacatcctttcggagaggaatgttgaactcgggcctgggatgttcgacgagttcctccaggaactcaggaggcgcagatgggaccaggtgctgactcacctaccagagaagaggatcgacgtggctctggtgacagagttctattcgaacctttatgatccagaggaccacagtccgagattctgcagggtgcaaggacaggtcgttcgctttgatgctgacaccattaatgacttcctcgacaccccagtcattttggaggacggggaggagtacccagcatacaccagataccttagcactcaccccgatcctgacaccatcgctgccacacagtgtactccaggggggcgttttgttcttaatgtcgatggtctcccatggaagctactgaggaaggatatgacgacactcgctcacacatggagtgtcctctcttactatgatcttgcgcccacttctcacacatctgatatcagtttgattgcccagtccagcacctcgaggctcgggttcccagcgttcattacagtgctgtgtgacattcagggggtggtttctgataccctgatctttgagtcactcagccctgcgatcaacttagcctatgtgaagaagaactgctgcaaccccgccgatccatcgatcacctttctagggactcgccgcacacacaccagagcctcggtgtcggcatcagaggcccctcttcctacccagcctccgtctcagccttcttctcagagaccgcgacctccacctgcttccacctcagcatccatggacatgcatggtcggatgctgagatccattcacgtcagacaacagctcatcatggagaacatgcacaggctgtccttacacctgcagatggaccccccgctcatcactccagaggcttatcatcagcagggggaagagccttctagagccgctgaggatcctgcggtcgatgaagacctcattgctgacttagccagcactgactggggcccatgggcagacttgggtggaggcagttga

SEQ ID NO: 67616 - DNA, 696 bp, Glycine max
  Peptide Sequence Number=SeqID_159301
atggcgcggctgggcaccgcgtggatgtttccgctgaccctgctgctgtacctgcttggctgctggctgtgggtgatgcggcggaccacgaagctgcgtgcgcaactgctgcatcagctgccggacttcctcgacaacctggtgcggctgactgcactgggcaacagcctgcaggccgcgttccaggttgcgtcgatgcagaccagcgcgccgttgcgcgggctgttggacaccacggtgcgctttgcgcgcagcggcatggagttggaccgtgcactcgcgcaggccgcgcaaccctatcgcatggaggtgctgaaggtgttgtcggtggtgatcggcgcagcaggagctttcggcgacgacctccgagacacgcatgtctgcgtgggtgctgggcctgctgccaccggcctgcgcggtgctgatggcgatcgccagcccggacttcttccagccggtgctgcacgatccgcttggccacaagatcctgctgcttgcactgggcatggagcttgtcggcggcttcctgctgtatcgcctggccaaatcgctatgaacccccgccccgccggagacgacgcgattggagcgccagcgccatggttcgcctataccctggctcgcacgctggctgcggcagtccctgcggcggctgtacgcagccaggtcgtgagcagcgtacaacggccacgttga

SEQ ID NO: 67617 - DNA, 201 bp, Glycine max
  Peptide Sequence Number=SeqID_159302
atgtgggatcgaaacatgcttagaggagcactcaaactgggtgtatttacccccaaggcctacactctgaagagtccgtcagggcctctccctcctgattcaggatccctactgtcataccctaatttcgtccggggacctttgcttgatgacatgcgacctttctttggtccttgtgaggtgcttggcacccatcattag

SEQ ID NO: 67618 - DNA, 297 bp, Glycine max
  Peptide Sequence Number=SeqID_159303
atgcagttatctagccctgctctatcaagttataaggaaatacttttcctctattctctgcacacaattgccagtctattcagacctattcccattctctgcaagtcaggcttaaaaaagggctttctgtttgtgaaggcacgcttagcgccattctcgcacaaagcgcaagtaagtgagatttggcttggtgccaatcttgcgcttagcgcagaagtgacaaccgtctcgcttagcaagctgcatatgcgctgggcgcgtgctggcgtggaagactctcttcaggcttatccttaa

SEQ ID NO: 67619 - DNA, 301 bp, Glycine max
  Peptide Sequence Number=SeqID_159304
aacttgtaaagggattttacaagattgtggaactctcaagcgggttgcttggggactggacgtaggcacaaggggttaccactactggaaaacccgaatgcaaattttcattgaggcaatagacttaaacatttgggaagccatagaagttggaccttatgtacccaccatggtggctggaaatacaacaatagagaaacctagagaagagtggtttgaagatgaaagaatattagtgcagtacaatttaaaggctaaaaacatcattacttctgccttaggaatggatgaatattttagg

SEQ ID NO: 67620 - DNA, 333 bp, Glycine max
  Peptide Sequence Number=SeqID_159305
atggcctcatccaactttccatttcttgagggaaattctattaataggcctcttatgttcaatggcgagggttatcactattggaaaacccgaatgcagatccttattgaagccatagatttaaatatatgtgaagccattgaagttggtccttttattcctacaaaggtagtgggaaatgcaattatagaaaaaccaagagaagaatggaatgatgatgaaagaagaaaggttcaatacaatttaaaggccaaaaatataatcacttctgcattaggcatggatgattttttagagtctcaaattgtaaaatgcaaaagaaatgtgggatag

SEQ ID NO: 67621 - DNA, 225 bp, Glycine max
  Peptide Sequence Number=SeqID_159306
atgccttccaagattattttgatgatgccaaagaatcaagagtcaaagcgtacatctacttgggttatgatactgagaacaagagagggtacatctcttgttgatgaggacaaggcaaggaataagggcaaggaacctttagaaggacttggaagacctatggcaagggctagaaccaagaaggccaacgaagctcttcaacaagtgttaacccatgctatttga

SEQ ID NO: 67622 - DNA, 333 bp, Glycine max
  Peptide Sequence Number=SeqID_159307
atgggttctccacctgcctccactcctcctcctcctcctccaccaccaccacctccttctcctcctcctcctacttcggacgcatcggcttcgacgtctgccatgaagcggacacgcaaagcctcacgtctacgatcgttgtccactagaccacctcgtgttgagagaccagtggtgcatgttgatcctgctaccgggaaggccgacggtccccataggaaaaaattaagaacatatttagggattgtggcacgtgataaggtggacatcacctacgagaactggaaggtggtccctactgctcagaaggacctgatttgggaggatatttag

SEQ ID NO: 67623 - DNA, 306 bp, Glycine max
  Peptide Sequence Number=SeqID_159308
atggataaatttgacatctttgaccctcatcctctcaaaaacacatctttgcttattcaacttccaccggaatgtgagtgcaagccattgggcgacatgagactcatgggtgcatcttccaaggaaggaaaatgcgcggagtcgccaccaacatttattcgaggaaaacgtctgaaaaatcggaaaatgtgtgatctacgaactttaagtgtgaaaggttcgggagttgtatttacgcacggggaagggtgtttcccttgctcctacgtattccttaatcgtgataaggaaatcagacctatgtag

SEQ ID NO: 67624 - DNA, 249 bp, Glycine max
  Peptide Sequence Number=SeqID_159309
atgggagactacaaggaagcgggatgggagtggaagcttgcttggagaaggccgctgttcgataacgagaaaagttacccccttatggtgggaatcactgtcatgggtgagtcaatctcatgttttcccgaaagacccaaagatgcatttcctacaacatgctctaactacgaccagtggttcgcaggccagaagatggaagtggtggtggatagctgtcacatggaccatttggaagcagagaaataa

SEQ ID NO: 67625 - DNA, 648 bp, Glycine max
  Peptide Sequence Number=SeqID_159310
atggacaacgaggatgacaccagatccttaatctatgatggagaatgggctgaagtaacccgtaggagaaacaagaatacgacagctagtagagtgcaatcaagaccaacgaaccagcatctagctaatagaacagtaacatggtggaacaaggctgacatcacaactttttacttctctagattcccatcatgggttaacaagaaggacttgtggcagacattccaaagatggggtaaggatgttgaagacgcagtggggctggaaagaaaactagataacagcattttctttggagggaggaaaatgtttgttaaccagcccaaattcgaaaggagcgaggaggccataaggaagcaaaacaataacaatatgcctgataatgtcaacttgcaaggcgagtgcggcttcgccgggaacgagtatcctctgcaaccagaaggaagaatttccccaactcgcagaggttgcgaagagaccagtggtcctcgatatatcaacagcgcagaaggagtggatacagaatgcttgggtgggtcgtttaaaaaatatcgacatgtcatcttccataacctgcaagagtctaaggccacgcagattatacatgaggagaggaagaacgggtccactccgatcatggacctttaa

SEQ ID NO: 67626 - DNA, 690 bp, Glycine max
  Peptide Sequence Number=SeqID_159311
atggctttcgctccttccaattttgtttctcagccatttcccaattcggttgcagagaaacttgatgactccaattatctgcactggcatcaacacgtagagccagcgatcaaatcgcacaagctgcagcgatttgtggttaatgttgtcgttccttcgcgttacctcaccgaagacgatcgcatcgttgatcgagttaatccagaatatgaaacccctgggaggttcaagaccaaacgcttcttgtttggcctccactccaaatctcgtgcgcgacaacttcgatctaccatgcgtgctgtcaatcttgatggaaaatcaattgaggaatacttgcacaaaatcaaaggctacgttgatgaattagctggcgtgggcgttctggtttgtcacgaggagtatgttgatgcactcctcgaagggttaccgactgatgttagctttcaaccacatgagtcgctcactctttttgatcctactacgatgcatcccattccttattcagctggtccacctagaacctctaacacttgggttaatcccaattctaagtcaacaggctcagttcataatcagcccagtgccatgctcacaaacttagcctctcatgggactgctccagctggctccacttggataccagattctggagctagttttcatgttattggtgattctcaaaacatttag

SEQ ID NO: 67627 - DNA, 1797 bp, Glycine max
  Peptide Sequence Number=SeqID_159312
atgtgggaaatcttcattcccaaacagagaaacaaagaagggaggaggtatggattcatacgattcaaaggagtttccgacaaaagaagaaccgaaagatacctagataacattattgtagggggcctcaagatgcatgtgaacattccgaaatacaggagaggaaaggcgagccagaaccaaaacaaagacaaacacaagaagcaaggggagggcgtggttgatatggatcaaatggaaatagctccgaatagggcagcacatagcacggcagtcaataggacgtacggagaggcagtggctccgcatacagagaagaccggacaaagaagaatctcaggcacccatttagcagagtacgggggatcacactcttcgctcatccttgacattccgaagggagacaaaacatgttacactgacgcatgggtaggaagaatgaagaagccagagattttcaaaagacttgaagacgaggtttcatggaccttaggtccaggtgtatcacccaagtatctaggtgatgacatgatcctccttcttgggctctctgatgagaaagcagcagagataataagcgaagaaactaaccaaggctcaaccctgttttactcgctggtgaaatggagctcggagttgcgaccgggaaataggttggtctggcttcgatgttggggtattccgttagtagtgtggaagttggaaaacatccgcaagattgtggcgacggtaggagatttggtggaagttgatgatgatgtagaacacatgcaaaggcttgaccaggtaagggtcctcgtcagaacacctcggccaccattaattcaacactcagtggccatacacatcgaaggagatattcatcgtgtccatatggtggaagagaactgcagcgtagagatgtcttgtgcccaatatcgcaggagcagttgggattcatccgaggagatcgtctccgacgaaggcgacacagtaacccctcggtcatggatgagcaatcacttgccgaaaccagtcggcgacgaacacgacgacaactgcaatatctggcagtccgcaacgttacccagtggtcacaatgttgaagatgacccactgggtaacgactgcaccaatagggcacactgcccaacccatgtgtcgcatagtacaggaggctccaaggggaaagaattggagcctgtcgaaggatatctgacaatccttcctgcaggttacggagaagaggatgtagatatcgtagggccagaagctaaggttgcgggaaagaggaaagaagctgccagatcatcaatgggtggtactgaaacttgccttgaagagattatagctgaccctacccttggtcaaaagatggacagcatttatggccacaacgggccacacacgcttgaatttgaaaattcacgtgcccccaacgtgaagaactcaaaggaaaatgaagcacacttatttttcctctgcgacaaaatactccctttatggtgggaatcatggtcgtgggtgagaattcaaggtgtcttcccgcataacccaaggcagcatttctcccaacatgtgaattgtttggccaagggtattagggatatcagatggaggtgttggtggctgacccttacatgggcagtgtggcaacacaggaacaatataatcttttcaaaccaaacttttgatggcaacaaggtgatggacgatgctatatttacactatggacgtggttgaaggtttttgagaaggattttgctcttccctacagccattggttgtctaacatgccatcagcttttgtttattag

SEQ ID NO: 67628 - DNA, 273 bp, Glycine max
  Peptide Sequence Number=SeqID_159313
atgaagaacggacaaagaacggaggaaaaccttcacggatttgcttacggaaacctctcggaagtgaaaaaaggggaggaggttgccgtccagctcgcccaggtgagctgggttacttccaccagaagcaacctagcttcgaaaaacagtctggaagggttatgggaattttacggaagcattacggatctcccagaagactattttttaacaaaacgggggaggtggttgccacctagctcgcccaggcgagctaggttgctttcaccttaa

SEQ ID NO: 67629 - DNA, 387 bp, Glycine max
  Peptide Sequence Number=SeqID_159314
cattgcacgcctaggcaggcgcagggtgatgcacctcaggccacagacgcacagctaccacctcatcaggctgatcccactcggtcactaggcatggagcgttatctacaacacttggttcgccagcaggcgacaaaccatcgggggcaagtgcagatacatgagtgtctctaccagctcagccacagtcagcaggggcagggttttgctccttttgcgtgccctactccagagcagtttagggctgaggtcgcatggaccggagattggcccgaggcccaggcaggggaggcgcttgcaggagctcccggtgatgcagaggaggcctgtatggatgaggagatgacagacttgctcgatttcttaggaggaagtggagccacgtga

SEQ ID NO: 67630 - DNA, 870 bp, Glycine max
  Peptide Sequence Number=SeqID_159315
atggatacgtggttcactgatgaaaacaagaagactgacttcaagatgatctgtgtcctgaagaatgtgagaatacccaagattctaaacttggaatggttctctaagcagggatttaaattttctaactggttcaaagcacatggtctgtcgacatgggtgcaaatgaaaggaaccttctaccttgagttggtaaaggttttctacagatgtgtccatgctaatatggaaggcaatttgtactctactgccaatggtgtagagataatcattgatgctacaatttggaaagtagttgtaggactagatatgggtggagtccacaaatttgaggaatcaatggatggctacaacaagatggagacgtacagaggtatgcttcttgacccaacaaggattctaagaaaccgcctaggtattggtggtttgacagctgaagatagaatgttagtgtatctcattgcctacattctagtaccaagaacggacgaggactccaagcagtccattatcaacaaagaaaccttcatcgctagacaacaacactttagtgttgtcaatttgaaggcaataaaggttgacattaggaggaacaatcctattctactagtggcccaggaggacgatcctcagatagcagaaaggcaaagtccaaagcaaaatgcaagcccaacaacaagaataggaagaagacattgtttccaaaaagcaacagacgaagaagagcgcccacatctggaacccatccaacgacaacatgaggtagtgactccacctcaatgggtaaagtatgaccatgtccataatccattagctgcatacaaggctctgcctctaggtgccatagtggttatggatactccttcatag

SEQ ID NO: 67631 - DNA, 228 bp, Glycine max
  Peptide Sequence Number=SeqID_159316
atggaaggagattctattggtcaaggtgatctggggaggagcggaaaacagccacttcttccttcttctcttcccctaaacccttcccaacgccctaagctgcttctccaccacccacgaccatcgatggccacctcaagccgccattgtttgccgttaaacccccacaccaagaggaacactttagtacaaggggaatcttcaaaacttatctcgaggattcggtag

SEQ ID NO: 67632 - DNA, 501 bp, Glycine max
  Peptide Sequence Number=SeqID_159317
atgtcacggaacttcacagattgcttaacgatgggtgtcaagttcctcgaagcggtcaaacaaaggaaagaatacgctttacggtgcccttaccaaacgcgtgctagagctagactaattagtgaaatagaggaggtgcaagagcagatggaggccgacatggaggccatgaaagagcaaatggccataatgatggaagccatgatgagtatgaaaaaagtgatggaggttaatgcggctacagtcgttgctgcaagtaccgccacagaagtagacccgactcacccatctggcctcaatataggaggcgaagcgttaggaagtacgggcggcccccattttgtgcaagttcagaacaagcattccttcccaccatatggcttgccttccaactatacaccacccaatgttgcacacactcccaatgagaatgttgacaactctgcatccatacccattgagagccaacaacctcaatctgatcatgcacatgtctcttaa

SEQ ID NO: 67633 - DNA, 2640 bp, Glycine max
  Peptide Sequence Number=SeqID_159318
atggatcatataaataacgaggctagtgttgacccttttgcgattggcccttctagcattcttggtagaacaattgctttcagggttctcttctgcaagtctatctcacaattgaggcatcatatacattttgtgttgttggatatcttgaaaagattttggggattttggggacccattgtgtcatggttgcatccaagaaacccgcaggggatattggcaatgatgacaataattgctgtcttgttgaaacgttacagcagtgtgaaggtgagggccgagatagcatataggcagaatttttggagaaatatgatgcgagctgcattgacctatgaggagtgggctcatgcagccaagatgattgatagagagacaccaaagatgaatgaatcaaaagacctttatgatgtggagttggtgagtaacaagcttcaagagcttcgccatcgcaggcaagaggggtctcttagagatataatattttgtatgcgtgcagatcttgttaggaatctaggtaatatgtgtaatccagagctacacaaaggtaggcttcagatgccaagactaatcaaggagtatattgatgaggtatcaactcaattgagaatggtttgcaactctgattcagaggagcttgcattggaagaaaagctttctttcatgcatgaaactagacacgcatttgggaggactgctttgttgttaagtggaggtgcttcccttggagcttttcatgttggtgtggttaaaacactggttgaacataaacttttgcctaggataattgctggttcaagtgtaggatccattatgtgttctattgttgccactaggtcttggcctgagctccaaagcttttttgaggattcattgcactcattacagttttttgatcaaatgggtgggatttttacagttgtgaagagggtaacaacatatggtgcagttcatgagatcagacagttgcaaatgttgttgaggaatctaacaagcaatcttacatttcaagaagcatatgacatgacgggtcgaattctcggaattacagtttgctccccgagaaagcatgaaccacccagatgtcttaactacttgacttcacctcatgttgttatatggagcgcagtcactgcttcttgtgcctttcctggccttttcgaggctcaggaattgatggcaaaggatagaagtggagagattgttccttaccatccaccatttaatttgggtcctgaaaagggttccacttcagtgcgccgttggagggatggtagcttggagatggatttgcctatgatgcaattgaaagagctcttcaatgtcaatcattttatagttagtcaggccaatcctcacattgccccattattgagattcaaagaaattatccgagcttatggagatacaagtatagtatataaatatccggtggatacaagaatgtggattaagattattacccgcgcagctatggggccgggcatgacttccaacctcaatattgactggcatcttgctcatctagcagagatggaggtgaaacatagatgtaatcaagtactggaactcggctttccattaggtggactagccaaactgtttgctcaagactgggagggtgatgtaacagttgttatgcctgcaactcctgcccaaaacccttcttatgtagagcttcaaaaggcagctaaccaaggcagaagatgcacctgggagaagctttcggccatgaaagcaaattgtggaattgagcttgctcttgatgagtctgttgcaattctcaatcatatgagacgactcaaaagaaatgctgagagaactgctgctgcttctcatggtcttcccagtacaggcaaatttagtggttcaagaagaattccatcgtggaacatcattgcacgagagaattctacaggctccctagaagaccttcatgctgctgctgctgctacttcctcattgcatcaaggtgttattagtcccagtggagccactggtaaaaattggaagtcccaccgtagctttcatgatgcaagtgacagtgaatctgaaagtgctcatgacttgaattcttggaccagatctggtgggcctttgatgagaactacatcagcagatatgttcattgactttttccagaacatagaagttgataccgaactaaatagaggcaaggtgacaaacactaccactagccctcgtgattttcagcatcacatttcaaggcacacaacacctgatcataataggtggtgctctaagagaacagaaatcgatcagaaagaaaatggcaacaggatgattgccatgaatggatctaacataatggtaactgaaggtgatcttttacagcctgaaaggatccataatgggattgtgtttaatgttgtcaagaaacaagactttttgaccccttcaaataggaataatgattataatagttgttgtaacaatgaagttgctgaatgtgtacaaattgaatttccagggaaggaggtggatgctcttagttcagcttccgaaaatggcgatgatggttccacaatggccaggtccctaactgaaaaaccagattataattcaacaaatcatttcagcaaagattttggtgaagatcaaagcattgctgacaattaa

SEQ ID NO: 67634 - DNA, 300 bp, Glycine max
  Peptide Sequence Number=SeqID_159319
atgaaccaaaacaccaaccagggaagaaattttctagcaaagaggcctatagaattcaccccaattccagtgtcatatgctaacttactcccatatctactcaataatgcaatggtagccataaccccagccaaggttcctcaacctccattttctcaaggatacaactcgaacacaacatgtgcttatcatggaagagttttggggcattccattgagcattgtatgaccccgaaacataaggtgcaaagtctaattgatgcgggctggctaaaatttgaggaggataatcgcttgtga

SEQ ID NO: 67635 - DNA, 330 bp, Glycine max
  Peptide Sequence Number=SeqID_159320
atgttgcagtctcccctttaccatccagagacaatcaagtccgatggcacgtggaaaccattaaggtcatctgccacctttgctatccagagacaatcgagtctgatggcacgcagagacaaatatggtcatttgctccctttgtcaaagactcaatgtctttcaatcaagactattaaagtctctcctccgtcatccagagacagtcatgtccgatggcacgcagagacaaatatggtcatctgcccctctttgttgaagactcaatgtctttcggctgagactattaaagtctccccttcgtcatccaaagacaatcaagtccgatga

SEQ ID NO: 67636 - DNA, 231 bp, Glycine max
  Peptide Sequence Number=SeqID_159321
atggctccgagaaagctccccgccaagaggtctaggaaagacacaactagggagggttctagtgcggccccaagggtcgatgtggacttcgatagacacaggttccggagtgcgaaacaacagcagcggtttgagaccatcaaaggttggtcattcctcagagagagacgagtccagctgagggacgaggagtatcctgagttccaaggggagatagctcggaggcattag

SEQ ID NO: 67637 - DNA, 210 bp, Glycine max
  Peptide Sequence Number=SeqID_159322
atgttttcaaaaggcgataatgaccttcacttacatttcaaagacgacaatgtgatgcaagctccattggagcttgtaggcctaggatcttcttcatcaatggattcctttgcttcttggaagatgaatggcagcggaatcgagaaggaagagagagaggagatgccacttcaaggagaagatgagtctagaagaagctcaccaccatag

SEQ ID NO: 67638 - DNA, 390 bp, Glycine max
  Peptide Sequence Number=SeqID_159323
atgggggctgaggaaggggttcgagcattgagtattgaaggaattgagagaaataagagagaagaagaagaaagaagaggaaaaaaggtcgaagtgctgccgaatcgtgactgtaatcaacctctacatcattcttcgttcggtgttcttcgtttgtcatttgggggtgctcttcagccctgggcccatctaggcccatcaggaagcttctacatgaagcaaccagctcgcctgggcaagttgggtggcaagcccctcccctattttggctataaaagggcatgggaggttgaaggaaggggttcaacaccctgggcaagcatatttcacttaaaattagtgaaaagaaggagaaagaagaagaaaatcaaggccgaggcacttccgtaa

SEQ ID NO: 67639 - DNA, 777 bp, Glycine max
  Peptide Sequence Number=SeqID_159324
atggtgtgcaaaggttggagctttaatggagtttcaatggaggatgaagaagaaagaaaaagcaacttcctcgcgtttctccgcgcccgtcggggccagttttcgaaagtaggcaatatatatatcaaaacgcttagaatgaaaccccgagcgtggttcagaggatgtcacaacggtaggaattgggttcaagctttctccaaccccttcttcatcaatggactcctgacgtatacgaaggagtgcggttcgttcgataaattcctatctctttatctatttatgagatgtttggatttttcaaaactccatggacatgcagaagagaactgttattcccacttggaccacagccacacgagaagtgaaggaagaagaagaaccataagagaaagaagaaccgcaagaggaagaagaagaaccacaaacacgaagaaggagaagaagaagaagaacgatgacaagaacactggaagaggaataagcggatcagaggaagatgaagaagcaactgtaggcagaagagaaggaaacgtgttgtacggacgaataagtaggagtatttatagtattagggtgaaggacatttttgtcatttcaccatgggtgctgggtgccctaacaaaaatgttgggtgcaccaagtaacaccccacttcttaatatgaataggcctttaaataatctaatgggtcgtacaaacttatataaaaatcatacatatccaaccctaaaaggtaagctcttgatgggtaataggcccaagcttaggctatag

SEQ ID NO: 67640 - DNA, 318 bp, Glycine max
  Peptide Sequence Number=SeqID_159325
cgttcctttgctataggtgttggtgcagtcacttcatttggttactgtaaggatcgtgatggtcaatggctgaagaaggacgcactccctccacaagacgagcgtactccttctcctcctcctcagcgagatgattcagcccttatgactgaagttctttcagagttatggagtctccgcacttatgttggtgaacgattcgattccttggatggttgctttgaaggcatggatacctgcatcacccagcttgaagagaatgtcacttatcttcgtcgggggagagaaatggggtggtatagtggtgtaaaagcttag

SEQ ID NO: 67641 - DNA, 230 bp, Glycine max
  Peptide Sequence Number=SeqID_159326
tggagtcagttcaagtgatagaggtgtcatcctctgaaggagatcttgaagaggacccagaggagttacctcttgaacctgttgtggatgaccttgacttacctgaggatgatgaagacccactccctaatgttgattccctagaggatattatgtcagcatttgaggcagactctacagaggagagtggccctggagggacaacgaatagtgacgactctttatcatag

SEQ ID NO: 67642 - DNA, 399 bp, Glycine max
  Peptide Sequence Number=SeqID_159327
atgcttagagttttcttgtgtgcaaggtatcaggctaatcctgaggaatctcacttaacagttgtcaaaaggatcattaagtaccttaaggggacaaccaatgttggtttgttgtatcccaaagatgacgagcaacccttccagagctcagaagaaagccaagtcctccaaaaggaagcaaggagagtgctctcaatagacttgatacatggtttacggatgagaatgaaagaaaatttttatctgaagctgctgaaagtcttctatacttgtgcccacgccgatttggaagaaatgattatcgatgctgaagtttggaaggtagtaaccagactggacatgggtggagtccacaagtttgaagaatctattgatgagtacaacaagatgcaaacttaa

SEQ ID NO: 67643 - DNA, 549 bp, Glycine max
  Peptide Sequence Number=SeqID_159328
atggcacgttctctagacaagataaagaacatcgatggctcaaaggaaactcttaaacttactgtgaggatcactgatctatggtttattgggacacctaacaaatctgagcaagctgggatggtttttgtggactctgatatttattacttattgttcaggccattgtgttgtaactttaacgcaatccagggtgatgagatccatgttgtttgtaaacaagaccaattgaagtcttggaagatggacttcaaggaaaattgtacttatgtcatgcacaattgtaaagtgctaaaaaacaacgatcagtacagagtttgtgatcaccaatttaaattggtgtttattggggttactgttgtaaggcagtgtgttcaagaggacctcccttttagaaaatataggtttgctggatttgcggatgttgtggctagccagtttgaacctgggctattggttgatgttattggtgttgtggaggaggttgtctttcgccatgtttcaggaaaaggtagaagggtagtctttaaactaaaggacttgaggtaa

SEQ ID NO: 67644 - DNA, 855 bp, Glycine max
  Peptide Sequence Number=SeqID_159329
atgttggccatttggagcatgattcttgttacagcttcaactattgtctgtcatcttagagagctggagaagtcaaaacctgtaattttgactggtgatctaaattgtgctcatgaagagatagatatatacaacccggctggcaacaagagaagtgccgggcttacagatgaagagaggaaatcatttgcaacgaactttttatctaggggatttgtagatacctttagaaggcagcatcctggtgttattggatatacttattggggttaccggcatggtggacgcaagtttaacagagacacgcgacggacacgacccaacctatattgtgaatacgccgtcgtggccctccagcgcgatagtgcacccagcaattcaatgaacttccaaaattgcccttcgtttaaaaatcaaaatgttctccctcccgcgatttgtgttcttcattggccttcttcccaacagtcttctcgttggctggcacaagctttggttctccattttggttccctccgttcgtcttcttcattggcttctgtgagcatttcttccgtcatcgaggttgaagacgaagttcttccgcgagaagaagcttcttccgcgcgtgtgttaggggacgaaaatggagtcagcggaagaaggtggtcttccacgagctcctgcggaagaaaggtgaaaggttcttccgcgggtgccagtggaagaacctttttagtttcttccgcaggagcccgcggaagaacaccttcttccgctgactccattttcgtgctgttacactcgcggaagaacaccttctttcgcagagtgcattttttgctcgcggaagaagttgtcaaacttcttctgtag

SEQ ID NO: 67645 - DNA, 153 bp, Glycine max
  Peptide Sequence Number=SeqID_159330
atgaaactctcaaaggtggtcaaactctcaacgtcacctctcagcaacattcgctacaagctcaaactcggtgctttgattgcaaaactaaagcttgacaacaaggccaataggacaatgatcactaccggtaacatcaggaagaatgtatga

SEQ ID NO: 67646 - DNA, 375 bp, Glycine max
  Peptide Sequence Number=SeqID_159331
atgaccactcttacccagatatggatgacgttactacttagcaatattcttcccagtgaccacaactccgatctccccctaccaaagatcgcgcccacaagacacccagtggacccggagaagtccaacagggtcctggggtttctagctctggttataggcctctgtcagttctacggagtgcccgtcgcccccagcaaggtcattaggccccctattaatagggttttcatcgagaagtaccgcgcccccaggcaggtgcaggacgaggcaccacaacagcctggggatggccaacagcgggcaacaaactcaccacccccacctctagagtccatctcatctcatctacaaaggctagagcgttgcctatga

SEQ ID NO: 67647 - DNA, 450 bp, Glycine max
  Peptide Sequence Number=SeqID_159332
atggccatcatttacattttgaagacgacgatgtcttcagtcattgcatgccttcaaaaggagacaatgtccacatttacatttcgaagacgacaatttcttcagtcattgcatgccttcaaaaggcgacaatgtccacatttgcatttcgaagacgacaatgtcttcagtcattgcatgccttcaaaaggcgacaatgaccctcatctacatttcgaagatgacaatatcttcagtcattgcatgccttcaaaaggcgacaatgtcctcatttacatgcgaagacaacaatgtcttcagtcattgcatgccttcaaaaggcgacaatgtcctcatctgcatttcaaagacgacagaaacttcatccagaacattctagatgggggtgaacttatcaattgcgggatgcgctcaggaaacttcctcacgaagcctctagagatgggttga

SEQ ID NO: 67648 - DNA, 240 bp, Glycine max
  Peptide Sequence Number=SeqID_159333
atggcatttgatgaagcgagtatggaaaggaagcttcaattgcaagaacttgaggagatcctcttacaagcctatgagaactccaatatttacaaggggaaagtgaagaggctaaaggcccaagtggagaaggacaaagcccccgagtggagaaggatgaaggcccaagtggagaaggatgaaggcctagaggcagagacactatcaagactactaattgttgctgaaggcccaaactaa

SEQ ID NO: 67649 - DNA, 198 bp, Glycine max
  Peptide Sequence Number=SeqID_159334
atgacttatcaagataatccttgtggcgtctaccctgacttatcttccttcaccggaagtggtgtctaccctgacttatcttccttcaccggaagtggcgtcatccaaaaactctacagcctgtatcaagcgatccgccccgtaaggttcacatcatctggtatcagagcttcggctcttgatacagactttgtgtaa

SEQ ID NO: 67650 - DNA, 1038 bp, Glycine max
  Peptide Sequence Number=SeqID_159335
atgggagcacgaaagagactctcttcttccgagcctcattcttcttctcctgcaacaaaggaaaacaccacaaccaccaaacccgaacaaaaaccaaccacaacagaccctccaattgcgcctcctaaatggggtcttcttctgaagctctctctcttcttcttgctcccttactcgtatctcctcttccgctactatcccatcgagccggagctccgaagatcgatcctcatcaacgctggaatgagcctcgcgggtctcttcgtcacggtcaagatgatccccgtcgcgtcccgctacgtccagaagcggaacctctttgggtatgacatcaacaagaagggcacccctcagggaactgtcaaagtgcctgaatcattaggtatagttgttggtattgtgttcttggttgtggcaatcttgtttcagtattttaacttcacatcagattcaaattggcttgttgaatacaatgcagcattagcgtgcatttgtttcatgacactgctaggatttgtcgatgatgtccttgatgtcccatggagagtaaagttactactcccatcaattgctgcacttcctttgttaatggcatatgctggacacacaactatagttataccaaagccacttgtcccacacattgggattgaggttttggatcttggatggatgtataaactatatatggggctcttggctgttttttgcacaaattccatcaatatacatgctggaataaatggccttgaagttgggcagacagtggttattgcatcagctatcctgatacacaatattatgcaaattggagcatcaacagatcctgaatataagcaagcacatgcattttctatttacttagctcagcccttgctagctacctctttggctttactttcttacaactggtatccctcttcagtttttgttggtgatacatatacatactttgctgggatgactatggctgtgattggtattttaggccattttaggcatagaatcatagatatactggggactctaaatttgtga

SEQ ID NO: 67651 - DNA, 402 bp, Glycine max
  Peptide Sequence Number=SeqID_159336
atggagattgtgaagcagagatgtgattatggagctaggagcggtgtctcaagatcaaatgccagttcatcattgttccttactagagacagcagaacccaccatgacaaagaaaatacgctcttagtgaggaaagtctttacggagtcagtccttagagtaatggatgaccataattggtacttgggtgatgattgtaaggcatactccccaaaggaggaagagaagaaggtccctgctgagagggattgggagacacttgaccaagtgattcttgacagtggggagacaaccattagagaagttcctcaggaagtagctggatggttgatcaaggagagtagtgaggaggactcagaggaacatatgcatgaaatttcttcacaggaaccctactgctag

SEQ ID NO: 67652 - DNA, 693 bp, Glycine max
  Peptide Sequence Number=SeqID_159337
atgaatcaattctccccaaagcttaagcttcttaatggaggttggtggtacaggccagaatatatcatcaacgagttgaatataaactccgtgataactaccccttgtcacgaggagatcttgcccatcaactcatggactacacagaggccttatcttcgtgctggtaaagtcccatttgtctcatccgaggccattcatcaactccatatatttatcttcgtgctagctgtgtttcatgtcctttactgcattctcactctggctctaggtagagccaagatgagaaggtggaaagggtgggaagtggaaaccaagacagcagagtaccaattttcacacgttctagatggtttcaattgcactgttttcacatatggtcagacagggactggtaaaacttatacaatggagggtggaatgagaaataagggtggtgatttacctgctgaggctgctgtcattccaagagcagtgcgtcaaatatttgatattttggaagcacaaaatgatgattatagcataaaagtgacattccttgagctttataacgaagagataactgatttgttgtcccccgaagacaattctaggcctacagacgaaaaacaaaagaaacctataacccttatggaagatggaaaggataatgtatttgtgagaggccttgaagaagaatcagtatacttttga

SEQ ID NO: 67653 - DNA, 359 bp, Glycine max
  Peptide Sequence Number=SeqID_159338
atggctccgaagaggctctccgcgaagagatctagaaaggatgccaccggagaaggctccagtgccgccttggagtttgatagtcactggttccagagtgccgagcaccagcagcgcttcgaggccatcaagggatggttgttccacagggagaggcgtgcccagctcaaggaggacgagtactctgacttccaggatgctctcagccaattcttgggtgacccgctgattatggaggagaaccagcagtgtaaattcagacagaggaagaaccaggtggacaatttcgatgaggaagccatcgcccagctgttgtgcataccggggcaggatttcgctcggaccactgcgggaaggcg

SEQ ID NO: 67654 - DNA, 912 bp, Glycine max
  Peptide Sequence Number=SeqID_159339
atgagttctgatgcagtagatgctacagcaagtctatctccaaagcaaaatgaaagaaagggagcatcttctatctttgttaatatagctaagaactttaaagcggggaatgcggatcagaatgcaaatcaatcagttcatactaatagactggaaaatttaaaacaattattctccagtcctcctttcttaaagtcttcctcgagcacagtagataagcaagatccttttgcgattgacatagatgacattcaaattgatgaacctgtagtcttctcatctcctcagaaaatcgatattgacaagagagataaagggaaaggaacagacagacagaaatttcttgaagaagcaagcacagacttgaaaccaaaagctagaacagctgacaaaattaaggctaaatacagaaagacgggcacatgggatgcctcggcagcagctgcacttgcaagggataaacttgtagagcggcaagaaaagctccaggctatgaaaaagaagggtgttctagtgccttatatccagaccatacaaaacatgtatgatgagataaccactagtgtaaaaactcctagtgaagagactaaggactttccaacaaggccctgtgaaaaaggatacgagatcaagaaagacaacaacaaccaagatacaactgttttcatgtatcgctgcaagaggggaggatggagcccattatttgtctacaacaggctgccaatagatgaagtttttctcaagctttcttcttctttcggctggtaccgatatcactccttgtgtctcggtccagacctggtgttatatttattatatgatcggtttttgccttgcaaaaaaataaaccaaggtcctatcccactaggtgaagtcttggcaacatggatcacacaaaaccattcaacttga

SEQ ID NO: 67655 - DNA, 354 bp, Glycine max
  Peptide Sequence Number=SeqID_159340
atgcaaccttccattacaagtccatttcggcattttcaaaccacttctagttatgctcgtgatcaaggactcaatttccacattcatattgctcttgcatacagtttcctcctgattgcagtagtaggttcggacgctttcaagccagaggatgacattatttcttgtggcactatcacttgtcagctctcccacaaattttggggacaagccaaaactaattactatccttgggggacaagcaaaaccgaaggtgctaaacacgcccacgatggagatactcacaatgaggaaggccaacactactcaaaggtgagtttcctaaattgtccttctgtttctgttgctgagtga

SEQ ID NO: 67656 - DNA, 454 bp, Glycine max
  Peptide Sequence Number=SeqID_159341
atcttctgaggcatcttctagttttcctattgcagggcattctcatatagaatctgttgaagatacaatcatggttgaagacccaagaagagtaaccctggaggattattcaagttctactgtgccacaatttttcactagtattgcacagccagaagttcaagctcaatctgttgaagatacagtcatggcttccactttgaactcgtgtctctgcagatcttcacacagcaaaatctctcagaactctctggaacttggacctttctctctctctagaaccttcatgcatgcagagcttctcaagaaaggtgccaaactcccttcacaaaatctgatttcaggcttaaatagcggaagtgctgaagaggtgcgcttgatgacctggagcaatgcacttagtgaacttgacatctcatcttcttctggattcttcctcgcgcttagccactga

SEQ ID NO: 67657 - DNA, 444 bp, Glycine max
  Peptide Sequence Number=SeqID_159342
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaggcagttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 67658 - DNA, 417 bp, Glycine max
  Peptide Sequence Number=SeqID_159343
atggggaccgtcggccttgctgcaccaggtggtctagtagacaacgatcatagatgtgaggctttgcatgtccgcttcacggcagacggcgaagccgatgcgtccgaaggagtaggaggaggaggaggaggggagacaggcaattatcaacatcaagagttctttatagaaatcattgagaacaatacttcaaactctcggggaaggaatgacataaagaccttgaatgatgaaggaatgtgtcgcaacctaccctttggcgggcgggcgagcgaggcgaggctcacgggtgcatcttccatgggaggaaaatgcacggagtcgccaccaacgtttattgaaaggaaaacgttagaaaaaccaaaggaaactggtcataaagaatattccagattcgggagttatgtttatgcttga

SEQ ID NO: 67659 - DNA, 804 bp, Glycine max
  Peptide Sequence Number=SeqID_159344
atgacttcttcagtggatgatccagattttttcttgaagatccacttgcaccccactactcatctgccttcaggaaggggcaacgaggaagaggttgaccagttgccaaaatataagtttagaataataaaggaatttaagaaagaaggcgatattgaagaatcttcaagaggaataatgacagaatcagagagtgagactgccaccgaacatgttattgccttagaagatgcagctatattacctccagagttaagacaatatcttccaactatgttgacattaagacaatattttgacatagttgctgcaccgactataagagtgattcttggtggtgcttttgtagtaaatggcaatgtgaatccaactgttgaagtcaacatatttggttattcagaggctgcagacgttgtatttacaagtggggtagatgtacttgcagtggggataaatgttacccaccaagttgtactaactgaatttatgcataagactccagtgccgccttggagtttgatagtcaccgttttcggtgtgtcgagcaccaatagcgcttcgaggccatcaagggatggtctttccacagggagagacaagtatcctgacttccagggagatatctcttgcagacattgggcacgactagtgacccctatggctaaatttgacccggagatagtcatagaattttatgccaatgcctggcctactgaggagggggttcgggacatgcgctcacgggacaggatttcgcccggaccgctgcagggaggcaggtatggatcatgcgcaccaacatga

SEQ ID NO: 67660 - DNA, 291 bp, Glycine max
  Peptide Sequence Number=SeqID_159345
ggctgggcaaagcctttctgcagcagcagcagcatcctgtatgcacaagtgtttgctgtgtcttggggcaggaaagatattgagctggtagaggaggaacaggcacggattggtgctgatccttctagtgggacctccaataaatctgagaattataagaaggaagcatggaagaaaacacagaagcataaaccaaagagggtggagagtgtcaacgctgatgcagaagcctttggtgatgactcgaaaattctgattgctttatgcattgtgaagctgctgaagcagtag

SEQ ID NO: 67661 - DNA, 321 bp, Glycine max
  Peptide Sequence Number=SeqID_159346
atgcagaactatcaacatgcaaagagatgtgattctgcaaaagccaggatcaatagaaaacgtattatgcagcagaagcgacatgctcatgctcaatcatcttcaccaccaacagttaattgcacttcagaatataatatgattgtttctgattcatcagaaagtgaaaattctgaatccacacaaggttcagactctaattttatgactcccttcgaggattgtcaatctccaactaatcagcctgtaatcaacattgaaggtaatgactataattctgatttccagtttcagatgctactgtacatgctcttaaattaa

SEQ ID NO: 67662 - DNA, 213 bp, Glycine max
  Peptide Sequence Number=SeqID_159347
atggagtcgtcaactgtcgcaacctacccttcggtgggagggcaacgcggggctcacgggtgcgtcttccaagggaggaaagcgcgtggagtcgccaccaacgtttattcgaggaaaatgtcagaaaaactagaaaggtgtggtctacgaactttaatcgtgaaaggttcgggagttgtttttacgcacggggaagtcgtggttacagtgtga

SEQ ID NO: 67663 - DNA, 483 bp, Glycine max
  Peptide Sequence Number=SeqID_159348
atgacagggtgtaaacaatctgttaacgtttggcctcaaccccatgctacaggcgcgtttatgacactctctgctgattccgcatcgtcatctgacttttgcctgagcaatgctatgcgttcttcttcttcgctgacttcacaggcagcgacgtcaggctttgtgctgctgtggggcagcgcagccattttctcgcgtctcgggctggataatgcctcaccgctggcactgctggtggcgatggcggagggcgtgacgccagggctgatcgccaccatcatgggcatccagccaattctgacgctgtgcctgtctggcggcgtcgcagctgccgatcagcggcgtgctgtttgcgctggccgcgctgctgtgcatgaccttcggtgccatcatgcagcagcgggtgacgcagcatccggcgcaggtgctgccgctgcagtacggcgtgagtttactgctgtgcctgctgttgctgccggttaa

SEQ ID NO: 67664 - DNA, 351 bp, Glycine max
  Peptide Sequence Number=SeqID_159349
atgggggagatgtttgccacccagctcgcccaagcgagcaaggtgacttcctccagaagcaaccgccttctggaggaatcttctggagggcccaataggtgtcgaggtcaccttatcgtgcataggcaactccccccccatggtgatcagcttgagtctcaagggagttccaaaccgagtgacatgaccccaagtacaagtattcctgctcatgagaaactacaactcctatgtggagcttgtaggccttggatcttcttcatcaatggagtcctttgcttcttggaagacaaatggcagcagaatggagaaaggaagatgattggagatgccacttcaaggagaaggtga

SEQ ID NO: 67665 - DNA, 195 bp, Glycine max
  Peptide Sequence Number=SeqID_159350
atgaatgaagaacggatgaagaacggtgaagaacagctggatcttcacgaaattgttcatggaaacatctcggaagcgttacagaagcacatcggcttggattttcttcacggaaacaatttttttcacctaaaacagctgaaatgcatagccaagagggaaaagggagaggaggttgctgcccagctcacctag

SEQ ID NO: 67666 - DNA, 887 bp, Glycine max
  Peptide Sequence Number=SeqID_159351
ccttcagaggactacacatcctacctttcagaggactacacgtcctccccttcagtgggctacacgtcctcattctcagaggactacacgccctcgccttcagagaactacacgtcctccccttcggagagctacacgccatcgccttcaaaggactacacgtcatctccttcattggactacacgtcctccccttcaaagagctacacgtcctcgccttcagaggactactcgtcctcaccttcagaggctacacgtcctccacttcagagacctacacgcccttgccttcaaaggactgcacttcctcccctttagaggattacaagtgctcaccatcaaatggctgcacgcactcgcctttagaggactacacgctacacgtcttcaccttaagaggactaaacgtcctcgccttcagagcactacacctcctccccttcagagagctacaggctgtcgccttcagaggactgcacgtctttgcctttagaggactacacgtcctcaccttcagaggactacacgtcctccccttcagaggactacacgccctcccctttagaggactacacgtgctcatcttcagagggttggacgccctcgccttcagaggactacacgacctccccttcagaggactacacgtcctcaccttcagaggactacacgtcctcccctttggaggaatacacgtgctcaccttcagagggttggacgccctcgccttcagaggactacacgacctcccctttagaggactacacgtgctcaccttcagagggctacacatccttgccttcagaggactacatgtcctccaattaaaaggactacaggtcgtcgccttcagaggactgcacgtcctcacctttagagggctacac

SEQ ID NO: 67667 - DNA, 531 bp, Glycine max
  Peptide Sequence Number=SeqID_159352
atggtagataaaacccaaggaaacaacaaacaaggggaaggagaatggaaaggacatgatatagtagttgtggaaaatggaagagattgggtattgaatagctttgttggaaggctaaaagatcttcagaagtttgataaattatgtaatgcatatgctcttataggttctaccatggtgaagatgaaatatatacaggaaaatatggtgctcattacagggttgtctgaagagaaattggtggaaatggccaatcaaagtcaagtgaagaacataccaccatcaccaattagtgcagatgcgagatttgggagaaacattcaaaaaaagggaccgcctcctcgatggcaagcgatgtatggtatgaaatccattcttttagctcagaatgtatggaggaagtggatggtgggtggaagcttcagcaagatggtgaagggggactgtgaggcagtcaaagatgtctctgtcaacaatttctctaatgactttttacattgccataaagaagcacatcaagttgtagtataa

SEQ ID NO: 67668 - DNA, 136 bp, Glycine max
  Peptide Sequence Number=SeqID_159353
atggatgattttactgaggatgaggatcaacagttctttgatcacaccaatcaccaaagcgatgaccaaactgatgacgagggtgttggcaaaccacgacacctccgtcacctccgttgcaatatcagcaacctag

SEQ ID NO: 67669 - DNA, 1191 bp, Glycine max
  Peptide Sequence Number=SeqID_159354
ggttataggaagagccctgggagagaagtaaattgtgattcagatgaagctcctcagcggcaaaggcctacaacacctgtacgtaggcaacgggaagctacccttgttactaaggatgttcatcacgtggatgacgcagctgatgaggtccacgaacagcctcaagaagcaactgttgatgatgaagttgttgatgcccagggtttttcaggcgggccgcatgacacatcagttctaacagtctatgttgatcatgttgcagtcattgtttggaatggagaggaatgtcctgaattgaagctatcgtcccatgaaaggaaggttcagaaatccggcaggcctactacaacgattgaaaaattagttgttgtcgaaacatgcaatttccatcttcctgtaggagaggtgactatcaccctcgatgatgtggcctctttgcttcattttcccatcacaggcgccttccacagcttcgagactcttcatgttgatgaagcggtgttgctgctagttgaattacttaaagtgagtgcatatgaagcaagaggtgagacaatacgctcgagcttatctgttgcatttgctagtgcactctttttgctaacaagagtgcaacacacgcgcatgtgggtgttcttggacacctttcaagacctcacccagagtggaagctacgcatggggagctattgccctagtgcatatgtacgacaatttgaatgatgagtctaagagcagcggcagacaacttgtcgaatatatcacactattacagcatttttcatttgttgctgaggctattactgccaaagattatcatgaaaggaaaccatgtgcctaccaatggacctcttggaaggcattatcagtgttgacgtatcgaaaacgtctagatcgattaacgtctgatggtgtttgttggatgccttacagtgaccaccgtgtagttagagaattcgagctaatttctttattttttggatatatccgatggggtccagttgtcatacaccgaccagagaggattgtgcgacagtttgggtatgttcagactattcctctacattctttgggttcaagattatgcttagaagatattgacgacatatatatgcatttctctgattacctcgcactggtggatgagatttgtgttgtgcttggacaatgtacatcagactacatcaactga

SEQ ID NO: 67670 - DNA, 648 bp, Glycine max
  Peptide Sequence Number=SeqID_159355
atgatgacgactaaggccgcaaaggaaatcgctgagaagatcgattcctttgaggagcagccacacagggatccttcgtcccccatggatgtcaggatgttctcaccgctgctattggacgtccagagcaccctagacgtgtccgtgctgctggagccgctcttcctccctgcctcccaaagaattgcaatagttgacccagcaaatcagggaccaactagaggagtccatcacagaaaaagtgacgcgacaactcatggcatccttcagccagatgcagtcccagatgcaatctcaaggacttgcaccgcctccccaccctctagaaacgatcctgagacgggtgactctgataggtgtggcttgtacatagaagcagatcctgcccgcctggttgccatggggagagtttatgagggagccattgttgtttataacacttctttgttgcctggccaagtaaaggtgagcacttcacaccttccttgcttggctgacacatctggtcaagtccttatcacagcagctgtgtctccggcaaaaccaccttcaaagcccgatccggaggtcgatgatccgctttatctgatgacattgaccatcccagagcttttcttgaggccttaccagttacatggatgccaccct

SEQ ID NO: 67671 - DNA, 213 bp, Glycine max
  Peptide Sequence Number=SeqID_159356
atgaactcgctaagcgagcacgttgcgctaagtgagttcatcagtactcattccgagctttcctgggccaagcgcgataggttgcagtatccactgaagcgagcttcactcgctaagctcctaacacttagtagaatttttgaagagttggtgccgctaagcgcagccttcaaggagcttagcgcaaatccttttggcagatgttcagcttag

SEQ ID NO: 67672 - DNA, 325 bp, Glycine max
  Peptide Sequence Number=SeqID_159357
aattacctcaaacacttgtgcttatgcgagaaaaagggctgtgaggattaagcttgatgaaccttccttgatacctgtcatgcttgctagcttatttcatttgggctacttaatgaacatgttcatatctttgaagccaaagaatagaaggtttaagcagccgatgactcgctcaacgaggcaaatccgctcagcgagatgcatccacttagcgaggaatccagctcacttagtggattgggaaactgatgcaatcctacccccaaagggcattggattgaagacttcaagaagattgggccaaagatgtaagagaaggccctag

SEQ ID NO: 67673 - DNA, 462 bp, Glycine max
  Peptide Sequence Number=SeqID_159358
atgtcagttataaaattgtacatagaaaaggatgttgttggtggttctacatttctttctgcaaattctgttagatcatgtggaaataatttatctaatagtgaattggaaccgccaagaaatgtaagcaatttagatgatgatgaagatgaagatgatgatgattatcttgtgtctaattcatacattgaagaatctttaggtgaagatgatagtgttgatggtatatctgatacagatgatgaagtcactcacatggttgaaccagttacaatttttcaaccaagagaaggtgtagaaggaattcaaaattcattttggaatgatgttttgcattataacaatatcaattggagtcatcctgatgaggaggacatttgcggtttggagatgccatcgagttttaatgttggacaagaattatatgttggtatggattttgatagtaaagatgcgacatga

SEQ ID NO: 67674 - DNA, 321 bp, Glycine max
  Peptide Sequence Number=SeqID_159359
atgcagtatgcggatcacttactacctgcgggtcagctttgtctagtgcctgggcaagtatctacggattacatggagtgttttttccgcatatctcacccattcatgataccgacccaggcagttgaccaaccgagggatgcaccagctacagaccctgaggactacatacagccgcccagcccccaggttccagtagcatttgacccccctccacatgtggatgattacgagggatatgaggcgattgcacagaggttggagcgtgtgctcaaccttaggatagtcactgcgggcacagagttatatgacattatgtag

SEQ ID NO: 67675 - DNA, 144 bp, Glycine max
  Peptide Sequence Number=SeqID_159360
atgcaaagggtatttctctcagcttcaacttgttttcgtaattcccaacggtttggtggtatgcgggaaaaagagaaggttttgagaggaggagaagggaaaacgaaattgagagaaagaggaggcgtagaagctatcgtctaa

SEQ ID NO: 67676 - DNA, 540 bp, Glycine max
  Peptide Sequence Number=SeqID_159361
atggacacatgggtgtatttggacttgaagatcccaatggctttgttacccaggatgatatactttgttcacttgcttgaaaaatactattgtagtgatgagcatcttgaaaggaagattctagatcctgagcgcttgagtagggtggaatcaatttttggcaatctttcagaaaccatcaaaatatatggtccttggtcttctgcatgggtaggagaagctggaggggcatacaacagtggtggcaatcatgtttctaacagatttctaaacagcttttggtacttagatcaacttggaatagcatcctgctacaacactaaagtctattgcaggcagactttaattggagggaattatggccttctcaatgccaccacctttgctcccaatcctgactactacagtgcagttttgtggcatcggttaatgggaaagaaggttcttgcgatctcaagtgatgttcatattaaagacttttacctacagttagaaaattttttgtccgtaggtttagctctccctatggcgaggaactaa

SEQ ID NO: 67677 - DNA, 264 bp, Glycine max
  Peptide Sequence Number=SeqID_159362
atgcagttaaaagtcatactatttcttgatattaaacatccaatcaattgcaaaattagcagaggtatgtacaaaaaagtaattaagttagtgtctttgagagctctcgttctgagattggtggtgaaccatggtgttagctctcaactgcgagagaagctgaaacttgagattgagaagttcttcaagctccccattgaagagaaaaagaagtaccaaataagagcaggagatgttcaaggctatggaactgtgataagatga

SEQ ID NO: 67678 - DNA, 408 bp, Glycine max
  Peptide Sequence Number=SeqID_159363
atgagaatcaactcagaggcagctgctggaaaaatgaagcacaaggccaaacaaccatttagtgaagagacttataaggataagaagaatgaagatattgatgataatgtcattccctccttaaccacaggtttccttggtgttagaaaggatgctaagaaacatggaaagagagaaggcacactgaagttaaaggagaaggataatattggtcttggagaagaagggaagctgctgaatgatgagaaggtttcaaaggagatggatgatcttttggcatgttatctgactttgaatgcatatgagtatcatgatctcatcatcaaagtgttctggcaggtatggtctgacatgaggcaaggtggtttaggtaataaactaaacatgcaatggagttactatgaataa

SEQ ID NO: 67679 - DNA, 1776 bp, Glycine max
  Peptide Sequence Number=SeqID_159364
atgtcacaaggttcgtttgtcccccagggtcgtgatgacatacttaacaccgccatagggaaaccagatcatggaggtcgtgttcgtgcgacggggtctggggtgacaattagtcaatactatgggagggcatcacgtggttccagttcgtcatccatcaccatctcccaagaacagatgactgagctaataggaagcattagggaacaagttaagaatgagtttgcagaagaaaagaggcgaagtctagagacatggaaaaaggaggtgaaggatgccattattattgagatgtcacaaaaggtatcgcacctcacaccgcctactcacgtggatataaatgtgttaggtgcatgcgtgagcactaaggagagcaatgctgaagttgctgtcaaccgatctggggaagaacaagttgggcatatgacacctactatggggttggagcctctaccatacattgtggcatatgcagatgatgtcgtaagggttagcgttgacaaagtaattgatggtgaaactgaagtcccatgccccacatccgaaattaagtatgtaaggcaggcccttaacacaatcattgcatggccaacacctcttgtaaaactggtattagatgagcaagtcgccgaatctgttgatggggtcaaagatgttgttgtgcaggaccccttgcgtgagttgattaagtgtctggttgacatttatgacaaccctgttcagtttgagtgggatagtagtaaatttggtattccaaatgtagattcaaagttgttattaacatatgccgatgtgaacgaaataacaataggggacaaatggttgaacatagccatacttcagttgtggaccattagtaccttgggtcatgtatcgctatatggattccttgagcctcaatcaatacacaacgcaaaggacagacgtgggcaatgtgaagaatatattggaaaatggcttaaggaatctcagcgacaactgtacttaggagcttatctgaatcaggcccattggcaactgattgttttgtgtcctacaaacaatcaggtggtatggttttgttcaatgcggaaaaggcctgatgttcatatcaaaattgcaattaacaagcattacagacgactgatgacggcaaagttcctcaaactacaccctagtggattgaagttaagtcacgttcaacgaggaggctataagtgtgggtattatgtgatgcattggacgtggaacataattatcggggagttggagactgattggagtctagtacctaatgatgattttgaaggaattattgatgaaggagttgccaaagttgttgctggtttggctcttttggataagtcatggcgtgttcgttacatggttgctaatcaactatatgagctatgtgaagctgttggtcctgaccccaccaggtcagaattggtccctgcatatgttcgtctgctgcgtgataatgaggctgaagtacgtattgctgttgctgggaaagtaactaagttttcccgcattttaaatcctgaccttgccattcagcatattctaccatgtgtgaaggagttatcaacagattcatctcatcatgtttgctctgcactggcttccgttataatgggtatggcaccggtgttagggaagggtggagcaactctcttggatatagcatgtgaccctgagttggtaaacctggccattgacttaacttcttgtccggtaaattcataccttcttatagacgtcttagccactctgattatatggttgtggacatga

SEQ ID NO: 67680 - DNA, 372 bp, Glycine max
  Peptide Sequence Number=SeqID_159365
atggctgttatcacttccaatcttttcacactcagtactacccacaatgcaaccataactaaattcactaatcgtccaaactcaaaaaaaattctaatattcaataacattgggatgatgttgtttgctaagacagcaattgctatgcttggagatttagctgatactttgggtagtaatactggtcccttgattcagcagaaggcggaaacaattttgacacaaacaaattttgttcataaggagttcatgccattgcaagaagaggagttgagtatgaggaagattaaattcaaggctttcgatttgggtggccaccagattgctagcagagtttggaaggactattttgctcagcttactgaaacttaa

SEQ ID NO: 67681 - DNA, 285 bp, Glycine max
  Peptide Sequence Number=SeqID_159366
atggcaaggatgtcgacagatcctctaattattgggagagtcataggagatgttcttggctctttcaccccaaccataaaaatgaccgtaacttacaataagaagcaagtctacaatgggtacgagttcttcccttccacaattaccacaaggccaagggttgagattggtggaggagatatgaggtccttctatacactgattatgacagacccggatgtccctggccctagtgatccttacctgagagagcatttgcactggtattttaatagagatatatag

SEQ ID NO: 67682 - DNA, 636 bp, Glycine max
  Peptide Sequence Number=SeqID_159367
atggccttaaagacaatactcagatactctcattgtcacagagaatcctcatatataacatcttcttgcgtatcaaaagcttcacaatgccataggaaaactcaaatagaatgcaatcttttgaggtcacaacagtcaattttgaatcatcattacaaatgcattgaaggaaggcctacatttcaagaatgcaatagaaaatatgttgtaaaagcagcccatgctataccatcttttgattctgaatctcacgcttccagtcccaaaaacattttggaccctgtcaaaaaattcttggttgctttgtactggttttgcaatcctcactcgatgattggccgaacattaagcgcaacatctgggtgtctgcttgcagtggagaaattgtcagatatatctccattatttttcattggtttgttacaggtcttggtacccaacttctttatggatatttatgttaatggtgtgaatcaactgtttgaccttgaaatagacaagataaataaaccatttttaccattagtatctgggaacttatccattacaaatgctgtctttattgtagcatcatctgcaattctggtgccatatagatccatccctttttacaataatatttttcaatcaaaatga

SEQ ID NO: 67683 - DNA, 492 bp, Glycine max
  Peptide Sequence Number=SeqID_159368
atggttgatgaaggtggaaagcttggtggagggtttatgagatcagcttctgttaatgaattattctcaaggagaagttttctttcagggcttataagataccctacagtggcagggcacttgggaggcacacaaaagagaaaggttgagaattcgtggcagcacctgtgtctctctggggttcaaaaggatcaatctgaggagcaaaatctggtgttgttggagaagcatttgaattggcgcgctgatgcacaaaaagttggtgattggaagagggtgcttagggaatctgaggctgccattgttgttggagcagatttttcgcctcagagtgtagtgcaagggacagaaaagtgtggaattgatggggaaattgaacagattgttgcttgcaaggtggaagcctatttaaaactgcatcaacttgaagatgttgaatcaagtctctcgaatgttctgaagttggaaggttgtcctccagagtgctcttag

SEQ ID NO: 67684 - DNA, 918 bp, Glycine max
  Peptide Sequence Number=SeqID_159369
atggcggaaccatcaaagaagcacaaaggttcttcgagtagaagccaacgacactccgaggctcaggatattccaattccttcctccatttcctcctcctcattgttctcatcagaagaacaacgtatacggtacacaaacctattctcctctcattctatcattgaccctaagttcatagatttggatttcttttctgatgagagtttcaaatgcattcaagcatttcaaaaatcaaatctcattccctttatgtctctgaaattgcctgtgtattctgaattggtaaaagttttttattcgaaccttgaaattcaagaaagtaccttgatttcagaagtttatgggataaagatggtcattgaccaatccctcttctatgatttgacccaattatctagcaacggtgtaccatttgaagttgcatcctttggttaccgcaaagagcgtgatgactcttgggtaaaaaagggtactcaaccaaatgatgatgaaggacaattaccagttgaaggagactcttctctccttcaaagtattttggacaggttcgatggactccaaacttatgttggtgaaaggtttgatcttttggaacaacaagtggacacgcgattcgacgagacggactcaaggatcacaaaggattgtcatcatcaaaaagggggagattgtggaagcaatgtcttccaaggttattttgatgaagccaaagaatcaagagttaagcaaagtttcaagcaaagattcaagaatcaagtttcaagattcaagaatcaagtttcaagtttcaagtttaaagattcaagattcaagaaaaatcaagatcaagattcaagactcaagattcaagaatcaagagaagactcaatcaagataagtactaaaaagtttttcaaaacattgagtagcacatga

SEQ ID NO: 67685 - DNA, 465 bp, Glycine max
  Peptide Sequence Number=SeqID_159370
atgccaaaatttgatgttctaggttcttgtgcatcaaaagctttgcaaaacaaaaggaaaattcaaatggaatacaatcttttgaggttccaacaaccaactttgaatcatcattacaagtctactgagagagggcatgtatatcaagaatccaatataaaatatgttgtgaaagcagtctctaaaccatcttttgattatgaacctccaacttctaattccaaaaacatgttggagtctataaaaaatttcttggcagctttctattggttttgctatccttacacaatggttggccgaacattaagcacaatctctgcatgtctcattgccgtggagaaatcatcagatatatctccattattttttattggcttgttacaggctttggtaccatacacgtttttggatgtttatattaatggagtgaaccagctgtctgaccttgaaatagacaagatttga

SEQ ID NO: 67686 - DNA, 657 bp, Glycine max
  Peptide Sequence Number=SeqID_159371
atgaaatttaaatcaagcggcaccccttcaaaggcccaagcactcctcgacctcagaggccacttctcaacccccacactgtcgccaactactctgaagttatcttgtacatcgtcggctacccctccaacaccatcttcatcccctctgtctaagggaggcatttgggattttggaaccctaacggaggttgttaggttgatgggtgaaaggatgaagggaaagggtgggtcatcatcgtcgtcgtcgtcatctcctatgatggttaagtgcaaatgtgaagtacccgttattatgttcatgtcgcgtagtgtgaaccatccaaggagaaggttttggagatgcccacactggaatgaatccagttcttgcatattttttcaatgggttaatgatattgaggctcgcaataatttttacgtagaagggagtgagttgatccagtatgttcataaaaatgaagagctaaagctaaaacttgcttcattaatggaggaagctaaagcaaatgcaaaagaaatagtagaattgagggaaaaaattgttgcacatgaagaaaaatatcgcacatcctcggctaaagttgtgcacttgaagagtaaaattggaaggaaaaagaaaaatgttgttgttgaaaggaatagggtgaagctgtaa

SEQ ID NO: 67687 - DNA, 930 bp, Glycine max
  Peptide Sequence Number=SeqID_159372
atggatgagattgtagggcttcaagaagttttggaagttgatcttggtgtcattaataaatctcttgcgaatgttgatggaggtggagaagagatagatgtagatttacttaaacaactagacttggttgaaccatacaaggatgaatgcatattaagtgagaatgagattgaaaacaaaggtagaggtggtgatcgcagaacatttaatcgtggtagaagatgtggtgttactttgggagcttcagttaccaccaacccttctacctcttccattcacatatcaaccttagagttgatgattcatgtcgttgcgccagaaccaaacacacttcctacaactcaagatcaaccaaatttgacctttgtaaaggagttaattcccactacccctgttagagatgcttcacctttagcaccagatgattctcttacacctaagtacccacgtgattcaaattgtgaacatattgctaatcggaggcctttcatttttgcacataaaagagaggcaaagtttgatgaaccagttgccagttggttaaaggtattagttgaccttcgtaataggtggtttggagagtttaagagtttcactgccaaggcgaatcgaactattgataaaggagccttagcatattgtggtggttctatatctaaggcaggtcacttcaaaaagctgtcaaaggagtttcaaagaccaccaattgcttgggaggggaatgtgtatgggctaggtactttgagaaaaaggtttaattgctcaaaattagctttatctactcctattgctcctgtggaggaccaaatagaggaaatgtatgaggcaattactaaattgaatgctgagcttttggcaaaggcaaataaggagaggacactcgaggaaaagatgttgcagctaatggagaattatgaccagcaaagttag

SEQ ID NO: 67688 - DNA, 1791 bp, Glycine max
  Peptide Sequence Number=SeqID_159373
atggaagttccttcggaagcgccgtctaccggcatcgccgccgaaaccataagcaaaaatgcgctgaagcgcgaactcaagaacaaacagaaagaagaagaaaggaaacgcaaggaggaggacaaggccaaaaaggcagctgaaatgcagaaggctaaggataacaaatctgcacctgctgatgaagatgatatggacccaactcaataccttgagaataggctaaagtatcttgcagttcaaaaggcagaggggaataacccctatcctcacaaattctttgtcactatgtctcttgatcaatacatcaaggaatatggaggtttaagcaacgggcagcacctcgaggatgtctctgtgtctatggctggccgaatcatgcacaagcgcacctctggttctaaactcgtcttttatgacctgcacagtggtggcttcaaggtccaggttatggctgatgcgagtaaatcagacttggatgaggctgaattttccaaattccattctaatgtgaagcgtggggacatagttggtatcactgggtttccaggcaaaagtaagaagggtgaacttagtattttccccaagacttttgtgttgctgtctcattgtttgcatatgatgccaaggcaaaagtctgctgctgctgcggataatgcaaatttgaagaaaaatccatgggtaccaggaagtaccaggaatcctgaaacatatattttgaaagatcaggaaactaggtatcggttacgccatttggatttgatgcttaatccagaggttcgagaaatatttaagacccggtctaaaatcatttgttacattaggaggttccttgatgaccttgatttcttggaggttgaaacaccaatgatgaacatgattgctggtggagctgcagcccgtccatttgtaactcatcacaatgatcttaacatgaggttattcatgaggattgctccagaactgtatcttaaggagttggttgttggtggactggatcgtgtttatgaaattggtaaacaatttaggaatgagggcatagatttgacccataatcctgagtttactacctgtgagttctatatggcttataaggactacaacgacttgatggatataacagagcaaatgttgagtggtatggttaaggaacttaccaaaggcagctataaaatcaagtatcatgctgatgggattgacaaggaacctattgaaattgactttactcctccttttagaaggattgacatgattgatgaattagagaaggtggcaggcctaagtattcccaaagacttgtcgagtgaggaagctaatcaatatttgaaggacacatgcttgaagtatgagatcaaatgtcctccccctgagacaactgctcgtttgttggataaacttgttggtcactttttggaagagacgtgtgtaaatcctacattcatcataaaccaccctgagatcatgagtcctttagcaaagtggcacagatcaaaacgaggcctgactgaacgttttgaattgtttgttaataagcatgaactttgcaatgcatatactgaattgaatgaccctgtagtacaacgacaaagatttgcagaacaactcaaggatcgacaatcaggtgatgatgaagcaatggccttcgatgaaacattttgtacggctctagagtatggtttgccacctactggtggttggggtttgggaattgatcgtttgaccatgttactgacagactcacagaatattaaggaggttcttctcttccctgccatgaaacctcaagactga

SEQ ID NO: 67689 - DNA, 108 bp, Glycine max
  Peptide Sequence Number=SeqID_159374
atgacggcgataatagaaaccatgacaatggtggtggggttgaataatggtaatgaaggtggcaaaatggtgacggtggtagtgagagtgacaatgttggtggaatga

SEQ ID NO: 67690 - DNA, 717 bp, Glycine max
  Peptide Sequence Number=SeqID_159375
atggaggttctgtacaggaagctctatgacaagtacaccagactaaagtctaacaaactttctgatttggatcacctcaacgaagaacaagaactcaaattcagaaacttctcgtccgctgcggaagagttgatagagcacttgatgaccgaaaaggaagagcttcttggacaagttcatcacttgagaagcgagctcgcttcccttagggctgccaaagacaaccaggttgttgattatcagaggcttttgatggaggaaacccgcaaaaatgaagctctttctgaagaagttgagaaattgctgaagcttcgccaggaaggaacatctcatgatttaaattataacagtaagatcatgaccttagatgatcagtttaaggctaactacagctcatctgtaagaatgacaagaaaacgtacaaggcagaatgctttggagaaagaagcaaggcttatatcttttgaaaatgatcaagctaattctgtggagagagagtcaactgaaaacacttgcaaggagaccgcttctggtaagctgctggagggctgtaccaaggctaatgatcaaccaggcattgatgtacaggaaagtggtcgtcgtaactggcttattcaagttctttttgagtatgcactgggcatgaaattatccactgactatcaaactgaaggaatttgcctttctgcagtgcatcaatcaagcggtaattcataa

SEQ ID NO: 67691 - DNA, 444 bp, Glycine max
  Peptide Sequence Number=SeqID_159376
atggacagagcaaaagcaaagaaggtctttcatggaaaccttacctcaacaaagtcgtggaacggtggaagggaagaggaggagaggccgagaaggacagcggcggcggcagcgcacaatgcaatggaagaagaggcacaccacactctgcctcaacgtgggtccgcccttgaggtctacacatttgtttgcttctctgaaactttaaagttcatggctttggtgatgagaaggcaattgttccacctattcttgaactttgaggggaccaaatatggagaggagaaggtttgtactagcagagttgaaacacattcaagtcaaaagttagcccaatgtttattattggttgtttctatcgcgaacgttgcgccaagaagttttgcctcaaaggcgaaggagatacttgaatacataacaaaacatcataaggagatcccttga

SEQ ID NO: 67692 - DNA, 414 bp, Glycine max
  Peptide Sequence Number=SeqID_159377
atggagtttcagccacaaaggtggctaaaggatggggtatttcaacctatgaatccattcgagtacccaatttttcaagtcgggttgagggtgtgtgtggggaaggaaatggatctaaaggagatgaaaagtgtggtggttttgttgctgaggaagttccacatcgagttggtgtcatcgttgtcttgtgggattaaccctcatttctcttcgaggcttactaccacatttagttctggccttcacgtgatggttcatgaaagagaaattataacaaccactgaatcacaaaagagatctaatttaattgtaacgctttcaacattttccaatcttcattgtgttattatgaagttgatggatcagacctttgcattcagtaataactccacccaagaactcaagcatgattga

SEQ ID NO: 67693 - DNA, 2091 bp, Glycine max
  Peptide Sequence Number=SeqID_159378
atgggagagctaccagtggatagagcctatgctccagaagaccatcacaacaacttgcttgctactgcaattggagactggcaattagctagagaatccaaaatacatagctatggaaagagcttcaacggattcgttgcacgacttttgccatatgaagcagagaaattactaggattgcccctaaaacttaacagacactctaatgtggagagtgatatcatcgtgggtgtgttagacacaggaatttcgcttgattgccccagtttcaacgataaggggtttgggcctcccccaccctcttggaagggcaaatgtgtcacaggagccaatttcacaggatgcaacaacaaggtgatcggagcaaaatacttcaacctccaaaacgcgccggaacagaacctcagcccggccgacgatgacggccacggcacccacacgtcctccacggcggcgggcgtggtggtgaggggggcgagcctggacggaataggcgtgggcacggcgcgaggcggggtgtcgcgcgctcgcatagcgatgtacaaggtttgctggagtgacgggtgcagcgacatggatctgctggcggcgttcgacgaggccatagacgacggcgtgaacgtgatcacggtgtcgctgggagggacaccgaggaagttcttcagcgaccccacggccattggatcgttccatgccatgaagagagggattctcacttcttgttccgctggtaacaatggcccttccaccatgactgtggagaatgtcgctccttggattttgactgttgctgcttccaacactgatcggcaattcaccaccgccgttcacctcgccgacggcaagaaagctcggggaatgtccattaatacctttacccctgagaaaaaaatgtacccattgattagtggagcccttgcttccaaagttagcagagacggctatggcaatgccagtgcatgtgatcatgggagtctaagccaggagaaggtaatggggaagatagtgtattgccttggcacgggcaacatggactatataatcaaagaactaaaaggagcaggcaccatcgttggtgtttcagacccaaatgactactccaccattcctgttattcctggggtctatattgatgccaacactgacggcaaagcaatcgatctctacatcaattccaccaagaatgctcaagctgttatacagaagaccacaagtacaagaggccctgctccatatgttgcttccttctcatctagaggtcctcaatccatcacagtcaacatcctaaagccagatttgagtgctcctggagtggacattctagctggatattccaaattagcaacactaacaggggaccctgcagacaaccgtcgaaacgtttttaatatattgtcaggaacatctatggcatgcccccatgctgcttctgctgctgcatatgtcaaatccttccatcctgattggagtcctgctgcaatcaaatctgctctcatgaccactgccattcccatgagaatcaaagatgccacagcagaactaggatcagggtcaggacagatcaacccggtgagtgcattggatcctggcttactttacaacagtagcatggactcctacattgcattcctatgcaaagaaggctacaacagcagcagcattggaatactaattggcaccaagggactcaactgctccaccatttcccctccacaaggcactgatggaatcaactacccttccatgcatacacagattatcccttccaatgccagcatttccgcgatcttttatcggagtgtgaccaacgtaggatccggaaactcgacttacaaggccaaagtcagagcacctaagggcctttccattgaggtcatcccagacacattgaattttggtggggtgaaccaagagttgtccttcaaggtggtgctgaaggggcctccaatgcctaaggagacaaagatattttcagcatctcttgaatggaatgactctaaacacaatgagaaagaagatcagttggtggagtggaagcttgagaatctgttgaagagaatgaaaatgaaaattgaaacattacattcctag

SEQ ID NO: 67694 - DNA, 162 bp, Glycine max
  Peptide Sequence Number=SeqID_159379
atggttagaaccagaggtttgggtcgggctttaggcagagttataggaagagccctagggagagaagaacgtcctaagctaaagttatcctcccatggaaggaaggttgataaatttggcatgcctgctccaaagattgaaggcttagtggttggcacatga

SEQ ID NO: 67695 - DNA, 276 bp, Glycine max
  Peptide Sequence Number=SeqID_159380
atggcttcttctttcggctatcccaagagggaagaaaaggataaaataaaggtcctacgtagaaaaggagacaagcttcgtacaccaagatcttctgtgtgtctatgcaaaagccacagttccttggtgttccaagcacacacacattatataagaggcaatgcaaaagggagactttggtggagggaagcagagtctctggattttgtggaaggattgttgcagtgtgaaaagggtgaagaggaagtgagggacaaaaggaacaaagggtgttaa

SEQ ID NO: 67696 - DNA, 1314 bp, Glycine max
  Peptide Sequence Number=SeqID_159381
atggcaaaatgtaacaagtctcttgtcgtgattctcctcctccttcacatcctatgcttgcaatcacaagtgaatggtttttctcgtcaaccttctcgccagttaatcttcacaccccacaaacgttcggattctgatcctcaacaggtgcacatttcgttggtgggcaatgatcatatgagggtgtcatggataaccgatgacaaacactcagaatctgtggtggagtatggaacaaagaaaggtgaatatagcacaaaagcaacgggggaacacacttcataccattatttcttgtacgaatccggcaagatccaccatgtggtaattgggcctcttcagcccaacacaatttactactacaggtgcggaggatcgggttctgagttttccttcaagacacctccactaaagttgcctattgaatttgttgtcgttggggatttgggacaaactgaatggacaacatcaaccctaaaacatgtggatagcaaagactatgatgtgtttctactacctggagatctatcctatgctgatacccatcaacctctatgggactcctttggtcgtttggtggaaccctacgctagtcgtataccatggatggttacagaaggcaaccatgaaatcgaaactttccccattatccaaccaaatggtttcaaggcctacaatgctcgttggcccatgccatacaaggaaagtggctccacctcaaacctctattactcatttgatgttgctagcacccacgtcatcatgttgggctcttacacagattttgatgcacactcccaacaatacacgtggcttcaatctgacctagctaagattgataggaagaggacgccttgggtgattgcattgttgcatgcaccttggtataatactaatgaggcacatcaaggtgaaggtgaagacatgagacaggccatggaagagttgctttatgaagctcgtgttgacttggtctttgctggccatgttcatgcatatgaacgctttactcgaatttatgacaataaggctgattcatgtggtccgttgtacgtgacgattggagacggaggaaaccgtgaggggcttgcattaaggtttaagaagcctcctagcccactttctttgtatcgggagccaagctttggtcatggaaggttgagaatagtgaacgaaacacatgcatattggtcgtggcatcgcaacaatgacaccgacacatttgtagctgatggtgtttggattgagagtttaagcaactcgaaagcttgctggaatgcacaaggccagcatgttgctcatgaagagctttga

SEQ ID NO: 67697 - DNA, 252 bp, Glycine max
  Peptide Sequence Number=SeqID_159382
atggcaagcacaagcaaaacttaccttgtgattgaatggttgcaaggaaagcaacaaaggtcgttcaaagacaatgacaatgacaaggaatgcaatgaaggtcgttcaaagacaatgacagtgacaaggaaagcaacgaagaccgttcaaggaaaacaagaaagcttaccaagacacgacggtgagtgtcacaacagacacgaccagagcgcgaccacagcctcacagtggctttgcgagactcagccttag

SEQ ID NO: 67698 - DNA, 2073 bp, Glycine max
  Peptide Sequence Number=SeqID_159383
gtgatcgatggctgctgctggcgctgcgacaccaaagtcgaacgcaaagagatcccgcagtggttcgtgaaaatcaccgattacgccgaagagctgctcaacgacctcgataagctggaggactggccggagcaggtcaagaccatgcagcgcaactggattggccgttctgaaggtgtcgagatcacctttgacgtggccaacagcgcggaaaaagtcacggtttacaccacccgtccggacaccttcatgggggcaacctatgtcgccgtggcagccggtcatcctctggcgcgccaggctgccgtcaacaacccggcgctggctgatttcattgctgaatgcagcaacaccaaagtcgccgaagcggacatggccacgatggagaagaaaggcatggccaccggcctgcacgctatccatccgctgacgggcgaagagattccggtctgggtcgctaacttcgtgctgatggagtacggcaccggtgccgtgatggccgtaccgggtcatgaccagcgcgactgggaattcgccaccaaatacgatctcaacatcaagccggtggtgctcaacctcgacggtaccgcgccggatatcagcgccgcggcgatgaccgaaaaaggcacgctgttcaactccggcgagtttgacggtctggaccacgacgccggcttcaacgccatcgccgatgcgctggcggccaaaggtgtcggcgtgcgtaaagtaaactatcgcctgcgcgactggggtgtgtcacgccagcgctactggggtgcgcccattccgatggtgacgctggaagatggcaccgtaatgccaacgccagaagatcagctgccggtaattctgccggaagacgtggtcatggacggtatcaccagcccaatcaaagccgatccggagtgggcgaaaaccaccgtcaacggtcagccggcgctgcgtgaaaccgacacgttcgacacctttatggaatcatcgtggtactacgcgcgttacacctgtgcgaactacaacgaaggcatgctggatccggcggcagcgaactactggctgccggtcgatcagtatgtgggcggtatcgaacacgccatcatgcacctgatgtacttccgcttcttccacaagctgctgcgcgacgcgggcctggttaactctgacgagccggccaaacgcctgctgtgccagggcatggtactggcagacgccttctactacgtcggtgccaacggcgagcgcaactgggtttctccggttgacgttaacgtcgagcgcgacgaaaaaggccgcatcaccaaagccatcgacaatcagggccgcgaagtgatctacgcgggcatgagcaaaatgtcgaagtccaaaaacaacggcatcgacccgcagctgatggttgagcgctacggcgcagataccgtgcgtctgttcatgatgtttgcctccccggcggaaatgacgctggagtggcaggagtcaggcgtggaaggcgctaaccgcttcctgaaacgcgtgtggaagctggcgtacgatcacgtggctaaaggcgcgaccgtggcgctggatgtcaacgcgctcaacgatgagcagaaagcgctgcgtcgcgatctgcacaaaaccatcgccaaagtggcggatgacatcggccgtcgtcagaccttcaacaccgcgattgcggcgatcatggagctgatgaacaaactgctgcgcgcaccacaggagagcgaacaggatcgcgctctgatgcaggaagcgctggtcgccgtaacgcgcctgctctatcccttcaccccgcatgccagctacgtgctgtggcaggcactgggtggcgaaggcagcatcgacgacgccagctggccggttgccgatgaagcagcaatggtagaggattcgctgctggtggtggtgcaggtcaacggtaaagtgcgtggtaaaattaccgtggcgccggatgcgacgcaggaacaggtgcaggcgcgtgcggcacaggagcatctggtggcgaaatatctggatggcgtcacccttcgtaaagtgatttatgtccctggcaaactgcttaacctggtcgtaggttaa

SEQ ID NO: 67699 - DNA, 1413 bp, Glycine max
  Peptide Sequence Number=SeqID_159384
atgagcctgtgcggtccgtttgatgacaacgtaaaacagctggagcgccgtctgggcattgagatcaatcgccgcgacaacctgtttaagctggtcggccgcgcgctgagtgtcgaggcggccgccaatattctgcgttcgctgtacgttgataccgcgccggtgcgcggccagatcccggacattgaaccggatcagatccatctggcgatcaaagagagtcgcgtgctggagcagacggctgacagcgtgccggagtacggtaaagcggtgaacatcaagaccaagcgcggcgtgattaaaccgcgtacgccaaaccaggcgcagtacatcgccaatattctcgatcacgacatcacgttcggcattgggccggccgggaccgggaaaacctatctggcggtcgccgccgcggtggatgcgctggagcggcaggagattcgccgtattctgctgacgcgtccggcggtcgaagccggcgaaaagctcggcttcctgcccggcgatctcagtcagaaagtcgatccttacctgcgtccgctgtatgacgccctgtttgaaatgctgggcttcgagcgcgtcgagaagctgatggagcgcaacgtgattgaagtcgcgccgctggcctacatgcgcggccgtacgctgaacgacgcatttgtgattctcgatgagagccagaacaccaccatcgaacagatgaagatgttcctgacgcgtatcggcttcaactccaaagcggtgattaccggtgacgtgacgcagattgacctgccgcgcagcaccaaatccggtctgcgccacgccattgaagtgctggccaatgtggaagagatcagcttcaactttttccacagcgaagacgtggtgcgtcatccggtggtcgcacgcattgttaatgcttatgaagcctgggaagaagcggaccagaaacgccgtgataaactggcggaagagcatttgcagctggcgtgtgccgatgaaaacggcctgcccgcagcagcggcgtttcagcgctggctggaggcggcggtcacgccgtttcagccagagagcgaagtcacgatacggctggtcgatgaagcggagagtcatgagcttaatctgacttatcgcggcaaagataagccgactaacgtgctgtcgttcccgtttgaagcaccgccgggcattgagctgccgctgctgggcgacctgattatttgtcgtcaggttgttgagcaggaagcggccgaacagggcaaaagccctgaagcgcactgggcacacatggtggttcacggcacgctgcatctgctgggttatgaccatattgaagacgaggaagctgaagagatggaagcgctcgagaccgagataatgcttgctcttggctatcccgatccgtacatttcggaaaaagaagacgtctga

SEQ ID NO: 67700 - DNA, 969 bp, Glycine max
  Peptide Sequence Number=SeqID_159385
atgacgggcatgctggtcacacccgcgccaaagcattacaatacgcgccctgcacttctctgctcagaatcaatggctagttcaatgaccaaaaaactgcatatcaaaacctggggctgtcagatgaacgaatatgattcatcgaagatggctgacctactgaacagcacgcacggctataccctgacggaggaagccgaagacgcagacgtactgctgctgaatacctgctccatccgtgagaaggcgcaggaaaaagtgtttcacttgctgggacgctggaagaagctgaaggcgaagaatcctgagctgattattggcgtgggcggctgtgtggcttcgcaggagggcgataaaattcgccagcgcgcgcagtgcgtggacatcgtttttggcccgcagacgctgcaccgtctgccggagatgattaatcaggtgcgcggcagcaagagtccgattgttgacgtctcgttcccggaaatcgaaaagtttgatcgcctgccggagccgcgtgctgaaggtccgactgcttttgtctcgatcatggaaggctgcaataaatattgcactttctgcgtggtgccttatacgcgcggcgaggaagtgagccgtccctgcgatgacatcctgctggaagttgcccagctcgcagcgcagggcgtgcgtgaagtgaatctgctggggcagaacgtcaacgcctatcgcggcgcgacctttgacgaccagatttgtacctttgccgaactgctgcgtctggtggccgcaattgacggaattgaccggattcgtttcaccaccagccatccgattgagttcaccgacgacatcatcgacgtttatcgtgatacgccggagctggtcagcttcctgcacctgccagtgcagagcggtgccgatcgtattctgacgctgatgaagcgagcgcacactgcgctggagtacaaagcgattatccgcaagctggtggcc

SEQ ID NO: 67701 - DNA, 762 bp, Glycine max
  Peptide Sequence Number=SeqID_159386
atgaggctggcgatgccacctggcagcaatttcccccggacggaccgcgcgcgttctgcccgctgtttgatcgtcacgcttcgctggtgtggtacgacgcgccggcgcggatccgtcagctgcaaaatctgccgctcagccagctggccaaagaagtacaggccaacttccccggcgcgtgtcggccgcttcgaggtgaagaacgcggcgtcgtttcccgctggtgcgccggggccatgccacacgctacgtgctgccggcctggcgctggtcggtgatgctgcacacaccatcaatccgctggccgggcagggggttaatctcggctaccgcgatgtggatgcgctgattaatacgctggtggacgcgcgcagtcaggcgcagcgctgggcatcgctgccggtattgcagcgttatcaccgtcagcgctacaaagataatttgctgatgcagggcggtatggatctgttctacttcgcctttagcaacgcgctgccgccgctgcgtgtggtgcgtaaccttggactgattgcggcagagaatgctggcgtgctcaagcgtcagggattcgaaccccggaatgccggaatcagaatccggtgccttaccgcttggcgacaccccaataggtgtttgggattcgaaccccggaatggtggaatcagaatccactgccttaccgcttggcgacaccccaatttgtttggtggctacgacgggaatcgaacctgtgaccccatcattatgagtgatgtgctctaa

SEQ ID NO: 67702 - DNA, 417 bp, Glycine max
  Peptide Sequence Number=SeqID_159387
atgaaagttacaactttcaagcaaaccagccatgacatgattgcacacatagataaagctcgagccgcagtggaagagctgaaaaggtttcttgtggctgattcgatggaggaagtgaataagaagctgaacaagttttacatggttattatcttgaggagcctatacccagattttgatcatacttcttctgtgcctcatgtattgaaagatgaaaatcctgctgatgttgtggaaacatcagccatgattacaccttgtgggagaggaggaggccgtaataatagaggaggccgcagtggaagaggtggacatcctcaatgcacccattgcaataggatgggtcacactcaagaaaactgtcactctttacatggttttcctgacaaagtagcacagatgtctaagtcagagtaa

SEQ ID NO: 67703 - DNA, 630 bp, Glycine max
  Peptide Sequence Number=SeqID_159388
atgggttctacacctgcctccaatcctcctcctcctccttctcctctttctcctcctccttcggacgcatcgtcttcgccgtctgccatgaagcagacacacaaagtctcacgtctacgatcgttgtccactagaccacctggtgctgagagaccagtggtgcatgttgatcctgctattgggaaggccgacggtccccacaggaagaaattaagaacatatttggggattgtggcacgtgataaggtccctactgctcagaaggacctgatttgggaggatattcaggcggaatttgatatcccagaggcttctcacagtaggacgaaaaggaagttactgcagaccgttggggagagatggaggcaatttaaatcaaacctcacgaggaaatgggcccttacagccgatcaggacggtgtcgaggacattgtctgtgagaaatacggcatcagcaaggaaaaagacccttcttgggaggatgtgtgcaagaaggcacaggccatccagaagcagaatactgtcccccacattttgtctcgtgggggttatgattatttggagcagaagctcctggctgagaagacaaagaagaagcttggaggaagctgcacagtcaagaagcgttga

SEQ ID NO: 67704 - DNA, 528 bp, Glycine max
  Peptide Sequence Number=SeqID_159389
atgagggagacacatgaaattccccaccacaatctagccgacttcgagccttgcctcggatatgccactgaaaggcaagcagctggtggtatacccttgcaaaacactttggaggggcctcaatttcgcccccaaccacaacccttctatggaaaaatggtgggttacacaccttcaagctttgcggatttggtcttcaccggcgaaaggatcaaagtgggtctggaaaaaggcaaatctgatcatcctgctttgatgaatgcgaaaactggggcaaatgaaaagaatgagaatgagggagaaacccttgctatgactgccattcctacacagtcaaatttcccatcatcccaacaatgtcattacttagccaataacagtccctctcacccaatcatccacaaaggccatccccaatcatccacaaagcctgcccgtcacacattcggtgtgaaaacattgaccaaaatggaattttgtagcaaaaagcctgtaggattcaccccaaattccggtgtcatatgctaa

SEQ ID NO: 67705 - DNA, 1047 bp, Glycine max
  Peptide Sequence Number=SeqID_159390
atgagccgctggagcgtgctcggtagcggcgtgtccgggctttgtgtcgccatgctgctggctgaacgcggcgaaaccgtcgaggtcattgacgatgaagcgcgtcagcctgcctcgtggtttgccggtggcatgctggcgccgtggtgtgaagctgaaagcgcgccagccgaggtgattaccctcggccagcatgctgcggcatggtggcaaacgcgcgtcagcagcgtggtgcatcagggtacgttagtgctggcaccgtcgcgtgataacccggagttaaaccgcttcgcgcgcatgacgacggcgcatcaatgggttgatccggcgtcgcttgaaccggcgctggaaaaccgttttgtgcgcggactgtttttcccgcgcgaagcacatctcgatccgcgccgcgcgctggctgaactgcgtgacaaactgctgcagcgcggcgtccgctttgatgcgcgccagccatcgggccggatcatcgactgtcgcggtatccatgccagagcgcagctctccggcctgcgcgcggtgcgcggggaaatgctgatcctgcagagtcatgaggtgtcattttcccggccgattcgtctgctccatccgcgttttccctgttatctggtgccgcgtcgcgacggccacttcatgctcggcgccaccatgatcgaaagcgacgatgccagcgctatcagcgcgcgcgccatgatggaactgctcagcgcggcctacaccctgcacccggcgctggcggaagcgcgcgtaatcgaaagcggcagcggtctgcgtccggcatggccggctaatctgccggaaatccactatcacaacggtattttttatcttaacggcatgtatcgtcacggttttctgctggcaccaatgatggcagaacagctgatgcagcgcctgtccggggagcaaatcgatgcggcctgtgttgccaccgcctgcaatggcgattttgtgccgaaaagtcagtatgccagcctgcagttgcaggaaggctggcagctggaagtcctgtcaccgatgcagggaggctga

SEQ ID NO: 67706 - DNA, 1590 bp, Glycine max
  Peptide Sequence Number=SeqID_159391
atgacgctgaaagttttcaacgaccgcatcggcattaaatggcgtgccatcgtggaatttaacgttgggacgcagcgtaaattcccagtgcagtccgctgtcgtcagcatgccaggagagcgccagggccggcatgattttgccatcgtcaccgagccgcgtcaggccttcatacatcgggtccagcaccgtgccggtaaaggtcgcggtctgattgcccgggtccatgctgcgcggcggttcgttttgcataatgaccagctgagcagccaaaaccgatgcgctggaaaacgacgccagaatacccgcggcaagtgtcagtaccctgaaatgcttgagtgtgctttgcatgaaggcctcagtgaatcagtgacaaagagtgaagagtcattgcccggcaggcagctgaccgtcaatgcgcgccatcgcctgccatacgctttggttgtgttaacggcagcagatgaacgggctcgacgctatataaggcacactctgcaaacaaaagccaagatccgcacggcaattgcggaaaaaatgaagctgagtaaagccgcaatcagcactttaatcaaagagatgcttagcgcaggactgcttgaagagagcattccggaaagtaacggtcagggtcgaccttcggtgttattaaaaatgcgtgccgacagtgcctattttctcggtgcgtcgttgctcggtgacgatgtgtatctggtgctgacggatatgcacggccgcatcctggccagcacccacatgccgctgaatcccgaccctgtgcaactggctggcgcgctggctgccgctattccggacctgattgcacaaaaaggcatttccgccgatcagctcatcgggcttggcgtcacgctttccggctttgtcgatgagcaccaggccgtgtgcgtccagtctgccctgctgggctggaaaaacgtcccgctggcggcactgcttaacgcgcaaaccggtctggaggtgtcactggaaaacgatgccaaagctctggcggtcagcgaaaagattttcggcgtggcgaaaaaggcacggaatttcaccctgatttcccacggcgacggcattggctctgcgcacttctttcaggggcagctgcaccgcggcgcgcacggtggggccggtgaaattgctcactgtaccgtagagcccggcgggcggccgtgccgctgcggcaaacgcggctgccttgatacgctggcgtcgctcactgcgatgcgtgaaagcatgcgtgacaaacagctgccctgcaccagcgttgccgaactggaagcgctggcggtaaaaggcaatagcgccgcgatcgccattctgcaccaggcaggtgacgcacttggcctcgccattgccaatatcattcagatgaacgatccggagatgattgtcatcgctcatcagccggatgcgttcgacggcctgctcagaaccgtggtgatgcaggcggtagatagtcacgtgttgccttcaatcatgggcaagacgcccatcgccagcatggcgattgatcagttgagctgggcccgcgccgcagccagtgtggcggcttaccgttttatcgctcacttacccgactag

SEQ ID NO: 67707 - DNA, 46 bp, Glycine max
  Peptide Sequence Number=SeqID_159392
atgaagaatattccagattcgggagttgtatttacgtttgaggaag

SEQ ID NO: 67708 - DNA, 447 bp, Glycine max
  Peptide Sequence Number=SeqID_159393
atgggcttatacatagttcatgaccagtgtactcaactagtggcattgggaaaagtgtatgacagtgcgtccaccatacacaatgtcccttatgcagatgatgtggttagggtgagtgttgtgaaagtttacgacggtgatgctcaggccattggcacattcgttgggtggctgactcatcttgtggaagctgtatgtaatgaggattcacaaaagcttatgctgaaaaggattacatatgctggaatggataacacagtggctgcagttgatccattgggagaattggttaagaacctgtttgatgtttaccaaaagttggttgagtttccatgggatggggcaaaatttggcatacctaatgtgaaagacagttttttcatcacacacgcagatgtagcagagacaattttaggtgacaaatgtttgaacatatccatatgttga

SEQ ID NO: 67709 - DNA, 186 bp, Glycine max
  Peptide Sequence Number=SeqID_159394
atgggcagaaatgtctccgcattgattggtaaatctgtcccccaaatccctgaaaaatgtaaagatccaggtcccttgcagtcaactgatgtggtaattcatttagctaatagaagtgttgcctatcctgctggtttcatagaagatgtcttagttagagttggtgaactgatattcctttgttga

SEQ ID NO: 67710 - DNA, 498 bp, Glycine max
  Peptide Sequence Number=SeqID_159395
atggacatgaatgtgggttacttgatttctcatcagatatcacttatcgcccagcatgactcctctaggcttgggcccaagaaggccaagggtaagcagtctgaggctcatttactttctgttcccccatcaacatctccatcagctccttcttcatttactcccacaccagttccagctccagcttcagctcctacaggaccatcaggtttttcctttacttcagagactatatttgccatgctgcagagccttcacagaggccaggtggcttggccaggagtccagccttctccttctggagggggtgggacctccacatcccaagagcctgagcccatagaggagcagacaccaacggtagaggacgagttgatccctccagggccatttattccagagccagatgtagagattgctcaggaggaggcagcatcaacatcacctgcacctatgcctagggatgccctgctgttggatcaagtggcctcggaataa

SEQ ID NO: 67711 - DNA, 282 bp, Glycine max
  Peptide Sequence Number=SeqID_159396
atgacgaaagggggggcgtttttgcattcaaaaacttcttttccccctgtcgcaacctacccttcggcgggagggcgacgcgagactcgcgggatgcgtgttccacgaaaggaatacgcgcggagtcgccaccaacgtttatttgaggaaaacgtcggaaaagacgcgatctacgaactttttagtgaaaggttcgggagttgtatttacgcacggggaagggtgtttccctttgctcctacgtattcctcaatttgggatgagaaaatcagacctacgtag

SEQ ID NO: 67712 - DNA, 267 bp, Glycine max
  Peptide Sequence Number=SeqID_159397
atggtgacaaaaagggattgtagagtgattcaaagaagcctttatatacagggtgcaagaattacttcactgcttcaagtagtgtacgatctgcttccagagaaaaacacgttgcctaaaagttactatcagccaagaagatattgtgtccgatgggtatggagtatcagaagattcatgcttgcccgaatgattgcatactgtactggcatgcattcgaagaaatgtccaaatgccctaggtgtagggcgtcacagtacaaagtaa

SEQ ID NO: 67713 - DNA, 129 bp, Glycine max
  Peptide Sequence Number=SeqID_159398
atgtctgaagaagttgatatgaatgttgaaaatgacgaagatgctggcgtgaaagtagaacacgttaattattctgatgtcttaaatacttcccagttatttgctacccgtgatgaagttttacattga

SEQ ID NO: 67714 - DNA, 213 bp, Glycine max
  Peptide Sequence Number=SeqID_159399
atggagaattggcgaacagcgctacacaataatttcgcggggttccagactcgaagactcgaaggtggaggacacatgaacagcgctaggccaattacttcatggggcgccgaaaaacgtggagaatggagaattggcgaacagcgctacacaataatttcgcggggttccagactcgaaggtggaggacgcatgaaaagcgctaggcaataa

SEQ ID NO: 67715 - DNA, 2147 bp, Glycine max
  Peptide Sequence Number=SeqID_159400
atgaagacagaagggttactcgcgcagcgcatcgttaacgtaaaaagttcggccatccgtgaattgcttaaacacagcaagatggaacacgtcatttcgctggcgggcggcatcccctctgatgcgctgttcgatttcgaaggattgagcatcgccacccagcaggcgatcaccgaacagccgaaaagcgcgttccagtatggcttgaccgagggcagcccgctgctgcgtgagcgcatttgcgcgctgtgcgccgagcgcggcgtcaccgcgcgcgcggaagaggtgatggtcaccgccggctcgcagcaggcattggatttggtgatgcgcgccatcgtcaaccccggcgacgtgttcgtggtggagcgcccgacctacctggcggcgctgcaaacgctggagctggcggaagccaacatcatgtcggtctcgtcagacagcgacggtatggtggtggaagagctggccgagctgctgaaaacccagcgcatcaagggcgtgtacgtggtgccgaacttcggcaaccccagcggcatcaccctgagcgccgcgcgccgcgaactgctggtgaagctggccgccgaacataacttcctgatcatcgaagacgatccgtacggcgagctgcgtttcaccgaagagcgccacccgacgctgcatcaggtgtcgcagcgggtgctgggcaacaccgaccacatcatctatacctcgaccttctccaagatcctggcgccgggcctgcggttgggctgggcgattctgccgccgttcctgctgcataaagtggcgatcatcaaacaggcggcggatctgcacgccagcgcgctgtcgcagagcatcgtcgaatgctacctcggcctggatcgcctgccggcgcagatcgacaagatccgcaccgcctacaagcaaaagggcgagatcctggccgggcggcatgttcctgtgggcgcgtttccgccagccgttcaacgccaccgaatggctgaataccacgctgcagcagggcgtggtgttcgtgccgggggaatacttcttctccgacaacccggatcgttcgaccttccgcctgtcgttcgccaccgccaccgagcaacaaatgcaggaagcggtggcgcgcctgcgccgttcgctgtaatccccgcggcggcggagggcatgcccgccgccgacatcaaactgccatcttcacttcactctcctgagttaggcatgctcacctacgctattcgcaaaaccacgctgtgcgtcgcgttgaccctggcggtcagcactcaggcgctggcggcgaccgagatcccgttctggcattcgatggaaggcgaactgggtaaggaagtggactccctggcggatcgcttcaaccagtcgcacagcgacgtcaagattgtgccggtttacaaaggcaactacgaacagagcctggcggcgggcatcgccgcttaccgctccggcaaggcgccggcgatcctgcaggtttacgaggtgggcaccgccaccatgatggccagcaaggccatcaaaccggtctacgaagtgtttaaagaggccggcatcaacttcgacgagtcggtgttcgtgccgacagtagccggctattacaccgacaacaagagcggccatctgctgtcgcagccgttcaacagttccacgccggtgctgtactacaacaaagacgccttcaagaaggccggcctgaacccggaccagccgccgaaaacctggcaggagctggcggcggataccgccaagctgcgtgaggccggcatgaagtgcggctacgccagcggctggcagggctggatccagctggagaacttcagcgcctggcacggcgtgccgttcgccagcgaaaacaacggcttcggcggcaccaacgccaagctggagttcaacaagccgctgcaggtcaagcatatcgcgctgcttgaagcgatgaacaagaagggtgatttcacctacttcggccgcaaagacgaatccaccgagaagttttataacggcgactgcgccatcaccaccgcgtcatccggttcgctggcggacatcaagcactacgccaaattcaactacggtgtcggcatgatgccgtacgacgccgacgcgaaaaacgcgccgcagaacgccatcatcggcggggccagcct

SEQ ID NO: 67716 - DNA, 52 bp, Glycine max
  Peptide Sequence Number=SeqID_159401
cacgggaatgacagatttactcgatttcttgggagggagcggagccacatga

SEQ ID NO: 67717 - DNA, 624 bp, Glycine max
  Peptide Sequence Number=SeqID_159402
atgagagggaaaaaaataagggaagaagaaagaaggaaaatactaaaggagttaagaaaagaaaaacatgcctcctatagtagtcataactcttgcaagagtctaagtgaagaacttcgtgactattatgaaggaaggcataggtcacatcttagacctcactcccatagcagagaaaaggaaagaaagtatcaagaggctaacattaacctcccatacttccatgggaaggacaatgtagaggctaacttagattgggaaataaggatagagcaacaacttaaaaggaagtctacttcaaaatcttatggctctcactcttatccaaagaaagaccaaggtcaaggcatttttggggtgacaacttctaagcccaaagatcataaagggaagacaatagaaaagcaaccccttaaggctagtatgcaagagaagactagctctatgaagtactttaaatgtcttggaagaggacacattacttctcaatgccccaccaagaaaaccatgattatgaggggccaagaaatttatagtagccaagatgaggctactacttcaccttcctctagtgaaagtgaagaagcaaaagcatctacccccaagaagaaggacaacctttaa

SEQ ID NO: 67718 - DNA, 1254 bp, Glycine max
  Peptide Sequence Number=SeqID_159403
atgctggccgacaatttctgccagcgtgtagcccatgcgctccagaaacagcgcgttagcggtgaggatgtgaccatcaggcgtaaactcgaccatggcgatggcctcctgcagcgaactgagcgttgcgctgctgtgactgcgtttctgccacgcgaggcgcgacaggattcccgatgtaatagtgctgaacatggtggaccttattatggttatgggatgtcagcacggttatcggcgttggtggctaaaaattcaccactaaatgacgcggttgcgcaggggattgaaaatccccgtgtccgtggttcgattccgcgtccgggcaccactcacaataaggcactggtcagaaagacattttctgacggtggagaaggtgtgatggatatacggatgctggatcccgatgagccggggtactttttcaacttcagaaaccccctgcctcataatgagtattatgctgtaaaacctcagttcatgcctccacatggtgcgcgtccaattgtggatgatgctacaggattgtgtattggttacacggtcgcgcaggctcccggactgtggcaggtttatgatgcggatgggcgttttaccacgcttgaagaagccccattgcaaaccccgctcattgatccgttagatattgcgatgattgcagttggtgtttttcgcctgttgagtagtggtcgggcggtgctggatgtcgctgcgggtaaaagcataggcagtatgctaagcgaagcaacgctcaatatgctgcgtggccgcctgaagggaacgggactggacaatttcgcacttccatatcgactgagtggcgggacagaaatgtttgagatcaaaaatgaagatacgttatttcgcttctcatttatcgaaagaattgaggagcctgaagatcgccggctggatttgattatgtgctggctggaaattgccggttgcagtataaacctgcaatgtcagtgcgaactgacgattttcgaccttgaaagtctgaaggaaatgttatcggagttttatgcatccctgtacaaaaatggacgacctaagccggtaaatttcgcaccaagaatgaaagcgttcacctgcgaattcaatgctgtcgagggaagtgatttaatcggtttcaacttcactgcgactcccgctatttatgatagctggcaactgaccggcgggatcgctattgatcaatcctatttccctgcgttgatacagggaatcgaatcgattctgaccaactga

SEQ ID NO: 67719 - DNA, 1176 bp, Glycine max
  Peptide Sequence Number=SeqID_159404
gtgcagatcatcgccgatctcacgcgccgcatgctgcaaaaaaacgggctggagcaggttaaggtcagcgtgcactttgcgctggatgaggcgattcgcggtgcgcgctttgtgctgacacagctgcgcgtcggccagctggcggcacgcgccgccgatgaacggctgggcctgaagtatggccgtctcggccaggaaaccaccggtgtcggcggcttcgccaaagcgctgcgcaccattccggtgatgctggagattgcgcgcaaagtagaacagctggcacccgacgccttcatcatcaacttcaccaatccggcgggcatcgttaccgaagccgtggcgcgctacagcaacgcgaagatcatcggcctgtgtaacgtgccggtgaatatgcaccatatgatcgccggcatgttacaggcgccgtttgacgaggtggcgctgcgctttgccgggctgaatcatctggtgtgggtgcatcaggtgctgtgccgcggcgaggacgtgaccgccggggtgatcgaacagctgtgcgaaggccaggcgctgaccatgaataacatcaaagagatgccgtggtcgccggcgtttctgcgcgcgctgcaggcgattccctgcccgtatcaccgctactactggcaaacaccgcagatgctggccgaagagcaggagaaagcgcagcacggccaggccggaacgcgcgccgaacaggtgatgaaagtggaagccgagctgttcacgctgtatgccgatccgcagctgacgcacaagccggagcagctgagttttcgcggcggcgcatattactccgaagtggccgttgagctcatcagcgccatccataacaatagcgggcaaaatctggtggtgaactgccagaaccgtggggcgattcacggtctgccggacgacgcagtggtggaagtgaactgtgtggtcgatgcgcagggcgcgcacccgctggtgtttggcgcgctgccaccgctgatgcacgggctgacgcagcagatcaaagccttcgagcgattgaccatcgacgcggcggtgcacggcgatcgcggtgccgcgctgctggcgctggtcggcaatccgctggtcggcgatgtcgccagcgccgaagcgctgctggacgaagtgctgacgctgaatcaaccgtggctgccgcagtttgcgtaa

SEQ ID NO: 67720 - DNA, 228 bp, Glycine max
  Peptide Sequence Number=SeqID_159405
atggaaaaaagcaattccttcccacattattacttgtccttagaatgttatcatctaggacctgatagttcatcttcctggatatgggaagttgctgttaaagtcttgccggaatgtctcatctttctaccattgcttccatttctcatgctagagacaaataatttaactgtggccgatggctcaccttctttaagagaaatattccataaagaaaaagcaagttga

SEQ ID NO: 67721 - DNA, 1044 bp, Glycine max
  Peptide Sequence Number=SeqID_159406
atggctttccttcgatccaccttggcgacctcaatggttcttttagcaatgctagccattgtctccgcaactgactattatggatatggtccaacaccaaagcttgagaaccccaaacccaaaacagattacaaagttgacaaaccacaccccagaataccagattactatgcagtgcccaaaccaaaaggaaacgatgaactacatctgcttcccacaatcattggtgtccaaggtgttgttttatgtaaatcgggttccaattatttcccaattcaaggagcggttgcaagagttacatgtggatgggagaatgagcttgggtacgagacaggtcctatatcagtgttgagtcatgtgacagatagtaaaggctatttctttgctacattgtcacttggggagcttggatcgaaattgaagatcactgagtgcaaggcatacttggagagttctccattggagacatgtaaagttcccaccgatgtcaactacgggatcagtggtgctcgtctttcttcttatcgcctccttgagaataagatgaagttgtacactgtgggacctttcttctgcacctcccaacctgctaaaccactccctaacggcggtgactacggtcccgaagaagaaaaacttctatcaaaaactataggcattcaaggcattgtctattgcaaatctgcctctaaactcaccccacttgaaggggccttgacaaggatagcatgcgaggctgttgatgaatatgggtttgaaacgacaccgttttctttcttaagtgaggcaaccgactcgaaaggctacttccttgcaactttgagtccacaagaggtcgaaggaaaaggggtgctcaaggagtgtagggcttttcttgacgcctctcctttgaacaattgcagttatcccacagatgttaacaaagggattagtggtgctgtgcttcgttttcatcgcttcctccatgacaagaagatgaaattatacaccgtggggccttttcaattcaccgcatcaccgacaccaatctctgatggatattaa

SEQ ID NO: 67722 - DNA, 1251 bp, Glycine max
  Peptide Sequence Number=SeqID_159407
atgaccaacttgtacacgtgcctcgatggctttgcgtacagcaaagggcgcgtgggggacagaatcgagaagaagctgcttcaaatatcgcatcacgtgagcaactcgttggccatgctgaacaaagtgcctggagttgagaaattaacaacttcttcggaatctgatgaggtgtttccagaatatggaaagatgcaaaaggggttcccttcgtgggtgtcctctaaagaccgaaagcttcttcaagctaaagtgaatgagaccaagttcaatcttgttgttgccaaagatggcactggcaacttcaccactataggggaagcactgtctgtggctcccaactcaagcacaactaggtttgtgatacacgtaacggcgggggcatacttcgagaatgtggaagtgataaggaagaagacgaatctaatgtttgttggagacggtattggaaagacagtagtgaaaggcagtaggaatgttgaggacgggtggaccatttttcaatctgctactgttgcaaagtttgctctttattgttcatttatgaataatgatccaaaatctaatcctaacagcgttgacaataatggaaaatggtatgttgcagctgttgtaggagcaggattcatagcaaagggtataacatttgagaagtcagcaggacccgacaaacaccaagctgtggcactgagaagtggtgacactctctacgtccattccctgcgccaattctaccgtgaacgtgacatttatggcactgtagacttcattttcggcaatgcagctgtggtattccaaaactgcaacttatacgcacgcaagccaaacgaaaatcagaagaacttgttcatggcacaaggcagagaggaccctaaccaaaacactggcatatccatcttgaactgcaagattgcagctgctgcagatttgatccctgtgaaatcctcgttcaagagctacctaggacgtccttggaaaatgtactctatgactgttgtgttaaaatcttacgtggatatagacccagcagggtggttggaatggaatgaaacatttgcattggatacgttgtattatggggagtacatgaataggggtccatgttcaaacacaagtggtagggttacgtggccaggttatagggtcattaacagctccattgaggcaagccaattcacagttggacagtttattcaagacaatgattggttgaacaacactggcatcccattcttctctggtttgagttga

SEQ ID NO: 67723 - DNA, 1677 bp, Glycine max
  Peptide Sequence Number=SeqID_159408
atgaaaaaaagtcatagttgtggcccatttaaatgcttttcatggacacgaacaaaagtcatagttcggctccaacttggaagaagactgcgcaatcgcgtgtccttattgggtacatactttggcagtattgtattggtgattggtcagactagtgttattctccggtggctccttccttccttcgccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttgaagaaatgcgctgctaaggtgaacatggagtatggtcttgatcccatcgtgggagaagcaataatgcaagcggcacaagaagtagccgagggaaaactaaacgaacattttcctctcgttgtatggcaaactggcagtggcactcaaagtaacatgaatgctaacgaggttattgcaaaccgagcagcagagattcttggccataagcgcggtgggaagttcgtgcacccaaatgaccatgtcaatagatcgcagtcttctaatgatacattcccaaccgtaatgcacattgcagccacaatggaaataaactcaagactaattcccagcttgaaaaccttacacggtacactaaactcaaagtcaattgaattcaaagatattgtcaagattggacgcactcatactcaagatgcaacacctttgactcttgggcaagagtttagtgggtatactacacaagtgaagtacggtattgatcgagtaattggcactttgccgcacctgtatcagcttgcccagggtggtacagctgtagggactggattgaatacaaagaaggggtttgatgccaagatagcagcagcagtagctgaggaaacaaatctgccttttgttacggcagaaaataagtttgaggccttggctgcccatgatgcttttgttgaaactagtggagcacttaacactattgcggcttctttgatgaagattgctaatgatatacggttgttaggaagtggtccacgctgcggtcttggtgaactcattcttcctgaaaacgaaccaggaagtagtatcatgcctgggaaggttaaccctacccagtgtgaggctttgacaatggtgtgtgcccaggtcattggaaaccatgttgcagttacagtgggtggatcaaatggtcattttgagcttaatgtgttcaagccaatgattgccagttgtctcctgcattcgctgagactgcttggagattcatctgcttcctttgaaaagaattgtgtgagaggcattcaagctaatagggaaagaatttcaaaattactgcatgagtcactgatgctcgtcacatccttaaacccaaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccgtctgattga

SEQ ID NO: 67724 - DNA, 832 bp, Glycine max
  Peptide Sequence Number=SeqID_159409
atggactgggtaacgaagtctaataaaaatgggggggaatttaccggcgaccagcaacccaaatcagtgagcgtgaccgtacaaatcataaggagcccaaagtgcatcaagcggacagggctgtttggagtccaatcgagtccagggcttgccactaccggaccaatgcaaaagactcacaggcccagcgtgcaggtcccggcaactccccttcacgttatcgccacccaacccatgctggttccacctgtgctcaattggcgccacgtgtcccgcgaacaccaacagaaacgggggcagagaacccagctcgtagatccgatcgttcttctgaatctccatccacctctctatcctcttgctgtacccgattctccgccaccgcaccagatctatcaccatcacgcccgtgttgaagtagcatggcctccgcccggcgaacgccctcgcgaagcgcgtgtccgaccagaacgctgcggtgaagtacttggtgaagttggcgtggcagtattcaggggcgccgatgggttcgaggaggtcagcgagataatttctggcgtagttgaggggttgttcgagggcttgtctgacagaggtggagatcaggttgcggacgatctcgggatcaaagtaatagaccttgaagttcaattgagggaaggtggatttgacgagggattcgaggttggtttcggagacgaggaagtggaagaagatgttctccgggcactgggagtgttggaggatggagtggacggcggcgatggagccgcggaggtactcgacgtcgagggtgatggcgacgtggacgagggaggggtcgcagacggag

SEQ ID NO: 67725 - DNA, 1056 bp, Glycine max
  Peptide Sequence Number=SeqID_159410
atggacttgtacggtcggggccccgcgagaaatgtacacaacccagtgaaccaacccgaatggcgctcaccgggcaccgacactggtctcgaagaatcgatgtggcatttgacgctgggtggtggtggcgaatcttacccggagcgacccggtgtgcctaattgtgtgtattacatgcggactggggtgtgtggatatggtggcaggtgtcgttacaatcaccctcatgatcgtgctgcggttgttgcggcggtaagagttacaggggactacccagaacggttgggggaacctccgtgtcagtattatttaaaaactggaacctgtaaatttggtgcatcctgtaaattccaccatcctaaaaatggaggtgaatatttaagccaagctccactaaatgtttatggatacccgttacggtcggatgagaaagaatgctcctactatttgaaaacagggcagtgcaaatatggtatatcttgtaaattccatcatcctcaaccggcgggcacatcattgccagcatctgctgctcaattttatcaacaggtgcagtctcctacagttcctctgcctgaacagtatgtaggagcttcctcgagcttgagagtggccaggcctcctatattgcctggttcatatgtgcaaggggcttatggtcctgtatttctttccccaggggttgtccaatttcctggatggaatcattattcggcacttcctggcactcaacctggtgttggggctacatctttatatggagtgacccagttgtcatcaccaacatcagcttttgctagaccatatacactgctgccctcttccactggcctttcaggaagcaacctgaaggaacaattatatcccaaaagacctggtgaaccagattgccaatactatctgagaacaggggactgtaaatttggattagcttgtcaatatcatcatcctcaggatcatgttgtggcacagccacttcttagccctgttggacttcctttacgtccgttgcactacggtcaacacggacagcagtcaatctggagtaggagataa

SEQ ID NO: 67726 - DNA, 1693 bp, Glycine max
  Peptide Sequence Number=SeqID_159411
atggatggaaagaaattagagtacaaaggtgaggaagcactaaaggagatagagaggctgacaatgaaggctgctgaagttcaagaaggccttttgaaacagatcttaactcagaacagggaaactgagtatttgagtaagtatatgaggggagaaaaaaatataacagacgtagcagagtttaagagttcagggacatcagctggagagcctaaaatgatgccatcgattgtggaagatctagaacgccgtacctttgtgtacgtttctgatcttgacgagggcaaggcaatgtatctgtactttgtaaaagcagaaatgtgcactccatgtggcctaccagccagaacagtgttaacaagctactacaagagcaagcacttcaagtgccgcacacacgatccttggaacgactacacaagccctgaccaaaccattctatgcaatgacagcaaccaaagcatgcattgccagcttctctcaggtttggtccaccgccgccacgtcctacgcctcggtgccgtcttcgcctccgcacttctgagagccatttccttcctggaacgaaactggaggcacctttgtgaggacattcgaactggccaactcagttccttcataacagacccttcatgccgttcatgcatgtccacattgctttcatcccctgaccctcgtctcgctgatgaaatcacgagaatctgtagccagaagtcttggaagggaattctgtgccagctttggcctaaggcaaagttcattgaggctgtggttactggctccatggctcagtatgttcctgctcttaagcactacagtgatgggaaattgcctttggtttgtaccatgtatgcttcttctgagtgctactttggggttaatctgaagcctctttgtgatcctggtgatgttgcttttacgctcttgcctaacatgggttactttgagttccttcctcttggacataacgggacgctgttgatggactttgatgaaggggagcaggttcccaatgataagcttgtggatttggtgcatgttaagcttggttgcttttatgagcctgtggtcactacttttgctggattttacaacaacgccccacaagtccgtttcatctgcaggagaaacgttgtgatcagcgtcgacaccgagaagaccaacgaggaggacttgcacaggggcgtgacaatggcaaaaaagttgctggagccctacgatgctctcttagtggagtacacaagctaccccgacacttcttcgataccaggacactacgtattgtactgggaaattcttcattgcgggataaagacgacagagtcatcacaacaacttcaacttcttgacgcaaacgtgcttgaggaatgttgcattgcggtggaggaacaattggactacgtatatagacgatgccgtagctatgacaagtctgtggggccacttgagatacgtgtggtggagccagggacgtttgatgcattgatggacttgtttattagccaaggtgcttccatcaatcagtacaagactccaaggtgcatcaagtctaagaaagcactcaagttactcaagtctaaagttacagcgtctttcttcaaacctagggatcccaaatggtcccctaagatgtgtcaacttgaggattattatgtatggtgtcttattgattgcctcaaacctcaagtgattg

SEQ ID NO: 67727 - DNA, 3276 bp, Glycine max
  Peptide Sequence Number=SeqID_159412
atgggaggtttgggattaatcattttgttattcatctttctgcagaatcctcacgtgtccatgagtgatcttatcttcactgttggtcaaggtcgtaattgtaatttatggcttaaagatcccactgttggtaatgttttgtgcaagttgagccacatagagcgtggaggctcatctgttgcattacttgaaatcacagggggcaaaggttctattcaagttaatggcaagacatatcgaaagaatgcccgtctgattttaagtggaggtgatgaggtggtctttggttcttctggcaagcatgcttatatctttcagctgctcacaaataataatattagtcctgctgttataccttcttctgtgagcattttagaagcccagagtgctccaataaatggaacgcaagttgaagctagatctggtgatccttctgctgttgctggagcatcgatattggcctccttatctaatcttcctaaagatttatctctcctttcacctcctgctaaaactggaaagaatgtgcaacagaactctgacatttcatcactaccttctggcaacgaggatgatatgccaatcagtgaaatgaaggatgccaccaatgatgtagcatctgaagtttgctctgctgacaaaactgttaatgaaaatcctagtcttgacacagcagaagtcgacatcaatgtggatgccgatgttaggaaggttactgctgctacatatgaattgaggccattactgcgcttgcttgctggttcatgtcctgaacttgatttaagttgtggcattaccaagatattggaggagcgaagggaattaagagagctccttaaagatgttgataccccaacaatattggcatcaaccaggcgacaagcatttagggacagtttagaacagagaattctcaaatctaagaatattgatgtctcttttgaaactttcccatattatctaagtgatacaacaaagagcgttttgattgcttctacatttattcatttgaagtgcatgggctttggaaaatatgcttctgacctctcatcagtgtctccacgaatattgttatctggtcctgcaggttcggaaatatatcaggagactttgtgcaaggcacttgcgaagcattttggtgccaggctactgattgtcgattctctctcattgcctggcggagcaccatcaaaggaagttgattctgccaaagaaagttccagacctgaaaaaccatcatctgtgtttactaagagaagttcccagactgccacattacaacataagaaaccagcttctagtgttgatgctgaaattgtaggtggatcaacgataagttctcaggctatgctgaagcaagaggtttctactgcatcgtcaaagggcactactcttaaagagggtgatcgagtaaaatttgttggtaactttccttctgccgtctcatcactgccaaattatccttcaaggggacctagctatggctcccgaggcaaagttctgcttgcttttgaagataataggtcttcaaaaattggggttaggtttgataaatcaattccagatggcaatgatcttggaggcctttgtgaggaggaccgtgggttcttttgttctgcaaatcatttactacgggtagatggttctggaggggatgacgcggacaaagttgcaatcagtgatatctttgaggttacctccaatcagagtaaaagtggtccactggtgttgttcattaaagatatagagaaggcaatggttgggaactatgaagttttgaaaaataaatttgaaagcttgccaccaaatgttgtggtaattggctctcatactctgcttgacaatcggaaggagaagacccaacctggtggccttctgtttaccaagtttgggagcaatcagacagcactacttgatcttgcttttccggataactttggtagactgcatgatcggagcaaagaaacccctaaagtaatgaagcaacttggtcgtcttttcccaaacaaagtgacaatacagctgcctcaggacgaggctatactttctgattggaagcaacaattagaacgtgatattgaaactatgaaagctcagtccaatattgtcagcattcgcacagttctcaacaggattggattggattgccctgaccttgagactcttagcatcaaagaccaaaccctaacaactgaaagtgtggagaagatcattggctgggctataagttaccattttatgcattcatctaaagcttctatcaaagattccaagcttgtgatatctgcagaaagccttaattatggaattaacattctacagggcattcaaaatgagaacaaaaacttgaaaaaatcactgaaggatgtggttactgagaatgaatttgagaaaaaacttcttgctgatgttattccaccaactgatattggggtcacatttgatgatattggagctttagaaaatgtgaaggacaccttgaaggaattggttatgcttcctctacagaggcctgaattgttttgcaaaggacagctggctaagccttgcaagggaatattgctttttgggccccctggcacaggaaaaacaatgcttgcaaaggctgtagcaactgaagctggagcaaatttcattaacatttcaatgtccagcattacttcaaagtggtttggtgaaggagagaagtatgtcaaagctgtcttttctctagccagcaaaattgctccaagtgttatttttgttgacgaggttgatagtatgctagggagacgtgaaaaccctagtgagcatgaggctatgcgaaaaatgaaaaatgagtttatggtaaattgggatggtctgcgtacaaaagataaagagcgtgtacttgttcttgctgctacaaacaggccttttgatcttgatgaggctgttattaggaggcttcctcgacgattgatggttaatttgccagatgctccaaacagagaaaaaattctcagagtcattttagtgaaagaagatttggcacctgacgttgattttgaagcaatagctaatatgactgatggatattctgggagtgacctaaaggttaatctgtgtgtcacagcagctcactgtccaatacgagagatcttggagaaggaaaagaaggagagaagcttagctttgtctgagagcaaacctttacctggattgtgtggcagtggtgacattcgtcccttaaagatggatgattttagatatgcacatgagcagggtgtcctcaaaagtaagatagctgccttgtga

SEQ ID NO: 67728 - DNA, 282 bp, Glycine max
  Peptide Sequence Number=SeqID_159413
atgcggaatggactgagttccgagttgggaagagaccgcgactcagtcgccggggacgggaatgagatgcgggtcaagtgtgtgagggtgttagtatttaataaagagcgtgtgtgggaggggggaagggaaggctttcggtgcaaagacggaactgcccctgtcatttggtgcgaggtcaaggttggtttttcaattcaggccaagcactgcgtgataaatattccagttctgcgattatatatcaggaagctaaacgatgaccagatattgaaaggataa

SEQ ID NO: 67729 - DNA, 798 bp, Glycine max
  Peptide Sequence Number=SeqID_159414
atgtcgcacaagcctctggactcgcgccactccatagactcgtgcttgttgcagctccgcagctggaaacccttcaagctccaacaagacgggccccaccctaaaccctactaccacaaacgcccctgcctctccgatcgcacaaccacctcgttttccctcgacatgtccaaactcaccctcgccgccgacgacgacaccattcacaaccccaacaacaaccgcgccaccaattaccgcctcgtcgcgcgcaagaggcgccgccgcggctcccgatccctgtccggccgcagcagcgaccggagcgggacgcggcgctgctgctccgtgggggcctccgccgcttacggcacctgctccgatttcccggtggccatgggcaccgattccagtggggagctcttcggcaacggggatccgaattggtcttcggacgtgagcgaggcgaagaattcgaggagggagagagagagggatggcgagaaggagaatgtgggtgttgggtttggggtgagtggctgctctgatgcaaatggtaacgaatctgggtatgggagcgaaccgggttatcgcggggatgctgagtttggatatggggatgagtttgatgaggaagaggatgatcccagattgttgttctggggtgaccaacttggagagaatgacttgaccttcattgcaccagctgtagattctaaaagggagatggttggagagaacaccttgctagatcaaaaatctcatcatagatgccgtcgcaggaagcatgattgtagaatggttgatgcattaaggtga

SEQ ID NO: 67730 - DNA, 339 bp, Glycine max
  Peptide Sequence Number=SeqID_159415
atggaagaagacctggacggcgtcgctccgtgctcctccctcgccgtcgaggctatgattcgtgtcggagcggccggtgcaatctggggcttgtgtgctggtccttacgacgctcgtcaacagggtcttagaggctctgctaaagcttcttttgtggcaaagtcggttggcaggtttgggactcgatgcgggtttgtagctggcgttttcagtattacgcgatgcggggttcagaggtaccgagggcggaatgattggttgttcttgactatacccaagggttggtctcaatactgcctcgtcatgtcggggagagagatgaatgtgcctaactattaa

SEQ ID NO: 67731 - DNA, 888 bp, Glycine max
  Peptide Sequence Number=SeqID_159416
atgcctgttactcactcaccgattctggtggcactcgactatcatgatctcaatagcgcactgcagttcgttgaccgtatcgatccgggccagtgccgtctgaaagtgggtaaagagatgtttaccctgtttggaccgtccctggtgaagacgttgcaggcgcgcggtttcgaggtattcctcgatctcaaatttcatgacatcccgaacacgacggcgcatgcggtcgcggcggcagcagatctcggtgtgtggatggtcaacgtgcatgccagcggcggggcgcggatgatgaatgcggcgcgcgaagcgctactgccgtttggcagtgatgcgcccttgctgattgcggtgacggtgctgaccagcatggacgaagacgatcttaaaggtcttggcatcaccttatcgccggcgcagcaggctgagcgtctggcacggctgacacgcgaatgtggtcttgatggcgtggtgtgctcggcgcaggaagccgcgcactttaaacaggttatcgggcaggatttcgcgctggtcacgccgggtattcgcccggcgggtagcgaggctggcgatcagcgccgcatcatgacgccgcagcaggcacaacaggccgacgctgcagcaaatcctgcacagtttacaggaggtctaatggctcaggacaatccgctggtttactccaccgaaaccggccgtattacgcatagcgaagagaaaccacagcgaccgaaaggcgatggcatcgtgcgcattcagcgccagaccagcgggcgtaaaggtaaaggcgtgtgcctgattaccggcatcgatctcgatgatgacgcgctggcaaagctggcggccgagcttaagaagaagtgcggctgcggcggggcgctgaaagagggc

SEQ ID NO: 67732 - DNA, 1725 bp, Glycine max
  Peptide Sequence Number=SeqID_159417
atgaacaacgtcagaaccggattgatctggttagcggtggcgttaattggtgcggcggcgttcgccatgctggcgctcagtcgcggcgagcacgttaatgccgtctggctggtgatcgcctccgtcgcctgctatagcatcgcgtatcgcttctacagcctgtttatcgccaggcgcatttttgagctggacgaccggcgccgcacgccggcagagcgcttcaatgacgggctggactatgttcccaccaacaaatgggtgctgtttggtcatcactttgccgcgatcgccggtgccggtccgctggtcgggccgatcctggcggcgcagatgggttttctgcccggcaccatctggattctggtcggcgtgatgctggccggcgcggtgcaggattttctggtgctgtttatctccactcgccgcgacggtcgttcgctgggtgagatggcgcgccaggaactgggctcgttcgccggcgtggtcaccatgctcggtgcgctcggtgtgatgatcattattctctccgcgctggcgctggtggtggtgaaagcgctggctaacagtccgtgggggctatttaccatcgccgccaccattccgattgccctgttcatgggcgtgtatatgcgctttctgcgtccgggtaaaatcgccgaagtgtcgatcatcggctttgtgctgatgatggcggcgatcatttacggcggtgacgtggcggccgatccgtactggggaccgatttttaccctgaaaggcaccgagctgacgtgggtgctggtgatctacggttttgttgcctcgtcgctgccggtgtggctgctgctggcgccgcgtgattacctctccacctttttaaaaatcggcgtgatcatcgggctggcggtgggcattctgttcgccatgccggaactgaagatgccggcggtgacgcgctttatcgacggcacgggcccggtgttctccggcgcgctgttcccgttcctgtttatcaccattgcctgcggcgcgatctccggcttccacgcgctggtgtcgagcggtaccacgccaaaactggtggagcgcgaaagccatattcgcttcatcggctatggcgccatgctaatggagtcctttgtggcgatcatggcgctgatttgtgcctcggtgctcgatccaggcgtctactttgctatgaactcaccggcggcgctgattggcaccacggtggagaacgcgtctcaggttattaacggctggggctttgtggtgacgccggagatgctgagcggtatcgccggcgaagtgggcgaaagcaccattctctcccgcgccggtggcgctccgacgtttgccgtcgggatggcgcatatcatcaccgaggtttttaacagccgagcgatgatggcgttctggtatcacttcgccattctgtttgaggcgctgtttatcctcaccgccgtggatgccggtacccgcgcctgccgttttatggtgcaggatctggtcgggaccgtggtgccttcgctggctaacaatcgctcgtggctcggaaacatggccggtaccaccgtggcggtggccggctggggtttcttcgtgtatcagggcgtggtcgatccgctcggcggcatcaataccctgtggccgctgtttggcatcggtaaccagatgctggcgtcgatggcgctgatcctcggtaccgtggtgctgttcaaaatgaaaaagcagcgttacgcctgg

SEQ ID NO: 67733 - DNA, 177 bp, Glycine max
  Peptide Sequence Number=SeqID_159418
atggtttccggggcttctgtggcttccgtaaaatttctgaaaaccttggaaaatccaagccggggtgtttccgtaacgcttccgaaacatttccgtaagcaaattcgtgaaggtttttcgtcgttcttcaccgttcttcatccgttcttcgtacgttcttcgttcttcaatgggtaa

SEQ ID NO: 67734 - DNA, 93 bp, Glycine max
  Peptide Sequence Number=SeqID_159419
atgggaatatttgtttatgattatttggttgacacttctgcctctgttcaaacaagagagagcatcaatgagttcttgacaagtgttaaatag

SEQ ID NO: 67735 - DNA, 735 bp, Glycine max
  Peptide Sequence Number=SeqID_159420
atgaatcagagctcaaagcagaaagaacattattataaaaaaggaaaccaagcaagactgatccacaaaaatcagacaaagcactcaatcaaatcttctgtttccaatcaaatcctccatcttcaccctcagctcctccagctgctcccagttcatgtaaagcaccccttggccattggcatttgtgagcaacaagttgtcgagggtggcccgctcagagattatcggttgaaccaggtaatgtatgcaggaggcggcgttgaaggagattacggtccaaacgatgtgcagtttgaggtcgccattggtgtagaaggagttagtgatgcttcgattgtcactgctagggaactcgatccggaggagacgaatctcgttgaagttcttgaggacttgggttggggagtggtgggtgacgccgctgtcaaagtcttcgtcggaaccgatggcgagggaggaggtggaagaaggggatgtggcagcggtagtggcgacggaggaagaggggtgtttgggaccgaggaattggctgagggtttgaatgggtttcatgattccgccaaagacgaggcggaggaggttctagaaagggttgtcgttggaggcggcagaggaggaggaacaatcgccgtcagagatcacgtagtcgatgcggacaacgaaatttttgacctgcgggacgagggagtggaagcaacgcttgctctttcgagaatgagggagcacgaagagtag

SEQ ID NO: 67736 - DNA, 162 bp, Glycine max
  Peptide Sequence Number=SeqID_159421
caacgtaccctagcctcttctccttccattcaaccccatgacgttgaggaacttcccgactcaaacttccaagttcgtgaagaaattagtttgaacgaaggagtggcagttcgtgaagaaagacattggagtcactgcgaagaaaccagggaagatatttga

SEQ ID NO: 67737 - DNA, 486 bp, Glycine max
  Peptide Sequence Number=SeqID_159422
atgaaggcgagggcatggagccctatgaaggcgagggcgtgcagccctctaaaggcgatgacgtgtagtcctctaaaggaaaaggcgtgtagccctctgaaggcgaggacgtgtagtcctctgaaggtgagggcgtgtagccctacgaaggcgaaggtgtatagccctctaaagaggaagacgtgtagtcctctgaaggtgaggacgtgtagccctctgaaggcgaggacctgtagtcctctgaaggtgagggcatgtagtcatctgaaggcgaggacgtgtagccctctgatggtgaggacatgtagtcctctgaaggagaggacgcgtagccctctgaaggtgagagcgtgtagccctacaaaggtgaggacgtgtagccctctgaaggggaggacgtgcagtcctctaaaggcgaggacgtgtagccctctgaaggcgaggacctgtagccctctgaaggtgagggcgtgtagccctctgaag

SEQ ID NO: 67738 - DNA, 252 bp, Glycine max
  Peptide Sequence Number=SeqID_159423
atggactctagagatggtggctattgtagaggtggcagtggtgcatcagatgatgtgaacctgagtaggagcggatcatttgatacaggctacagtggtttggatgacgccacttcagcaacaattaatagtcttgatagtgtttctgcctttgggccttcatccttctccactagggccttcatccttctccactcgggggctttgtccttctccacttgggcctttgtccttctccacttgggtctttag

SEQ ID NO: 67739 - DNA, 495 bp, Glycine max
  Peptide Sequence Number=SeqID_159424
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttgtctcatttccacgcctgacactcagttccggggtaggcagttcgctcccaagctggact

SEQ ID NO: 67740 - DNA, 603 bp, Glycine max
  Peptide Sequence Number=SeqID_159425
atgaagaacatctttgcttttttcgcctcctttctattagcctttccattgtttgctcaaagtaacaaactgctgggtaaatgggttttagactttgcattgactgaagaaaattcacttgttcctgtagataatccttatttttccaatgaagttatctatgagataagtccgaataaaatgaaaatatctgcctatatgtttgatgcgaaatatattggggataatgagatagatctggggcacatgaagctaaactacgcgttcattgaagattatttgacagttgtcgagaaggacgattttgttaaaaaatatccggaatttgaagagaaacgaatacttcgtgacggaagagaattttatattgctaataatctttccaaattagtatttgataatggaacaatagatcccaattcgtgtattactaatggggcaccgctattgaaaaagaagacatccaaaaactactttctaaaagtggagtttatacttgaccagagtaatcagatttcaaatattgtcgtttcagacattgaggaggatgacattaggcagcaagttatacaatcgataaagcgttgcgggcaagttttataa

SEQ ID NO: 67741 - DNA, 291 bp, Glycine max
  Peptide Sequence Number=SeqID_159426
atgtcttccaagattattttgatggtgccaaagaatcaagagtcaagcaagttccacaaaatcaagagtcaagaaagtttcaagaatcaagatcaagattcaagattcaagaataatcaagatcaagatccaagattcaagaatcaagattcaagtaaagaatcaagactcaagattcaagaatcaagagaagactcaatcaagataagtattaaaagagtttttcaaaaactattgaatagcacaattttgttcaaaagaaaatttttaccaaagagttttactccctga

SEQ ID NO: 67742 - DNA, 231 bp, Glycine max
  Peptide Sequence Number=SeqID_159427
atggttgcagttgccgctacaagcgctgttgctaaggtgaacccgatgcccccatctgatctcaaccaaatgaatcatccaacctcagatatggatgtcaataactacactcccatactcattgaaagccaacaacctcaatctgatcatgcacatgtctctcaacccatgggggagacacatggaatgccccaccataatctagtcgacttcgagccttgcctcggataa

SEQ ID NO: 67743 - DNA, 513 bp, Glycine max
  Peptide Sequence Number=SeqID_159428
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgaagagaaatgctattcccactcggaccaagacataactttacttgttcaaataacaatttaagggtgaagcagagtcaggaacaacgaatccctttatga

SEQ ID NO: 67744 - DNA, 165 bp, Glycine max
  Peptide Sequence Number=SeqID_159429
atggagtttgaggaaacatggcaggggttatggctaccattgaattatcaactagataaaggagcaaggatgacctttgtggataactgggtggtaggtaaggagaagggttgttattggctgagtaatgacattgttgggctggtgggaagtttggccatgtag

SEQ ID NO: 67745 - DNA, 198 bp, Glycine max
  Peptide Sequence Number=SeqID_159430
atggatcaagctggcgaggaaaggaagttgcaactaagtgacctagatgaaatccgtttagaagcctatgagaattccaaattctacaaagagaagcccaagaagttccgtgacagcttgatagctaagaaggacttcgtgttgagatcaaaagtgaatccacagataagggcttcaaggtcaatggacaccggctga

SEQ ID NO: 67746 - DNA, 175 bp, Glycine max
  Peptide Sequence Number=SeqID_159431
atggaagatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacggggtggagacgatggg

SEQ ID NO: 67747 - DNA, 480 bp, Glycine max
  Peptide Sequence Number=SeqID_159432
atgaagaagaaactaaccggatgttgcacaaggtgcaaggctagcaagagaagcgatgtagggaatgacaacagtcgtaatttcacagcgcctcggcttcacttttcttcttcttttcctcttcctgctgaaggacctagctcacccaggcgagctggttgcttaggcccgaaggcttttggtggcctaggcgagccagatgctaacctcggcgagctggggacctcgagagcttttgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaataaggagatgaatgaagggcgagggagagaagagcacgaaattttgtgctctaaatga

SEQ ID NO: 67748 - DNA, 201 bp, Glycine max
  Peptide Sequence Number=SeqID_159433
atggcttacacacacattccgatggaagattcacaagcgattctcctcgaaatttcagccagcccacatcaattagaccttgcaccttatgcttcagggttgaggaaccttggctggggttatggctggggttttgacaccgggattggggtaggcattgcggctgatttggagacaacctctgtggatgattgggtggtg

SEQ ID NO: 67749 - DNA, 591 bp, Glycine max
  Peptide Sequence Number=SeqID_159434
atgtgtagtcctctgaaggtgagggcgtgcagccctctcaaggcgagcacatgtagtccacttaaggcgagggcatgcggccctctgagggcgagggcgtgcggccctctgagggcgaggatgtgtagtcctctgaaggtgagggcgtgtagccctctgaaggtgagggtgtgtagccctcaaaaggtgagggtgtgcggccctctgaaggcgagggcatgcaaccctctaatggcgaggatgtatagtcctttgaaggcaagtgcatgcagccctctcaaggcgaggacatgtagttctctaaaggtaagggcgtgcaaccctctcaaggcgaggacttgtagtcctcttaaggcgagggcgtgcacccctctgaaggcgaggacgtgtagtcctctgatggtaaggtcgcgtagccctctaaaggtgagggcgtgtatccctctgaaggcgaggacgtgttgtcctctgtcggtgagggcctttagccctctgacggcgaggacatgtagtcctctgaaggagagggcatgcagccctatcaaggcgaagacgtgtagtcctcttaaggcgagggcgtgcggcccttga

SEQ ID NO: 67750 - DNA, 397 bp, Glycine max
  Peptide Sequence Number=SeqID_159435
tgaaaacgctgtgaatgaagtaacggaagtaccatatacaatggtaccttccaagaaggacaaggaccatcatttggtgagatttttagatattttcgggaaactggagataaccatgctcttcggagaagaattacagcagatgccactctactccaaattcttgaaggatatgttaacaaggaaacataagactgctaagctggaggagactttggctcaattaatgcagataacaacgtcaaatcataaaagcactgagtcagcactgaagaaccttgaggtacaggtgggacacctggccaagcagatagctgacaagtcatctaatagttttgtgaaaaaatacagagacgaatcccaaggaggaatgcaaagctgtgatgacaagaagtaa

SEQ ID NO: 67751 - DNA, 894 bp, Glycine max
  Peptide Sequence Number=SeqID_159436
atgcaaggtaaaactctagcaggggatttagctccattggatttggagattgaagcaacttgctggagaaacaacgcagaaaaaaggaagagagtgctacaagagaggacaactaacccaagtggcgagagaattttgtcgtctgaatcctcatcatcatttccagtagattttagaggaactgaagttggtgcattcaaagctaacaccatggcagacgatcaactgcagagggtaactcttgaagattattccagctccaccgtgctgcagtttttcaccagaaaagctaaaagatggttgcaatctttcaaaggaaatagtccgaagacatgggaaaaagtggtggagaaatttttaaagaaatatttccctgaatccaagacagctgaaggaaaagtagcaatttcctcatttcatcaatttcctaacgagtccttgagtgaagctttggagtgtttccatgtcggagggaagatcaagttgaagactccagaggaagcaatggagctaattgagaatatggaagctagtgatcatgctgttttgcgtgatagaacacacatccccacaaaaagaagtctgttggagctttcctctcaagatgcattgttggctcaaaacaagctgttatttaaacaacttgagtcactcacaaagacactaagcaaactgccaacacagctgcaagaaactcaaccgtcttactcagcagttatgcaggttgggggctatagtatttgtggaggggctcatgaatcgggttactgtataacccaagatgatgcaactaaagaggttaattatatgggaaatcaaaatagacaaggatttcacacatgtggtttctcaaggtaccagcagggagaaaactttaatcaaaatcaaggataa

SEQ ID NO: 67752 - DNA, 312 bp, Glycine max
  Peptide Sequence Number=SeqID_159437
atgaggggcactgtgcataagcctcgagcgaacctaggggaagatcaaaagttctcacccgtcgatgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaattagacctacgtag

SEQ ID NO: 67753 - DNA, 567 bp, Glycine max
  Peptide Sequence Number=SeqID_159438
atgggtcagacactttatggacctgccatgactgttactttcttctccttgaatgcacgtttgcactttgcaggacacttttgggtgcctattggaaagtatccattatccagcaaagttttcggtaaaagacatctcatttcagccttctgcaaacataaaacaaagaaacagaaaaatagctatgaagcatggatacctcttttgttcaaagtgttgccgtgttgggcaaattcatctaaggaaacacctgttttgtcacctttagtcccagtttcattattgggtagttcaaaaggtgaagaccagaagctgaaagttgttactatgcaagaaaaagttcaagtggtattaatggcaataaaacagagtcgagagatcgtcaacttggttgctgctttggttcgtggtatgcttgttaaagatgcattgatgcagttggaattgacaataaatcgagcagcaaaaactgtatatcaggtagtaacactaggtattttcattgtcacctcattggacaagcttgcaaaatctataattttaattgctttcaaagttcctctgtga

SEQ ID NO: 67754 - DNA, 174 bp, Glycine max
  Peptide Sequence Number=SeqID_159439
atggtttctaggattccttcagtggagcagcagaacataaaatggaaagcatatatgcagaatctcaagatccaagtgatcctaattcctaaggctaatttcattatatatattatatcttcttcggtggatgtttctgattcctgtgatatatacactttactaaagaagtga

SEQ ID NO: 67755 - DNA, 372 bp, Glycine max
  Peptide Sequence Number=SeqID_159440
atgagcaattcctctgctggaacctcatcaaaaccaagaacagcttcctcacaaccatcagaaacttcgtccaagcgcaaaagaggagttttccaaaaagaattgcagcacatgatgtatggctttgaagatgatcctaatccacttcctgaaagtgtggctcttatggaggacattgttgtggagtatgtcacagaactggtaagactctttaactttttagttgttcaactctgtctgagtggcctggactcctggagtagttatgctaaacttgtctgccaagagctgaaacaagcaagaaaggttttcgaatcagacgaagagaaactaaggaaggtttttgaggtggatgactcacttgaaggatga

SEQ ID NO: 67756 - DNA, 1014 bp, Glycine max
  Peptide Sequence Number=SeqID_159441
atgaatcctaacaatgatggtcctatgattcttgtgaaggaagagtttcccgaaggtgtggctattgctccacaaccattggaggggcttcatgagattggtcctccaccattcctcacaaagacttatgacatcgtcgatgatgtttccactgatgagatagtttcgtggagcagaggaaacaacagcttcgttgtgtgggatcctcaggctttttccgtgactcttctccccagatacttcgagcacaacaacttctccagctttgtcagacaactcaacacctatgggtttagaaaggtagatccggataagtgggagtttgctaatgaagggtttcttagaggacagaagcatctattgaagaacataaggagaaagaagacattaactaatcaacaacaagctcttccaatagaccattgtgttgaagtggggaggtttggatcattagatggtgaagttgatgcattgagacgtgacaagcaagttctcatggtggagctagtgaagctcagacaacaacagcagaacacaagaaacaaccttcaatcaatggaaaataggcttaaaaggactcagaagcagcagcaacaaatgatgaagttcttgacaagggcaatgcagaaccccaacttcttgcaacaattggttcaacaaagggaatggagaaaggatcttgaggaggcagctactttttccaacaagagaataagaagtgatgttgaagaatgctcaagttttgttaaacttgaacatgaggaggagcacaataatgacataacatcatcagagcttgaggtttctgacatggaccttgttattatgaacactgaggaggaggaagagaaattattaggagctgaaattgaaagcattaatgaggaagtactctgggaagagcttttgaatgagggtactgaagaagatgtactaataggattggaagaagatgatgaagatatagttgtgttggctgaggaacttggttatttggcctcaactcccaaataa

SEQ ID NO: 67757 - DNA, 570 bp, Glycine max
  Peptide Sequence Number=SeqID_159442
atgcatcagtttgtctctacgtgggattctttttgtgggtttttggtgcttttactgactgtgattcccgtggagaagaatttgggtgctggcggtggcagcaatgctaatggtaatagaaatggtagcaatgatagttctaatagtagcttcagtggtgaaattgtaccagaagaaaatttcttggggatttgtagcagagaattgctagccagaggttgtgaacttctcaagcgcactcgcaccggtgaactgcattggaaaattgtatccgtttacataaacaggatgaatcaggttatggtgaagatgaagagcaggcacgttgctgggaccatcacaaaaaagaaaaagaatgtggtgcttggagtgatcaaagatatgcctgcttggcctggacgccacttgcttgaaggtggtgagaaccgtcgctactttggtttgaaaacagtgatgcgtggtgttgtggaatttgagtgcagaaatcaaagagagtatgatgtatggactcaaggtgtgtcaaggcttctatctattgctgccgagaggagcaacagaaaccgaatatag

SEQ ID NO: 67758 - DNA, 378 bp, Glycine max
  Peptide Sequence Number=SeqID_159443
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctccaaacttatctgccataagaaaagtgttagctcttttcaaccatggcacaagtattcctttaatgcttaagcaagcactaaacttgggtgcatag

SEQ ID NO: 67759 - DNA, 279 bp, Glycine max
  Peptide Sequence Number=SeqID_159444
atggaggggactgtcttcactcctgcactgcaagaaattgagcatgtaaagtctgatcaaggagaaattctgagcaagcctttcttggatgcgtgcaagcacatattgcctgtaataggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 67760 - DNA, 366 bp, Glycine max
  Peptide Sequence Number=SeqID_159445
atggttgacgatgttgctcagaggagtgaagatgtgcctcagatgaccgcggacatagatgtgactgttgtagaggacttaggtcgtgatggtgctgaggggtcacatgctgatgagggatttcctggtgggccccgtgacccatcagttttgacttcatttgcggagcatgtcgcacatgccatttggactggacatgagcatcctgagctgaagttggtgtcgcacgggaggaaggtggcattaattaggaggccagtgcctgcgattgaagggctggttgtcgccacaggattaagtccattgatcgagtattcagttgtaactggcgatcctggacttatatccgcatttgtggagaggtga

SEQ ID NO: 67761 - DNA, 426 bp, Glycine max
  Peptide Sequence Number=SeqID_159446
atgttaatgtgtaatgatcaattttcgtgtgttcgtccgattgagttattatgctccattggaagaacaccagatgaagtaataaacttacttgaacgcactacgacccctactcatgaggcgctcttgtattacaacgggagatggaacatgccactccagaaaaaatttgtaggatgcgcattcataggaaaaaatccaaagaaatttgaaattccttcaggatgtaccctcgatgaactgaaggatttgataaagcaagttgcatctaaaaggattccccctcatggaattcacgaatcacaagcggtgttggtacagtctaactactggaaaaaatatgggtcaatagagattttagctgtttttactaaacatggtatggaattcgaacacgatgtggataccacgtcgctaaacgaatga

SEQ ID NO: 67762 - DNA, 357 bp, Glycine max
  Peptide Sequence Number=SeqID_159447
atggacgaagatcaatggacgtatgactatacgatgtcacaagaagttcatatggattatgataatgaagaagaatgtggtgcgaatgaaccacatgttgattgttcgaatgcttttaatacctgtcaggtctttggtactcgagatgatattttgcagtgggctcgaacagttgcccatgaaaatggatttgttgcaatgattatgaggtctaacatagatactggtgtgaaaggagtggtctgtacaagtgtaggaataaaaaattcgttagaagagatattgggagtaggaaatgtggttgtcccttcaggcttcgtgggaaaccagtgcatggaggggaaggttggatggtga

SEQ ID NO: 67763 - DNA, 264 bp, Glycine max
  Peptide Sequence Number=SeqID_159448
atggatggagccccttacctaagaaagattgatttgagagtctatgttcaagctttagagaccatgttcaagttgaccataggtgagtactctaaaagagagggttataagggatctgaatatgcacctacatatgaagacaaggatggtgactggatgctagttggagatgttccattggagtcacatgtttatgacttcctgcaaaaggctaagagtcatgtgaaaggctcaaaagctagagggcttggttgtggtgtatga

SEQ ID NO: 67764 - DNA, 402 bp, Glycine max
  Peptide Sequence Number=SeqID_159449
atgtatacaagccatcaatatcgtgatcagaggcctaagcatgaggagagaagaccaaccttacaagacatggtgatggagcacataactgagagttatgagagaaatattgccacacttccttcccagattgaagctaatcctaagaatgaggaggtgaatgttgtgagcaccaggagtggaaagtccatggcaaaaccaaagaaaaaaagaaaagaggagcatgaagacacaccacttattttgggacaacccttcattaacacaggtggagcattgattgatgaggaggaagtatttaagaccattaacaagataaaagtgattgtggctaagtctaacccaagtatggggaagaaaaaccataccaagaacaaagttattctaaaagaccctagatga

SEQ ID NO: 67765 - DNA, 549 bp, Glycine max
  Peptide Sequence Number=SeqID_159450
atggcctacatcaggaagaactgttggaatcctgatgatctgacaatttctatccgaggggctaggagggcgaaagcgaggccaacgaatcttccttcaacatctacagttcctactccagcatccactttagtagctccttcagtcctagctcagcttgattctcagtgctttgaagccatgcttcagagcattcatcagggacacatcattttacttcaaagtttacaggtggtggctcctccaagattcattccttccattgagcagtttttggagagggtaaaggatgcttcctctgggaccaccattccagaaccatttacttttcaactggatgcaggtgaagagcaggttagaccagagactgctgctactccagagagatcacttgagagtacatcaaagccttctactccagtagcagacctcttctcactacagcctgaagctgacccttgcactcctgtacttgatataccagaggatcagaccacaccagtctggacactgaacacctctcctccagctactccagtacttcactag

SEQ ID NO: 67766 - DNA, 117 bp, Glycine max
  Peptide Sequence Number=SeqID_159451
atggccctctacaggatattaggctgccttgcagcggcgttttctgtttgcccagagccaggaagggacaacgatctgtcggtcgtcaccctagcctctatttgcgttcgttcctaa

SEQ ID NO: 67767 - DNA, 372 bp, Glycine max
  Peptide Sequence Number=SeqID_159452
atggagtgcctagagggtgtttgggagaccctcgaaggcaatgagaggtgccgattccgtggcacaattcgactcactgctacttcattagtacatccggaggaacccgcacgcacacttaagcagcctgtggagtggatactacctacacctactccatatcgactagttgagccggttcaggtgatagaggtgtcatcctttgaagagaatcttgaagaggacccagagaagttacctcctaaacctgctatggacgcccttgacttacctgaggataatgaagacccactccctgatgttgattctccagaggatattatgtcagcatctgaggcagactctacagaggtgggtaaacctattgtatag

SEQ ID NO: 67768 - DNA, 462 bp, Glycine max
  Peptide Sequence Number=SeqID_159453
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcgccgctctagaactagtggatcccccgggctgcaggaattcgattggagctatgtttcatgatttcctaagtgcggaccctcaaggcaatcctccattctccctctttttcggagccccatga

SEQ ID NO: 67769 - DNA, 255 bp, Glycine max
  Peptide Sequence Number=SeqID_159454
atgaagaagaagaaggttgcagtagctggtgtctcactaagcaaggcatatacgcttagcaagcaacatcctctaagcgaggcactcagctcgcttagcaagttaggagaatctggaagagaatctgccaagcatgcacgtgcccagtgcgccattagctcgcccagcgagtcatttgtctcttctggcactaagcgcgcctggcaagctaagccaaaattcactaactctcgcttagcgcgaaaatggcgctaa

SEQ ID NO: 67770 - DNA, 111 bp, Glycine max
  Peptide Sequence Number=SeqID_159455
atgcacaaaaatgagagagatgggaagtgggaaaatggtttcaaggtaagggtagatatgagaagaatatttaggctaaaactaagggaaaagaggggcaacggggagtaa

SEQ ID NO: 67771 - DNA, 96 bp, Glycine max
  Peptide Sequence Number=SeqID_159456
atgaaacgcccgaagaaccatcctttcctagttaacaatgtgttagaggaaaatgcaaggcatgggcaactatgtgtcaggatcatgcataagtga

SEQ ID NO: 67772 - DNA, 354 bp, Glycine max
  Peptide Sequence Number=SeqID_159457
atgcgagtggggaattctgatatctatggattcctcgagccacagtccattcagaggtctgggcaatcgcagtttgagtctgaaagttacataaagagttggatgcagagttcacaacgtgatgtctatcttggagcctacctagatgggttccactgcagcggacactggcagatggtggtcatcctgcccaaggaacacctagttgtctggttttgttcattgcataacatgtcagacaactaccttgaggggattattaatagtgcgttaaaaggtcttgacgatgctccacggcctaaatcaaaggcttctgctaggtggattgtcgtcaagacaaaaaagaagtactga

SEQ ID NO: 67773 - DNA, 175 bp, Glycine max
  Peptide Sequence Number=SeqID_159458
atgaaggcttttggctatagagcaagtaactctgatcacaccttatttttgaagagaggaaatgaccaagatgagatttctagtttgcaacaataccatgcatctaaatttgagatgaaacaacttggaaacctcaaatattttttgggtattgaagtagctagatcaaaacatg

SEQ ID NO: 67774 - DNA, 390 bp, Glycine max
  Peptide Sequence Number=SeqID_159459
atgaccgaccctctcaatgactcaatctcttgcttactcataagggtggacccttgggtactagtaccctcaccttcagagggctacacgtcctcaccttcaaaggactacacgtcctcgccattagagggctacacgccctcgcctttagaggactacacgtcctctcctttagaggactacacgtcctcgccttcagagggctacacgccctcaccttcagagggctacatgccctcgccttcagaggactacacgtcctctatttcagaggactacacgtcctcgcctttagagggctgcacgccctcgccttcagagggctacacgccctcaccttcagagggctacacgtcctcgccttcagagggctacacgccctcgccttga

SEQ ID NO: 67775 - DNA, 156 bp, Glycine max
  Peptide Sequence Number=SeqID_159460
atgtaccatctcttgttctctgttacaacaacccaagtggatgtatcctctactagtaccacaaaggatgtaccctccaatgtgttaaggcaaagttctcaggcggaagaagaagtagaagaagaggttcaagaagatgttcaaagagattcaaag

SEQ ID NO: 67776 - DNA, 695 bp, Glycine max
  Peptide Sequence Number=SeqID_159461
cctccagagaactccatgccctcaccttcagaggactccatgccctcgccttcagaggacttcacgtcctcgcctttagaggacaacacgccctcgccttcagaggactacatgttctccccttcaaagggctacacgtcctcaccttcagaggattgcatgtcctcgccttcataggactgcacatccttgccttcagaggactgcacatcctcgcctttagaggactgcacgtcctcgcctttagaggactacacgccctcaccttcaaagggctacacgccctcgccttcagaggactacacgtcctcgccttcagagggctacatgccctcgccttcaaagggctacacaccctcgccttcagagggctacacgtcctcgccttcagagggttgcacgcccttgccttcagaggactacacgtcctcgccttcagagggctccacatcagcgccttagaggactcaagggatcgcgcctacaaggcactcaatgggcccggagaagtccaacagggtcctagggtttccaactctgattacgagcctccgttagttctatggagtgctcgtcgcccccagcagggtcatcatgcccctattaacagggctttcatcgagaagtactgcacccccaggcacagggtgaggcatcacaatagcgggcatcagacgcaccgccaccacctctag

SEQ ID NO: 67777 - DNA, 132 bp, Glycine max
  Peptide Sequence Number=SeqID_159462
atggccaagatcatgtcacagatcacaagaacatcagtgattttaaacaccattcatgccaaggagcagacttacagtgaagttagtaagccgtttgtcatgagatggaaggaccagcttgaaccttactag

SEQ ID NO: 67778 - DNA, 279 bp, Glycine max
  Peptide Sequence Number=SeqID_159463
ggtacatcctttgtggtacaagtagagggtacatctacttgggttgttgtaactgagaacaagagagggtacacctcttgtggatcagttcaagtggagggtacatccacttggttgttcaaagagaacaagggagggtacatcccttgtggatctttgcttgtaaaggctaagaaatctcaaggaccgcatgtcacttggggactggatgtaggcacgggttgttgccgaaccagtataaattcttatgtttgtcttcttcttccctacactctttaa

SEQ ID NO: 67779 - DNA, 150 bp, Glycine max
  Peptide Sequence Number=SeqID_159464
atggcagaaatcacccaaggtaagacgatgatcggtcacgattggccgcatattgttgtctcctacttgcagggtcacgaccgaccgtcgtctcttcccggcactagacaagcagaggacatcactgcaaggcagcccagtatcctttga

SEQ ID NO: 67780 - DNA, 1171 bp, Glycine max
  Peptide Sequence Number=SeqID_159465
atggcttctaggaaacgcaagagtatcggttcaagacccacaacacaatatgatacaaggagatttcactccttagatgcttggaaccggtacacagataatgtcctggggaaaaacatcttgcctgagaggaaggtggagctctaccacactgagctaaatgattttaagactgaattggagaggcgtaatttccataaatgcctcgccaatttggttgatgggagcatagacttggctttggtgaaagagttctatgcaaacttatacagctctgagggcccttcaccaaagcaagccagagtcagaggccatttagtgaagatttatgttgacagtctcaacagattcctagagacacctatggtattggaagagggtgagactttacccacatactccggatactgcaggttgcccacaaattacagagagattgaggttgccttatgcatattgggccgagggttcattttgaacgctgggggccatcctgggaggattctcagcaaagatttgactactttagcccagatgacttctatagcccagtctaacacttctagacttgggtttcctactctgatcaccgccctatgtagagccagaggggttgtctctgacagccttacttttgagcgcctgagcctggaagaactgttggaatcacgaggatctaattatttctatccaggggctaggagggcgagcgtaaggccagctaagcttccttccacatctgcagctcctactctagcatccacttcagtggtgacgcctccaggatccattccttcagttgagcaatttcgggtgatggtagtctggtctggggcccaaccttctcttcacagggaacatgaaggtcccacagcccaggtaccacaacatgtggaggatgagtcatctgaggccaccgtcccagagccattcattgtaggagaggaggcaggtgagacacaagtgagacaggtagctgcagtcactcctgagagatctcttgtggccacttcagagcctcttgcaccagtggtggacctatcctcgactcagcacgtagcagacctctccactcctatcctagagatacatgaggacctaaccacaccagtcctgactatggacacttctcctccagctactccagtacttcatctgaaagatgcggagg

SEQ ID NO: 67781 - DNA, 391 bp, Glycine max
  Peptide Sequence Number=SeqID_159466
ttggaacctcttacgtgccgatcaacgtctcattttcgccaaaaagttggcccagggcttcccgggtatcaacagggacaccaggatttatttatttctgcgaagtgatctttccgtcacagtggcttctgttttctatcagctgtccctcctgtttcagctactgacgggggtggtgcgtaacggcaaaaagcacccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 67782 - DNA, 786 bp, Glycine max
  Peptide Sequence Number=SeqID_159467
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgattgtagggtcgatgtatgagactttctctggtcgagatgcttccagagggatggccaaaaattcgtttagtgatgatgtattggcagatattcatggccccatcgatcctttagaagatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 67783 - DNA, 645 bp, Glycine max
  Peptide Sequence Number=SeqID_159468
atgtttgctgcacaacacgtcactaaaatttgctatgtacaaaatgacaccaaccccaatcaacccctcccctgctatatgttattgtataaaagatcatggatacgatcattgtctactagaccacctagtgctgagagaccagtggtccatgttgatccagctaccggcaaggccgacagtccccacataaagaaattaagaacatatttggggattgtggcgcatgataaggtggacatcacctacgagaactggaaggaggcccctactgctaagaaggacctgatttgggaggatattcagaggcttctgacagtaggacgaaaaggaagttacctcagaccgtgggcaagagatagaggttgtttaaatcagacctcacgaggaaatgggcccttgcagtcgatcaggacagtgtggaggacactgtctgtgagaaatacggcattagcaaggaaaaatgggcccaattttgccagactcgcagacacccttcttgggaggatgtgcgcaaaaaggcacaggccagccagaagcagaagctcttggctgagaagacgaagaaaaagctggaggaagctgcacagtcaggaagcgttgatggcttcatcgaccctccatccccggtcagatgccacgtga

SEQ ID NO: 67784 - DNA, 438 bp, Glycine max
  Peptide Sequence Number=SeqID_159469
atggtagcgcaattaatccatgatcgagtggagatggagtgcctagagggagtttgggagaccctcaaaggcaatgcgaggtgccgattccgtggcacaattcaactcacggctacttcattggtacatccaaaggaacctgcacacacacgcacgcttcagcgaactgtggagtggatattacctacacctactccatatcgactagtgaagccagtccaagtgatagaggtgtcgtcatctgaagaagaccctgaggaggactcagaggagttacctcctgagtctgctgtggatgctattgactttccagagggtgatgaggacccactccctgatgtggattctccagaggacttcatgtcagcaaatgaggcaaactctacggaggagagcggccctggagggatagcgactagtggagattcttcatcatag

SEQ ID NO: 67785 - DNA, 258 bp, Glycine max
  Peptide Sequence Number=SeqID_159470
gtatgctctcactcgaacccttcacagaagatcagggtcggtcggcggtgcaacccacagggggatcccaccaatcagcttccttgcgccttacggttagtactcgaccgggcgtgggaggactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 67786 - DNA, 336 bp, Glycine max
  Peptide Sequence Number=SeqID_159471
atgactaaagcacgtcaaaaggaggtacggaaagaaaatagaggaggagcttgccacccagctcgcccaggtgagccaggttgcttcctccagaagcaaccgccttctggaggaatattctggaaggcccaagtgggcctgctcaatgtttgtggcaaagtacatttgaagacaaagcttcaagaaattgcttatcctgatctagactctatgtgtcctcctccagaaaagtttcatcggtgcatccaggattccattgaaaacattattgatgtcaaagcggatggtaactgtggttatcgtgcaatagctgccttattaggtatgggtgaataa

SEQ ID NO: 67787 - DNA, 451 bp, Glycine max
  Peptide Sequence Number=SeqID_159472
caaccataggaccggatgtccaaagctcgcaaaccttagtccttatgctacaaagcttattctgaggacaatttattatcatgcacaacctacgagaattggctcaccaagaccaatcatacctatggagcattttcttgagcaagtagcctggcctgaatctcaacctccattggtgggacccaacttggctgctcctcctaagcccacacctgcacgggttgaaccagtgccaactgatccacaatctccagtggtgagttcaccttcttctcctgagcttgaagtagttcccccatctccacctctgattatcctctctgattccccatctggagaagttgcggatccccctgattccccagttggaggagctgcttatctttcagattcctcatctggagaagttgttgttgtctcttattccacagtttttccatctgatagatga

SEQ ID NO: 67788 - DNA, 292 bp, Glycine max
  Peptide Sequence Number=SeqID_159473
gaatgggagaagggaggaaagatgaaatgggggcacccccttcaagggagcaaaaggactccattgatgaagaagatccaaaggcctacaagctccaatggagctacatcaagtggtaatcagagcacaagagcttcaatggcgtctccattcatctttctccttctccattctgctgcaatcagacttcaagaagcaaaagactccattgatgaagaagatccaaggcctacaagctccaatggagctacatcagatatatctacaacaaattgtgatgactttgcattag

SEQ ID NO: 67789 - DNA, 515 bp, Glycine max
  Peptide Sequence Number=SeqID_159474
agggctacaagccctcgccttcagaggactacacgtcctcgccttccagaggactaaacgtcctcgccttcactagactacatgtccttgccttcagaggactacatgtcctggcctttagagggctacacgcccctccccttcaaaaggactacacgtccttgccttcagagggctacacgtgctcaccttcagagggctacacgccctcgcctttagagggctatacgccctcgctttcagaggactacacgtccttgccttcactagactacatgtccttgccttcagaggactacacgtcctcgccttcagagggctacatgccctctcctttagaggactacacgtcctcgccttcaaagggctacacgtcctcacattcagagggctacacgccctcgccttcagaggactgcacgtccttatcttcagagggctacacgtcctcaccttcagagggctacatgccctcgccttcagaggatagcacgccctcgccttcaaagggctga

SEQ ID NO: 67790 - DNA, 441 bp, Glycine max
  Peptide Sequence Number=SeqID_159475
atgccatatccacatggacaaaaatattttccgcatgatcctgaaaaagttgcttgtgatgaagtcgcagagttgccccatgctactcatgggcttcgacttaagcaggaaactcctgacccaccaaaagctttgaaaattgttcctagcctttctctacaaaaaattcctaaagaacctattcgtgttcccactgaggttatcactacttcccctagagtgagggaagcttgggtggaaaaggttgtggagacaccatatatgacacctactacttctccacttttctttactcctcaattcactactcctatcagtccctataaccagtgtggattcaatcctctatttgaaacatcaactgatgctgagttcaacagattaaagtcctcacctcctccaaacattcaagttcttacaagaagcagaagagaagcttag

SEQ ID NO: 67791 - DNA, 445 bp, Glycine max
  Peptide Sequence Number=SeqID_159476
atggaggatagcctagtcactagaggcaaagggaaactaagaaaaaccataagcaaaagaattaaaaatgatttggagatacaatggaacattatggcattgtctgattcatgttggctaggtggtgaatggagagagaggggggaagagaagctcctggctgagaagaccaagaagaagctggaggaagctgcacagtcaagaagcgttgatggcgtcatcaaccctccatccctggttagacgccacgtgaagtggaagatggcccacacgaagaaaatgggggagatgatgactaaggccgcaaatgaaatcgctgagaagatcgattcctttgaggagcaggcgacacagggatccttcgtccccatggacgtcaggatgttctcaccattgctattggacgtccagagcaccctagacgtgtccgtgctattggaagccg

SEQ ID NO: 67792 - DNA, 642 bp, Glycine max
  Peptide Sequence Number=SeqID_159477
atggcatctatgaagaggaaaactccttctacacctacccaagccagatttgatagatccagattcacatccctagaggcttgggagaggtatatagacattgtggtgccttggaagatgctaccagggaggaatgtcgtggtttattacacagagtttgacgagttcaaggaggaactcgagagaagaaattgggatgagaagctgactgattttgctgatagtagtataaacatcgccattgtgaaggaattttatgccaacctctatgaccccgaggataaatcacctaagcaggtgagggtgagaggtcacttagtgaaatttgatgaagatactcttaacacatttctgaagaccccagtaattttggaggaaggggagaatttgtgtacttattccagatttgcactcctgaggcctgatcctcaggagttggctgctaagctatatatcccagggaggggattcgagcttaatgttgatgggcagccattgaagatattgaggaagaacatgaccaccttagctcagacatggagtgttctttccttctcgaacctgattcctacctcccatacatttgatgtgaccttggacagagccaagttgatttatggtattattatggggatcctctag

SEQ ID NO: 67793 - DNA, 207 bp, Glycine max
  Peptide Sequence Number=SeqID_159478
atgcttcaggcattggagtcgcgattcgctccatcatattacgatgacccccacagtgccttattcaaattacagcaacggggcaccgtgaacgattatctgacggagttcgagcacctcacaaattgggtcatcggactcactctgccatttttgttgagctacttcgtattaggtcccactcctgaactccaccaagaggtgtag

SEQ ID NO: 67794 - DNA, 75 bp, Glycine max
  Peptide Sequence Number=SeqID_159479
atggcgagacatgatgtaggaataagggaatgccccaaatcatttccatggcacgcatatgacgatgatgagtag

SEQ ID NO: 67795 - DNA, 159 bp, Glycine max
  Peptide Sequence Number=SeqID_159480
atggccggtttatattgcttgttacagttgggaagtctgattggaaaagaattggcaggcaggccaaggctggttttgaagaagccactatctgctccacgtgagccaagctcgagttatattgttttattgaccaaaagctggtgtttggatagataa

SEQ ID NO: 67796 - DNA, 441 bp, Glycine max
  Peptide Sequence Number=SeqID_159481
atgaagaaatgggaaagggaaatgaatacctcattagcagaggtgagaaacgacattgtaaaggagcactatgggctgaaacagagtgggggtgatgttttggggttttccggcgatggcatagctgatgacgaagatgttgtggaagcagatgcggtggtggaagatgcggcatcggaaggcgtcgaggaagtcaaggatgaggggcttgaggatggtgcaggtaaggattttgaagatggcgacgaaggtggcactgtgtggtggaagtggggttggcggccaacccagtcgaagaacttgatgcccttcaccgaagaagagttgaaacaacacaacctattacaccaccctctctctattggcgtggtcagcggtggtggtgctgggttggatggcggcgacaacgattttcgttggagaaaggaaagaaggagatga

SEQ ID NO: 67797 - DNA, 240 bp, Glycine max
  Peptide Sequence Number=SeqID_159482
atgtcagttgcctacgtattgtgtcacatttgctcaaaggctgagtcaagcttccagataagaagtgctccatgtggagattgtaggccttggatcttcttcatcaatggagtcctttgcttcttgaagatcatggcagcagaatggagaaggaagaaagatgatgggagacaccacttcaaggagaagatgagtcaagaagaagctcaccaccataggaagccatggataagaacttga

SEQ ID NO: 67798 - DNA, 829 bp, Glycine max
  Peptide Sequence Number=SeqID_159483
cggtgcgcttagcgggatgacccttcgcttagcgaacatggacaactcatccttcttccagattcatcctcgcgctcagccgaggagtgttacgctcaacggatggctcgctaagccagcaaattggcttagcgagaaggtgttttatgtccaagatccttgtgatgaaaggtggttagtggttctacaaggaaaaaccattggtgttaatcttgaagatgatgattcaacacttgatacttgtcacagtcctttctctacacacatgcctacaatgaatggagaagatgaagttgatgacaagtacggtattagcaaagacaagtggaaccaattttgtcaaagccgtagagacccttcatgggaggattccctagaagagcaatccgcacaacatagctttactgcccatggacgtaaggatgtactgacaacaaccattgggcaactagagcatcctggccgtgtttgtgttgctagagtcggggaagctgtgttgatcgctcgagacaggaccttgacgcttacacatccagttgagctaaatgtagctccttctgttgctgacaatcctcctcactcgattgcccttgagagagtttatgaggggtcatcaattgtacaccacatgcctttggccaatgatatggtgaatgtgggtgttgaagaagtacgagatgctgatgctcgcatccctatacccactgaaaaggttcagttcctccagaaggcggttgcttctggaggaagcaaccctgctcgcctgggcgagctgagctcgcctgggcgagctgggcggcaagcatctcccctattttgctataaatag

SEQ ID NO: 67799 - DNA, 604 bp, Glycine max
  Peptide Sequence Number=SeqID_159484
acttgggttccctgctctgatcaccgccctgtgtaaggctagaggggttacttctgacaacttggttttcgagcgcctaagcccagtcatcaacttggcctatatcaggaaaaactattggaatcctgatgatctaacaatttctatcagaggggccaggtgggtaaggacaaggccagctgagcctccttccacatctatagctcctattccagcacgatctattccttcagtggagcagttcactgagttggtagcctggcccgagactcagtcttctcttcctggggaagatgaaggtcccaaagcccaggtaccacagcatgtggaggatgattcattcgaggccaccattccagagccttttgtcagggggatggagacagaggagacacaggaatctacggccacacctgagagatctcttgaggcagcttctgagcccctagcacaaggggaggacataccctcacctcagcctgtagcagacccttccactcttgtcttggacttatcagagggtcaaactgctccagtcctaatagtgaacacttctcctccaactactccagtgcttcatttgacagataaagaggatggttag

SEQ ID NO: 67800 - DNA, 56 bp, Glycine max
  Peptide Sequence Number=SeqID_159485
atggggcaaaacgcaccaaaagattatggtgatggatggctcaaattctcacaaag

SEQ ID NO: 67801 - DNA, 297 bp, Glycine max
  Peptide Sequence Number=SeqID_159486
atggccaatcacaccacgattctggaggaagctttcaacctagaggtacccatccagctacccaaacaaaacaccccaggccgaggataccagacaatcaccaagcaggagcaatgctcggaggacatcaagaggagcagcacaggaactaggaagcaaacagaagatcgaaagactgaggcagacaaagacactagcaacagcggcgtgagtgacaacctccaccagaataagaaccccccccagcatgttagaggtgtaatcaacaccatcgctagcggtttttcctatgaatga

SEQ ID NO: 67802 - DNA, 429 bp, Glycine max
  Peptide Sequence Number=SeqID_159487
atggtgcgtcttctcgtgaagaaaacgtgtggagttgtcaccaacgtttattcgaggaaaacattagaaaaaccaaaaagacgaaggtctgcagattttgaaaataagggttcgggagttatttaccgaggagaatcgttaaggcgttggaccttgaaacgacctcaagtgatgtttgatgaaaagaggagagaatcgttaagacgttggaccttgaaacaatctcaagcaatatttgatgaaatgaagaagtttataaatgatgagcaaagaacaaatgaagaacgatatcgaagtcgattacggttgcaattcggtagccccgcctcgaccttgtttttctcttctttcttcttcttcttctctctgatttctctcaatgctggaccttggaaccctttactcaacctccctcacgcctatttatag

SEQ ID NO: 67803 - DNA, 1329 bp, Glycine max
  Peptide Sequence Number=SeqID_159488
atgggaataattccaatctttatattggttcactccttcactaagatcattgttagaacacgaggtctaggtcgtgtgttaggcaccggtcgaggtagagagactactcaggatgcgcctgaggctgatgttcctcggcgtcgttggcccactgcttcagcatgtaggcaacaggttcgtgtgcctgaggatgttgcccagagacctgaggatgggcctcagttgcatgaggatgctcctcatgtgtctgatggtaccccagatatgacgagtgttgcggatgctgttgacacagagggagtggccactgagacgagcttggggtcacctgctgtacatgagggattccccggtgggccacgcgacccatcagttttgaccggttatgctgagcatgtcgcacacaacatatggagtgatctacattgctggatatacgagcactttccttcaatgcacacatgcttcgttgatactgcttgtgatgaggggagcccccgggcctgcaggtggcttacgggtaaggctcacatgacggggatcaagggagccccgtatcggacacgcatggatgccttcactgtgactgacgtgtcctggatgccctacgctaagcaccggggagtcaggggcttcgacttgatatcgtcatacacagggcagctgagatggggtcagcttgtcgtgtacactcgacctgagcgggttactcgacagtttggctacattcagaccgtccctccgacgctggttactaagtctctaatgagtgatgagatagacgactggtggatccatttttcagaccatttggtaggtgcgggggagatctgtgtagttcttgggcaggtggcgctagactacatggagtggtttttctggatatcccacccgtttgtcacgcctaccgaggagactcttgagccgagacagccgcctccccctcatgttgaggagttcatcgagccacctatccttgaggtttcagtcgcgtctaatctccctatgccttttcctttggccttgttcgtcatttctacagagaatgcaatgagaccaacaccaattgtatgctcagagttagagaaatggagagaggaagaaaaccctcttccgtggaatccagcggaagaacgttcttccgttgacactcgcggaagaagttcttccgcgggattccacggaagaaccttctttcgcaattgtcatttcaactgcagaagaaccttcttccgtggaatcccactgaagaacttcttctgcgagtgtcaacaaaagaacgttctttttaaagaacaaaaacgctcaagggcatttttggaattttga

SEQ ID NO: 67804 - DNA, 315 bp, Glycine max
  Peptide Sequence Number=SeqID_159489
atggggatgttggttggtgtgggcgctgaacgtgaaaatgaaagaaatggtagaatgagcaagatgaatattatccaactagaggctgacggtgctcaaattgagtgtactcttttaggttcatttgtggataaactaactgcttttttggcatctggaaaagttgacaatgttgtggtcattgttcaatttgccaaagtccagagttttcaagattttgaggatgccaaggttctagcaaagagctactacatttttttagtgttgcttgaacatgatgcttcagaatatgtgttggacaagtggcctcaataa

SEQ ID NO: 67805 - DNA, 663 bp, Glycine max
  Peptide Sequence Number=SeqID_159490
atggcacgtactccgaatgagattaagtttattgatgggtcaagagaaacccttaaacttgctgtaaggatcacgaatctttggttcgttgggactcccaacaagtctgaacaagctgaaatggttattgttgattctgatggagatgaaatccatgctatttgtaagccaaaccagctaaagtcttggaaaattgatttgaaggaaaattgtacttatgtcatgcataattttaaagtgatgaagaatgatggatcctatccaccctcagtgagtatttcattgaaggcctcaaaattattgattaatgaacctgtgttggaaatccaagaattcaatgagaggtattttggtcatgcaattttctctgtatctgtaaagccagttttgacaccttgcggtcaaggaagttcacaactttcaggctcaagccaattatcatcaaaggatgcatttctttcaaaggctgaagcaaaaaccattgctgagattaacgtcatttcaaaggtggtcttgaaaactgacatagaggcaacaacattcacatgcggatgtggcaaagataatgatcaacctgtcctgaggtatagacttgaggtgatggttaagcacaaggatgaaagcacgaaattcttgctctgggaccgtgaatgtgctgagtag

SEQ ID NO: 67806 - DNA, 57 bp, Glycine max
  Peptide Sequence Number=SeqID_159491
atgacttctactaccaatgtagttttcaaagaggtcttcaaaaatgtaagaagctaa

SEQ ID NO: 67807 - DNA, 639 bp, Glycine max
  Peptide Sequence Number=SeqID_159492
atgtcctttggaaggatttctaatttccaacacatattaggaaataacttagattttgcatctttcttcctcgcagatattgaagaccttaaggaattctccaaaattcagggagcattggaagctaatgatttgactcattgggacattacctattggtgtgagacactatgttcccaagtgcttttgaagctacacatcaaagataaatctagggtgaattgtacaaaatcattgtaccatggtgacgacacggcacaaggcacagtgaggccacggcgggagcttgggtcaaggcacggtgcgagacttatcaaggtaatccttgtggcgtctaccctgacttgcgtctacccggacttatcttccttcactagaagtggcgtctaccttgacttatcttccttcattggaagtggcgtcatccaaaactctaaagcctgtatcaagcgatccgctcatagtcagtggcaccctaacttatcttccttcactggaagtggcatctaccctgacttatcttccttcactggaagtggcgtctaccttgacttatcttccttcactggaagtggcgtcatccaaaactctaaagcctgtatcaagcgatccgctcctagtcaggttcacatcagttag

SEQ ID NO: 67808 - DNA, 564 bp, Glycine max
  Peptide Sequence Number=SeqID_159493
atggctaggatattccaagaagattggaccagggatgcaggagaagaagaccctagggttctcccgagccttaggggttctgttcgctttgatgatgaccgaatgttttcacagaaggtccatcctataggagagagttccaacaataatcccatccatcttcatggtggttctaacgttgctagcggccaagtctcagatgttcgtgtggctaacgctatcgttggtggtgtcacagttcctccggatgctggccaaatcccttggctaaatcctcctccaaatgttatagatttgggtttagaggtgacaactatccagagtgttccaaggattcctttcttctggacttcatctcctatgaagttcataaaaaatcctattgcttacatgtctgactcggatcaggaaaacatggttgttcttctgataatgggcaagttcgactaccattcaatcaagaaggctcaggtggagaaggatgagaaagccaaggctgagaagatggaggaaaaattgaagactgatttcagtgaagccgaaactgagattctaaagacttaa

SEQ ID NO: 67809 - DNA, 579 bp, Glycine max
  Peptide Sequence Number=SeqID_159494
atggaaatacatacagatggagggtgggagtggaatctctcttggagaaggccattgtttgaaaatgaaattgattcagcagttcattttctcacagacattgaagattcagcaattcagcaacaaggcacagatacttggatatggtctagagatccagcaggtcactattcaacaagaattgcatacaacttgttaggggaagaagcagcaggtggtagacaggaggactgttttgagaagctatggaaattaaaaattccagttaggattgcaattaaaggcgtattcccgtttagtccaaagcaggactttcttcaacatgttggtgttcaactcgatggactaaggacaaacagatggcaatactggtggttagccttaacttggtctatttggaagcttagaaataatatagtgttctctaatgcaacctttaacgctaattcactatttgaagatacaatgtttctactttggtcttggcttaggagtttcgagaaaggctttacagcccattttaatcaatgggcaaccagctttacaaaaagctttatgaagcagaagaggattacatag

SEQ ID NO: 67810 - DNA, 2562 bp, Glycine max
  Peptide Sequence Number=SeqID_159495
atggcattgatcgatatctccaaagtccttattcgtaaaggtgatgggctattcgagaaaggtcctgactttaagcccttgatcattgacattagggatacatctagtctcagatccctaatccgaaccgagagtgaggagaatctctctgtgaagctacgaagagatttgctttcttcttgtcggacattggctagagctactatagtaaggcaagtgtaccaatggagtgttgcacctttcaatctgttatggagaccgagtgcgcctaatggtcatgttgaaacttttgatacggttttcataggcacctggcacgggaggtccaccaaggttgcggcactcccattttttagagtccccatgacaagcgttccaagtatggtggacaaatgcccccgtggtggtttttctgtctggattgttgatgttctattgccgtttgtggccattgatggtgctcctccacgaataggggtggggatacttgcaaatacactccaatgcttaagtaagaagtgcatagttgatatttatcccggagcagtttcctctgagtcgatattgtcttggagagacaatgttgacttaacaagtgtgaaaattgatatttatgctggagcagttgcccacgagttgatattgtgtcaaagaggcaatgttgacttagcaagtgtgaatgacgcttggactattagggatgataaggatgcgacaaaaagagggactgggtttgcccttgaagatggctggatcctcgtgagacaacaatcgctcctttatccaatacagattctcaatctcgagcctgggatgccttattcttatgaggatggtttagaatttgctaaggtttcgttattgtttaaccaatatatgcaaaagaatgaaggatcagccaatttctcaaatccattggttttgagggaagaaaaacaaattgcattgaagttgttagggcgggaagacattaatttcctggatggaaatgggattgattatgacaatgaatatgatccatcttttgtttgtgacaggaatatggctaccaaattagaactccatgaagctcctaatttagaaaatgttgagtgggccaacgaacaagtccatggatttgtccttcctaacttcatccaaatgagtaatcgtgtgctggccataacttcttcttatctgtcataccctaatttcgtccggggactatcgttcgttgatcttttgatccttgctagtcgacttagtttcctggaccctagcttgcctaggctagcctctggcttgcccgggcccccaaaagacttcaaggaggggttccaaggttcagaaggtgagggattgagagaagagagaaagaagaagaagaagaaagaaaaggagacgaggccgaggcgctaccgaatcacgatcgcgatcattccttactttgtttcttgttccatgatacaaaagagcaagggtgtcgcaacatgcccttttgcgggcgagcgaggcgaggctcacgggtgcgctttccaaaggaggaaagatgcgcagagtcgccaccaacgtttatttgtggaaaaacgtcagaaaaaccgaaggaaactggtcaaaaagaaaattccaagttcgggagttgtatttacgtttgaggaaggtattagcacctctcacgtcgacaaaagcggggctcttgctcctacgtaccctccatcgaagaggaaatcagacctacctagttcttttctaagggttgtagagacacaccaatccttagggtttttgaagaatcattcaaattttttaaagatatgtacttctggctacatccttcaaaagattgttgggatgaactatttgttcttgacgatagtgagggtagtgaatgatttaaacctcattttgaactctattggtcatcctcctattataatagacatgtcagttcctatgggaggcatgaaaaagaattaccttaagaagaacttgcttctgcgaattatattgttgaattggttaacaagattagagatttcatcccttaagctcttcttggttgtagtccttcttgttgttagcggtagtgacaagaagaaggtgatttggaggaacaaacctaaaccaaccaacaaatgtagaagttataacattgagactcgttctaagtctttgcatgaccttcctctgcctccctcaaagaaacaaaatattgttgaccttgaaggtgatgtacaaccaatcaggactagtttgatccctactaataagcttagtggtcctcatatgtggatgtcttcaaggtcaaagattgatcggatcatcatgtcagaagattgggaagctttccaaaagaagggtcttgatgatgttgaaaatttattagaagagtttaaccagctgaaaattcatgccaatgagttagaagcttacgtacaacaagagcgagaaggaaatgtctggcttaaggaaaagaacacccaacttaaaggagacggagaattctgcatgagggtcaatggtgaactcattcctactcgtcttagggctcttggtactgtgaatcaagattgtgttacatga

SEQ ID NO: 67811 - DNA, 525 bp, Glycine max
  Peptide Sequence Number=SeqID_159496
atgcctttgtgggaatcatggacagttatcaactcgatcactatcaccctctataagatagaagacaatggagcagttgaaagctcaacaaaagaagaatgtcaaggagatggctacattataacaaaagcaagaagtagatctgcaagcattacgctaagaaaacgtagtcattcgagggcaattgcaacagtcgcaagtaaacacacaaaacaccatgcctacacccctaacaagtggcaaccgaagaagaatattctttgcatgacaccaactgccaggaggataccattggacgatctcatcagaattctcaagggtatttcaaacctctttgaaaggacttgcactgacatggtggcactaatttcctcctggtctagtgacacgtttgaaaccttggttgtacagttcggtgctcaatacataacatgcaaaccttatcataccacatctataaccttgatcaatttgacgcaagctgatgatgaacccctgcgcaatttcatgggtcatttttcataa

SEQ ID NO: 67812 - DNA, 390 bp, Glycine max
  Peptide Sequence Number=SeqID_159497
aagtattgcacgcctaggcaggcgcagggtgatgcacctcaggccacaaacgcaccgccaccacctcatcaggctgatcctgctgggttactaggcatggagcattatctacaacacttggttcgccagcaggcggccaaccactgggggcaggtgcagatacatgagtgtctctaccagctcagccttagtcagcaggggcagagtttcactccttttgcgtgccctactccagagcagtttagagctgaggtcgcatggcccggagattggcccgaggcccaggcaagggaggcgcctacaggagctcccggcgatgtagaggaggcccgtatggatgaggagatgacatacttgctcaatttcttaggaggaagcggagccacgtga

SEQ ID NO: 67813 - DNA, 246 bp, Glycine max
  Peptide Sequence Number=SeqID_159498
atggcttcaagaaaaaggaaaaacacgacttccaggccccaacctaactatgatacaagtgagagtgagagggcacttgataaagttcgatgcagacaccttcaacacatttctggggaccccagtggtattggagcctggggagaccatccccacatattccagattttgcagactgaggatggatcctcaagagatagcggctcgcctctgtattccaggcaggggatttgttctaaatgttga

SEQ ID NO: 67814 - DNA, 96 bp, Glycine max
  Peptide Sequence Number=SeqID_159499
atggaggagatacatggagaagatgatgaaaaacaaggaattaaaaatggagaaggaggaaaggtgattggagttgccacttcaaggagaagatga

SEQ ID NO: 67815 - DNA, 540 bp, Glycine max
  Peptide Sequence Number=SeqID_159500
atggttaggactagaggattaggtcgtgccttaggtcacgttactggcagaggtgtggacagaggagatcgtgatgattctgatgatgctccgcagcgtcgatggcctaccgcatccgcgcgcaggcagagagtagttgtcactactgagcacaatgagccagtggtccctgcgacagaggctgacatattttcggatgagccgatggtaggaggtgatgtagaggacacaagggcagacattcctgcacacacaggcgcacaggttactgaggatgagcttgagggatttccgggtggtctgagtgacccatccttgctgacccagtatgcggatcacgttgcaggcagcgtatggatgggagaggagcatcctgagttgaagttatcctctcacgggaggaaggtccatagtttaggtaggcctgtccctgccattgagggcctagtagctgggacgggactaagtcctctgatcgcgtgttcgatagacactggcgatcggggacttttgtcgtcgtttgtcgagcggtggcactag

SEQ ID NO: 67816 - DNA, 111 bp, Glycine max
  Peptide Sequence Number=SeqID_159501
atgcagcaggcggaatggagaaggaagaaagatgattggagacgtcacttcaaggagaagatgagtcaagaacaagctcaccaccataagaagccatggataagagcttga

SEQ ID NO: 67817 - DNA, 273 bp, Glycine max
  Peptide Sequence Number=SeqID_159502
atggctgttgaagacctagtccctgtgctgagttccttcaaaaccttcttgggtaggccatggagggagcgattttgccctcaatactttgtattatggagagtacaagaacgttcgtcctggggttccacgagagatagagtgaaatggggtggttaccatgccataacaagtgcaaccgaagcatccaaattcacagttgagaattttattgctgggaaatcatggttaccagccacagggattccattcttattgggactcgatgattaa

SEQ ID NO: 67818 - DNA, 204 bp, Glycine max
  Peptide Sequence Number=SeqID_159503
atgtggtaccattcgtcaggaaatagcctaagcgtgtccatgccacactctcacttaggaaaactaggcagcagagggaaaactgtcaggaaaccacattacaaacgaaacctcaaagagagttgggcttcgtcctcaaaaggaaacaacaccagaaaatctagccttccatggattcaaacagaaaacgcaaatgaaacatga

SEQ ID NO: 67819 - DNA, 303 bp, Glycine max
  Peptide Sequence Number=SeqID_159504
atgagaaatggcaagaggtccccgtacgccattgggatcagggtgaatttcggagccttccttggtggagggttcctcgtcgtgtcagagcctacgccaaggtgggcattgctggccgggcgaggttgggctggagccaaagcctgtgggggccccctctatgttgacgcaggcgcctttggctgggcgggcgccgagttgggcgactcaggcgttgaagtgacggcatgggcatctccctccttcctctttgccccagctattccagtcctcctacttctggaaccggcgggggagatgtaa

SEQ ID NO: 67820 - DNA, 180 bp, Glycine max
  Peptide Sequence Number=SeqID_159505
atggagaggtatgaacgtcctgagctgaagctatcttcccatggaaggaagatggctaagttcgggaggcctgctccagagattgaaggccttgtggcggctagtggactaagtcctttgataacctgttccctagataccggcgaccgaaaacaaatgtctgcttttgtggaacgctag

SEQ ID NO: 67821 - DNA, 224 bp, Glycine max
  Peptide Sequence Number=SeqID_159506
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtaatcaagcttatcgataccgtcgacctcgagggggggcccg

SEQ ID NO: 67822 - DNA, 242 bp, Glycine max
  Peptide Sequence Number=SeqID_159507
aacctcaggagagaaatagtgagaataacgatgagtggggtacaaagtcattgctaaaggagagaaaggcagaacttgatcactcaaagacagaagctaaaggagaggaagacccgaagaaggatcgggtatatggtaaaaaagccagcaatttcaaacacattctcaaccacaagaacaccaatggacaaaccaacttcaactacaacaaagtaattcagcttcacttggagttcatataa

SEQ ID NO: 67823 - DNA, 408 bp, Glycine max
  Peptide Sequence Number=SeqID_159508
atggaggaggcagtgtgtgcctatgacgttgtagcacgggaatttcgtgaccctatggccaaaacaaacttccctctcccttcaaaaaatacctcaacctcgcccccaccactatcacatccgcaaattagcaggaggaaattcctttcatttcaagtagggattatgatagcattgtttggaatcatttatattgatgagacactagatttagtggactataaggccaaacagttcagacatgatatcaaaatttccaacggtgagaatgctcggaattgtgttgcgaaaatgatactcaaatttcacgacgatccaacggtgaacgggttcgagatcgtcgtttttctgaaactggtttggtgggctgcgggaaaaagaaagggttttgagaggagaagaggataa

SEQ ID NO: 67824 - DNA, 255 bp, Glycine max
  Peptide Sequence Number=SeqID_159509
atgggggagcaatggagacaatttaagcctgatttgacgtcaaaatgggcacttgcagccggcaaggacaatgtcgatgacattgtttgcaaaaaatatggcattagcaaggagaaatgggcccaattttgtcagagccgtagagacccctcatgggagaagctgatgactgagaagacaaagaaaaaatcagaggaaggtgctcaatccggaagcactgaggtcgtaattgaccctccatctcccatcaaatga

SEQ ID NO: 67825 - DNA, 122 bp, Glycine max
  Peptide Sequence Number=SeqID_159510
atgtggagtcctatgaaggagaaggcgtgcagccctacgaaggcgagggcgtgcagccctctgaaggcgaggacgtgtagtcctctgaaggcgagggcatgtagccctctgaaggcgtggag

SEQ ID NO: 67826 - DNA, 528 bp, Glycine max
  Peptide Sequence Number=SeqID_159511
atggctactccacctggctcgcctcctcctcctactccttctcctcttcctcctcctcctcctcctgaagcagcattacaatcgccgtctaccttgaagcggacaagaaaagccacacgactaagatccttggcgactagaccacctggggcagacaaattggtggtccatgtcgatcctgcgatcaggaaggccgacggtccccacaggaagcaattaagaacatatttggggattgtcgcttgtgataaggtcgacatgacatacgacaattggaagcaagtccctgctgctcagaaggatttgatatgggaagatatacagactaaatttgatatccctgaagcatctgacgttaggacaaaaaagaaaatacttcaaactatgggagagcggtcgagacattttaagtatgatttgatgtcaaaatgggcacttgcagccgacaaggacaatgtggatgacactgtttgtgaaaaatacaacattagcaaggagaaattggcccaattttgtcagacccactga

SEQ ID NO: 67827 - DNA, 492 bp, Glycine max
  Peptide Sequence Number=SeqID_159512
atgaccatgattacgccaagctcgaaattaaccctcactaaagggaacaaaagctggtaccgggccccccctcgaggtcgacgaagatggtcttggtgcgccattgttcgatcgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 67828 - DNA, 201 bp, Glycine max
  Peptide Sequence Number=SeqID_159513
atgagtgaccctggaagattactcaaaaaggcaaaaagatggctctattcatttaaaggtaatagtcttaagacttgggatgaagtggttgaaaaattcttgaagaaatgcttcccaaagtccaagactactgaaggaaaagctgtcatctcatcctttcatcaatttccagacgagtccttgagtgaggcttcggaatga

SEQ ID NO: 67829 - DNA, 521 bp, Glycine max
  Peptide Sequence Number=SeqID_159514
atgttgacaatcattgaccagtataaagagaaggtaaacctagctgctagtcatgggctgagactagaggacgagcatgcgaaggtatcggctttggaaatggaaggggaagcaagagagagagtgatagaatcattgcatggggaggcgatgaaatggatgaatagattcgctctcactctgaatgggagtcaagagcttccaaggttgttagccagagccaaggcaatggcgaatgtatacccggctcccgatgaagaagtgcaagagcagatgaaggccgacatggaggccttgaaggaccaaatgacctccatgatggaggccatgatgagtatgagaaggatgatggaggacaatgcggccgcagttgccaccaccagcgccgccgttgaggcgaatccaacccatccacccggcataaaccaaacaagtcttccagccccagacgtgtacgggcggtccccatatggtgttgtcacaacctacactttcgcgggcgagcgaggtgagactcacgg

SEQ ID NO: 67830 - DNA, 264 bp, Glycine max
  Peptide Sequence Number=SeqID_159515
atgcagcacaaaagcataaagcaaagagggtggagagtgtcaatgttgatgcagaagcctttgacaggagattcaactgtgctgaagataggagattcggctaaagttgtgataaaacaagacatgaagggaggagagcataaatatgggtttaacaacaataaacgtgagaagacagagaagaaaaaggtggtggatgatgaaactaacgacaaacatgagctgtatgaagtcctaaggatgccatctaaaacaaaatactga

SEQ ID NO: 67831 - DNA, 468 bp, Glycine max
  Peptide Sequence Number=SeqID_159516
atgctcgctaagccagcagattggcttagcgagaagcattacaaaataaccataaattgggagagtttgataccatttatacaagttttatacacaaaagttagtcgttttcaccgactaatagtagtcgtaagcccatcaacgattcctcaacctccatttcccagaggatacaactctaatgtgacatgtgcttatcatggaggagttctggggcattccattgagcattgtatgaccttgaaacataaggtgcaaaggacttgcgctcctcagttgatctccaagtccacccaatcaaaaattgcacattctacacgtttggtaagggtgccgccttggatcttcttcatcaatggagtcctttgcttcttgaagttcaatggcagtggaatggagaaggaagaaagaggattggagatgccacttcaaggagaagatgagtcaagcacaagctcaccaccatag

SEQ ID NO: 67832 - DNA, 468 bp, Glycine max
  Peptide Sequence Number=SeqID_159517
atggaaagaaaggaaaaaaatgaaaataaagaaaaaaacagaagaaaggaaaggaggattcctgatcaaggatcggaaagaagtgaaaaaggaaaaaaaagcaattctcgatcaatgaaagatagaggacagaaattcttcaagccagattgccactcaaaatcattctcgactggcaatatcccaccccacatgaacaaagaggaaaagaccgaaacacccaacttcctctccaaaaacactacccttgagaaaattctattggtccgtgatcgtggaaaaaacccggtgcaccattcggttctgccaaccctttttcggagccccatgaattgcgttttctttcatgcgtcctccacccacgagtttggagccatgcgtagtgattgcttagtgcaattctccattctcaatcttttttcagagccccatgaattgcgttttcgttcatggatcctccacccatga

SEQ ID NO: 67833 - DNA, 937 bp, Glycine max
  Peptide Sequence Number=SeqID_159518
gatccccatcctcacctttagagggctacatgccctctcctttagagggcagcacgcctgcaccttcagagggttgcacgcccttgccttcagagggctgcacgtccttgctttcagaggactgcatgtcctcaccttcagagggctacacgccctcacctttagagggttgcacgtcctcgctttcagaggaatacacgtcctcaccttcaaagggctacacgccctcgccattagaggtctacacgccctcgccttcagaggaatacacgtcctcaccttcaaaggtctacacgccttcgccttcagagggctgcacgccctcgccatcagaggactacacatcctcgccttcaaagggtcacacatcctcgactttagagggttgcacgccctcgcctttagagggctatgcgtgctcactttcattcctgggccaccccctgatcttggaggaaggccaattgtgcgagcacaactagaggaggagtctatcgcggagctactatgcataccagggcaagatttcacccgtgccgttgcaaagagacgacatcattctgctcaacgaccacaatgtcgatctccccctgcggaagtatcagttggtctgtgccgtcatgacatagggatcacgcccacaagacacccagtggacctggaggagtccaacagtgccctagtgtttccagctttggttacgggcctctgtcaatcctacaagatgcccgtccccccaccaaggtcatgccatcgtgacatagggatcgcgcccgcaagacacctagtggacccagagaagtccaacagggtcttgtggtttccagctctaattacgggcctctgtcacttctacagagtacccgtcgcccccaacaaagtcatcaggccccctactaaccaagctttcatcaagaagtactgcgcccctaggcag

SEQ ID NO: 67834 - DNA, 431 bp, Glycine max
  Peptide Sequence Number=SeqID_159519
attggcaattcctccaactggggaagcagaagggtcaactgtttctccagctggtgaatcaggaggagcagtcgcttcatctgatgatgcatcagagatgacaatcagaggtggagatgggggactacttcacactcaggagaagatggtggattcaccactggagattgtgggtcagctggctctggatcaacctgcacaggtgtggcctcaggtggagcagcctcattgggtctctcaccaatggaagttgagcttcaggccaggctacttgctcaagaaaatgctccatagtcctcgaaataagctttgtaacatagggactaaagtttgtgagctttggacatcctgtcctacggttactgacggaggagctggagtggatgatgaagggatgtcctccgttctagctctttttctcgatgcaatct

SEQ ID NO: 67835 - DNA, 659 bp, Glycine max
  Peptide Sequence Number=SeqID_159520
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 67836 - DNA, 249 bp, Glycine max
  Peptide Sequence Number=SeqID_159521
atgttgttcgagtctgggtcagcccttgattggggcaatgttactccttcatccgtagtccttaatgttgtcattgatgaaggagatctcagtgtcaccatagatgaaggaaatcttggtgttgtcaacgacgaaggagatgtgcttgttttgggtgcgggtttggatctttgtgtcaccatcgatgaaggagatcttagtgttctcaccaaccaagatccgattgtcgtgcgtactgtaacaccctga

SEQ ID NO: 67837 - DNA, 624 bp, Glycine max
  Peptide Sequence Number=SeqID_159522
atgaccagtagactacttgtcggatcattgacatttgattgtcgcatcatgcactatatcattgttagaattttgatgcctcgttcttctaatctagctcaagcctctgaggaggacttgattctgatgtgggctttcttgaccggttgtccaatcgactgggcccatttgattcattatcgcatgcataaggcattgcggtctagttcacctctaccttaccttcaacttgtgactttatttcttcgacattttgaaattcccttgaattatcagccctttgtgcaagttaaatgttcctttgctattggtgctggtgcggtaacctccttcggctaccttaaggacatggatgggcaatggttgaagaaggatgtgcaacctccgcaagacgaacgcactccctctcctccacctcagagagatgactcttctgccctcatgaatgaagttctcttagaattatgtggtcttcgcacctatgttggtgagcgctttgattccttggatggtcgtatcgatgccattgatgctcattttgctgggatggacactcgtatcacgcaacttgaagatgacatgagcttcatacgacattgctttgatcctcctgcggattcatag

SEQ ID NO: 67838 - DNA, 174 bp, Glycine max
  Peptide Sequence Number=SeqID_159523
atgaaggaaattaaaatcaaagtaagtgatccaactttggatgcatttgatattggcaatttgattttgaaagacaatgttgaagattacttctcaacccaggaagagcttgaaaatgatggtgatggtgatgatattggagatgattttattagagaattgatggacatttga

SEQ ID NO: 67839 - DNA, 338 bp, Glycine max
  Peptide Sequence Number=SeqID_159524
gcaaagacgagcagtgcaaagagggattgaacgatgtgtttcattggaaggtgattttgactagcccgatcggtcaaacctcatccacaacactagccattgttggtcttcttcttcgccttcgtcgacgtgttattgttggtggcgacaatgaaacggttgttgttgttagatctgagtgtgcgagacagatcataaactgttacggggagatgggtttgggtgcgatgtgggtggctgtgggtgagatggattttgcagcgcgatgtagtggtcattgtcttcgtcttcttagatggcgtcgttgtcgcagggttccgcatcgcacactcgtttag

SEQ ID NO: 67840 - DNA, 264 bp, Glycine max
  Peptide Sequence Number=SeqID_159525
atgaggtatttcaacattctcatttacgaaaggatattggtcaatttgttgatgatagatctagttgcaagactaaagcataagggacacctttatggtacaggagatcttgctcatagttataaatgtggatatgatagcttcatgcagcatgtgcaaggatcttgcagtcgcgctcaagattcaacgaagattaatcgactaagggaggagctttgtcaatcaaaggaggagatatgtgtattttactcaattgtactttag

SEQ ID NO: 67841 - DNA, 279 bp, Glycine max
  Peptide Sequence Number=SeqID_159526
atgttgaatccaactcagtttcaggccaaagaagagaaggcaaaagctgctgatgactcgcttagcgacacagatccgctcagcgagatgcatccgcttagcgagacatccaactcgcttagtggatgggaaaccctagaagagaataagattgagatctgctcacccagtgcgcagctagtccgcccagcgagaatgttatctcttctcgtgctcagcatgcccactcttgctaagcgaaaatccactaactctcacttagcgagacatgcttgctaa

SEQ ID NO: 67842 - DNA, 270 bp, Glycine max
  Peptide Sequence Number=SeqID_159527
atgatccgcatactggatcagcacggatgggtcgctcggaccacccagaaattcctcatgctcatcctcagcagcctacgcacctctggtgccatcgggtcatccggaaatatgtcaacctctacatttggcgcagggagcactgactcatcgtgcaccgcagtcacaggtactcgctacctctatgcggatgcggtaggacatcgacgctgcggagcatcatcggaatcatcacgatctcctttgcccgcacctctgccagtaacgtga

SEQ ID NO: 67843 - DNA, 408 bp, Glycine max
  Peptide Sequence Number=SeqID_159528
atgactttaggtatgccaatgttgctaatgccaacaacagagtctattcttgcaatgttgttgtccactcttgtaattgcgtctattgctgataccacaatggtggcaacaaaaacgcctgttgtaatcactacgtcattcattaggcaacaaatttatttgggcatccatgatataatgtaccaagtctccaaacagcttgctgatatcgtcaaacccatgagtttgatgataaggatgatgcaaatcaatggagtggatccttctattctaccagtatcatctcctttgggacaacgtgggccaattcaagcttcattgataacaatgggtcaaccgaatatggcacctatgcctaacattctgttagagtttgtggtcttagttcctttgtcccacatcgcttga

SEQ ID NO: 67844 - DNA, 282 bp, Glycine max
  Peptide Sequence Number=SeqID_159529
atgtatgtgcagctatttaagaaaaaagaaaagctaagtgcggaaaagcaacccagcctcgttacaagcctagaaaagtcctgtggaagtaatgtcttccaaggttattttgatgatgccaaagaatcaagagttaagcaaagtttcaagcaaagattcaagaatcaagtttcaagtttcaagattcaagattcaagaatcaagattcaagaaaaatcaagatcaagattcaagactcaagattcaagaatcaagagaagactcaatcaagataagtactaa

SEQ ID NO: 67845 - DNA, 579 bp, Glycine max
  misc_feature (12)..(12): n is a, c, g, or t
  Peptide Sequence Number=SeqID_159530
atgctgcaggcnactctagaggatccccgcaccagcatgaccaccttgacccagacatggatgacactgctgctcagcaatgtcttgcctagcgatcataactccgatctccctctgcctaagtgccagttggtgtatgccatcctgacacggatgagcgtccacgtggcccaggtgattgctgacgccatttatttgtttgcaggtatggcgcctactaggcaccctctagacccagctaattccaacagggccctggggttttcgacactgatcacgggcctctgccagtcctatggagttcccgtcacccccaataaagcggccaaccaccttgggcaagtgcagatacatgagtgtctctaccggttcagcctcagtcagcaggggcagggttccaccctttttgtatgccctaccccggagcagtttggggctgaggtcgcatggcctggagactggcccgatgcccaagtaggggaggagcctgcaggatcccccggtgaggcagatgaatcccatatggatgaagatatgactgacctgcttggtttcttgggagggagcggagccacgtga

SEQ ID NO: 67846 - DNA, 387 bp, Glycine max
  Peptide Sequence Number=SeqID_159531
atgaagaacggacgaagaacagtgaagaacggcggaaaatcttcaggaaatcactcacggaaacgtctcggaagagttacggaagcacctcgacttgaattttcttcacggaaacacattttttcaccaaaaacagttgaaatgcatagcataggggtcagggacccttttgaaaagccccctttccctatttatagagaaaaaggggtggtgcttgctaccctgctcgcccaggcgagcagggttacgggaattttacggaagcattacggaagccccggaagccattttttaacaaaagggggaggagcttgccgcccaagtgagcaagtggcttcctcaacaagcaacccagcttgcaaaatgttctggaagacccagatatga

SEQ ID NO: 67847 - DNA, 465 bp, Glycine max
  Peptide Sequence Number=SeqID_159532
atgaatcaggagggagaggccctgagagactcttcggagtgtaggccttgggggtcacccggtttgagtgctcctttaagcctatgccgatcccacatggttggagcattctcgcaaaatagcgtgatcctgactggtctccctatgattttacttagtgagagtgatctaacatactcattgtgtggtgcgtcttgtcatgtactcctaggtgcccgacaaggtagagggtgtcacagaggtcacattgcctctcaatgccccacaaagaaaaccatgattatgaggggtcaagacatttatagtagtcaaaaggagactacttcttccccttcctctagaggaagtgaagatgaagtaaggggtgaagagtctagtgaggaagtctacccccatgaaaaaggtgacctcctaatggttagaagactccttggaggtgaatcttgtgatctatctcaatcctaa

SEQ ID NO: 67848 - DNA, 1251 bp, Glycine max
  Peptide Sequence Number=SeqID_159533
atggcttccaagaccacaattcattgctgcttccgcggtgaagacacacgcaatagcttcactggttttctttttcaagctcttagtagaaaaggcaccattgatgcattcaaagatggtaaagatctcaagaaaggcgaatccatagcgccagagctgatccaagccattcaagggtctcgccttttcttcattgtggtgttttcaaacaactatgctttctcaactatccgaaaaaagctacaatatgcagagattgaagatcttgaaaagataacaaatatactgggtcacaaattttcaagtcttccaaatgatgatctggttgggatggaatcttgtgttaaagaattagcaaagcttttacgtttggggtccgttaatgacattcaagttgtggggatgagtgggataggtggaataggaaaaacaactcttggtcatgcaagggaattgatagttcttgataatgttgatcaagttggactcctaaagatgtttccaaggagtagagatactttgttacgtgaatgcctaggtgaagggggcagaatcatcataatttctagggataagcatatattgatgagacatggagtagatgatgtttaccaagtccaagcattggatcacgaacatgctgttcagttggtttgcagaaatgctttcaaaagtaattatgttatgaccgattataaaaagttggcttatgacatactatcacatgcccaaggccatcccttagcaatgaagataccgagaagggaatatttttggatattgcttgcttgcttattctacatataccctgtgcaatatttgatgaaagttattgattttcgtggatttcatcctaaatatggccttcaagttctaattgatagatcactcataaccattaaatatgaattgattcatatgcgtgacttgttgagagatttaggcagacttggtaatctttccaatgaattaggatatcttacttggaatgaatatccttttgagtgtttgccacctagttttgagctggacaatcctgttaggttgcttttgcctaatagcaacatcaaacaactatgggaaggcatgaaggccctaaatcttgagtggctagatctccaaggacgtatacaacttaggcagattgatccatccattggtcttctaagaaagcttatttttgtgaatttcaaagactgcaaaagtcttaccaagttaccacattatcatatttggcctcaattctcttga

SEQ ID NO: 67849 - DNA, 285 bp, Glycine max
  Peptide Sequence Number=SeqID_159534
atgaagatgaaagcaaacaaaacaagaaatgaattgaaagtctcggattcgaacagttaccagttgaagaacgaagaacgaacgaagaacggacgaagaatggtgaagaacggaggaaaatcttcacagatttgctcacggaaacgtctcggaaggattacggaagcacttcgactctattcttcttcacggaaacatggagaggaaggtaacatagtaagagtggatgtagtatcaagaacttcagaagttattagggaagactcaggaaatcaagcaggataa

SEQ ID NO: 67850 - DNA, 372 bp, Glycine max
  Peptide Sequence Number=SeqID_159535
atgatcgtgttgttgatcgtatcagccttgattatgaagcctgggaggtccaagatcaaacactcctgccttcacacgaaaactcaagcacgacagctccgcactgccataagagcagttactcttgatggcaaaacaattgaggagtacttgcaaaaaatcaaagggtttgtggatgaacttgctggtgttggtgtccaagttcgtcatgaggaatgcattgacacactacttgaaggattgccgtcaaattacgcgtcagtggtttttgttatcgaaagtttaacgacccgcctcgtcgctacgatatcaacactctattatgcgataatttcaatttttataagaagaactccattcatttgcttatga

SEQ ID NO: 67851 - DNA, 1788 bp, Glycine max
  Peptide Sequence Number=SeqID_159536
atggggttggcttactcagggagagtagtgttcattatgagggttgagacgaggctatgcatagataatgtttcaatctatcaaaaagttggggttcaacttggtgtggaggaaaggacagaacgctcaccatattgtgttcttatgtgccttacattagagggaaaactcgtcatgttccatgttgctagtcttgcaagaagtaaagcttcacctgaggttgattctgttctgcacaatgaggatgaaggttgcactcttcctcagggattttataacaatttacaagcaactactgagaagactagggagttgtggacttcaaatggctcaagggactctcagagagcttctaatctattgcctggtgaaacattttcattcccaaaaaagtttgatgtttcttcaattttagcttcaagctatgctgatggtgttgattttcaaaacaaaaaatgtaccatgggtgctacaaatgatcttgggagcataggtggaaaaccttttcttgtacaggatgtgaatgacatatctccaaccatcaatttctccaataggctagttcagattgtaaagtcatctactcaaaagttccttccttctaatgagcaacatggaactccatccacgcttgggatatccaattctgatttatcaaagcagtttggcaatattaatgagatgactaaagaattggatctagttttgaaatcaatagaagaggctggtggctttagagattcttgcacaaggtcactacaaagttcaattgaagccgtggagcaagacatgaatgctctgtctaaaaaatgcaaaatattgacggttgaacctattattcgtagtcatcatcttgaaggctatatcattaatccgaagattccacataaatatgcttcgattgaagatcacaatgctgataaagtcactagcgagtatagcgtgaagtatgaacaagatcaatttcttcttgcgtggttgcaatccaccatcttcggcggcattgttctgcaagttcgtcaagttcgtaatgagctttgcaatctctcttttgataattgctctattttggatcatcttttgcatgttcagatgcttgttaatgagcttactttgattggtgaaactgtttccaattctgaacatcttgacctaattctcaatggtctccctgatgagtatgagtcttctgattctcttattactagtcgatttgatccatttactattgatgaagttgaaacattgttgcttgcatgtgaagtgtgcattgagagatcttgtaagaaagttttaggttctattaatcttactcaaggtttaggatttgttaatctcaactttggaagttcttctcttgataattctgttaatcctaattctgcatatagttgtggtggtcgaaattttggcttgagcaattgtgttggtcatggttcaagtcgtagtggtggtagaggtaggtttgccaattcactcatggcatctgctcccactcaaactcagacttggtatcctgattctggtggttcccatcacatgactaatatgtcacagaacaaacaacaagtgacaccttttgagtggcctaaccaaatcactattggtaatgttcagggcctcaacattaactcctcaggatttgtgaggagtgatggcctctatcaattccctcaacttcttgcttttatgcccaagtgcaagctcccttcacctgtttgcaattctgttaaaactgttgtacaaagtccttttgtaaatacagtcactagtgactctgatttttag

SEQ ID NO: 67852 - DNA, 126 bp, Glycine max
  Peptide Sequence Number=SeqID_159537
atggaaggtcagtgcacttcgccccccacgaacatacacaacatccaacatatgaacgtggcccaaagcaagttccaaagaccatggaaggttaccccaacataccctggcagaggtcgggattga

SEQ ID NO: 67853 - DNA, 243 bp, Glycine max
  Peptide Sequence Number=SeqID_159538
atgccacgtcatcctttagtgtcacgttggatagtccatgtggcactaaaattgacctcactaatagctgtcgcaacctacccttcggcaggaaggcgacacgaggctcacgggtgcgtcttccatgggaggaaaatgcgcggagtcaccaccaacgtttatttgaggaaaaacatcggaaaaatcgaaaaagtggtcgacaagggtgtttccctcgctcctacgtatcctcaattgcgatga

SEQ ID NO: 67854 - DNA, 186 bp, Glycine max
  Peptide Sequence Number=SeqID_159539
atggcaacggaatggagaaggaagagagagaggagacgtcacttcaaggagaagatgagtctagaagaagctcaccaccataggaggccatggataagagcttggaggaagaaggagatgaatgaagttatggttcagcccactaatccaagatcaattccaagattctccactaagtgtgcttaa

SEQ ID NO: 67855 - DNA, 186 bp, Glycine max
  Peptide Sequence Number=SeqID_159540
atgaaccgccattgttctccgttgaaaccccacaccgagaggaacccttcaaccgaagtgaaatcttccatcttgcctcgcggtttcggtagagaacgaaaccctaatctgacctttcattctccttcgagaagattgcatggaaccgacgagcggagacgaaaaagaaatctccaagtgacgtga

SEQ ID NO: 67856 - DNA, 396 bp, Glycine max
  Peptide Sequence Number=SeqID_159541
atgggtgattctggtggttctcgtgaagcgtatggtcatggtcaagaatgtttattcctagggtattcctcttctcacaaggttacaaattcttatcttcttctgtcttttgacaacactgagcctgtacctcaaacttctacttccactatatctgcctctgttcaacttgtcaattcagagtctactacccttgcttcatcctctttagaatctatttatgtaccaaattctataccagtcaatactcatcctattcaaacaaggtctaaatctagtatttgtaaccctaggttacatcgtttcttacttattctaagcctaaaattgcaaaacaggctttggcaaatgcagattggctcactgttatgcgacaagaatatgatgccctgctaa

SEQ ID NO: 67857 - DNA, 588 bp, Glycine max
  Peptide Sequence Number=SeqID_159542
atggtgcaaaaaggtgattttggagcaaaaattgtgcccccaaaaagaattttgaagatgcttctagaactctttgatcatcaagatcaaaatgttcgtgcatcctctaaagggttgactcttgaactttgccgttggattggtaaagatagtgtaaaattaattttgtttgagacaatgagagacacaatgaaaaaagagctagaggcagagcttgtaaatgttacaggaacagcaaagccaacccgtaaaataaggtggatgtctgattttgatggttttgaattttcccatcctgagtattctatacaaggattgggtcttttgtatactcactgcagcatgcatacttttgtgactgaaaatgaagttgctctgattgctgcaagaggtgaaggaacacaagtcacaatggaacattttgaggtagccattgataggatcattggtggcttggaaaagaggaacaatggtagagcttggtgttcgaggcccaagcaaacctcccagaacacagagagagagagagaaagagaatctagatttaggaagaagatggatgcttattattctgctaccattcactaa

SEQ ID NO: 67858 - DNA, 624 bp, Glycine max
  Peptide Sequence Number=SeqID_159543
atggctgcaagattaagaccattggtacctatgaaacagttaaggctggaaaaggagaaagttgaacccaacaagtggactgcaaactgggttagtgatcctgatgatctgccttgtaggcatacgattgttgtcattagatacaataaccacatactagaggactatagtgatgatatgctgaccattggatcttataacgcaacctatgaaaattacatactccccaccaagagtcaacaatattgggaaaagacaacttttaacaggccaacatcaccacataataaaaagagacctagccgatcaaaaaatgtagaagaaattatcagaatgaggaacaagatgagattaactactcttaatctgctctacaagttgaacaaccttcagctaattttgaaaaaaacaatcttcatacctccaccatcatcagctgcgtttagactacctctagttaggcctttagcaccaattcaaattatattgtcagatgtaccatctcataggatgaaccaaccaaattacatgagctatacccacaccagggatgccccgctgccaaggttcgaagaagtgaaattaggatatgcttgtcttttgtttatagtagattgtgactaa

SEQ ID NO: 67859 - DNA, 678 bp, Glycine max
  Peptide Sequence Number=SeqID_159544
atgattgccaacatggccatctttgattggctctccaaatcctctcagaatgcattttctcttccttcccttttcttcttctcgcaccctcaaaatgcactctctctgaggaaggactctcaaaacccattctctccaaggaaggatgacacctattttccaacgaccaccaacgtgctttctctattgatggaggttcacattttcgtcttctctattgcaccgccagatttggtcaatgtgtggacaacccaagaattgtgcaaagcttaccacaactatgtgaagtttgcttcaatgtattatttggtgcctgatagtgaaaaagaagtgtatgtatacttaaaacatgataggctagaggagggtcctattaatgaaactgggctagagactgaagtagatgtgttccagatgctgaaacggaagttattggagttgaaactcaagttaataatgaagatgatggacaatcaagtgacacaagtaatgatagttaccactctgaagaatttgagtctcttcccaacagtgatgatgaagggtgatgtaagctccattggagcttgtaggcctaggatcttcttcatcaatggattcctttgcttcttggaagatgaatggcagcggaatggaaaaggaagagaaaaaggaaatgccacttcaaggagaagatga

SEQ ID NO: 67860 - DNA, 222 bp, Glycine max
  Peptide Sequence Number=SeqID_159545
atgaccaagaatcatgaaagcgatgaggaggagtccttgaagaaaaagtggtacatagatagcgggtgctctaaacacatgacgggagatgcctcaaagttcacaactatctctcctaagaaaagtgggcatgtaacctatggcgacaacaacagagaggttatagggtatcatttgattctcaaaaatgtgtcattaaacatgaacatgataaggacatag

SEQ ID NO: 67861 - DNA, 531 bp, Glycine max
  Peptide Sequence Number=SeqID_159546
atgaagaaaaataaacaagcaaccactaaatcactaggtgagtcttcttctactaattgtccttcaactgaaaagccatttgtagaagataacatggttgatcgaggaggagaaggaaatagaccaccaacgaggattcttggtgactatgcttatcaacaaggaccaaagcattacaacaacatagtcattcctccttttagcaataaggttgtggaattgaaggcagcactacttagtctgattgactcacacccctttgctggaatggatcatgaggatttgtacacacatttgtccaccttcattgagttgtgcagtaccatggaagcttttgacgaagatgttgaagctgtgtacctcaaagctttcccattctccttggcagagattcaaagctttgttgcagagatggccactgttcaacacctggtgattgtcaacaagaagaagatggtcattatctgtagaatcaagccagacctcaacagaacttccaaggaagctaccaaggctataaaggtggcttag

SEQ ID NO: 67862 - DNA, 534 bp, Glycine max
  Peptide Sequence Number=SeqID_159547
atggtgaccaaaggttggagctttgttgggcaacaatggtggaggaagaagaagagaatggcaacccacatgaagagaaaaatctggccttttgaaatgccaaaaccctgtctcggtttgcgtgtcgttcctctggttccagtccctcgcatctctctgcgcccgtcggggccaattttcgaaagtaggcaatatatatatcaaaacactcagaatgaaaccccaagcgtggttcagaggttggttttgttaaattttaagttacacgccgaatttgaggataaagaaaaaatacttcagactgtacgagagcggtggaggcagtttaagttagatttgacctctaaatgggctctggcacacggcaaggagggcgaggatgacaaagcaaagagaagattccttgtaggagcaggcctcacagggaagctttgtcacccacagacgtcaggatgtaatgactgttcccattgggcaactagagcacccggtcgtgtccgtgttgttggatccagtatcacgatcaaaaactaa

SEQ ID NO: 67863 - DNA, 677 bp, Glycine max
  Peptide Sequence Number=SeqID_159548
gcttccggtatcacagggacacagatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 67864 - DNA, 328 bp, Glycine max
  Peptide Sequence Number=SeqID_159549
atgaaggctcaagtggagatggatgaaggcccagaggcagagacactatcaagacaattaattacttatcaaggtaatccttgtggcgtctacccggacttatcttccttcaccggaagtggcgtctacccagacttatcttccttcaccggaagtggcgtctaccttgacttatcttccttcaccggaagtggcgtcatccaaaaactctacagcctgtatcaagtgatccgccgcgtaaggttcacatcatctagtatcaaagcttcggctcttgatacaagttctattctatcctatcctattattttctttgtaatttgtccag

SEQ ID NO: 67865 - DNA, 192 bp, Glycine max
  Peptide Sequence Number=SeqID_159550
gacattgaggcaacaacaattcaggaagaacctctatcttctgaggcatcttctagttttccaaaaaaaggggaatctcacacagtattaattgaagccaatatcatggctgatgagccaagacaagtgaccctggaagattactcaagtacttatgtgccgcaattcttcacaagcattgtgcagccaaag

SEQ ID NO: 67866 - DNA, 195 bp, Glycine max
  Peptide Sequence Number=SeqID_159551
atgttcatgacccctaggctatgcatttcggctattttgggtaaaaaaacacgtttccgtgaagaaaaatcgagtcgaagtgtttccataacgctttcgagacatttccgtgaacaaatctgtgaagattttcctctgttcttcgttcttcaaccgcaaaatttaaccgatcgttcacgccgtaacctcggttaa

SEQ ID NO: 67867 - DNA, 820 bp, Glycine max
  Peptide Sequence Number=SeqID_159552
gatcatcttagaccctaagtacctagacatagatttcttgaatgatgaaatgtttgattgctatcaagtgtttcaaaattctggccttgttgatttcatgtcattaaaattgccacattatcctgaacttgtaaaggtcttctactgcaatttgaaaattcaagatggcattatttcctctgaggtgcatggtattcctatgatcattgatcagtcattgttcttttctttaactcatttacccagtcaaggtgcaccttttgagggcaccattgttgatgactggcaatttgattattcttgtcatgatgctcgccgtatggaggatttgattctgatgtgggctttccttaccggtcatcagatcgactgggcccacttggttcggtaccgaatgcataaggcattatgggccaatgcacctctcccttacccacaattgataactttgtttttgcgtcattttcaaattccgcttgatgatgaaccatttgttcaagtcaagcgttcctttgcaattggtgctggtgcagtgacttcctttggttaccataaggatcggaatggtcaatggctgaagaaagatgcactccctcctcaagatgagcatactccttcacctcctcctcagcgagatgattcagcattcatgaatgaagtccttatcgaattacgaggtcttcgttcttatgttggtgaaagtttcgactcattagatacacgttttgccggcatggatattcgcctcacacaacttgaagaggatataggttacattcgtcagagtttcaatcttccaccaccacctccaccctcttag

SEQ ID NO: 67868 - DNA, 528 bp, Glycine max
  Peptide Sequence Number=SeqID_159553
atgaccatccagaatatgcaatttcagcaagagacaagagcctccattcagagtctgacaaatcagatggggcagatggctactcagttgaaccaagctcagtcccaaaattctaacaaattgtctggcaaccaaattcaagtgcctccaccagtagcagcacctgcacctgaacctgtcaagcttccttctacacttgagaaaaaggatgagatagtcgcacaaaagagaaggctttctaacaaaaattttcatagaggatgtgttgcttaccccgcagttccaattattttaggcaggccatttatgaaaacagcccgaaccaagatagatgtttatgctggcacattgtctatggaatttggtgatattgttgttcattttaacattcttgtaggcctaggatcttcttcaccaatggattcctttgcttcttggaagatgaatggcagtggaatggagaaggaagagagagaggagacgccacttcaaggagaagatgagtctagaagaaactcaccaccatag

SEQ ID NO: 67869 - DNA, 387 bp, Glycine max
  Peptide Sequence Number=SeqID_159554
atggctggtgcaaaaggatcttcatgtgcaattcctggttgtgattctaaggtgatgagcgatgaacgtggtgctgatattcttccattaaaaataggaggtgggatatgcctaggatgcaaggagccatataagaacacagaactagatgaagtggctgtagataatgggcatccccttccacttcctccaccaagtggaatgtctaaaatggagaggagattgtccatgatgaagtcaacaaagtcagcactggtgaggagccaaactggagattttgatcataataggtggctctttgaaacaaagggaacctatggctatggcaatgctatatggccaaaggaaggtggttttggaaatgaaaaagaggatgattttctttag

SEQ ID NO: 67870 - DNA, 633 bp, Glycine max
  Peptide Sequence Number=SeqID_159555
atgggtgaagcagaggaggtgcaagagaagatgaaggccgacatggaggccatgaaagagcaaatggccacaatgatggaggccatgatgagcatgaagaagataatggaagccaatgatgccgctactagcgctgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatggggatgtcaataactccactcccatacccattaagagccaacaacctcaatctgatcatgcacatgtctctcgacccatggaggagacacatgaaattccccaccacgatctagccaacttcgagccttgcctcggatatgccgctgaagggcaagtaattggtggtatacccctacaaaacactttggagggccctcagtatcatccacaaccacaaccctcacgttccacaacggttaaaaaccctcataactatggcaggaatgggaaagttggattatctagaggaaaggctcaaggccattga

SEQ ID NO: 67871 - DNA, 618 bp, Glycine max
  Peptide Sequence Number=SeqID_159556
atggcctccaactcccagcagtttagcgccagaaatgatgccatagtcattagaggagtgcatgaggtagctacaaacccatttgcatcatctgaaactaagaagcttgaaggcaaactggatgcgttggtcaacttggtaacccaactggccgtgcatcatcgcaaggacctttgcccttccatgcagcaacctgtagcaattgagcaacctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaacagtcctag

SEQ ID NO: 67872 - DNA, 1239 bp, Glycine max
  Peptide Sequence Number=SeqID_159557
atgggatcaagtcaaatgccttcacttaaaaagaggttctatcaagtcaaagtcaagagcctagggaccaccagtctaaaagagttagggcagttgatggttcaactccagcggcaagcttttcgcaaagcttacggtaaaatctgggacctagccatggtagaagtctccacagaggtcgttgcctccctcgcccagtattatgatcagccgatgaggtgcttcacctttggggacttccagctatcacctatggtagaagaatttgaagagatcctaggatgccctctagggggaaggaaaccctacctcttctcagggttctatccctcattagctagaatttccaagatagtccaaatcttggcgcaggaattagaccataggaagcaagtcgaaaatggggtggttggaataccaagaaaatatttggaggcaaaagcaagaattttggcaagtaaaggcgaatgggcctcgttcatagacattctcgcgctgttgatcttcggaggagtcctctttccaaatgtggatgggttggtggaccttgcagcaatcgacacttttctcgcctatcataacaacaaggaaagtttggttgtcgctatgttagccgacctatatgacaccttcgaccgaagatgtgagaagagcagtacgaggatttgttgtactccagctctttatgtatgtttggtttcgcacctttttctccaagaggtgaggcatgcttgcccgctagaaggtcgtcgttcatgcacagagaaaggaggtgcaaattgggaccaactcttagcaaacaaagaaggagcgtctatcaactggttccctcgatggaaggaaggaagaaccggagttcttatttcatgcggaggatttccaaatgttcccttgatggggacgaggggttgcatcagctacaatcccgttcttgctataagacaacttggctaccctatgagaggggcaccactagaggatgagctcacgcctatcatttcacgaggcttcaataagaccaacgtggagacacttcagaaggtccgcaaggcatgggagatgttgcaaaagaaggacaaagaactcaggggcagtaacaatgggcccattggtggctaccgtaagtggttgagagcccacgtccaaggtttggattggctcccaagttttagaaccgctaaaaaggaggaagttgaggcaccgcaaggcattctcctttcggatcatcagcagctctga

SEQ ID NO: 67873 - DNA, 195 bp, Glycine max
  Peptide Sequence Number=SeqID_159558
atgtctgctgtttatcggcatcattttgaaaagcgcgcgcgactatccggccgcgctcagcaaactggaagcgctggacgaagtggtggaagcctgcaggtgctgatcaacaagatccagaccattgatgaaatccagtccaccgaaacgctgatctccctgcaaaacccgatcatgcgcaccatcaagccgtga

SEQ ID NO: 67874 - DNA, 1391 bp, Glycine max
  Peptide Sequence Number=SeqID_159559
atggctcaaccccatcttttggcagaaagaatttctcgcctcagcaatgccctggagaaagggctgtatgaacggcatcatgccattcgtctctgcctgctggcagcgctgagcggcgaaagcgtgtttctgctggggccaccgggcatcgccaagagcctgattgcccgccgcctgaaatacgccttccagcacgcccgtgcctttgaatacctgatgacccgtttttccacgcctgaagaggtgtttggcccgctgtccattcaggcgctgaaagatgaaggacgctaccagcgtctgaccaaaggctatctgccggatgccgaaattgtctttctggatgagatctggaaagccggtccggcgattctcaatacgctgctcaccgccatcaacgaacgtcgcttccgcaacggcgacagcgaagagccgatcccgatgcgcctactggtcaccgcgtccaacgaactgccggaagccgacagcggtctggaagcactgtacgaccgtatgctgatccggctgtggctcgacaatgtgcatgaaaaacagaacttccgcagcatgctgacccaccagcaggatgaaaacgccaacccggtggcggaatcgctgtgcatcagcgatgaagagtatcagcagtggcagaaaggcatcagccaggtcagcctgcccgatcatgtgtttgaactgatctatcagttgcgccagcagctggagaacctgccagaggcgccgtatatctccgatcgccgctggaaaaaagccatccatctgctgcaggccagcgcgttttacagtggccgcgtggcgattgccccgcttgatctgatcctgctgaaagattgcctgtggcacgacgtggcgtcgatgcagctgctggatcgcgaaattgatgcgctgatgacgcagcacgcgtggcagcagcaggcgatgctgcacacgctgcagcagatcaaagcgcgccggctggcgctgcaacagcagcagagcgtggagcaggcgctgacgctggagaagcacagcggcatgttcagccgcaaaccgcactatgaattaccggcctcgatcacggacgaacagctgaccctgatgctgcaacagccgctgacgctgcacgacatgcaggtcacgcacgtggtggtggcacgcgatgcgctcaatcagtggctgctgaaggcgggcgagatccgcggcaagctcaacggcattggctttggccagacgctcgacctgctggtggatgcgcaccactgtctgacgctgcgcgacgtcagcctgcagtccacgcgcctgacgctgccgggtgccgccagcagcagcgacgtgccgcaggaaatcattgaagaatatgacgcgctggaggcccagctgcgcgagcagcgcacgaa

SEQ ID NO: 67875 - DNA, 2025 bp, Glycine max
  Peptide Sequence Number=SeqID_159560
atgagtctgttcctgcgactggcgatcggctttctgctgttaattatcctgtgcggtgccagcgccaccttcagcgcgtggcagcagacgcgcgacaccgttaacgagctgtttgatacccagcagatgctgttcgctaagcgtctgctggcgctggatgccagccgcctgcaggctgcctcgctgccaaaaaccaaagcgattttgcgccaccatcgcggcgatcaggatgacgacgcgctggcctttgcggtattcagcgccgacggcaaaccgctgcttaacgacggcgaaaacggtcgcgatttgccgtttaccgcggatcgtgacggcttccatgatggtcgcctgcgcggcgatgacgatcgctggcggctgttgtggctgacctcagccgataagcagtggcgcgtggtggtcggacaggagtgggaatatcgtgatgatatgacgcgcgatctggcactgagcagtctgctgccgtggctggtggccatgccgctgatgctgctgttgctgctggcgctggtgtggtttgagctgcgtccgctgaaacgcctgactgcatcgctacagcagcgcgcgccggatgatgccaccccgctgacgccgcaacgcctgccgctggaggtgaagccgctggtggcggcgctgaatggcctgtttgcccgcatggcacagctggtccagcgcgagcgacggtttacctccgatgcggcgcacgagctgcgcagcccgctggcagcgctgcgcgtgcagagtgaggtgattcagctggccggcgatgacgaggcgatgcgtaaccatgcgctgcagcagctcgacagcggcatcctgcgcgccacgcggctggtcgatcagctgctgacgctgtcgcgggtcgaagcagacgatctgcgcagcgaatttcagccggtccccctcgcgccgttgctgcaccagctggtgaccgaacatcaggcacaggcggcagcgcagcacaccaggctgacgctgacggctgacgcggaaccggtgatgaacggtcatccactgctgctgggtttactgctgcgcaatctgctggataacgcgctgcgctacacgccgtccggcagtgagattcagctgcggctcagcgcgcgcaggctggagatcgcggataacggaccgggcgtcagcgcagagcagctggcgcggctgggcgaacgcttctggcgaccgccggggcaggcgcaaaccggcagcgggcttggcttgtcgattgtgaaaaatgtggctcagctgcacggacatccggctaaccttcagcgcggtgcagccgcaggggctgcgcgtcaccctcagctggtgacgcgcgatgcgtcagatttcgacctgagtaccgagctcgattacccggttcggcggaatttcaaactgatccggcgcgcgcagggcgttgcgctgcagcgcaaggaacagcttgccgcgcagacgcagataccacgggcgtttgccgatgatcagcgactccccttcgaggccgcagcggtggaaaatctcctcgacgttcggcgtttcgcgccagccgtagcttgccaccacgcgccagaaggtgggcgacagctgctcaatggtcacgcgacgcacgttgtgcacataaggcgcatcttcggtacgcagcgtcagcagcaccacgcgctcgtgcagcaccttgttgtgcttcaggttatgcagcatggcaaaggggatgacattgagcgcccgcgacatgtagaccgccgtgcccggcacgcgcaccggcggcgacttctccagcgaggcgatcatcgcctccagcgaattgccatgctcatgcatacgacgcagcaggcggaagcgctcgctcttccacgtggtcatcacgataaacatcatcagcgccagcgtcagcggcagccagccgccggagaatactttgaccaggttggcggagaacagcgaaacgtcgatgcacagcatcgcgatgagaatcagcaccaccagatagcgattccagtgccagttctgaatcgccaccgttga

SEQ ID NO: 67876 - DNA, 396 bp, Glycine max
  Peptide Sequence Number=SeqID_159561
atgggagaaaataatgacacatcaacaacaaaggaaattactaaaaagattgagcaggcatcacagggttcgtttgtcccccatgaacttcaggatgtcctgactgctgccattgggcgactagaacactctggtcatgtgcgtgctgttggagccggtgtgtccatcaagcaatactttggaccggctcaacggacctcccgtatttcttcctccatcgctcctgaagaactagagaagcttactcaacaaatcagggaccagctggaggagtcgatcacagaaaaaggaattgcactgcctccggagcctgaggttggtccctcagctgctcgtgtcatcacaaagggcagttgtgttgatccctcaacgacggatccaaacacggatgactaa

SEQ ID NO: 67877 - DNA, 330 bp, Glycine max
  Peptide Sequence Number=SeqID_159562
atgggactcctccagaggatcgatgtcgctttggtgcgggagttctatgcaaatgcctacgatctagaggacgacacacccaagttctgtagggttcgggggaaagtcattcgcttcgacgccaagacattgaatcactttttggagatccccgtcattatcccagagggggaggagtaccccacatactcccagtacttgcacacttatccagaccaccaagccatcgcggccaagtggtgcacatcggggggtcagttcattctgaacgccaatggagctccgtggaagctgtttaggaaggacctcaccatattggctcagacttag

SEQ ID NO: 67878 - DNA, 189 bp, Glycine max
  Peptide Sequence Number=SeqID_159563
atggagaagtctgaaaagaaaaatattaatgaaaagaaattgaagaaagcatacattacatgggatgaaaacgatatggaatcttctgaagattcagaaaatgaagagataaacctctgccttatggctaaaagttatgaaagtgatgaagaggaaaacaaagacatgcctccaataaggctggactag

SEQ ID NO: 67879 - DNA, 177 bp, Glycine max
  Peptide Sequence Number=SeqID_159564
atggaggttgaggaaccttggttgggtttatggctaccattgaattatcaagtggtgtttagcattggttgtgtggggcttctccacgacaagcgcacgttgcgttcgagtcgtatccttggaaaaatggaggttgaggaaccttggttgggtttatggctaccattgaattatcaa

SEQ ID NO: 67880 - DNA, 132 bp, Glycine max
  Peptide Sequence Number=SeqID_159565
atgcctatttggggggaaaaagccctagaagcagcaagaggagaaacttgtgcattgaagcctaggttttgcctagtcttacaagagggatttgcggacaaagttgatcgaggccgtacccgaatcaaataa

SEQ ID NO: 67881 - DNA, 113 bp, Glycine max
  Peptide Sequence Number=SeqID_159566
atggaggattgcactagagggtcctgtcgcaacctacccttcggcgggagggcgacgcgtgactcgcgggatgcgtgttccatgaaaggaatacgcgcggagtcgccaccaac

SEQ ID NO: 67882 - DNA, 462 bp, Glycine max
  Peptide Sequence Number=SeqID_159567
atggctaccaccaaggctttggaacaagagaccaaaagggcccgtagggaagaacatggtcgggacaagttccgaggggctctgtggggcagtaacagcgaacttaaactccgaagagaagaaagggaccaatctcgagtagacgctttgatcttgaaagatgaattgaaggcttgctcgaggtccaagagaagtttgtctcagcggttgtgcgagacagagaccaacatgttagctatcatcatcaagtatcaagaagaacttagcctagccacagcccacgagcatagggtggcggatgagtatggccaagtgtacgcagagaacgaggctagaggaagggtgatcgactcgttacaccaagaggcaaccatgtggatggaccgatttgctcttactttgaacgggagtcaagaacttccccaattgctagccaaggccaaagcaatggcggacacctag

SEQ ID NO: 67883 - DNA, 417 bp, Glycine max
  Peptide Sequence Number=SeqID_159568
atgatgcatgcacctgacctcaactctcagatgcaatgcggtacgtaccgtatccaataccaaggaaatagccctaagcgtgtctacatgacacctcacttaggaaaccatgcagtatttgtcgaggccacccagtcgtgcatcgtaactccccccctaggtgatcaacttggggccacaaggagttccctaccaggtgacacaccccctagtacaaagtacatactgccacagtttatactatttcccgtgtcatataagtttcccacacaagagacgtctgacaaggtcaatgcaccccccaatggacatacacaacatacgatgtacaaacgtgggcaccatcaaggacatccaacaaggccaatgcaccccaccacgaacatactgttagacaagtggcctcagatatcttaa

SEQ ID NO: 67884 - DNA, 507 bp, Glycine max
  Peptide Sequence Number=SeqID_159569
atgccagtccccaagcaaccaccgattcttgagatttccaataaccttgtaaaatcatatacaagcaaagatccacaagtgatgtaccctagccctgtaaatgagtatgatttaaaagaagaagataaggagaaagtgcaacaatgggagcaatgctcacaagtacacactcaacaagaaaataatctccaagttaacacatttcctcatcaactgattgtcaaagaagaaaggcatgaagaccatgaggttccaatcattatgggacaaccctgtctgtcaacagctagttgtgtattagacatgggtaaagcaatgaaacacccagatgatagtgaggcctattttgaagaagaaattttggagcaggagatagaattaacagcctcaaccatggtattacagactcctttggagaaagaatttgacgatgtgacagaatgcctagtcagtgaaaatggaggagaaatgctagcttgtattgaagagctggatgatccagactga

SEQ ID NO: 67885 - DNA, 715 bp, Glycine max
  Peptide Sequence Number=SeqID_159570
ggcgcagccagcacgattacatcgagctgtcgcgccgcttccacagcgtgctgctgtacgatgtgccggtgatgatttacaaaacagaagaccaggcgcggcggttcctcgcgctgggcacgcggctgaaattcgaatatcagcgctgtctgtcgcgcctgcaggagatgcagagcgaggagtatcttcgcctgccgcacctgccctgaggggcaaacagaaatcaccgcttcgggcgcaaaaagagtcgatctttagattcgacttctctataatcttgcgaccccacgttacagcacaggctttcttttcccggaaaactcgtgactggtatgttgttgacgcaactggcaaaaccctgggtcgcctggcgactgaactggcgcgccgtctgcgtggtaagcacaaagcggaatacactccgcacgttgataccggtgattacatcatcgttctgaacgctgacaaagttgctgtaaccggcaacaagcgtaacgacaagatttactatcaccacactggccacatcggtggtatcaagcaagcgacctttgcagagatgatcgaacgccgtcctgagcgtgtgattgaaatcgcggttaaaggcatgctgccaaaaggcccactgggtcgtgctatgtaccgtaaactgaaagtttacgcatgtaacgagcacaaccacgcggcgcagcaaccgcaagttcttgacatttaa

SEQ ID NO: 67886 - DNA, 174 bp, Glycine max
  Peptide Sequence Number=SeqID_159571
atggtggaccagcagacgaccaagtccaaagacaaagacgttaaagaagtgctactaggaggcaacctagaattggctacgaagcagctccccgcgaagtggttcaagaagggcaccattgaagaggattccagtgtggccccacaagccgacacaggctttgacaaacactga

SEQ ID NO: 67887 - DNA, 411 bp, Glycine max
  Peptide Sequence Number=SeqID_159572
atggccaaaatacaaggcccaaaagaaggaaaaacctattctaatatttacaaagtagagtggacccaaccttggcctatgggctcagaaatctaccctgaggtaaatatgtttaacatgaacacctctaataagaagacaattctagggtgccaatttgagagcctaactagaaaggctatgacctgtttggtaactagggtggcaccttggcattgcaatctgccctccgcaaccttgccttgctataacatggttgtccaagtactatttttccttaaattattactagctggaagcttaccaataatcatatacggacacactttgcatagaatcaatattagagaatctcaagccagaagcatatcttttattacattagaaagtgcaactgtacaagagaaataa

SEQ ID NO: 67888 - DNA, 423 bp, Glycine max
  Peptide Sequence Number=SeqID_159573
atgggctttctacaagatgacagagaatatgttgaggcaatcaaagaggccaaggacaagggcacaactgattatctaaggaaattgtttgtattaattctattaacgggtgccatgagcaaacctgaagaagtttggaatcaatgttggcattggctagctgatgacattgcatatcaatatactaaatcaacaatcaactcagaagtgcagatcaatgatgatactcttagaaatttgacattcattgaaattgaacaactattgcacataaaccaaagatcactaaaagactatcctacaatgcatatcctcaggatatcaatctcacatcctacctacaaaacaacttggtattatcagaactcgactataaccatgatgcaacaagatcagaatttgagcatctttttgcatccatga

SEQ ID NO: 67889 - DNA, 116 bp, Glycine max
  Peptide Sequence Number=SeqID_159574
gaattaatgaaacattgggcttaatccggattttggttgtggacttgaagagggcaaataaagcagcgcttagcgggaccgaacggtccaccgggttgttccacctaaaaggataa

SEQ ID NO: 67890 - DNA, 261 bp, Glycine max
  Peptide Sequence Number=SeqID_159575
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtggaactaccaagctggagtacggtaggggcagagggaatttcacggggatcctctag

SEQ ID NO: 67891 - DNA, 1095 bp, Glycine max
  Peptide Sequence Number=SeqID_159576
ttcgatcgagccgatgcgctcgccgaagcccagcgcgcgggcgccgcccagcgtggaggcgcgcagcgtggtggctgcatccagcgcggtggcgtcgtcggccacggccttggccaggatcgccgccgtgcggttctcgctgaacatgtccaggtcgttgttgctggcgcagccgtcggtgccgatcgccaggttcacgccggcgcgttgcagggcgcaggccgggcagaaaccggaggccagcttcaggttcgattccgggcagtgcaccacgctgacgccacgttcggcgcacaggtggatttccgcgtcggtcagctgggtcatgtgcaccgcgatcaggcggtcgttgaccaggccgagtcgatccagccgcgccagcggacgctggccgtgcagcttgatcgaatcggtgatttcctgcgcggtctcgtgggtgtgcaggtgcacctgcatgtcgagctggtcggacagcatccgcacccgctcgaagttggcatcgttgacggtgtacggcgcatgcggcgcgaacgcggtgccgatcagcggatcggtgcgccactggtcatgcagttcaccggccttggcgaagtactcgtcgtcggtcttggcccaggcggtggggaaatcgatgatgaccgcgccaaccagcgcgcggaaaccgtgcttcttgtagaccgcggcctgcacatcgccgaagaaatagttctcgttggcgcaggtggtgccaccgcgcagcatctcggcgatggccagggtggtgccgtcggcaacgaattcggggccgattaccgcggcttccaccggccagatgtgctgctgcagccaggtcatcagcggcaggtcgtcggcgacgccgcgcagcagggtcatcgggttgtgcgtgtgcgcgttgaccaggcccggcatcagtgcggcctcggggcggctgaccacctgggcggcgcggaaacgcgcgcgcgcctcggcacgcggcaggatcgcgatgatctcgctgccacgcacggccacggcatggtcttccagcaccaccgcatgcggctcgatcggaacgacgtaaccggcttcgatgagcaggtcgcaggcttcggggag

SEQ ID NO: 67892 - DNA, 384 bp, Glycine max
  Peptide Sequence Number=SeqID_159577
atgggtgaaaggatgaatggaaagggtggatcatcatcgtcatcctcatcgcctagtgtgaaccatccagggagaaggttttggaaatgcccacactggaacgaatcaagttctagcaaaaaatttgaatggattggtgatattgagactggcaaaaatgtttttgtaaaagggagtgagttggtccggtttttggtagttgtcttcttgagtttggttggttgcccaacaatgttaggtattgatgcaatcctcccaaggaagggacccatcaccaaagccatgactaggagactccaaaaagattgggccagagatacgggagaaggtcctagggttctcatgagccttagggtagatgttgggcccatggactacgtatga

SEQ ID NO: 67893 - DNA, 708 bp, Glycine max
  Peptide Sequence Number=SeqID_159578
atgtatgaccagttagatgaggcttgtaggaccaccatccgacagcttgcggggtacttgacgctactacaggcgcacatgaagggaatcacaggagcaccttacagggcacgttgtgatggtttgaccatcacagatgtgtcctggttgccgtacacggagcattggggggttagggcctttcaggagatttcatcattccagggtcagctgagatggggtcctatggtggtcacagctcgaccggagatggtggtacggaaatttggttacatccagaccatccctccgccgcctgttagtgctcgattgtcacacgatgagatagatggcaggtggatgcagtttgcggagcacttactacctgcgggtcagctttgtctagtgcttgggcaggtatctgcggattacatggagtggtttttccgcatatctcacccattcatgataccgacccaggcaggtgaccaaccgagagatgcaccagttgcagaccttgaggactacatacagccgcccagcccccaggatgattacgacggatatgaggcaattgcacagaggttggagcgtgtgctcaaccttaggatagtcactgcaggtacagagttatatgacattatgcaggactgcctgacgatcgcgagagggggacccagtgctgatggaactgtcaaggctcgtcagagacaccgcacggaccattga

SEQ ID NO: 67894 - DNA, 240 bp, Glycine max
  Peptide Sequence Number=SeqID_159579
atgagggtatctgagagactcaccggagaaaaaggggagttttatttgcaactcgtaagaaagagagagagaaaaggcttgagcgaaaaacaaggaagagagaaagaaagagaaaataatactaagttgttggaatttttgaacgtagaaagagacattatggtcatttcggagaagaaggggtgctttgatgatgatgttgttggagtcttgcgttgccgcgtaaacgacccgttctag

SEQ ID NO: 67895 - DNA, 496 bp, Glycine max
  Peptide Sequence Number=SeqID_159580
ctcccaatttaaccttgagaggaattactctgaccactgtcctattgtcatgcactctaaatgcattgattggggccctaaaccttttaaggtttatgatggatggctaatgcacaagcaatttcagaaggtagtgagggattgttggttagattatcagccaatgggcaaagtcaaacagcttcaacagaaactaaatgacttggagaattctatgccagttcaaccttctgaacaacaagtgaaggacctcaagaaaacccaagctgacctttgggaaaaagctactatgcaggagtctattgtgaggcagaaatcaagatgcagatggatcaaagatgcagatgcattatatatttttctaaactttaaaggggttctgtgggttcgaccaacgacaatgtgggtgtcgacggagcggtttctggtagatttcaggcgggaggagaaagagaacagcgatttcaagcaggaggatgacaaagagaagaggtag

SEQ ID NO: 67896 - DNA, 600 bp, Glycine max
  Peptide Sequence Number=SeqID_159581
atggagaagataacgattttatctgaagagcaagagagaatcactgagcctgtggcacatggtccagcatcagagcgtcgatttccaccacaagagtttcacatgcttcagtcaagtgttgaaactcggggttttggcagacataggcaggctgttgaagcggaagaattttcccaacaaatggaggagcgtggccatggaatgtattacacgccaccaacattttctcagtatccttcacagatgtatcagtatcctttcgaaggtcatgacactgatatgtctgcaagcgaacattcgtttggtggtgttgcgaaaacacatcctcatttttcatggtcgactatgaccccatcacaacaacatgatgccccaatgccaacacccaacgccccattagctccgcaatggaatgtacccaaagcaatacctgatatgggtgacttattaggtgttgatttacgtcacgagttttttgctgaggctgagcaagtagaagcggggagacatcgtggcaaaagaaatcctgatcgtcaagcgcaaagatgggatcgatcatgtggcacatcctcacatcatcacggacaccataatgaatga

SEQ ID NO: 67897 - DNA, 720 bp, Glycine max
  Peptide Sequence Number=SeqID_159582
atgtcacaaaagaatacaccgcagatatcagcacatattgagccagatatgcatgtgttaggtgcccgagtcagcacaaaggggagcaatgctgaagttgctgtcaacccatatggaccagaccatgttgctaatgtcataccccgtatcggcttgtatgtccagtgtgaagatgctactgagttggtgggcttgggtaaaatatatgagggcggccctacgatacacaatgtgacttatgcagatgatgtggtaagggttagtgttgacaaagttattaacggtgatgctaaagtcctgtggccatctttagaaattaagtatgtcaagcaggcccttggcacattcattgcatggccaagatcgcttgtaaaagtggtatcaaatgagatttcagaaattagtccaaataaagtgactgatgctgttaaactggttattaatgttgttgtagaagacccattgcgtgagttgataaggaccctagttgacatttatgagaagcctgttcagttggtgtgggatgtaactaaatttggaatttctgatgttattgcatccttgttcgtaacatgtgttgatgtcaacgaaatcatatcaggcgtacaatgtttgaacatagctattctacagttgtggaccatgcatatggatgaatggagtaataacttgggtcaaggatcggtgtatggattcaaaattggtgtatggattccttaa

SEQ ID NO: 67898 - DNA, 297 bp, Glycine max
  Peptide Sequence Number=SeqID_159583
atggtgaagaagtgttcttacctgcacttaaattattatcatggcgacaacgatggagacgaggactatgtcgtaatagggtttgagggtttgaggagtggagttagagtgagttttttgaggagcaacaacgagagggaggtcaaaagggaatggtgtggttgtggcacgcatgtggtggcggtggcggtaaaaatgagaagtgatgttggtgctacaataaggtttcgtgggaggaaagtgaaagagagattaaaagagaatgagacaacaatggaagagagttcgaatttgtaa

SEQ ID NO: 67899 - DNA, 582 bp, Glycine max
  Peptide Sequence Number=SeqID_159584
atgccttcgagttttatagatctagtgtttgctggcgagagaattgacgcaggtccgaggaaagagaaatttagttatgttgcttctatgaatcctggtaatagggaacctgacaggagtggtgagaggaagaaggagggagaacttcatgttgtggctgaagttccagcgtggccaaactttccactacccccttataatcccatgtaccaatatcctcctcagcaatatcaccactcagccaatatcagtcctgctcattacccaccaccctaccaaccaagaacacccaatcaaccacagaggccacccgtaaattggccacaaaatccacccgttgcacagccaagactgaacaccacccctaataccaaccaaaacaccaaccagagaaggaattttccaaaaaagaagtctatagagttcaccctaatcctgatatcatatgctgacttactcctatatcttctcaataatgcaatggtagccacaagcccgacaaactcaacctctatttcatcaaggatacaactagaatgtgacatgttattatcatggaggagtttagaggcattccattga

SEQ ID NO: 67900 - DNA, 279 bp, Glycine max
  Peptide Sequence Number=SeqID_159585
atggtaaagcgcagaaagttgaatatcattcaaaatgaaggtaaaaagagaaccataggttgtacacatatgctcgatgtgtgggacttgccaaatggagaattcatacttgttgaagtagatcattggggcaatcctatgggttgggaagggaaaactctactgaatgcaattgggagcttggtaaggagacaccaatgtgctcctatcaattttcttagctggaaagacatgcctgaggactatattactaacatggttgaattaattcaggtctag

SEQ ID NO: 67901 - DNA, 568 bp, Glycine max
  Peptide Sequence Number=SeqID_159586
gcttaagttcaacgacgatgcttacgtaagcattgtctttgaaagtaagccttctaagacggtgttgacgattaatttcaaagacggtgcttacgttaacaccgtccttgaaggttggcggttttctaaaatggtagcttttgacccgtcgttgaaagggttagcttttgacaacgtgggattctacgacggtcaacgaccatcgttggctttgcttggtatgaggagctttcgggtagattggatacccgttgtactcaacattgaagcttttggggaaaaggataggttggagacaactgaaggcgagactcctaagattgtgttgagtgaaaggtcgtggatggtgatgggccattacctagctattcaaaggtggcatcctggattcaaccctcaaagaatgaacttaagaaagtcccagtttggattagggttagattataataccttgcatagaatagagtatggaagaggtaatgagtttatgacggaaaggacacattttgcaagattgtgtatagcggttgatttgactaaaactgtagtcctagcctttgagatttag

SEQ ID NO: 67902 - DNA, 615 bp, Glycine max
  Peptide Sequence Number=SeqID_159587
atgaaatctctgtcagagaaggtagatgcactttcccagaatcttgtgagggaaacgtctatactaaataataaagaagacactttgaggagtgaagaagccaacaaagcaaatcttgttaaaaatattgaagaattgaagcattttgtaaaagagaagtcctctgctgttaaaacggctgaagagggggcaacagatctgaaaaagaaagttgatgagctcacaaagagtctagaggagcatgataaagaataccagtgtgttttagctggcaagagcagtggtaatgaggagaaatgcttagaggatcaactaagggatgcaaaggtagcagttcctagagtgcactctcttctaactaaattttatattttgttcctaaagtgcaatgggatattttcttctaatcaaggtgcacctcggtggattaaacccaagactaatgtgcaaagtggagggtttgagtgcggatattatgtcatgcactggatgtggtgcatcgtgactaccggtttgaaggatgactggcacaagataaacataatgcatggagttacaatttggttttctgatggctcatcgttagacgtggaggccatcacaacagttcgatag

SEQ ID NO: 67903 - DNA, 291 bp, Glycine max
  Peptide Sequence Number=SeqID_159588
atggctggaattgatactcaggcactaggagcatgtaaactttgtgcaactggaaaaacacaggttactcctcagcttcatgaagataggagaacaacttccttccatggacgctatgagaatgaccaccgtatatgtcctgatgtcactgtaacttcaattgttaacaatcatagttctcggggtttggatggtttggtgaacaatcatactaattacacaggccaaatcatcaagtcttccaactacatggctgtagatattgacaatgatgatgatgccatacttgcg

SEQ ID NO: 67904 - DNA, 423 bp, Glycine max
  Peptide Sequence Number=SeqID_159589
atgagcgtttcaatctttcatgagacacttttcctcttcccaccaagtgtttttgtctccgcaccaccggcgctgctcgttccgtcattcataccaccagtaaataactgcgaggctagtcgtcatgttgttgttcttctctgccgtagggttataggaagagccctagggaaaacattcaatcgtgatgcagatgaagtcccccaacagcgaaggcccacaacatctgcacgtaggcaacaggaagctgcacctgttgctgaggatattcaacatatggatcatgcagatgacaaggtccatgaatatcctaaagaagcagttgttgatgatgtagttactgatgctgagggttttccaagcgggccccacgacacattagttttgatggactatgtttatcatgtgacaacgaaagtttga

SEQ ID NO: 67905 - DNA, 350 bp, Glycine max
  Peptide Sequence Number=SeqID_159590
gtgtagctgattcagatgatgaggggtctatagatttaaggacaaatcctcttcaagagggaggagatgatgaaatcctcccaaggagggaacccatcaccagagtaatggctaggagactccaagaagattgggccagagatgtaggagaaggccctagggttctcatgagcctttggggaggtgagcatttgcttgttatacctcattgccacattgatgtaagctccattggagcttgtaggcctatgatcttcttcatcaatggattcctttgcttcttggatgatgaatggcagtggaatggagaaggaagagagagaggagacgccacttcaaggagaagatga

SEQ ID NO: 67906 - DNA, 600 bp, Glycine max
  Peptide Sequence Number=SeqID_159591
atggtatcaaggtattttgttgagtttgagcgtgtaaattatgttggcattgataattctcgttatggatgtagaaggagaactgctcatgatcttccatgtgcatgtgagctagttaggtatgttcttggtagcataccactcgaaacaatccctatgttctggcggaggctaagtttttctgaccaaggtttatttgacctcgaagttagcagaaccgaagagattgaagccatatccaagcggtttgaagagcttgatgtcaaaacagaaggtgttcaaaagaaacagatgactaaacaacaaagatcaatgaagtgtgatccatcttacttggagtatgtggatgcattacattctgtgcaaaatggcaattctttaatgaaatgttgggcatcatcatctgaacaaccaaaaccaaagaggaagatgccaatgttggatcaatttcatccatacattcatgatttcattgaaaacattgttgatgtcaaaggtgatgctccatgtggagcttataggccttggatcttcttcatcaatgaagtccttttcttcttgaagatcaatgacaacggaatggagaaggaggaaaggtga

SEQ ID NO: 67907 - DNA, 435 bp, Glycine max
  Peptide Sequence Number=SeqID_159592
atgcatctgactgagacaagtatgcgagcggggaattctgatgtgtatggattcctcgagccacagtccattcagatatctgggcaattgcaatttgaatcgaaaagttacatcaaaagttggatgcagagttcaaaacgcagtgtctaccttggagcctacctgaatgggccagacaactaccttaagggaataattaacagtgctttgaaaggacttgatgatactccacaacctaaatccaaggctgttgttaggtggattgttgttaagtgtaatagacaaaaaggaagcactgagtgcggctattacgtcatgcactggatgtccacgataatctcaggaactttgaggaataattggagaacgaccattggaagcagagggattcaaggtgtttcgcatccagtgaacacagtattatctaaaagttag

SEQ ID NO: 67908 - DNA, 939 bp, Glycine max
  Peptide Sequence Number=SeqID_159593
atggcatcttcgtcgtcatgctcatcaaatatacaaactagatctggtccaactgatagtgaggttttgtggatgcaacctaagcatgttgcagaacatgtttggaatgaggaaccagacagaaaattacacatcagactagttgtccccacgtatcaaggagtcagaccacaggaaggcgaacttgaaggcaatgtggttaaattaagttggttggctcagcatttttcaaacttaaataaccatgacggtaacgtaaaacaattacaaaggtttacccgtgcatgtattcttagattcataggaggtgtcctctttgttaacaaaagtagtagcagagtttccctgagtgcatcacttatgcatggggacctgtcgtgcttgcgtatttatatagagagatgtgcagcgccaccgattacaaagttaaatcaattggagtttgtctgggagccttacacaataactgtgatggcagcattgcctccaatttgtgtggttggaagtgtagcgtggttcgtagtggtgccactgatttgtttccatgttgttgagtggcaccaaaccgatagagttttgcgacaatttggaatgcaacaacctattcccgagtgtccttcgcaaccgcagaatctccatggcataacgctcaaaggcaaacaagatgaaaattggttccagctgttggccccaatgatcattcaatggaacaatcgagctgagtttagggtcgacgtttatcctcgacaggagggcctactgagttttaactccgactacatgggtgaagttatggaggatttacagtatatggtgtcaccacaagggaggaacacatggacagttgatgatctcgtgccttacgtggaaaagttaacgattttatccgaagagcaagagagaatcattgagcctgtgtcacatgggccaacatcatag

SEQ ID NO: 67909 - DNA, 303 bp, Glycine max
  Peptide Sequence Number=SeqID_159594
atgtcactactggaacctctacattacacaaacacatcacgtgagtttgggactcagagtcgtacaatgatgcactcatttccatgggaatacgatgccaacaaggaggtggcaaacgcgacgaggaggttactcggtttgtgttccaggggattaaggattattggtaatgtgaaggttagggatttgggagtaatgacaatgtttgcatttacgggttctagggaggaagtttactggacgatgcacatgggtgagggaagtgaaactggcaatgctaattcattgagttcattggcctaa

SEQ ID NO: 67910 - DNA, 297 bp, Glycine max
  Peptide Sequence Number=SeqID_159595
atgtttgcacattcgattaaaggctgccgtcccttgggacgggcgtgtggggtgctaataccttccccgtgcgtaaatacaactcccgaaccttttcacttaaaagttcgtagatcgcgtcttttccggtttttccgacgttttcctcaaataaacgttggtgacgactccgcgcgtattcctttcgtgggacacgcatcccgcgagtcacgcgtcgccctcccgccgaaggatttatctagcgaaggcgacgcgatgcgtcgcaaggaaggagaaatgagagaggagatggagtga

SEQ ID NO: 67911 - DNA, 441 bp, Glycine max
  Peptide Sequence Number=SeqID_159596
atggaaccaattgtttcctgggaaagtgtggatgcaaaagcacatgttgttcctgcgatgccagagcgccaacatggaatgtattacacacttgatcagttcacccaagagccatctcaaatgtcgcccctgtatccgtacccatatcaaagtgaaacttcatcagatgcatatttcatgggaacgcaacctccgctacaaccaagatatgttatggttgacttatttgggtctccttctcctgcgggaaccccttcatttgcacatggttgtcagatatcaatgcctaacgccccaatgggccctccagggattgtgtcaggaaacattcctaacattactgatttattaggggtagatttaggtaatcaattttctattgaggctgatgaatggaggggcgataggagaaggaatccagatcgacaagctcggagatag

SEQ ID NO: 67912 - DNA, 375 bp, Glycine max
  Peptide Sequence Number=SeqID_159597
atgggggaaaggggtgggttagggttttggacaagtttaaagcatggtgttggaaggatgaattgttgggatggaaggggaaagggagcaagaaaaaaaagaggggagagggggggaatggtttggaggaaagagagtgatgatgatgatgcaggcaagaatatattcgttgaggtcactgattcacacaagagtcagtgtctcctgcagatgagtcttaaaggggatggtatgtacgtggctattgtccagataacactttgctgcatgctcctttccaacaacaaaaccttacctcatgttttcaaatgctcacgcaacaccattttcagtttattttttagtcagattccagggtctccaaccacggaatga

SEQ ID NO: 67913 - DNA, 125 bp, Glycine max
  Peptide Sequence Number=SeqID_159598
atgaagacagttcaatctcttctccgtctctctgatgtttgggaattctatcggagcagtcgaaggaataactggaggaatctcatggaaccgctagagatgccgctatcgctgtcggaagacac

SEQ ID NO: 67914 - DNA, 751 bp, Glycine max
  Peptide Sequence Number=SeqID_159599
atgcatttgcaaaccaatcctgcttcccataccaaccatcatgacctcaaacaattttctgattggctactagacataggcgatggcaaacttggagaacctaatgatgaatatgacaaaatcaccatcccagatgagtttcttatcaaggactttaatgatcctatccagtcaattgttgaggcaacatatccagacttattacaaaactatagcaacggagatttcttgcaaaagaaaattgttctagcctctacaaaagatgttgttgatagtataaatgactatgtcctagctttgatacccaccgaagagaaagagtattgtagtgttgataaatctgatgaactactcaatcctgcatttggaattctaacacctgaatttctgaactcattgaaaacatcaggaatacctaatcacaagttaaaaatcaagtctttgggcaattgggtctcacgaaattggaaaagttgtggcaccaagaagcctaggagttattcaagtcccgaaccacaaaaccacaatttgaatttgaatttcattcaacatggtgtaagattgtgcaaagaagaggtgattgtggtaatgcaaaagctgggaatgagtgttgagcgagatggggatggaatagaggactttggagaacaagaaattactcaaatgtctgaaaatgaggttattagtgtggaagaggtgaaggaagctttcaatgtgtttgatgaaaacaaagatgggttcatagatgctg

SEQ ID NO: 67915 - DNA, 264 bp, Glycine max
  Peptide Sequence Number=SeqID_159600
atgagtgaaataaaggaggtgcaagaacagatgaaggctgacatggaggccatgaaagaccaaatggccgccatgatggagaccacgttaagcatgaagaaaataatggaaagtagtgcggctgcagttgccactacgagtgccaccactgaggtagacccgactcacccattgggactcaatcaagtaaatcctccaatctcggatatggtaggtcagggaggagaagcattgggaagtacagacggtccccatgttgtgtag

SEQ ID NO: 67916 - DNA, 423 bp, Glycine max
  Peptide Sequence Number=SeqID_159601
atggagagggagatgataacaatgatagtagacacgttattggtgttctactatgagaagatggtgggttacacgccttcaagctttgccaatttagtttttgccgatgaaaggattgaagtgggtctgagaagaggcaaatttgattatcctgctttgatgaataggaagcttggggcaaatggagagagtaagaagcaggaaggaacccatgttgtgactgtcattccttcatggccaaatttcccaccaactcaacaatatcaatactcagccaatatcagcctttctcattacccaccaccctatcagccaagaacactcaatcatccacaaaggtcacccctaaatcagccacaaaactcgcctgctgcacatccgataccagacgccacccttaacacgaaccaaaacaccaactag

SEQ ID NO: 67917 - DNA, 678 bp, Glycine max
  Peptide Sequence Number=SeqID_159602
atggggacgaaagaagagttgaagggagtagttatcagggtaaggaaagaatgcaatagactaagggatgtcaatatgtcaataactaaagcatcgaagcaagaaatgagaagggctaaaggggaagagacaaacagaacaaggtaccaaggagctttgtcatgcaatagtaatgaagtcaagctgagaagaaggacacagagggaccaagcaatagtggaaaatgtgacactgagagatgagttgaaggattgtaaagacgatgagggagaggcaagatttggctactatacatgggctggctttgagaaacaagctggcggaagtgctagccttacagggatgaataggtttgcgctcacgctaaatgagagtcaagagctctcgaaactgctagctagagccaaggcgatcgctgatatatactctgatcccaatgaagttcatagtcttttcgattattaccagcacatgaaagacagtgctttacaacacccttaccggatgcgtgccaagaccaagataatgagtgaaatagaacaagtgcaggaaaaaatgaaggccgatatggagaccatgaaggagaaaatgacagcaatgatggaggcgatgatagatatgatgcagataatggaggttaacattgttgcagcagctactgccagtaccaccacttag

SEQ ID NO: 67918 - DNA, 270 bp, Glycine max
  Peptide Sequence Number=SeqID_159603
atgccactcatgccagaaatatttgtgacttcaatagtcggcatgctagacccaacacgcatgacagatacgtcttaccctccgttgaacacctgtatgttgtacctctgtcgcaacatgcccttttgcgggcgagcgaaggtgaggctcacgggtgcgctttccaaaggaggaaagatgcgcggagtcgccaccaacgtttatttgtggaaaacgtcagaaaaaccgaaggaaaccggtcaaaatgaaaattctaagttcgggagttga

SEQ ID NO: 67919 - DNA, 528 bp, Glycine max
  Peptide Sequence Number=SeqID_159604
ttggaccttgaaaatgggtcgatcggtccgcctccggtgtgcaccggccggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggaatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgtt

SEQ ID NO: 67920 - DNA, 701 bp, Glycine max
  Peptide Sequence Number=SeqID_159605
gatcccgaggactacacgtcctcgcctttagaggactacacgtcctctccatcagagggctacgcgccctcaccttcagaggactacatgtccttgccatcggagggctacatgccctcacctttagaggactacgcgtcctcaccttcagagggctgcacgcgctcgccttcagagggctgcacgccctcgtcttcaaaggactacacgccctcgccttcaaagggcgacaggtcctctacttcagagggctgcacgcccttgcctttagagggctatgcgtcctcactttcaggatcacgaccacaaggtacccagtggacccggggaagtccaacagggccctggggtttccagccctagttagggcctctgtcagtcctacagggtgcccgtcccccccagcaaggtcatgccatcgtgacatagggatcgcgcccgcaagacacctagtggacccggagaagtccaacagggtcttggggtttccagctctgattacgggcctttgcaagttttacagagtgtccgtcgcccccagcaagatcatcaggccccctactaaccgagctttcatcaagaagtactacaccccccaggcaagcacagggcgagacaccacagcagcccggggatggcaggcagcgggcaacagatgcatcgccgccacctccagagcacctcagcgcatccacaaaaag

SEQ ID NO: 67921 - DNA, 501 bp, Glycine max
  Peptide Sequence Number=SeqID_159606
atgaagagggtgagaaaaaaaggagaaatccatgttgcaactgccattcctacatggccaaacttcccaccagcccaacaatgtcattacttagccaataacaaaccctctccttacccaccacccagttatccacaaaggccatccctaaatcaaccacaaagcccacctaccacacgaccaatgctaaacaccacttttagcacgaaccgaagcaccaaccaaaagggaattttgcagcaaaaagcctgtagaattcaccccaaattccggtgtcatatgctaaacttgctctcatatctactcgataattcaatggtagccataacccctgctaggtttcctcaacctccatttttccggaaaaatgactcgaacgcaacgtgtgcttgtcatggagaagccccggggcgttccactgagcattgtagggccctgaagcataaggtgcaaggtctaattgatgcgggctggctgaaatttgaggagaatcgcgtgtaa

SEQ ID NO: 67922 - DNA, 888 bp, Glycine max
  Peptide Sequence Number=SeqID_159607
taccttttgagcatcctgagcattctgttattggtgattttgagcattatagttttaagcattctgattttgaatattctgagaacatggcacaccctccaccccgtgagaggactctaagggaattagttgcacctgatttcacctacgaaagcttgtgcatccaatactctgatgaggatgtcccatatgttcttaaaactggactgatccatttgcttccaaagtttcatggccttgcgggtgaagacccacacaagcatctgaaagaattccatattgtctgctccaccatgaaaccaccagatgtccaggaggatcacatatttctgaaggcctttcctcattctttagagggagtgacaaaggaatgtctatattaccttgctccaagtggtggagcccatggagacatgacccctgctgaagccagaaatttaattgagaagatggcttcaaactcccaacaatttagtgccagaagtgatgctattatcattagaggagtgcacgaagtagccacgaattcatcaggtgagactaagaagcttgaaggtaaactagatgccttggttaacctggtaacccaactggccatgaatcaaaaatctgcacctgtcgccagactctgtggtttatgctcctctgccgaccactacacagacctttgcccttctgaagcaattgaacagcctgaagcttatgctgcaaacatctacaatagacctcctcaacctcagcagcaaaatcagccacaacagaataactatgacctctccagcaataggtacaatctcggatggaggaatcatcccaaccttagatggtcgaatccttcacaacagcagcaacaacaacaaccttattttcaaaatgctactggcccaa

SEQ ID NO: 67923 - DNA, 381 bp, Glycine max
  Peptide Sequence Number=SeqID_159608
atggaggaagaaaaaggagtgccgaactacgacgagttgacctgtaaaggcgagagagctgcgtggttcaagctgggtctccgcttttcctcttcggcagcaaaggatgatgttccaaaaccctcctcttccttcctctccaaattcgtcaaagcctcctccgagtcaaagaagcaagcacagctccaatccatccacgacaatctcaagaaaagccttctttcgagtctaggtgcatataagactttggaaaccaagagtgaggggaaatttggtcacagtacaccgcggtggattgaagtgaagagtcacgttcaaagcggaacctatgagtgtggctattatgtcatgcactggatgtggaacataatcgtcgggtag

SEQ ID NO: 67924 - DNA, 111 bp, Glycine max
  Peptide Sequence Number=SeqID_159609
ggagtgatggatggacagaatgatcatgtgatagtggatgctcttcaagccttagctcaggctatagggaatccaaataggggagaagttagtggagttgttgagtactag

SEQ ID NO: 67925 - DNA, 582 bp, Glycine max
  Peptide Sequence Number=SeqID_159610
gaagtgtcgcgcctgatactgttgcatcttctgcgccggttcaagcaccgagccaatatctctccaacgggtctgctcgataatcatggcaagtgctgccgcaagcttcgcgttgacagcgcgtccggccgatgtctgcggtgcaactgccttcagcctgacggaccggatttccccggaaacctcgccgcggatttccaggaaaagcgatgccgcgtcagccgggtccgccgtcgttgcctcgcccagatcggccatacattcgaagctgcggttattcaccgggctagggtgccagccttgcgggctggagaagccttcggccgtgaaccggtcgcaaaggtctttgccggagatgatgaaatcgcgggcgaaagacgctctggcgccattgcgctcgaatttcagcaggtaaggtggcagataaatggttctcgcggcaagcttctgccgtttgatgggttttgccctggcagatggtacggcggaaagaggagcgggcgccagattgagataggcatcagccggtttggagcgaattatcggaccattggcggtccggcgaatatcaattgcgagtaa

SEQ ID NO: 67926 - DNA, 417 bp, Glycine max
  Peptide Sequence Number=SeqID_159611
atggaagttgacgtaaaccgtggctccgacggctggttgcgtgcggaatccggggcgctctcgaccggtgaagcgatcggtaccgggatgtcgattctggtgatggttgtacagagctgggaagatgaagcgcgtcgtctgcgcgggaaagacatctccccatgccgactgctgttcctggatgaagcggcgcgtctcgatgcccgatccatcgccacgctgtttgagctttgcgaacgtctcgatatgcagctcatcattgcggcaccggaaaacatcagcccggaaaaagggaccacctataaactggtgcgtaaggtgttccagaacagtgagcacgtacacgttgtcgggttgcgcggttttgcgccgcagccgccggaatcgttgcctggcaccacggcggatgcttcctga

SEQ ID NO: 67927 - DNA, 138 bp, Glycine max
  Peptide Sequence Number=SeqID_159612
atggcaagggctgatcctggaagaatttatctagcgaaggctacccttggactcgaaaggaatcctaaggagttttgcatgggtgatcaatatcagaaaacaaatacgctttggctcgaagggggtagcaaaggataa

SEQ ID NO: 67928 - DNA, 354 bp, Glycine max
  Peptide Sequence Number=SeqID_159613
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgattttagagggagttag

SEQ ID NO: 67929 - DNA, 248 bp, Glycine max
  Peptide Sequence Number=SeqID_159614
gaagtacatatacttctgacttactttatgaggtacaggctgaggaaccttcttcttctcctaccctggttcctcccactgttcaaccaccacccacaccagagttgaagccattactagcaaccctcaaatatgcttacttggaggacaaggaaaaatttccagtgatcacctctgcctcccttgctactgagcaagaggagaagttgttgctagttctcaagaagcacaagaaagccattggatga

SEQ ID NO: 67930 - DNA, 908 bp, Glycine max
  Peptide Sequence Number=SeqID_159615
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcggttcacattgagcatgtccaacgagtatccattgttagtagaatacaaagtgaatgagattggattcattcgttactatcttgcacctaaaatgaacgaagccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 67931 - DNA, 1656 bp, Glycine max
  Peptide Sequence Number=SeqID_159616
atgaccatcctgtttattactgccggctggggcaaaatcaccgcctatgcaggcaccgcacagtacatgcaggcgatgggcgtgccgggcttcctgctgccgctggtgattctgctggaactgggcggcggcctggcgattctgttcggcttcctgacgcgcttcaccgcgctgttcaccgccggcttcacgctgctgaccgcgttcctgttccacagcaactttgcggaaggcgttaaccagctgatgttcatgaaaaacctgtccatcgccggtggtttcctggtgctgggtctggtaggtccgggcgcctacagcattgaccgtctgattcggcttatgggacaactgattgacggtgtctggcatgacacctggtacgatacgaagtcaaccggtggccgcttcaaacgcacagaagcagtctggcgtaactggatcacggcagacggcagcgccgggccaaccgggaaagccggctttgccgccgagcgcgatcgttaccatttatacgtttcgctggcctgcccgtgggcgcatcgcaccctgctgatgcgtcagctgaaggggttagaagagatgatttcggtgtcagtggtgcacccgctgatgctggagaacggctggacctttgacgatgatttccccgccgcgaccggcgattcgctgtatcagaacgaattcctctatcagctctatctgcatgccgatccgcagtacagcgggcgcgtgaccgtgccggtgttgtgggataaaaagcagcacacgattgtcagtaatgagtccgccgatatcatccgtatgtttaacagcgccttcgacgcgcagggcgctcgcgccggcgattactacccgcccgaactgcgtgacaagatcgacgaactcaacggctggatttatgacaccgtcaataacggcgtctacaaaagcggatttgccacgtcacagtcggcctatgatgaagccgtaaccgcgctgttccattcgctggcacggctggagcagattctgggtcagcatcgctatctgaccggcgatcgcctcaccgaagccgatctgcgcctgtggaccacgctggtgcgctttgacccggtctacgtgacccactttaagtgcgatcgtcatcgcatcagcgattaccgtaacctgaacggcttcctgcgcgatatttatcagatgccgggcattgccgatacggtgaacctgccgcacatccgccatcactactactgcagccacaagaccatcaatccgaacggcgttatttcgctgggaccggcttttgactgggatgagccgcacggccgcggcaaatttaatcaacaccatcccggccagcagcagtgccacgcccagccagccgcgggtgttcaggcgttgcccgaacagaatccagcctgccgctacggtagccaccagaccgaaaccgccccacaaggcgtaggccaccgagagatcgatccccttcactgcctgcgacagggcgctaaatgccgccaggacagccaccagcgataccacgccatacagcggacgacggaagccgttggcgtatttcagcgcgatgttcgccacaatttccagcacgatggccagcgccagccaggccagatgcacgacgttaagcgtggtcatgacgcagctccttacggctga

SEQ ID NO: 67932 - DNA, 423 bp, Glycine max
  Peptide Sequence Number=SeqID_159617
atgggagttttgtgcggttttatctggctacgtgcggttttctgccctcaccctaaccctctcccacggggagagggaatagttaagtgtgttgttggaggccgaatactcaactcatcccacgcacaatcggtcccttctcccgcttgcgggagaagtcattcatctaggccagcaatcgctcactggctcaagcagcctacccgggttcagtacgggccgtaccatgtgaacccctatttggccttgctccgggtggagtttaccgtgccacggactgttgccagccgcgcggcttgcgccccccaggcgttacctggcaccctgccctatggagcccggactttcctcccctctgcccgtctcccccgaaagggacgacgacaaagcggcgactgtctggtcagcttcggcgcgggataa

SEQ ID NO: 67933 - DNA, 507 bp, Glycine max
  Peptide Sequence Number=SeqID_159618
atgatgacaacccgctgcgcgtccgcatgtggccaggccgatttcgctgatgggctacgcctcgctgcgcgtgctaaatcaggaagtgctggcgcccggtgcggcatttcagccgcgcacctatccgcaggtggatgtgctcaacctggtgttgcaggcgatgctgctgtcggcccgccagggcgtcaattacagcgaacacaatatcagcaaggatcgcccactgacgcgcatgcagctgtggctggccgcctgtccggaacgggaaaatccgctgctgcaaaaacgcgcgctgccgcagcaaacccatgtgctgattgcgtcaccggatggcgcggacggcagtttgcagctgcgccagcaggtgtgggtacatcaggtcacactggcaccaggcgagcagagcagctgcgctgcggcgatggggcgtttgtcagtgaagaggcgcagattacgctgcaggcggaaacgcctctgcgtgcgctggtgattgatattccggtgtaa

SEQ ID NO: 67934 - DNA, 138 bp, Glycine max
  Peptide Sequence Number=SeqID_159619
atgatcaagtcaaggttggtgttgaggaagttagagatgcagatgctcctattcatgtacccactcaagagggacccgtgcgaccagcaaaacctgcagataggccggattatgatgttgatgatcccatatatctga

SEQ ID NO: 67935 - DNA, 240 bp, Glycine max
  Peptide Sequence Number=SeqID_159620
atgtataaaaacttctttgcatctactcaaaagaatagttctcctttcttgacttgtttttactgtgctccatgtggagtttgtaggccttggatcttcttcatcaatggagtcctttgcttcttgaagatcatggcagcggaatggagaaggaagaaagatgattggagatgccacttcaaggagaagatgagtcaagaagaagctcaccaccataggaagccatggttaagagcttga

SEQ ID NO: 67936 - DNA, 324 bp, Glycine max
  Peptide Sequence Number=SeqID_159621
atggttcgatattctggtgtcctaggcgtagaggaaccacaccaatccatcccgaacttggtggttaaactctactgcggtgacgatactgtaggggaggctggggagaggaaatgttcccattttttaggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatga

SEQ ID NO: 67937 - DNA, 1107 bp, Glycine max
  Peptide Sequence Number=SeqID_159622
atggtagatgctgccgcacaggacaccggtgcagagactgacgcacaggataccgatgcagagactgacggggatgagcctatgggatttcctggtggacccagggacccatcagtgcttacagagtatgctgaccatgttgcgggcagcgtatggtctggacaggaacgtcctgagttgaagttatgctcccatgggaggaaggtgcataacttgggtaggcctattcctgcaattgaggacatggttgctaggacaggattaagtcctttgattgcatgttcgatagacatcggtgatcggggatttatatcctcttttgtggagaggtggcaccgggaaacttctagtttccatcttcctgagggggaggtgtcgatcacgctggacgatgtcgtgtctcttctccattggcctatcattggcacattccatgacttccagcctctgcgcaccgacgaggcggtgaggtgtccatggccgagacaagccaatgtggtggaccatacgtacgcctgcagtggctgcgagacatataccagcacagatgtcagacgcagcactagacagctgttgctcgcgattatcttctacatcttttgggttgcactctttttgctaataagagtgcaacccatgttcatgtctcacacttacaggcgttccgtgacctcactcttgctgggtggtatgcatggggagctgcaggcctcgtccttatgtacgatcagcttaatgatgccagtctcaacaccaatcgatagcttgctgatatacgaacactttctgtcagttgcggagtccaatgttgatttagactacgacgaggtgtcaccatgtgcgtgtcggtggattgtaacaaagaagactgtgaagaagttaggctacgtccagtgcattcctgcacaccctgtccattcgtgggtgtcatatgatgacgtggacgatacttggacgcactactcagaccatctggaggcagcaggtgatctatgtgttgtgccaagtgagtgtgcacctgactacatgaactggttcttcatcatatcacatccattcatgactacgccacagacagatcctcctcgagatacatatgtgacgtag

SEQ ID NO: 67938 - DNA, 548 bp, Glycine max
  Peptide Sequence Number=SeqID_159623
atagatgtttatgctggcacattgtctatggaatttggtgatattgttgttcattttaacattcttgatgccatgaaacatctatttgaggatcattctgtttttcgtactgagataattgatcagattgttgatgattatatgtttgattttgattatgttctttatggtaggaaacatccatttctatctgatctgcatacttgtcattccttatgcattgaatctgactctgagtttgaatttgatcttgtatctgatttttatgctgagagtgaatttgaatttgagtctggtattgtacctcttgatgttgattttttagagtcagaatgcactaaccatgttgcaggaagtacatatacttctgacttgctttatgaggtacaggttgaggaaccttcttcttcttctcctaccctggttcctcccacttttcagccaccacccacaccagaattgaagcccttaccaacaaccctcaaatatgcttacttggaggacaaggaaaaatttccagtgatcatctttgcctcccttgctgctga

SEQ ID NO: 67939 - DNA, 165 bp, Glycine max
  Peptide Sequence Number=SeqID_159624
atgtttgcattcaacagtgctttgaaaggacttgacgatactccacaaagtaaatccaaggctgctgctaggtggattgttgttaaaacaaaaaggaagcatcgagtatggatattacgtcatgcactcgatgtcaactataatcttaggaaatttcaagaataa

SEQ ID NO: 67940 - DNA, 363 bp, Glycine max
  Peptide Sequence Number=SeqID_159625
atgggcatcaacacgctgaccttcgacaaaagcaacgacggcgaaaccccggaaggcattggttttgccattccgaccgcgctggcgaccaaaatcatggataagctgatccgcgatggccgggtgatccgcggttatatcggtattaccgggcgcgagctgccgccgctgcacggtcagggcagcaacctcgatcgggtacagggcattattgtcagcgaagtgacgccgggcggtccggcggatcgcgccggcattcaggccaacgatgtcctgctgcaggtgctgcgcaatgagcagaagatgacgctgccggttaccatccaggagtttccggaagcggccaataatacctcgccgtaa

SEQ ID NO: 67941 - DNA, 537 bp, Glycine max
  Peptide Sequence Number=SeqID_159626
atggctcctcttcatggcaacaacaatcaaacgcaatacgaaaatggctcgtggtttatggccgaggaagaagaagaagaatcaaatcaggaagaagaagaaggtagcgcgagagagacaggtccaagaggtcaccaacacaatacgaaaatggctctgaggaagaagaagaatgaggtgctgtgtgaggaagaagaagaatcaaaggggctgagtattacgggcttttcacctcaagtgctgggtgcaccaacaaaaatgctgggtgcacctagcagcactctagtatgtgacagcgaggcgaggctctccggtgcgttttccaaaggaggaaaatgcgtggagtcgccaccaacgtttatttgtggaaaatgtcagaaaaaccgaaggaaatcggtcataaagaatattccagattcgggagttgtatttacgttcgaggaaggtattagcacctctcacgtcgacaaaagcagggctcttgctcctacgtaccctccatcgaagaggaaatcaaacctacgtagttctttttaa

SEQ ID NO: 67942 - DNA, 381 bp, Glycine max
  Peptide Sequence Number=SeqID_159627
gataaatatctcggaaaggaagaacaaaggccagggctcgcggtcgggacaacgagccaaagaggctccgtcgtgccacatcagcaggaacttcataagtgtgggtttaagacgcgaaggtcaagtcgccacgatatgcgatggcgactccccgaggagatcggatttggtacggccatgccctcccagtttccaactaggaaattggcgggatacagatccgatgacgagtcccgtgaaggtactagtaccggtgacctggccgtcgatttcgatcaaaaagcaagtcagacagagaatgaagaggacgagaatgtggggcttcccctagagctggagaggataattgctcaggaggatcgagagataaggctgcattaa

SEQ ID NO: 67943 - DNA, 495 bp, Glycine max
  Peptide Sequence Number=SeqID_159628
atggcagctcacccaggtgagctgagacttactcctgaagtaactggctcgcccaggagagttagttccttcagcctaaagtcttttggtggcccaggcaagccagaggctagcctgggcgagctagggtctaggaaactcaaggaaaagcctgggcaagctagcctgaagtcttttgaacaatctttcgttttgtgcgatcttggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 67944 - DNA, 1518 bp, Glycine max
  Peptide Sequence Number=SeqID_159629
atgaaagatcaggtcgatcagctgctggcgaacggcgtggcggcggcgtgccttaactcgacgcagacgcgtgagcagcagcagcaggtgtttgcggactgccgcagcggcaaactgcggctgctgtacatcgcgccggaacgtctgatgatggataacttcctcgacaccctgcagcactggaatccggtgatgctggccgttgatgaagcacactgtatttcgcagtggggccacgatttccgtccggaatatggcgcgctcggtcagctgcgccagcgcattccgcagctgccggtgatggcgctgaccgccaccgccgatgaagccacgcgtaacgacatcgtgcatctgctgcagatgcacgatccgctgattcagatcagcagttttgaccgtcccaacattcgctacacgctggtggagaagttcaagcctaccgagcagctgctgcgctatgtgcaggatcagcgcggcaaaagcggcatcatctactgtaacagccgcgccaaagtggaagacaccgctgcgcgtctgcagagtcgcggcatcagcgttggcgcttatcatgccggcatcgacagcgagcagcgcgcacgcgtgcaggaagcctttcagcgtgacgatttgcaaatcgtggtcgcgaccgtggcgttcggcatgggcatcaacaaacccaacgtgcgttttgtggtgcacttcgacattccgcgcaatatcgaatcctactatcaggagaccggccgcgccgggcgtgatggcctgccggcggaagcgatgatgttgtacgacccggccgacatggcgtggctgcgtaagtgtctggaagagaaagcgcccgggccgctgcaggatattgaacgccacaaactcaacgccatgggcgcgtttgccgaggcgcaaacctgccgtcgtctggtgctgcttaactactttggtgaaggtcgccagcagccgtgcggcaactgcgatatctgcctcgatccgccgcggcgctatgacggcctggtcgaagcgcaaaaagcgctgtcgggcatttatcgtaccgggcagcgttttgggatgagctatattgttgaagttttgcgcggctcaaccaaccagcgcatccgcgataacggccacgacaaactgccggtgtacggcctcgggcgcgagcagagtcaggagcactgggtcagcgtgctgcgccagctgatccatctgggcatggtgacgcaaaatatcgccatgcactcggcgctgcagctcactgaggccgcgcgcccggtgctgcgcgctgaagtgccgctgatgctggcggtaccgcgcactgtgacggtgaaaagccgcagcagcgcgccaaaagtctacggcggcaattacgatcgcaagctgttcgccaagctgcgtaagctgcgtaaagccatcgccgacgaagagaatattccgccttacgtggtgtttaacgacgccacgctgattgaaatggcagaacaaatgccggtcagcgcttcagagatgctgagcgtgaacggg

SEQ ID NO: 67945 - DNA, 993 bp, Glycine max
  Peptide Sequence Number=SeqID_159630
atggatgctttgaacttcctcaaattctggagaaacgccaccatgagcacaacctccgaaccccaccttgttgttgaaaccgacaccgaatccgacgaagacgactcattcttcgacttggagctcacgccactcgatttcgacaacaaagaaaacaacaccaacaccaccacaaccaaaaacgacgacgacccaaaacaaacgacaacaagcgaactcaaaagtcttggctccaaagacaacttactcagcaaaacagacaatggcgttcagcgtaaaacaccacttcccctgtctcctccttccgaacctatctccaaacgtaaggtcctcccaatcgaacctatctccaaacctcagtcccccattgcgcttctcaggtccgccccgagcttcagaatcttcatgttccgaaagcgaaacagaacacctccacaacagaaaacagagcactctgttaacgaagcaaaagtctttgcggtgaagctcagcgtcgacgattttcgttcctctcccgcgctcagcagggacaacagcacgagaagctttgggagcaaggttcggggtttgagctacgaggaagaaccgaagccggagcggttttcgaaggaggtgttgcggaagtacctgaagctgataaagccgctatatgttaaagtttctaagaggtatagtgataaggtgaggttctccggtgagggttatgcggcgtcgccgtcgtcgtcgccgtcggtcgcctctgtttcttcgaggacggagaaacaggggaaggggatgagggtggtttcgaagcatttaggaaagagtaggtcggcgtcgtcgacggtggcgggtgttagttctccggcgaagaagagcgatgacacgatgcagcagcagcttgatgggatccaaagcgccatccttcactgcaaaaggtccttcaactccagagaaggatcaatgtattcggtgaggaaatcatttgatggtgaacatggggaaaaagtgtaa

SEQ ID NO: 67946 - DNA, 1752 bp, Glycine max
  Peptide Sequence Number=SeqID_159631
atggggcaagagtgtagaccagcctcttcggccctccttcaatatatatgtatgtctaggcctagcatggaaaacaaccttaaccgtgaaacagaagggcatggcttgcctaaaattccatcactagttcaacatatatcatcaaatgatgaaggaaactttgacaatggtgacttgaaaaatctaagctcatctttcaaagagaatgaaacaatcttagcaggaagccaaggtgatgaacatgcagccattaatcatcggaataagcattcggtatctatcaacataccattctcttgtgaagaggttcagctgcataacaccgtaagagttctctatagtggcgaaaatgatttctcttctcaatcaactactacagactccaagccaccattaccatcacaatcaatgccaaatggcagtctgcactcagagccagcaagcggtgtcaattttaacaatcaagaaagcgtcataagcttgaataataagaggattgattttttcaaaacatggtccagtaaactagggggacacatatcagttatgagtggaaaggtacatacagaaagtgcagaagatgataacagcttatgcaacactaataagcctttacctgttgatttgttcttcaaaacattggagggtccacagttacaaactcctaagaagtcttcagaagagatggtgcttcctcaggacaagcagtggccatttcttcttcggtttccggtttcatcttttggtatttgtcttggagttagcagtcaagcaattctttggaaagcattggccacgtctccttccactgcatttcttcacataacccctaaaataaatttcatcctatggttcatctccattgctattgttgctactattttcaccacctatctcttcaaaataattctccattttgaagcagttcgtcgtgagtaccaacatccggttcgtgttaacttcttctttgcaccatggatagcccttttgttcctagctcttggagttcccccatcagttaccaaggacttgcatcaagcagtttggtacattctaatgattccattgttctgccttaagctaaagatatatggacagtggatgtttgggggcaaaagactgctgtcaaaggtggccaatccaacaaatctcttagcaattgttggaaattttgtaggagccttattgggtgcatcaatgggcctaaaagaagggcctcttttcttctttgctcttgggcttgctcactacatggtgttgtttgtaactctctcccagatgcttccaacaaataagaccatcccaaaagacctccatccagtgttctttctttttgtggcaccgcctagtgttgctgctatggcatgggctaagattcagggttcatttcattatgaatcaaggattttctatttcactgccatgttcctatatatttcactggctgtccgggtcaatcttttcagaggattcaaattctcactttcatggtgggcctacacttttccaatgactgctgcagcaattgctaccataacctatacaaatcaagtcacaaatgtactaactcaagctttgagtgtaatattgagtctcattgctacattcacagtaacagcagtgcttgtctcgactatagtgcatgcctttgtcctacgagacctctttcccaatgaccttgccattgccacaagtgagagaaagcaaaaaccacgcaggaaatggctcccatttaagacttgggagccatga

SEQ ID NO: 67947 - DNA, 267 bp, Glycine max
  Peptide Sequence Number=SeqID_159632
atggaatggagagtgaacatagaggcaactcctggttcagattatcctatggaattaaatcggaatggtatgtcatatttgtcaagaagatcggaggataagatgtctacccacttggttgttaggatgtcccacatcacctgcctcaattctcgaagtgtagcttatatatctgttggacaaattcacttagcgccaattggttttaagctgaaacctaacatagtatcaaagcctatagcccatcttggttcttgctttttctag

SEQ ID NO: 67948 - DNA, 1005 bp, Glycine max
  Peptide Sequence Number=SeqID_159633
atgaatgctactaacctactcaaacgagatatcgtacatttaaatcttaagttgtcacaacttcaagctttgcttgatgagaaagaggcacagttacgccaatttagaagtatggaaggggggagtactggttcatcgagcaatttgcgtgaagaaactgctcgtgtgtcgaaagattcttcagagctttttccaactggcattccacaagtaggtcaaacagagattagccaagattcagttgcgggtggactggggaatattcgttcggagttgattggctccacatctggcaatgattctactacttttctatcgaatgaccgtatgagaaatggcagagctgacaatgccactctaaaagacaacaatggggaagtttttggggaagaagattttgctgaggtgaaagtagagtaccaggagacatttttggggcacaccggtccaatcagtcggtgttgcttctctgcatctggaaacaatattgccagtgcttctctggatggaactgtcaggatatggacatatgatacatcaactccagtgtctagaaatgcaaccatatattgtggcactgaaattttgtcacttgactgggaatgtaaatcagaccgcttgcttcttataggtacatccgatgggtgcattaaggcatggaatgtggatgcaaagagagttgtctgtgacctcaacacaaccgaagcatttccaagtgtattggacataaagtgcagtcctgtggaacctatttttgtgtctgcagcagcatctggaggggctggttctaactatattgacaacctgggttttgcttcacttactgtgtggaacatgaagacatggaaagccatgacagtccttcctcttggagaagatccaccagcaattacttctctatgctttaatcacaatggaaagattttggcagcttctgccgttgatggaatgattcacatgtttggtatccttaattttattcatttgattgtttccttggtttga

SEQ ID NO: 67949 - DNA, 585 bp, Glycine max
  Peptide Sequence Number=SeqID_159634
atgatagccaatgcactggatgaggatggtaaattcactgctgctcaagtctctcgaaaacttaagcagcttggtttatctcttcctcagaagagttctggaggcaaaatgcacccaaaggatgcagatctcatggatctttcaaatgataggatggatgaatctgatgatgagacattggtaacattgataaaaaggaagaaaatggagaatgacaaattatcaaggggacagttacatggacaaatcagtgaggatagattgtcaacagatgattctgatgatgaaatgctcagctctgttctcaaaagaactagaagatcctctcttaaatcaaagcaagttgagcttgaaaatatccaaattcaggagagcataatgggcgatgattctttcaatgaaggcaaaacagatgttttggaaagggataatcgtgttgattctatgaattcctcccaaatagaacatcagcaaatggatgacttagcagattcagaagatgaagtggctgttagtgcatttcctgacaatgccagatctagaaggcagctgagaatggtgattgatcctgaggatgatgactga

SEQ ID NO: 67950 - DNA, 324 bp, Glycine max
  Peptide Sequence Number=SeqID_159635
atggacgacttagttgaatacaagagtataaatacttgtagtggattctatctataccttcccatcatcaacacatcttcttgcgttatcatgggtgcctctccgcgaggcaagcttcgcagacggagtgtccacatgataagacacgaggaattgcgtcgcgctcgtcgaaggattgaagaaataccgggcactccggcgactccatcgccggcggtgataaccagagcaaaggaagagagagtaaggggattgaaggatactgaagccagggaagaagagggtccttgtcacatggatgcttgcatacataaagacttgtga

SEQ ID NO: 67951 - DNA, 915 bp, Glycine max
  Peptide Sequence Number=SeqID_159636
atggccaaaagcaaaaactgtcatgctttgcctcttctccttgccctgatcctcttcttcactcttcttggaacctctcacgcaggtggcatagccatctactgggggcaaaatggtaacgagggcaccctctcagaagcatgtgcaacaggcaaatacacccacataaacatagcctttctcaacaaattcggcaatggccaaaccccagaaatgaacctggctggtcactgcaaccccgcaaccaattcctgcacaaagttcagctccgaaatcaaggactgccaaagcaaagggatcaaggtgttactttcaataggtggtggcattggaagctacactttggcttcagtagaagatgcaagaaacgtttcaacttttctgtggaacactttcttgggaggcaagtcatcatcatcttcaaggccactaggtgatgctgtgttggatggcatagactttgacattgaacttggttcaacacaaaactatgagcaccttgcacgttttcttaaggcgtatagtggggttggcgggaagagggtgtacctaggtgctgctcctcagtgtccaattcctgatagatttttgggcactgcccttaacactggcctttttgactttgtttgggttcagttctacaataaccctccgtgtcagtatgctaatgggaacataactaaccttgtgagttcttggaaccggtggactagtacggtgcctgccgggaagatatttttagggttgccggccgatccggccgctgctggcagcggtttcattccggctgacacgttgacttctgagatcctgcctgtgattaaggagtcgccaaaatatggtggggtgatgctgtggtcaagattctttgatgtccagaacgggtatagtacttcaattattggcagcgtgtga

SEQ ID NO: 67952 - DNA, 4482 bp, Glycine max
  Peptide Sequence Number=SeqID_159637
atggcgggtttttggagcgtgttttgtggggaatctggttgttcagaggctggaagaatgccttgcagctatgattttaggcttctcattgatccttccacttgtgtcaaccatttgttgaattcttgctttgatgtgttgctgcttatcatgcttgcatgcattatgatccagaaatcatcattaaaaccatctcgtggtctaacacaggtgcaaagatattcatattttcagctagtttctgccatagccaacggtgctcttgggttgacacttttgtgctttggcatttgggttttagaagaaaagttgaggaaaaaccaaactgcgttgcctcttaattggtggttgctagaaatctttcatggattaacatggttgttagtgagtttaacaataactcttaagttgaaacaacttccaaaagcatggtcaaggcctttttctgttctaatcttcttggtttctgattttttctgtgcttcatcagtgttttatgcaattagtagcagagaactatcccttaagatctcttcagatattctatcttttcttggggcgatattattgttattatgcacgtataaggaatccaagcatagggacactgacagtgaaattgatgaaaatctttatgcccccttaaatggtgagtccaacaaaaatgattctattagatatgtaaccccatttgccaaaactggattctttggcagaatgacattttggtggttgaatccattgatgaaaatgggcaaagagaaaacacttcatgatgaagacattccgcggttgcgggaggaggatcgagcagaaagttgttatttgctgtttctggatcaattgaaccgacagaaactgaacgatcaatcctggcagccatcagttttgaggacaataattttatgccattggaaagaaattttaatatcaggattctttgcattgctaaaggtagttgctctgtcttcaggacctcttcttctgaattcttttatattggttgctgagggtaacgagagtttcaaatatgaaggttttgtgttggccatatcacttttctttacaaaaaacatagaatccttatcacaaaggcaatggtacttccgctgccgactcattggtctgaaagttaggtcgttgctaactgcagccatttatagaaaacaattgaggttatccaattctgctagattgatgcactctagtggtgagataatgaattatgtgactgtggatgcttatagaattggtgaatttccctattggtttcaccagacttggacaacaagctttcagctatgtatctcattagtaatactttttcgtgctgttggatgggcaacaattgcctccttggtggtgatagtaatcactgtgctttgcaatactccactcgcaaagttacagcacaagtttcaaagcaaacttatggtgacacaagatgatagattgaaggcttgttctgaggctcttgtgaatatgaaggtgttgaagttgtatgcgtgggaaaccaattttagaagttctatagagagattaaggaatgaggagctcaaatggttgtctgcagtgcaattaagaaaggcatacaacacctttctcttttggtcctctcctgtgttggtctctgctgcttcctttggggcatgttactttcttaatgttccattgcatgcaaataatgttttcacttttgttgcaactttgcgccttgttcaagatccaatcagaaccatccctgatgttattggggtggtcattcaggcaaaagtcgcgtttgctcggattgtcaaattcctggaggcacctgaacttcagagtgtaaatatcacacaaaggtgtctcaatgagaataagaggggttcaattttaatcaagtctgctgacttttcatgggaagataatgtatcaaagccaacactgagaaacataaatttggaggttagaccagggcaaaaggtggctatctgtggagaggttggctcaggcaaatcaactctcttagcagcaattctcagagaagttcttaatactcaggggacaactgaggtttatgggaagtttgcctatgtttctcaaacagcatggatacagacaggtacaataaaggagaatatattgtttggagcagctatggatgctgaaaaatatcaagaaacacttcacaggtcttcactattgaaggaccttgagttgtttccgcatggtgatctcactgaaataggggagagaggagtcaatctgagtggaggtcagaagcagcgaattcaacttgcacgtgcactatatcagaatgctgatatatatctcttggatgatccattcagtgctgttgatgcacatactgcaacaaatttgtttaatgtaaggaaaagttcttttcttcaggaatacataatggaaggacttgcagggaaaacagtcttgctcgttactcatcaagttgacttccttccagcatttgattctgttttgttgatgtcagatggggaaatcatagaagctgctccgtattaccatttgttgagctcaagccaagaatttcaggaccttgtgaatgcccacaaagagactgctggttctgaccgacttgtggaagttacttctccgcagaaacaatcaaatagtgctagagaaattagaaaaacatctacggagcagcattatgaagcatcaaaaggtgatcaattgattaagcaagaagagagagagaaaggagaccaagggttcaaaccgtatatacagtatctgaatcagaacaaaggatatatatacttctctgtggctgctctttctcacctaacatttgtggttggccaaatattgcaaaactcatggatggccgctagtgttgacaatcctcaagtcagcactttgcaattgattcttgtttacttgctgattggagttatttcaacactattcttgttgatgagaagtctttttgtagttgctttgggccttcaatcatcaaagtctttgttttcacagttactgaactccctttttcgtgcccccatgtcattttatgactccactcctttaggaaggatacttagtagggtctcctcagatctcagcattgtggaccttgatgtcccatttggctttgtttttgctgtgggagccactatgaattgctatgctaatctaaccgttttagctgttgttacttggcaagtcttgtttgtctccataccaatgatttattttgcaatcagcctgcagagatattactttgcctctgcaaaagaactgatgcggctgaatggcaccacaaaatcctttgttgctaaccatcttgctgaatctgttgctggagctgtgacaataagggcttttgaggaggaagatcgtttttttgagaaaaatcttgatctgattgatgtcaatgcgagtccttacttccaaagttttgcagcaaatgagtggttgattcaacgattagaaacagtcagtgctgttgttcttgcatctgcggcactatgcatggttgtacttccacctggaactttctcctctggatttattggcatggctctctcttatggcctttcacttaacatgtccttagtattttcaattcaaaatcaatgcaacatagccaattatataatatcagtggagaggctaaatcagtacatgcatataccaagtgaggctccagaagtaatagcaggaaatcgtcctcctgcgaattggccagttgctggtagagtacaaataaacgaattgcagatacgttataggcctgatgcgccactagtacttcgtggaatcacatgcacatttgaaggaggccacaagattggtattgttggcagaacaggcagtggaaagtctactcttataggcgccttattccgtctagtagagccagcaggtggaaaaatcattgttgatggcattgacatttgctccattggtctccatgatttgaggtcccgttttggtattatacctcaggatcctactctttttaatgggacagtcagatacaatttggacccattatcacaacactctgatcaagagatatgggagttttcatttcatatgaaggctcttgggaagtgtcagttgcaagagactgtccaggagaaagaggagggattagactcttcagttgttgaagctggagcaaactggagcatgggacaacgacagttattctgtttggggcgtgctcttctaaggcgaagtaggatattggtgcttgatgaagcaactgcatcaattgataatgcaactgatttgattttgcagaaaaccattaggaccgagttttcagattgtacagtgatcacagtagctcacaggataccaactgtgatggattgcactaaggttcttgccatcagtgatgggaaacttgtggagtatgatgagccgatgaacttgataaagagagaaggatcactgtttgggaagcttgttaaggaatactggtctcattttcagtctgcagaatctcattga

SEQ ID NO: 67953 - DNA, 1323 bp, Glycine max
  Peptide Sequence Number=SeqID_159638
atgtatgaggttttcttctacactcaccatctctacactctctacatcttattttatgccatgcacgtcggcgttgaatggatgtgcatgatttctccggggattttcctttttctcattgatagacaccttagattcttacaatctcgccaatgtgctccgttgctatcagctcgccttttaccttgtggtgcacttgaactcaacttctccaagaatccaagtttatactataaccccacgagcatggtgtttataaatgtgcccaagatttccaagctgcagtggcacccttttacagtcatttcaagttgtaacatggaaacagatattctgagtgttgccgttaaaactgggggtagctggtcaaacaaactttatcaggaactttcctcatctgctttggatcatctcaacgtttctgttgaaggaccctatggaccaactacgacttcacaatttttaaggtacaagcagcttgtgttggtgagtggtggaagtggcatcactcccttcatatccataatccgggatctcatatttcaaaaccgacaagaacaagaatcccacgttccaaaagtcctacttgtttgtgctttcaagaattctgctgatctaaccatgttagatcttttgcttcctctttttgtttcaacaactcaattctcaaaccttcatcaattgcaaatcgaggcctatattaccagagaaaaagaagaagccccaagagattctcaaaaacaaatccaaaccaaatggtttaagcctatcctctcagactctcctatctcacttgtattaggcccaaacaactggctatggcttggtgctataatctcgtcatcctttctcatgttcctcctccttttggggattatcactcgttactacatatatccaattgaaaataactcagatgaagtttatcattggacctttaaggttttgtggttcatgtttctactttgtgcagtcatatgcatatgttctagtgcagtttttctttggtggaagagacaaaactccttggaaagtaagcaaatcatgaatgtagaatttccaacaccaacaaggtcaccagggtcatggatttatggctcagagagagaactagaaagtcttccccaccagtctctagtgcaagcaaccaatgtgcattttggtgcaagacctgatctcaagaaaattctttttgagtgcaaagacaaagacattggagtcttggtttctgggccaaggagcatgagacatgaagttggcaaaatctgtgcttccggtctagctgataatcttcactttgaatcattcagctttacatggtga

SEQ ID NO: 67954 - DNA, 357 bp, Glycine max
  Peptide Sequence Number=SeqID_159639
atgccatgcaaaggaaagataaaatttctgagttcagaactatgctttttgcacatggagactataagggggatttgtctagatgctgaacttttccatttcacccttatccctgtccctggacctttgagtgcaatcatgtgcatgttgttatgtactgcagtgaataatgatcctattatttgtcctgttggcaaggacactgatgatagtaaggaatcccatttaattggagaagataagaagcagaacagtgttagtacaactgaacaagaccccacgagactaacaatgtacttattaaggaaatgtgaagaaaagtcagccaccaaccgcacaagtgatgccaagcaatga

SEQ ID NO: 67955 - DNA, 1383 bp, Glycine max
  Peptide Sequence Number=SeqID_159640
atgaagctgtgttcacaggtcattggtgcgatctccttagttcttatattgggatcactaaatgtgaaagtagtagaatgcaaggtaggcagaggattgaaaaacactgaatattatgccataaattgccgaaagcatagtgcagttttgacagattttggtggagttggtgatggcaaaacatccaacacaaaggcctttcaatcagcaataagaaaactcggccaatatgcatctgatgggggtgcacaacttattgtgccacctggaaaatggctaacaggaccttttaatcttacaagccatttcactctttttctccacaaggatgctgttattcttgcatctcagtgtaatccactaaagggtcacttacattaccacattgacaggttgaatcagaatggccccaacttcctgtactgccttcatatggaagaggaagagatgctcccggaggaaggtcacaatggtactattgatgggcaaggatcttattggtgggacaagttccacaagaaccaattgaatctcaccaggccatacatgattgagatcatgtactctgatcaaatccaaatatcaaatctcactttggtcaactccccatcctgtaacataacaataaaagggcttaccattctcgcaccagtggactctccaaacacagatggaattgacccagattcatgtacaaacactaggattgaagactgctacattgtttctggtgatgattgtgtggcagtaaaaagtggttgggatgagtatggaattaaatttggaaagccaactcaacacctagtcattagaaggctcacatgtatttcccctgatagtgccatgattgctttagggagtgaaatgtctggtggaatccaagatgttagagttgaagatatcactgccatcaacactcaatcagcagttagaatcaaaacagcagttggtagaggtggatatgttaaagacatatttgtcaaaggaatgaccctcagcaccatgaaatatgtattttggatgactggctcttatggatcacaccctgaccctgcctttgatcccaaagcacttcctaatattactggaataaattacagagatgttgttgcaacgaatgtcacatattctgcaaaacttgaaggaatttctaatgaccctttcacaggaatctgcatttctaatgtgagtatccaagtgagtgaacaaaagaagaagcttcagtggaattgcactgatgttgctggagttacgagcaatgtcactcctaacacttgtcaattgttgccagagaaagggaaattcgattgtccttttcccaatgacaaactgtccattgaaaatgttcagttgaagacctgttccattaaaaaggtcttctaa

SEQ ID NO: 67956 - DNA, 635 bp, Glycine max
  Peptide Sequence Number=SeqID_159641
taaaaagtggttgggatgagtatggaattaaatttggaaagccaactcaacacctagtcattagaaggctcacatgtatttcccctgatagtgccatgattgctttagggagtgaaatgtctggtggaatccaagatgttagagttgaagatatcactgccatcaacactcaatcagcagttagaatcaaaacagcagttggtagaggtggatatgttaaagacatatttgtcaaaggaatgaccctcagcaccatgaaatatgtattttggatgactggctcttatggatcacaccctgaccctgcctttgatcccaaagcacttcctaatattactggaataaattacagagatgttgttgcaacgaatgtcacatattctgcaaaacttgaaggaatttctaatgaccctttcacaggaatctgcatttctaatgtgagtatccaagtgagtgaacaaaagaagaagcttcagtggaattgcactgatgttgctggagttacgagcaatgtcactcctaacacttgtcaattgttgccagagaaagggaaattcgattgtccttttcccaatgacaaactgtccattgaaaatgttcagttgaagacttgttcccttcagaatgtcttctag

SEQ ID NO: 67957 - DNA, 738 bp, Glycine max
  Peptide Sequence Number=SeqID_159642
atgtcagatcctgatgcagcagcaatcaaagtgataacatcaaacggtggtatcatggaattcagtgctccagtgaccgtgagtttcatcaccaacgagttcccggggcacgccattttcagaagccacgacctcttttggaaaccactaagccaattcgaagaactggagccaggccaatcctactatctgctaccattcagcaacagaaacaacaacaacaacaacaacaacagcaacaataatatagacactctaccatgtgatggtgaaaatgttaacgttgttgtgagacaagggcatgttagatctcaaagtgttcctacaatctcaaaccctgccttgtatagaatgtccttggactaccaccaccacaaccagggaatggggttgctcaagaggtcctcgaataataacattgatgccttctctagcaggagcagtggtgttgttaatagcagcaacagtattggtggtggtggtagcagtaggttttggaaagtgaagcttgtgatcaccccagaacagttgctggacattttggcacaagaggctcgaaccaaggagttgatagagagtgtaaggatggtagcaaaatgtggaattaatgctggtggtgctatttcaaattcagctgcagattcactcgctatcacatcaaattgtagaatttctgagcatttgttgtgtaatagtaatagcggaacattcaaggcacttgcttataactttctctaa

SEQ ID NO: 67958 - DNA, 1849 bp, Glycine max
  Peptide Sequence Number=SeqID_159643
atggttgcctttgggaaaaagttgaaagaaagacaaattcaagaatggcaaggatattacataaactacaaactaatgaagaaacgagtaaaacagtatgctcaacaaattcaacttggaacactagatcggcgccatgtacttaaggatttctcaagaatgctggataatcagattgagaagactgtgcttttcctgttggaacaacaagggcttttggcaagtaggatagcgaagctcggagaggagcatgaagttattcagcaggagcctcatataagtagaatagctgaactacgagaagcttatagagcagtgggacaagagctattgaagcttctcttctttgtagaagtcaatgctgttggtttgcgcaagatattgaagaagtttgacaaacgctttggctataaatttactgattactatgtcaaaactcgcgcaaatcatccttactcccagctgcaacaagtgttcaagcatgtgggatttggagctgttgtgggagctttatctcgcaaccttcacgaacttcaggagaatcaggagagtcagggaagcttcttatcaatttatgatcagcctacacttcccctccaggatcctgttattgattcaataagagcagctattgataggttaagtaactcaaccaacttcctaaactttttggggcaacatgcacttattatgcatgaggagttgcctgcacctgttgatgagcgtgttgacgagcaaacagatgattattctatgagccttggggctgcaccaacggtttgcggtattgtgatcggggcaatggcagttgcacaggtgttttcttcggtgtattttagtgcgtggtcaaatagatcatacttgaggcctcttatattcagtagcatagttctttttctcggcaatgtcttgtatgccttggcatacgatcttaattcgatatggattctcataattggtcgtcttttatgtggagcggttaaccggcgttatattagtgattgtgtgcctttaaagatccgcatgcaagcatcggcaggtttcgttagtgccagcgctcttggaatggcctgtggtcctgcattagccggcttacttcagaccaattttaagattttcaacattacatttaaccaagataccttaccagggtggcttatgactattgcttggctgatatacctagtgtggttgtggatcacttttaaggaaccttatcgtgaaattgaagagaaacatgtaccacatcaatccaatgctgaaaacaatgcacttgaaaaaggcataaaacaaccactgctgactagtttaaaagataaggtagatgaagatgatgatcaggattacgaagatagtgaagaagctccagaggattctcatcagccagccaattcaattggagcagcatatagactccttacaccttctgtaaaggttcagttattgatatacttcatgcttaaatatgcaatggagattttactatcagaatctagtgtcatcacaacatactacttcaattggacaacaagcactgtttccatttttcttgcttgccttggtttgacagttcttcctgtcaacattattgttggaagttatataagcaatatgtttgaggacagcttcaatgtaatttttccatacactgaaccacagtacatctgttcggggctccttatgtttgtttctgctgaagtacttgaaggtgtcaacttgtcacttctttcacgagtaatgtcatcaaggctttctcgtggaacctacaatggagggctcttgtctacagaggcagggacacttgcacgagtcattgcagatgcaaccattactcttgctggctatgggg

SEQ ID NO: 67959 - DNA, 474 bp, Glycine max
  Peptide Sequence Number=SeqID_159644
atggatagatgtaagctcgagatagcttgcagggaaagcaagagagaaaatgaggaagatgaaaaagttgtgttgaaggtggaaatacatgatgacaaaatcaagaaaaaagctatgaaggctgtctctggcattttaggggttgagttagtttctgcagacacgaaagacaagaaattgaccataattggggacattgatccagtaaaagtagtagccaagctaaggaagcagctttgtcacgcagacatagtttttgttggaccaacaaaagaggagaagaaggaagaacctaaaaaagattcagcaaaagaaattgttgtaacaatagcttatggcaaaccgagaaaattattggctgagtcgcggacaatgtcgctttttttaagacgtttcgtggcactgccaaaaattatgcaagcagactatctaccacgaagtccccaggataaaacagcccaaattactgtataa

SEQ ID NO: 67960 - DNA, 2484 bp, Glycine max
  Peptide Sequence Number=SeqID_159645
atgcctcatagggatgttgtgtcgtggactacactcctttctgctcacaccaggaacaagcatcattttgaagctcttcaattgtttgacatgatgcttggttctggtcaatgccccaatgagttcaccttgtccagtgccttaagatcgtgttctgccttgggagagtttgagtttggggctaaaattcatgcctctgtggtaaagcttgggttggagctgaatcatgttctgggtaccactttggttgatttgtacaccaagtgtgattgcactgtggaaccacacaaattgcttgcgtttgtgaaagatggtgatgttgtatcttggacaacgatgatctcttcattggtggaaactagtaaatggagtgaagctctacaactctatgtcaaaatgattgaagccggtatttacccgaatgagttcacatttgttaaactcttaggcatgccttcttttcttggtttggggaagggttatgggaaagtactgcattcacagttaatcacatttggtgtggaaatgaatttgatgttgaagacagccattatttgtatgtatgcaaaatgtagacggatggaagatgctattaaggtctcacaacagacacctaaatacgatgtgtgcttatggacttccataatctctggatttgttcaaaattcgcaggttagagaggctgtcaatgcattggttgatatggaattgtctggaattctaccaaataattttacgtatgctagtttattgaatgctagctcctcagttttatcattggagcttggggaacagtttcattcaagggttatcatggttggattggagggtgatatttatgtaggaaatgcattggttgatatgtacatgaaatgctcccataccacaacaaatggtgtgaaagcttttagagggatagccttgccgaatgtcatctcttggacttctttgattgctggttttgcagaacatggttttgaagaagaatctgttcagttgtttgctgagatgcaagcagctggagtgcaaccaaattcctttacactatctactatccttggagcttgcagcaagatgaaatctattattcaaacaaagaaactccatggatatatcataaaaacacaagtagacattgacatggctgttgggaatgctcttgtagatgcttatgctggaggggggatggcagatgaagcatggtctgttattggcatgatgaaccatagagatatcatcacatacacaactttagcagcaagattaaaccaacagggagatcacgaaatggcattaagagtcatcactcacatgtgcaatgatgaggttaagatggatgaatttagcttggcaagttttatatcagctgcagctggcttaggcattatggaaactggaaagcaactccattgttattctttcaaatcaggtttcgagagatgtaactcagtctcaaatagcctagttcactcgtacagcaagtgtggtagcatgcgcgatgcatacagagttttcaaagatataactgagccagatagagtgtcatggaatggtttgatctctggattggcatcaaatggacttatatccgatgctctttctgcctttgatgacatgaggttagcaggagttaaacccgattctgtcacattcttatcactgatttttgcttgcagccaaggtagtttattgaatcagggtcttgattatttctattccatggaaaaaacatatcatataacaccaaagttggatcactatgtgtgtttagttgatctcctcggtagaggtggtcgcctagaggaagctatgggagttattgaaacaatgcctttcaagccagattctgtaatttataaaaccttattaaacgcttgcaacttacatggaaatgtgccactgggagaagatatggcaaggagatgtctcgagcttgatccatgtgaccctgcaatatacttgctgcttgcaagcttgtatgacaatgctggactccctgattttggtgacaagactcgcaagctgatgagagaaagaggcttaagaagaagtccaaggcagtgttggatggaggtaaaaagtaagatttatctcttctctgcaagagagaagataggtaatgatgagatcaatgaaaagctagagtctcttataactgaaataaagaatagagggtatccataccaagagagtgaagacaagttataccactcagagcaattggcccttgcatttggtgttcttagcgtgccaactttggctccaatacgcataaataaaaactcacttatctgcactcactgtcattcttttataatgcttctgacacaatttgttgatagagagataattgtgagggataggaaacgattccatgtctttaaggacggccagtgttcatgtagagcaatgtcgatgaaacccgaaaggggtccaagattggtcaggccagggttgaaggctgttgccaaaattggagtatga

SEQ ID NO: 67961 - DNA, 543 bp, Glycine max
  Peptide Sequence Number=SeqID_159646
atgcgcgaggcgagtgttggaaaggtgcgtgagtcggagttcggagaggagggaggagacggtggcggcgaggttggaggttttgggtttgaggagctttgcggcgaagaggaaggtttcggagacggtgaggagggggaggcagtggtcgtgttgggggacataggaggagagcttgcggaaggtggaggggacgagaggggcggagttgaggaggagggtgccgtgggaggggagggtgcgggcggcgaggatgtcgaggagggtggattttccggcgccgctggggcccaccacggccaggatttgggaggggagggcggtcagggagatgtctttgaggatgagattgatgtggctgttagtttccatttcagggtgtttgtggcgctggtggtgggggtggtggagactaatctgaggggtcttccatggagggttgaagtgagagagaagagctatggcgttgggattgaaacaaggatcggttcctttccatgtgttggagtttataaaccttggtgcatggatgatacagagtga

SEQ ID NO: 67962 - DNA, 501 bp, Glycine max
  Peptide Sequence Number=SeqID_159647
atgcctatgacacatttgaccggagatgcgagaagagcggagcaaggattgtctgttgcacaccctctctttatgtatggctggtttctcatattttctgccatgaaagtagttgactcgcctgtcctctacaaggtcactgcatgtgtgccgagaaagggaaagcaaattgggagcaactcttgggttcctgaacgtccccttgatgggaacgagggaaaggacaaggagcttagaggaagcaacaatgggatcattggcggttatcacaagtggttgaaggctcggacgaagaggttgaggtccccgagaagagcgaagaggtgcaatttaatggaactggaaagaacccaaatagtcaaggaaaagttcaagatggcagccatcaaagtcagaaaggaatgtgacgagttgagggatgtcaacacggctacagccgcagcattggaacgagaaacaaagagggccagaaaagaggaatggggccgaaacaagttctga

SEQ ID NO: 67963 - DNA, 511 bp, Glycine max
  Peptide Sequence Number=SeqID_159648
atggctaccaccaaagccttggaacgagaaaccaagagggcttgtagggaagaacacggttggaacaagttccgaggggctctgtggggtagcaacaacgagcttaaactcctaagagaggaaagggaccaatcacgagtagacagacacactttacggcacccttaccgaactcgtgctagagctagagtaatgagcaaagtagaggaggtgcaagaacaaatcaaggctgacatggaggccatgaaagagaaaatggccacaatgatggaggccaatatgagcatgaaggagataatggaggtcaatgcggttgcattgctgagggatgacccccataatgtgcaaattcaaaacaagcacgccttcccgccatatggcctgcctcccaactatacaccacccaatgtggcgtacactcctagtgagaatacacatgaaattccccaccacaatctagccgatttcgagccttgcctcggatatgccactggagggcaagaagttggtg

SEQ ID NO: 67964 - DNA, 201 bp, Glycine max
  Peptide Sequence Number=SeqID_159649
gttcgcactcctatagtgatgggcagctgtcgcaacatgcccttttgcgggcgagcgaaggcgaggctcacggatgcgctttccaaaggaggaaaggtgcgcagagtcgccaccaacgtttatttgtggaaaacgtcggaaaaaccgaaggaaatcggtcaaaatgaaaattctaagttcgggagttgtatttacgtttga

SEQ ID NO: 67965 - DNA, 115 bp, Glycine max
  Peptide Sequence Number=SeqID_159650
gctatggttcaagttgaagccagagaccataacatggctggactttgtggagtgtccaaaggttcaagatgaaaaaatacaggaccttgagatagacttgatggagtcggctatg

SEQ ID NO: 67966 - DNA, 120 bp, Glycine max
  Peptide Sequence Number=SeqID_159651
atgtgtacacctgaagggtggatgctgtgcgtttttcctcgaaacacaaaacggactcagatgatatggggcatccccttatccctaaaccactggccaagcccataccctgacatgtag

SEQ ID NO: 67967 - DNA, 123 bp, Glycine max
  Peptide Sequence Number=SeqID_159652
atggcctttgtggataactgggtggtgggtaaggaggaggaatggcagtcacagcatgggtttctccctcatcctcgccctctttattttgccccagttttctcagtcgtcctagtaggatga

SEQ ID NO: 67968 - DNA, 759 bp, Glycine max
  Peptide Sequence Number=SeqID_159653
atggcatccttcagccagcttcagtcacagatgcaatctcaggcacctcctgagcctctggttggtcctggtccctccagtcctcgagtgagcacaaaggggagttgtgttgatccctcaggaaatgatcttgagacgggtgactctgacaggtgcggcttgtacatagaagcagatcctgcccgcctggttgccgtggggagagtttatgagggatccactcttgttcataacactcctttgttgcctggccaagtaaaggtgagtgtggacgaggttaaagatgcagatgcttcagttcctgtacccactgctgaggtttccttagtggggcaggcacttcataccttccttgcttggccgacacatctgatcaagtctttatcacaccagacgggtgactctgacaggtgcggcttgtacatagaagcagatcctgcccgcctggttgccgtggggagagtttatgagggatccactcttgttcataacactcctttgttgcctggccaagtaaaggtgagtgtggacgaggttaaagatgcagatgctccagttcctgtacccactgctgaggtttccttagtggggcagacacttcacaccttccttgcttggccgacacatctgatcaagtctttatcacaccaggtagttgtgtctccgccaaaaccacctccgaagcccgatccagaggtcgatgatccactttatctgatgacattgaccatcccagagcttttcttgaggccttatcag

SEQ ID NO: 67969 - DNA, 2298 bp, Glycine max
  Peptide Sequence Number=SeqID_159654
atgtctatcatcaataccaaaatcaaaccgttcaaaaacgctgcattcaaaaacggcgaattcatcgacgtaaccgagaaagacgttgaaggtaaatggagtgttttcttcttctacccggctgacttcacctttgtatgcccgactgaactgggtgacgtggcagaccactacgaagagttccagaaactgggcgtagacatctactccgtttcaactgacacgcactttacccacaaagcctggcacggttcttcagacaccatcgcgaaaatccagtacgcgatgatcggcgacccgaccggtgctctgacccgtaacttcgaaatcatgcgtgaagcagaaggcctggctgaccgcggtaccttcatcgttgacccggaaggcatcatccaggccatcgaaatcactgcagaaggcatcggccgtgacgcgtctgacctgctgcgtaaagtgaaagcggctcagtacgtggcttctcacccaggtgaagtttgcccggctaaatggaaagaaggcgacgcaacgctggctccatcactggacctggaactcactatgctcgacaccaatttaaaaacccagctcaaggcctaccttgagaaactaacgaaaccggttgagttgattgccacactggacgatggcgcaaaatccgcagagatccgcactctgctgaccgatatcgcgagtctgtctgataaagtcagcttccgtgaagagaacgatcaaccgaccggtggacatccgtcgaaagaggcgcagagcctgctggatcaggcgctgaacctgatggcggtgctcaacccgcgcatccgtcataccgccatcgacggtggcatgttccagaacgagatcaccgaacgcaacgtcatgggcgtgccggcggtttacctcaacggcaaagagttcggtcaggggcgcatgagcctggcagaaatcgtcggtaaggtagacaccaacgcggataagcgtgcggctgaagagctgaacaagcgtgacgcctatgaagtgctgatcgtcggcagcggcccggcgggcgctgcggcggccatctactcggcgcgtaaaggtattcgtaccggactgatgggcgagcgctttggcggccaggtgctggacaccgttgacattgaaaactacatctccgtgccgaaaaccgaaggggcgaagctcgccggttcccttcgtgcgcacgttgatgactatgacgttgacgtgatcgacacccagagcgccatcaagctgattccggcagcgaaagagggcggtctgcacgccatcgaaaccgcttccggcgcagtgctgaaatcacgcagcatcatcattgctaccggcgcacgctggcgcaacatgggcgttccaggcgaagagcagtatcgcaccaaaggtgtgacctactgcccgcactgcgacggcccgctgtttaaaggcaaacgcacggcggtgatcggcggcggtaactccggcgttgaagcggccatcgatctggccggtattgtcgagcacgtcacgctgctggagttcgccagcgaaatgcgcgccgataaagtgctgcaggataaactgcgcagcctgaaaaatgtcgatgtgatcctgaacgcgcagaccaccgaagtaaaaggtgacggcagtaaagttaccggtctgacctacatcgaccgcaataaccagaccagccacgaactggcgctgagcggtatcttcgttcagattggtctgctgcccaacactaactggctggaaggcgcggtagagcgcaaccgcatgggcgagatcctgatcgacgccaaaggcgaaaccagcctgaaaggcgtatttgccgccggcgactgcaccacgccagcgacgcgcctgttcatcgctgatatcgcgataataaattttatggatgcgctcgccgcagcgtttgcattcggcttcgaggtacgtggaataccggtaacggccgccgggggcaacggcgccttgacgggaaatggtgatattgtgccagtgcctgaccctctttccccggcgcaactcgcgcactctctgcaactgctgcggcagcaggcaccgctggtgcactgtatgaccaacgacgtggtgcaaacttttactgctaacgtgctgctggcactgcaggcttcgcccgcgatggtgattgatggcgatgaagcggcgcagtttgccggttttgccgatgcgctgctgattaacgtcggtacgttaacccgtgagcgccgcgatgcgatgctggcggcggtacaggccgctaaccaggccggcacaccgtggacgctggatccggtggcg

SEQ ID NO: 67970 - DNA, 300 bp, Glycine max
  Peptide Sequence Number=SeqID_159655
atgggcgtggtcactgacttcggcaggatggtggctgcgatttccggcgtcgcccccatccacagcgcgatcgccgtgccggacaccatggcgcggcagcgccagcgccaccacggcgggctgcagcagctgattaagcagcgcgctgccggcgaaatagcgcgcgtagggcaggtgcgtcagcagcagcagtggaataatgatcgccatggctaccagcagcgggttgacgatggagaggttgattctggctgccagacggcgtgccagcagatacgccaccacggtaagcggcagtga

SEQ ID NO: 67971 - DNA, 771 bp, Glycine max
  Peptide Sequence Number=SeqID_159656
atggacctagcagtgattgatgctttcctttcctttcaccatggcaaggaaagcccagtcgtcggcattttgaccgacatgtatgatacgttcgaccagagatgtgaaaagagtggcgcaagaattatttgttgtacatcgactctctatgtgtggctggtttcacacctttttcgccacgaaggtaggcctgtctgttcgctacaaggttattgctcgtgcgccgagaaaggaaaggcgaattgggaccaactcctggctagcatggagggggcgtccgttaattggttccctcgctggaaggaaggaagaaccgagaatctgtcttcgtgcgaaggatttcaaaatcttggctaccccatgagaggagcaccatcggaggaaagcattgtgcctttcatcgcatggggtttcaatgaccccaacgcaagggtacttcaaggagttcgcaaggcatgggatgcggtgccaaggatggacaaagagcttaggggaaatagtaatgggatcatcggcggctatcaggaagaggccgaagctccgaaagagaatgaagaggtacaagccctaaaggcggagcttgaaagagcctgggcagtcagagagaagttcaagtcagcggctatcttaaacgagactgaagggaatatgtggaccatcatcgatgagtacaaagagaagctaaacctagcggcgactcacgagcaaaggctagaggatgagtacaccaagatatcagcggaaagggaagcaaggggtgggatcctctag

SEQ ID NO: 67972 - DNA, 309 bp, Glycine max
  Peptide Sequence Number=SeqID_159657
ttttcctcaaataaacgttggtggcgactccgcgcgtattcctttcgtggaacacgcatcccgcgagtcacgcatcgccctcccaccgaaggacttatcaaggtaatccttgtggcgtctaccctgaattatcttccttcattggaagtggcgtctaccttgacttatcttccttcactgggaagtggcgtctaccctgacttatcttccttcaccggaagtggcgtaatccaaaccttcatagcctgtatcaaacgatccgctcctactcaggttcacatcatctggtatcagagcttcggctcttga

SEQ ID NO: 67973 - DNA, 801 bp, Glycine max
  Peptide Sequence Number=SeqID_159658
gttcataaatccattcgggaaaatgaaccttacgacctgttgatcactgatttgtattatgaagaagatcaccggcagcaaaacattaaagacggaagagatcttatccaacaaataaaggcacttcagccttcccttaaagtcattgtcttttccgccgaacacaaatccggaatcatcgattctcttttcaaagactatcatatcaatggatatgttcgtaaagcaagaaacgattccaaagagctgaaaaaatcaattgcatctgtttacattaatgaaaattatctgtctcttgatttaaagcaggaaataaaaaaactaaatagttatgagttttctgcgtatgaaattacactcgtttcccttctttcaaaaggagttctgcaaaaaaacattcctgatctcctacaggaaaaaaacataaaacctaacagcttaagcagtgttgaaaaaaaattgaacagcttaaaagaagatcttgagagaataaacaatgagtatcaattcaatcttaaggctggaaacggagaaattatcctgaccagcgaaggctatgttcagaaagcctcctgtcataaaggaatagagtctgtaagaatcaattcaaaggaggattccagatatgacagaagagaggctgtaaatggtaaagattatttcgtgctaaaagccagaaatggggagatcattggaaaaagccagctctacagctcaaagacagcaatggaaaatggaattcactctgtaaaatccaacgctccaaccgcagaaattattgatgaaacccttaaaaactaa

SEQ ID NO: 67974 - DNA, 450 bp, Glycine max
  Peptide Sequence Number=SeqID_159659
atgagtaatataatctggaaaataaaaacttttgatgagttcaccgttcctgagctttataaagttttaaaggcgcgtattgatgtttttgtgatcgaacaaaactgcccttatcctgatctggataattatgaccagaagggtattcatatctgggcggaggaagacggtgagatccttgcctactgcagggtttttgataaaggcattaagtatgatgaaacttcattcggaagggtactgactactgagaaagcaagaggaaaaagcttaggaaaacaattgataagatatgcggttgaaaccattgaaaacaggtttcatacatcggagatcaaaatctctgcacaggattacctgttgcgtttctattctgagtttggttttattgataccgggaaaaaatacctggaggatgatattccgcatacggaaatgatcagaaaataa

SEQ ID NO: 67975 - DNA, 378 bp, Glycine max
  Peptide Sequence Number=SeqID_159660
atggagttggcatgggacggggcgaaatttgggttacctaattccacaaatggttttttcatcacacatgcagatttgtggatgatgtttatgaatgattggagtacaagcattggtttgctccagtgtactggtttccttgagccccagtctatatgctgcacaaaggacatgcgtgaagaatgtcaacagtacatagaaactgcaatgaagaaaatatgcagtaatttccaaggcaaggacaatgcacctccacctccacctcaatggattgaggctaagtttttttttaatggaacaccattagacactgacaccatcacgacactacgcaagaaatgggcagcctattttctagaagatggaaaatggatgtaa

SEQ ID NO: 67976 - DNA, 999 bp, Glycine max
  Peptide Sequence Number=SeqID_159661
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttatggggatggaatttgttagggccgatgttccttttcgaggggcagaatctaaatatagtgtggaacaagtaggtgtaattgttgagttctatggtggcgagcttaatggagtcagttatagcgatcccgctactgtgaaaaatatgctagacgtgctcaatgggtggaaatttttgattagatcgtggctactttga

SEQ ID NO: 67977 - DNA, 345 bp, Glycine max
  Peptide Sequence Number=SeqID_159662
atggtccatgacatcttcgtcaaggtgaaactggaagtaacagggacatctgcagccctaaatgtgtttggcagtagacgaagcagcgatgtaacacgatcttttgccccaatttttttcaagatgggtacttccatacttcaacttgactcgatgaaccttttcgtaaaagcacgagcttggttcaaccccataacccaggaaatggcaattttgatcgccaatacttcatcaacaattcatagggatgaaagactcgggaatatgcatgcaataaatgggtttatgatcccaacatggttggctcatggggaaaacgcaagggtcacgcatgagcaaacatga

SEQ ID NO: 67978 - DNA, 399 bp, Glycine max
  Peptide Sequence Number=SeqID_159663
atggctccgaagaagctcgctacaaagagttctaggatggacaccaccaaagaaggctccagcgccgcccaagagtttgacgcacaccggttccggagcgtcgagcatcaacaacacttcgaggccatcaagggatggtcattcctcagagagaggcgagaggagctagctcgcaggcattgggcacctctcgcgacctccatggccaagtttgacccagacatagtcctggaattttatgccaacacttggcccaccgaggagggagtccgggacatgcggtcgtgggtgagatttcagtggattccctttgacgcagatgctctcaaccagtttttgggccacccgctgatgttggaagagggtcagcagtgcgagtatggccagaggaggaactag

SEQ ID NO: 67979 - DNA, 201 bp, Glycine max
  Peptide Sequence Number=SeqID_159664
atgatgtcgattgggaaatgttcgatcggcatcatccggcgaagcttcttcattagacctcagggatcggtcatcttgactagaatcatgaaactggccaaatacaagctaaaggcccaagtggagaaggacgaaggcccaagtggagaaggacaaagcccccgagtggagaaggatgaaggcccaagtggagaaggatga

SEQ ID NO: 67980 - DNA, 603 bp, Glycine max
  Peptide Sequence Number=SeqID_159665
atgacaccggtaaaccgaaaggcaggaacaggagagcgcacgagagagccgccagggggaaacgctggtatctttatagtcctgtcgggtttcgccaccactgatttgagcgtcagatttcgtgatgcttgtcaggaggagcggagcctatggaaaaacggctttgccgcggccctctcacttccctctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 67981 - DNA, 691 bp, Glycine max
  Peptide Sequence Number=SeqID_159666
gccgtaatatccagctgaacgagtctgattataggtacattgagcaactgactgaaatgcctcaaaatgttctttacgatgccattggggatatatcaacggtgggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 67982 - DNA, 372 bp, Glycine max
  Peptide Sequence Number=SeqID_159667
atgtaccctcccttgttctctttgaacctagtggatgtaccctccactagaactgatccacaagatatgtactctcttgttctcagtcaaacccaagtagatgtaccatctacttgtaccacaaaggatgtaccctccaatgtgttaagacaaagatcccaggcagttaaacctttgatactttgtgaatggggatacaaaagaattctcaggcgggagaagggagacacaaaagaatttaggtggttagtcctttgttcttttggaaaagggagaagaaagacacaaaaagaattcaggtggttagtccttggcgaattctttttggcaaagggagaagagatgaaaagaatgaatagcacaagtttcaag

SEQ ID NO: 67983 - DNA, 1056 bp, Glycine max
  Peptide Sequence Number=SeqID_159668
atggccccgaggaagcttgcctcaaagagatccaggaaggataaagcggccgaaggaaccagttccgcgcccgagtatgacagccaccgctttaggagcgctgaacaccagcagtgcttcgaggccatcaagggatgggacgatgagtataccgatttccaggaggagatagttcgccggcggtgggcatcactggttacccccatggccaagttcgacccagacatcatcctcgaattttatggcaatgcttggcctacagaggagggcgtgcgagatatgagatcctgggtgaggggtcagtggatcccgttcgatgcagatgctatcggccagttcctgggatatcctttagtgctggaagagggccaggagtgcgagtatggccagaggaggaaccggtccgatgggttcgatgaggaggccatcgctcagtgctatatatggatgacgttgctgcttagcaacatcctgcccaccgatcataattctgacctccccctgccgaagtgtcagctggtgtacgccatcctgacacggatgagtattcatgtggctcagttgatcgctgatgccatttatctatttgcaggtatggtgccgaccaggcaccctttggacccagataagtccaacagggccctgggatttcccgcactaatcactggactctggcagtcgttcggagtccccgttgcacctaccaaggccgcaggcgcgccaccaccacctcatcaggctggcccagctgggtcatttgacacggagcagtatttgcggcatgtggttcgccaggaggcggccaaccacagagcgcatgtgcggaccaatgagaccctttaccagctaagcctcagtatgcagagccagggcttcgcttctttttcatgccctactccagacaagttcagggtggaggtcgcatggcccggggactggcccgaggcccaggcaggggaggcacccgcagaggctcccggcgaggcagatgaggctcacgaggacgaggatatggccgatttgttggatttcttgggaggtagcggagccacttga

SEQ ID NO: 67984 - DNA, 153 bp, Glycine max
  Peptide Sequence Number=SeqID_159669
atgtgggatcgacacagacttaaaggagcactcaaaccgggtgtatttacccccaaggcctacacttcgaagagtccgtcagggcctctccctcctgattcagatactgctcatgaattatacaatacctacgacctcacactcgtgttttaa

SEQ ID NO: 67985 - DNA, 204 bp, Glycine max
  Peptide Sequence Number=SeqID_159670
gttgcgacaccactcgctaagcgcaacttacgcgctaagcaaatccttgttcacgcgctgagcgagacacttctcgcgctaagcgcatcaacccctgttcattggctgaaagggcgagtcatctccctgagcgcacagctgcatctttctaagcgcccactgtgcgctaagctcaatttcctctctgttggaccattcatgtga

SEQ ID NO: 67986 - DNA, 455 bp, Glycine max
  Peptide Sequence Number=SeqID_159671
agggtgagactttacccacatactctagatactgcaggctgcccacagattatagagagattgaggctgccttatgcataccaggcctagggttcatcttgaacactgagggccatcctgggaagattctcaggaaggatttgactactctagctcagtctaactcttctagacttgggtttcttgctctgatcaccgccctatgtagggccagaggggttgtttctgacagcctagttttggagcacctaagcccggtcattaacttggcctacatcaggaagaactgttggaatcctgatgatctgacagttactatccgaggggctaggagggcgagggcaaggccagctgagcttccttctacttctgcagctcctactccagcatccacttcagcagctccttctgtcccagctaatacagattctcagcgctttgaagccatgctttag

SEQ ID NO: 67987 - DNA, 861 bp, Glycine max
  Peptide Sequence Number=SeqID_159672
atgccgactctaaatcactctatgtcaatttggatgataatccgctcccagattgagttagatgagctggaaagtgtttccattctgtcaatgacccttgcatgggatgaattttccttctctacttttcaagaagcccattattcgcttcaagtttctctagaccaggtgcctggtacgataattggaaatgaagatatcaatagtattaggtggcccggttctgcatggagacgcctcaaggatacattatacttggagaacatagaggaaagggaaactgggggcacgcctccaataatccagacagtgagagcatgggacctgatacttatgtggcaaggtcaaggcatttatctatggacttttgagctagaagtgatacagattgataaattaaggtatcaagatgtcttatcgaaggggttccgttcagccgccgataaggtggatactgcggactcagactgctgggaatttaggagccaattaaagagtatgaaaggatacattatacttggagaacatagaggaaagggaaactgggggcacgcctccaataatccagacagtgagagcatgggacctgctgtccaggtgaagtccacacgaaaggaaaagcagaagaagcaagagagagatgatggtatgaataatggatgtggaatagtttctactggtattagtggtgcaagctactgcaccggaactttcaatactgtcgattgctctccagatggaaggtatgttctagtgtcaagtcggggaaacttctacctaacctgggagtctggttgtggaggcaagtcaagattttgtgccacttattttgaggcaagtcaaaatgtgcagtggctttaa

SEQ ID NO: 67988 - DNA, 396 bp, Glycine max
  Peptide Sequence Number=SeqID_159673
atgacctctccagcaacaggtgatcttccactggcaattctgatttacagaagcagcatatccctcttccattccctccaagagcaatttccaacaaaaaaaatggaagaggcagagaaggagatcttggaaacatttagaaaagtagaggagctgtgcactaataagcggaagctgaaaggaagtgaaagaattagtatgggcagaaatgtctccgcattgattggtaaatctgtcccccaaatccctgaaaaatgtaaagatccaggtcctttgcactcaactgatgtggtaattcatttagctaatagaagtgttgcctatcctgttggtttcatagaggatgtcttagttagagttggtgaactgattttccctgttgattttatattttga

SEQ ID NO: 67989 - DNA, 318 bp, Glycine max
  Peptide Sequence Number=SeqID_159674
atggctcaaggattgtgctgttatttgtccttaaaagagatgaaacaagcgaccaacaattttgatgagccaaatgtgataggggtaggagggtttggaaaggtttacaagggtgttattgataatgggttcaaagtggctatcaaaagatcaatccgcaatcaaggtcatgttagtacacccttgaaaggtagctttggatacttggatcctgaatatttcaggaggcatcaattgaccaagaaatcagatgtgtactcatttggggttgttttatctgaggcactttatttgaggaaggtagctttggatacttga

SEQ ID NO: 67990 - DNA, 1011 bp, Glycine max
  Peptide Sequence Number=SeqID_159675
atggttagaattagaggtcttggtcatgctttaggtcgagcaataggaaaagtcctagggagaaaacaagggagtgatgatgacaatgatgcctctagaggcgaagacctatcgcatctgctcgcaggatcctcctacgactgcagaggaattgcacgacaaggaacgacaacaaaagcacctgttgaggatcctcctactgatgaacgccttgagttgaagctatcttcctatggaaaaaagattgctaagttcaggaggcttgctctagagattaaaggccttgtgattgtcagtggactaagtcctttgatcgcatgttccctaaatacgggcgatcggggactaatatctacttttgtggaacgttggcataaggaaactagtagtttccatttgcccatcggagaggtgactatcaccttggatgacgtcgagtcgttgctacatcttcctattgtaagggtgttccacaacttcgagcaacttcatgtcgatgacgctgttgatatcttggtggaattactcgaggtcagcgctgcagaggcgagagctgagacaattcagtgtcatgattcttatgttcgactatcatggctgcgcgacgtgtatcaaatgaagatcgaggcatgttattggattgtagcagcacgagttgggagttatgcttggggcgctgctgtacttgtgcacatgtatgataatttaaataaggcattgaagagcacgacaaggcagcttgcaggatatatcactctgttacagcaatatgacacatttgttgaaccagatgtgtatcaacaactgatggcgacagcggcacctgataaggcagacattgatgtgcatcatcttcgacatgcagtggatggtcatgtagcaattgctaataagttggagaggcaactgaacctgaggatcatgaccgaaggaacagaagcgtatactattgttgaagaatgtttgagcatcgcaagaagctacattagccaatcaattgtaggtcactga

SEQ ID NO: 67991 - DNA, 2244 bp, Glycine max
  Peptide Sequence Number=SeqID_159676
atgtacgtagcttccatgcgcaagtctttcaaggactccttgaaagtccttgaagctgatatccagcacgccaataccctggtgatgatcactgttgcagaagggttggtgattgcaaaggcttcagattttccaagggagtatgatggtgcatgccttcagatgagaatgtcatacagtccagctgcacacctgtttcttttcttggtgcaatggacagattgtcatcttgctggagcccttggactgttaagaatcctaatttacaaggtctatgtggatgggacaaccaccatgtctacacatgaaagaaaagcaagtattagagaattctatgctgtcatatatccctctttattgcaacttgaaaaaggtgtcactgataccgaggataagaagcaaaaggttgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccattctcaagagagtaaactcaggcgatctctgggtattcactgatagaagggatgtggtagacatggcaacagtgactagggagaatctcagaaggcttttcatgtacatagataagttgcctctgattgttcctgactccctttttgacacatacgactctcacataagcctgccaaacgcctatgaccgcttctctaactcccttaaagtagtgactcatctcttctcttctcatctcatctcttgtcttcaccacccctccccaacttcacgtgatcctttcaagtccaaaacggtgcgtattatcaccgccgcgagagacccttttcgtactacaatcacggaaacaatccgaattaaagataaagaaaaaggtggtggtggtggtgtcggaatcacaatgccagaggttagaatcattgccaagaatttcatggacatggtggcttccatgcccgccatgaagctcgataagctctatgaaaacggattcatctgtgaagctattctcagttcagagttaagtaacccaaagggttggtgcaatggtataaggctccattgcgtttacatgagtgagaaggatccttttagcgggagaacccgtgtccgattcccatcacgtgtaaaattcccatggccagcggcagccatacacagtgggtctcttctgcctcttgcgaagaaatacgtcatacagatgctgcatattgatgtgtcagtggcagctaaattgttggaggaatgggtgcttccgggtggagtttcaaagcacagagtggccattgataggttggttcaattgagagttttccttgaagctgttgacaggaagaatgaaaagacttacaaagttaatccaacatttcagagaagtctccaaaaacttttagtacaaggtggaactttgccaagggaatcaatgccttctaatattactgtgaggctcccaaccttagagaatcttgaggcttatgctctagaacaatgggagctcttccctgatgaaggttttccagcggcgtatcctgagttacagctgatggatacaaatgcacagctttggtacatcatcagagaatatatatctaattctgaggatagaggtgttgatgcagctgaccttatctcattcatgctggaacttagttttcatgacattggggagggatttgtggttgtggaaacaaattttagagtttatgcttactcaacttctaaattacattgtgagatattgcggctattctcaagggtagagtatcaacttccaaatcttattgttggggctattacaaaagaaagcttgtatagtgcttttgaaaatggcattacagcagagcagataatcactttccttcagcaaaatgctcatcctcgtgttgcggagaggataccatctgtgcctgaaaatgtcacagaacagattaggctgtgggaagcagatctaaacagagttgagatgacagatgcatactattacgatgagttcccttccagagatgtgtttgaaggagcctgtgactgtgctagagaatggaatggtttgttgtgggaagattcaaagaagatgcacatggtggttaagactgagaagtatcaggtatatcacttggcgggtcaatggggcatacaggttgtggctttggctttggttgtggcttcggcttggtctccggcttcagttgcctgttag

SEQ ID NO: 67992 - DNA, 396 bp, Glycine max
  Peptide Sequence Number=SeqID_159677
atgggtcttcgtgggagggatcaaaatcgaatctttttggatgtgggaggagaatcttcttctgatgggtatcaaagggtggaagaaggttctggaagaggaggaggagaaaatgaacacatgggtcttcttgctttggagcacaaagcacaaagaaggaagttcaagcattcagggacatggtggtgggggtatcgattgaagtttagctgcacactgctatggcgtggtggagtggactatgggggaaacggaagaggaacaacaaagaagagattgttaccgcgctatgttatttttatccttaatcctcaatttcctacgtttgggcttcatgaccaacgacaacggccccgtgtgtacgaggctacatttggacataattttgtttgttga

SEQ ID NO: 67993 - DNA, 834 bp, Glycine max
  Peptide Sequence Number=SeqID_159678
atggatccaatccaacacaagttcgtcaacgttggtgctctcaagctccacgtcgcagaaaccggaaccggtgagaaccactcctctgcattttacttctattctttgtacttcacctatcaccaatcccctttttcaggtccaaacgccgtcgtattcctgcacggcttcccggagatatggtactcgtggcggcaccagatgatagctctcgccggtgccggattcagagcggtttccttcgattacagaggttacggtctctccgacccgccacccgaacccgataagacctcttggtccgatcttctcagtgatctccttcatattcttgatgctcttgctctttctaaggttacattaaaacaagatcgagttggtatgataaggcatactaatgtaggcatgaagggatgcctacatgtgtttcttgttgggaaagactttggagctcgtcctgcatatctattttcaattcttcaccctgaaagggtcttgggagttgtcacgttgggagttccatatgttcccccaggcccctctcagtatcacaaattccttcctgaaggcttctacattttgagatggcaggaacctggaagggcagaagctgattttggacgctttgatgcaaagactgttgtgcgaaatatttacatcctcttctcaagaagtgaaataccaatagctaatgaaaaccaggagatcatggatttggtggaacctgatactccgcttcccacttggttcacagaggaagatcttgcaacatacggagccttgtatgagaaatctggattccaaactgcattgcagattccatataggtgctag

SEQ ID NO: 67994 - DNA, 312 bp, Glycine max
  Peptide Sequence Number=SeqID_159679
atggaaggaactagtgacagtggtggtgaatatcatcaactggacgaatctcaacatttgttactggacgtgatgactacacagatgcaacgattggagaaccaactgaatcagaatgttgggagactttatggtgggaacatagggggaaatgatagacccgggcaaaacagaatggagggacagaacaaaattgaaggagtaaaactcaatgtacctcatttcaaaggcaggagtgacccagacgcctaccttgactgggagatgaagattgaacatgtattctcctgcaatgattatactgaagagtag

SEQ ID NO: 67995 - DNA, 514 bp, Glycine max
  Peptide Sequence Number=SeqID_159680
atggtgctaggagattcagttgataaaggagaaaacctaggaggaaccagggaacataagctgtacaagacacttgagatgtttgaggaatggaagagacaaagggatccacgatgtcggatgcaatgtcctgacatcctgctcgaaaatactggagttgctacacaatgcataagtcaagacaaattgtcaagtgaagcactaaagctgcaggatccacgatgtcggatgcaatgtcctgacatcctgctcgaaaatactggagttgctacacaatgcataagtcaagacaaattgtcaaattttcaggaaagtgatagatctcatccagcatcaagaagttgcagcccagaatcgtacacggctataaaaacatggaggctgcacgagttctgtaccaagtccgggattgaagagttagtttgtgagtttttgggacttgagtcttttgtgagccaccttgatggtaccctagcatcaagtgttggacctgagtgtgtagagttgatctcta

SEQ ID NO: 67996 - DNA, 168 bp, Glycine max
  Peptide Sequence Number=SeqID_159681
atggagatgagaaaccaaccttttatgaagagagtgtgcgatctgaatcaagcgagaacggaggtcgtaaccatcgtgagagtatgcaatctgaatgaggttttcgtgactgagggagtgagaacgagggtcgcaagggagagtgtgtgggtggagaggaatgagtga

SEQ ID NO: 67997 - DNA, 507 bp, Glycine max
  Peptide Sequence Number=SeqID_159682
atgtctccatcaccgtcgtgttatttccgccgtcaaggcaaggatgttcatcacgtggatgatgcaactgaagagatcttccaacaacctaaagaagtagcttttgatgcccatggttttctaggcacgccgtgtgacatatcaattctaactgcctatgttgatcatgttgcagtcattgaacgtcttgaattgaagttatccttccacggaaagaaggttcagaaatccgggaggccagctgttaagattgaaggtttccatattccagtaggagaggtcaccatcaccctcgatgatgtggcctctttgcttcatctacccatcacaggcaccttccatagcttcgagactcttcatgtcgacgaagcggtgttgatgttagtggaattacttgaagttagtgtcgatgaagccaaagctgagacagtacagtgtcatgggacatatgtacaactatcatggctacgagacatttatcgtagcaaatgtgatgttgaacactag

SEQ ID NO: 67998 - DNA, 3033 bp, Glycine max
  Peptide Sequence Number=SeqID_159683
atgacaactaattcatctcttccttctggagttcataaagaaaaacatattctctttgagattgggaactctgaaaggcagctgtgggcattgatccattctaaaggcctattacactctgatgttcaagtcttgtatcacaacatcaggtcaagttatgagagagcaatcctcaataatcacactcattcagaacttcaagaagttgaatattccttgtggaagcttcactataagcatattgatgaatttcgcaaaataatgaagagaagctctggtaatgcagagaacaagaaatcaggaatgccgaaagatggtgttgtgcagataaacaacgacaatcatatacaggcatttaagtcatttctttcagaagccactgagttttaccaaactctaattgtaaaactcagaaaacattatggagtcccagaagaggctttgtttcataaaaagggttgtgtttcagcttcttttgaaccagaatcgatgctgaaatgtcaatatttacatcatcgctgcttagtctgcatgggggatctggccaggtataaacaacattatgaaaaccttaatgctcaaaagcaaaattggtcagtttcagccacacactacttggaagcaacaaggatttggccagatagtggaaaccctcaaaaccagttggctgtattggcaacatatattggagatgattttcttgctttataccactgtgtaagaagcttagcagttaaagaaccttttcctgatgcctgggataatcttatcttactgttggaaaaacttcacaagctgccatctctaatgatcttgcagaacaggtcatctcatctggaatgtgtttccagtgaagtctgctttgatttcttcaaaccttctcaaaggatcagcaaagagactggaacgcaaccaaataatgatagctcgaatggcaacctgtttgaaggtgaaagtaatcattttacggacacaaagttatggtctcatatagtcagaacagttagttacctcttcataacatcaagtttggagaaattccccattgcattggcatctactattgaagtgttagatgaaataatggagctagaagatataaaactaaagaccatgttggagtcctatggacaaatggatttggccagaaagggtcctttccgagccttacaaatagtttctatactcatatttaccctaaagaatctgattgataagcatgagaaagatgaatcaaaagacaaaaatgattgtcagcaacttgtgctgatacagctggcattagctgctgcattcattttcatgggccgttttgttgaaagatgccagaagtctagtcctttgaatcattgtcccttattgccttctgtacttgttttcatggagtggtgtgcaagcatgcttgataccattgaagtatatgcaactgatcaaaagagtgaaacagctatttcttactttttttatgtgcttattgaacttctaaatcaactcaatgagaatagaaaagaaaccaggaagcttgtagatagtagtaccccactttgggaagactatgagttgaggggctttgcatctgtagctttttctcatgtctcactagatttctcttgtagatgggaacacatcaacaactttgagagtggcactgaattgcgcgctcagcgcatgagtgaagcagcaatgaggattgctaacagatctaataatttgcaaaagtggattatatgtgatgaattagaaagaaaattttactctgctagatctgatgaaaatcacgagaagaaagaaacaggtaatgtagagtccactgacaaatggacaagtggggatgaccctaatcagaaaactcgcaaagacaatggagaagatggaaaatgtgatacaagagacaatccaagtagttccagcactaatggaaaaccttctgctgtggaggaagaagaagtgattctcttcaggcctctagcgaggtataattctgcaccattgtacgcactttttccccctcatgagcagatgtcatcaccaaaagacaaggatgataaagtcttgccttctgatgattgtctgcgccgtactacatctctgcctatggcacaaaatccatttcaaattgatccgtggggattccaaggtgacattacgaattcaaggatgaacaaatcgttccaactgctagaaccttcaatgaaggaatcaaatgcacacacattttctgagggtccaatctctgctgggcatccttcactcaatgcatgggcccttgataccaacaggttgcaccccattgaggaactagcttcttcgtacttggccgatctttccatcgatagaactcagaatgcagtcatcagttcagcagatgagtttccaaacttcccttcctcatctgctacatatactgttccagttccttctgctccactgttgccagataatgctccttggtacaccgatgtcattgtacaatctactgtgtctgctccatcattgccagaaaacccatcaccgataaatagttattcagctttgagttctacttatggaccccttggatatgatactagttttccatcttattccaatggatatgcaccgccaccaggtagaataacttcttcagaatggctgcgttggtacagagggaatccaacacctgagagggtcaactataatatgcagcctgctcatttgaatgttcatggaaatcatgaaaacttcctccatcttgacacctacaggttcaaccaatttgatcaatggggtaatccttcgtctcctaaccagtacacatatgtgaagccaccaggtcccccaccattgctgccaggttattatccctatgcttttggtgctggtgaacacataaccaatcacttccacaattttcaaaggccaagcccttatgggtgtggttctgtgacagaacagagaaatgagccactgcctctgctagagtaccttaaggaaagggaatggagactccagcaggaccctagcctcagagggcctacattcacgggaaattaa

SEQ ID NO: 67999 - DNA, 213 bp, Glycine max
  Peptide Sequence Number=SeqID_159684
atgatttttgatgggcaatctctggagcaagactgtgttttggaaactatcaaacgcaaatcctggttgtggttggattcttatgtcaaacagttcaaatactccttcttcgaatactggcattcgaatgaacccactgctatgcctcaaatggttatgaagcgtgaggaaattaagggaagcagggacatggatataaaaagctgcatgtag

SEQ ID NO: 68000 - DNA, 2775 bp, Glycine max
  Peptide Sequence Number=SeqID_159685
atggatcttatcatcagtgattcagactgggaaacttccagtggcagcaacagcagtgaggatcaagatgaaattgattttctatacggcggtaaagctcagagcatattatcaagtttagaggaaagcatcggaaggatcgatgattttctttcatttgagagagcatttgtccatggagatgtggtctgctccttgtcagacccatctggacaaatggggagggttacaagtatggatttgtttgtggatttggaaagtgttaaaggaaaagtattaaaaaatttgaactctaagaaacttttgaggattcgttccattgcagaaggtgattatgtaattaaggggccatggcttggtcgagttcaaagggtggtggacaaagtggctgtattgtttgatgatggagctaaatgtgatatcactgccttggaaagagagaagcttttaccactgactggtaattttcctgaagattcgcagtttccgtactatccagggcagagagtaaaggttaagtcctccagtgcttctaaatcaactagatggctatgtgacacttggagagacaatcatgatgaaggaactgtttgtgctgtggaagcaggcttggtgtatgttaattggatttctcatgttctagtgggttgcgattttagtgtgagtgctcccaaatgctggcaagattctaaaaccttgactgtgttatcttgtttttcacatgcaaactggcagcttggtgattggtgcatgctctcggttgcggaccaaaaggaacagattactcaacacgcacctataggtgatcttactatggagcattgtgtgtcaagagggtgtaagggaagtaaccttaactcttacagtggtgagttgtttataattgggaagataaagaccaaagttgatgttgtgtggcaaaatggtgaatacactttgggattggatccagagaatttacttccagtgaatgttataaacaatcatgaattttggcctcatcagtttgtgctggaaaaaggtgcttctgatgatcctcttaaaactagcagtcaaagatggggtgttgtccaatgtgtggatgcaaaggagtgtactgtaaaggtacaatggaaaactatttccatatctgacccggataatttgactggagacaaattggaggaaactgtgagtgcctatgaacttgtagagcacccagattactcctgcttttttggtgatattatgtttaaggcggctcaaaaacagcttggtaaccaagctgagaaagaacaagcaaaatcagtgaccgactttaatgcagaggctgttcctaaaaatgggaaccaaatgagttatcaggatgagttccctgataattatttcatgtcctgcattggcagtgttactggtttcaaagatggtgatgtggaggtgacatgggcaactggtttcacaaccaaggttgcaccttatgaaattttccggattgagaaacatgaaggttcaactgtaacccccactccttttgagacaaatgttgaagagttcactcatgagataatcgaacacaggagtctaccttctgaccagaagggaaaggacttgttaaatggtgatggtactagagagaattgtgaaaagaatcttggggaatgtagttccttttcccttcctcgagcagcctttgaacttttctccagcattaaagccagcatattccaaacttttagaggaactctaatttcaggagcagtttcctcagtacctacatttgaaaagaagaatggatatgattgtctagataagaaagatttggaaacttctgacctctttactgaacaacatccaatggctgagttgcaatatactgaggacaagacttcatatcctgaaaatattgagattcatgagaagaatgattttccattttctttagacagcaacagttcaaaccagttcaagcagtttgatgtaatagaaaattgccctgaccaccatttttttgttgagggaaaagggttgtcaacatctcaggtaaaaagaagttgggtgaaaaaggttcagcaagaatggagcatcctcgagaaaaatcttccagaaagaatggatctcatgcgagcagctattgttggtgcatctggaactccttatcatgatgggctgtttttctttgacatatgcttccctccggagtatcccaatgaaccacctatggtgcactacaattctgcagggctccggttaaatcctaatctgtacgagtcaggaaaaatctgtctgagtctcctaaacacttggacaggcacagacactgaagtgtggaaccctggagcctccactattcttcaagtccttctctctctacaggcacttgtccttaatgagaagccttatttcaatgaggctggatatgaccaacaaattggcagagctgagggagagaaaaactcagtcagttacaatgaaaatgctttccttgtcacaaccaaatccatgatgtatctattaagaaagccaccaaagcattttgaagcactggtggaagagcactttagaaaatgctcccaacatatacttcttgcttgcaaggcttatcttgaaggagcttctattggatgtgcttttggtagtggaaaaactggacatgaaaaccagaaggggacttcaacaggatttaaaattatgcttgctaagctcttccccaagcttgtagaggcattttctgataagggaattgattgcagtcagtttgttgatctacaaaaagaacctttacttactaagttgtaa

SEQ ID NO: 68001 - DNA, 813 bp, Glycine max
  Peptide Sequence Number=SeqID_159686
atgtctgcaaccaaatctgcgtcaaggaagcgagcatccgaatccgaacgtgcaaaatctgacaagaacaagcgatcagccccagataacttcgatctcgatttggatttcgatctctcagagttcgtattcgccgcttttgctttttcgtttatttttttcggaatcgtgcttacagtttcttatattgcgcgaatctgcagtgacatcaaaggaatcgtgtcggcgctgcacctgatcagagacaaggcacagaaggacggtcagaagaagaacgaagagacaatttccagtgtgggttctgaggttaagtctatgatcgagggattgaggtcaaaaattgagaaggacaggcaaagctttgctaaggcactttcaaagagttccaaagaggaaggaatttgcgtgttgttcaaaactggtttaatcattgctgtgactgcaagcatgcagtatgaaagttcattgaagaatgaaactgctaagtttcaagcacttcatgagaatttttgcaaagagaaagctagttctctgcaggcgctgaaagatgctaactacttctgccaattgatagatattatctccaaatttgaagaggaaaaggaaaagctatttgtcagatatgaacaactgaggaagaaggaaagggttatgatatctgaacaagaaaaagcctgcaatgataaaattgcccaactggaagattcattgaaaaagaagaaaaaggatgacaaaactctcagcattctaaggaaaactcttggttcattcttgggaaatgcctcggacgaggatttcccacccgatgattga

SEQ ID NO: 68002 - DNA, 249 bp, Glycine max
  Peptide Sequence Number=SeqID_159687
atgcataaacagaatcagaaggactttcacaggcttgtagtgaggcttggctacaaaaaatcattggttttcctcacaaatggtgcaaaggatacaattctcattcaaggagtagcagcaacttcctgtctaacctatgtctcacctgcctcctcctctacaatgaatggccctggaatggtggcctcagatgacgcatcctctacatgctatggtacctgggctgtgggaccttcatcttccctgtga

SEQ ID NO: 68003 - DNA, 570 bp, Glycine max
  Peptide Sequence Number=SeqID_159688
atggcaggcaaaagtcaatgttgtgtccgggggctccactatggtacgcgcatgtggcatttgagttgtaccacttggggtatggtggctagaagaccttcccgggtatggccaccaccaaatgattttccaataatgagggccacaacttggaatatgccatgggaacaggagagaactcgtctctcggggggcatcgtgcgttgttataactcgctccaggagttgtattattggctggccggggaatggctggagctgtgtgttgggcaggcattttttttgttgcgggaggcccttccacttgagctgggagggaacttccagctcggatcgaaaagttcgggtggttgtgttggctcttctattgttgttgggggcaacgttggaggcatattcaaacttgcctttcctcagtccggactcgattctttctccggcgaagacaaggtctgcaaagttagccggcatatatcctatcagcttcttgtagtagaacgtaggcaacgtatctaccataatcctgatcatttccctttcagacataggtgggacgacttgggccgctag

SEQ ID NO: 68004 - DNA, 1118 bp, Glycine max
  Peptide Sequence Number=SeqID_159689
ggcgcggattcggtataacgcatcgccgcaaacgactttggatcgtccggcgccccccagtttccctggccgtccaccagcggatagcgcacgtcacccacggtacgcgccgatttctgaattttgcgctggcgttaagccccagctcggacatggcataaacaatgcggcgctgcaccggcttgagaccgtcaccgatctggcatcctcacttcgtggcccgcaacggcgggtcatccggcggtcatttggcgaggatagtaccttattcgcgggatttagtcacagggaagccgttgaggacagaaagaatctcccggctttaaataacgtgacgccggcggcgccgcagccgattggtcagctggcgttacagctcggtgtctccggaaagaccattcagcgcgacctgcagtggctggagagctggctcagcaactgggcgctgacgctggagaaaacccctggccgcggtgtgcggctgcgggttaaggatatgcagcagcgtttgcagctggagcagcagctgaacggcgacgaggccggcgacgcgctcagtcataacagccggcggataaaaatcgcctcccagctactgagcgatgcgccgcgtgccacgtcaatcagcaagctgtccgagcgctactttatcagccacgcctcgattgtgaacgacctgaaagtaatcgaagagtggctgcagccgctgggattaacgctgcagcgcggcccgggtggcacgcacattgagggccatgagcaggcgctgcgccaggcgatggtgtcgctgatcaacgatgtgatgcagcaacaggtcgccggcacgccactgctgccgcggctcgatcccggcagccagcaggcgctggtgcactattttggcgaagaggatgtggcctttgtgcagacgctgctgcaacagatggagcagcagctgagttatccgctgggcgatgcctggtatctcaatctgtgcacgcacatcctgatcatgatgcaccgcatggcgcagggcaacgcgctggcgctggacattctcaccaccgcgcacgatctggatcagtcgattctcaccattgcccggcagatggtagtgcgcattgagcagcgcatcggct

SEQ ID NO: 68005 - DNA, 358 bp, Glycine max
  Peptide Sequence Number=SeqID_159690
ggtacatcctttgtggtacaagtagagggtacatctacttgggttgttgtaactgagaacaagagagggtacatctcttgtggatcagttcaagtagagggattttacaaggttgaaaagaaatctcaaggaccgcaggtcgcttggggactggatgtaggcacggctgtgaaggcagaatatgatgcctttatgaacaatgatacttttactcttgatcctcttccccctaataaggtccctattggctgcaacttcagtttcagctctagcaaatgtcatccctccttatttgtctattccaaaggttccacaactgtctatatgctgatctatgttgatgacataatcatcaccg

SEQ ID NO: 68006 - DNA, 297 bp, Glycine max
  Peptide Sequence Number=SeqID_159691
atggagttgattgaaaatatgtatgccagttacccggttgtaccatatgtggtgttactcatgaatctggtctttgcattccttttgaagagcaaatgcaaaaggttagctacatggggaaacaacaaaggcagggatacaatcgaggtggattctcaggtttccagcaaggtctttacaaccaacaaggacagtggagatcacaccctagtaatcaattcaacaaagaccagggtggaccttccaacaggccacctcaacaagggcctaacatttttcagaggacaaccaagctag

SEQ ID NO: 68007 - DNA, 126 bp, Glycine max
  Peptide Sequence Number=SeqID_159692
atggctaagcgcatcgacaattctggaagaaggatgagctgcatagaggcgctgagtgaaggccaactcgctaagcgcaccgtcttcaccttcaggctgggaagcttccctgctatggagagctaa

SEQ ID NO: 68008 - DNA, 358 bp, Glycine max
  Peptide Sequence Number=SeqID_159693
ggtagagcaacaacttaaatggaagtctacttcaaaatcttgtggccctgaatcttatccaaagaaagaccaaggtcaaggcatcttaagggcggcaccttctaagcccaaagatgatatagggaagacaatagaaaaccaagatgaggctactacttcaccttcctctagtgaaagtgaagaagcaaaaagggaagaatctagtgaagaaatctaccccaagaagaaggagtggatgatgcaatcctaccccctaatggcattggatagaagactccaagaagattgggccagagctgctgaagaaggccctagggttctcaatagccttagggtagattttggagctgtgggctaa

SEQ ID NO: 68009 - DNA, 336 bp, Glycine max
  Peptide Sequence Number=SeqID_159694
gactctgcccagtcgttcggagtccccgtggcacctaccaaggtgattcggccgcccatcacccgggcttttattgagaagtactgcacccagagacaggctcagggggatgctccacaggccgcggttgagcctcagcatgcagagccagggcttcgcttcttttcatgccctactccagaccagttcagggcagaggtcgcatggcccggggattggcccgaggcccaagcaggagaggtgcccccagaagctcccggcgatggagaggaggcccacgaggacgaggagatggccgatttgcttaacttcttgggagggagtggagcttcatga

SEQ ID NO: 68010 - DNA, 300 bp, Glycine max
  Peptide Sequence Number=SeqID_159695
atgtacaaagtgagagcaacagcttctctagatgacgaattagaaagatcgacaattcctccaaccggggaatcagggggatcagctgtttctccagctggtgaatcaggaggggcagcagtttcatctgatgatgcatcgaagatgataatcagaggtggagatgggggaactacttcaagctcaggagaaggaggtggattcaccactagagatcatggcttagctgacattggttcaacctgtgccggtgcgggcttaggaggagcagcctcattaggtctcaccaatggaagttga

SEQ ID NO: 68011 - DNA, 174 bp, Glycine max
  Peptide Sequence Number=SeqID_159696
atgcgtgaagatgcagaaaaagcaagaaagcacgaagttgggcgtgagagaaaatgcagggttgtcatcatcaaaaagggggagattgtagaagcaagcttcatgatgatgaatcaagttgattcaagtagttttgataatgacaaagatgatgacaaaaattccaaagaatga

SEQ ID NO: 68012 - DNA, 258 bp, Glycine max
  Peptide Sequence Number=SeqID_159697
atgactctgatgaacaaggttcctctaaaattggtactgctctttcctgcaagatttttcttctcctttttgcattatttcttctgcaagtggcttcaatttccaagtgtaattcaaccaaatcacctgcagaagatctacgcagcatacaaagcactagcaagagcagcgaagttccctggcaacggtgccaaaatacttgttcgctctcttaacaactgcaaatttatcggcaagtgtactgagtcaagcaagtag

SEQ ID NO: 68013 - DNA, 417 bp, Glycine max
  Peptide Sequence Number=SeqID_159698
atgtcttgcctagtgataataactccgaccttcctctgccaaagtgtcagctggtgtatgccacccaccaggcaccctctagacccggataagtctaacagggccctggggtttccggcattgatcacgggcctctgccagtcattcggggttcccgtcacacctagtaaggcatggaacggtatctacagcacttggttcgccagcaggcggccaaccaccgggggcagatgcatatacatgagtgtctctactagcttagcctcatttagggctgaggtcgcatggcccagggattggcccgaggcccaggcaggggaggcgcctgcagaagctcccggcgatacagaggaggcccgcatggatgaggagatgatggacttgctcggtttcttgggaggaagcggagccacgtga

SEQ ID NO: 68014 - DNA, 240 bp, Glycine max
  Peptide Sequence Number=SeqID_159699
atgcccaagtggagaaggacgaaggtccaagtggagaaggacaaagcccccgagtggagaaggacttatcaaggtaatccttgtggcgtctaccctgacttatcttccttcattggaagtggcgtctacccagacttatcttccttcaccggaagtggcgtctaccctgacttatcttccttcaccggaagtggcgtcatccaaaccttcgtagcctgtatcaaacgatccgccccgtaa

SEQ ID NO: 68015 - DNA, 882 bp, Glycine max
  Peptide Sequence Number=SeqID_159700
actacatgtcctccccttcagagggctacatgccctcgccttcgtagggctacatgccctcaccttcagaggactacacgtcctcgccttcagagggctacactccctcgccttcagacgactacacgtcctcgccttcagagggctgcacgctctcgccttcatagggctgcacgccctcaccttcatagaactccacatctgcgccttcagagaactcaagttcctgggctaccccctgatattggagggcgaccaactgtgcaagcacaaccagagagggaggctatcgtgcagctactatgcataccggggcaagatttcacccagccgctgcaaggagacgagtgtggatcatgcacaccaccatatctccaatctccccctgccgaaggattgcacccacaagacacccagtggacccagagaagtccaatagggccctggggtttccagctctggttatgggcctttgtcagtcctaccgggtgcccgccccccccagcaaggtcacaccatcgtgacatagggatcgcacccgcaagacacccaacggactcggagaagtccaacagggtcctggggtttctagctctgattacgggcctttttcagttttacggagtgcctatcgcccccaacaaggtcatcaggccccctattaaccgggctttcatcaagaagtactgcgccccccaggcaggcgcagggcgagacaccacaacagcctggggatggtcggcagcgggtaatagacgcactgccgccacctccagagcccctcagctcatctacataggctggagcattgcctacaacccgtggctgaccagcaggcgaccaagtccaaagccaaaggtaagcaaagtactaggtccgtga

SEQ ID NO: 68016 - DNA, 594 bp, Glycine max
  Peptide Sequence Number=SeqID_159701
atgattatgaggggccaagacatttatagtagccaagataaggctactacttcaccttcctctagtgaaagtgaaaaagcaaaaggggaagaatctagtgaagaaatctacccccaagaagaaagacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgcgagcattgccacacttcttgggcttcagtttattcctcaatcccaaaataggtttggtattattaggcaccaagtccctaaaataggtggtatgatgaatgttttgagtggtgcaaccctcttttgtaaaatcactcgtgcacctaacatcttcatggtgtgtgtacatagggacccattaggactaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 68017 - DNA, 1354 bp, Glycine max
  Peptide Sequence Number=SeqID_159702
gatcccccagcaggatccagtagccgcgatgcaggccggtaagctgaatgaaggcgtaccccacgcacagcaccagcgacatgcgcaccgcgtggcggaacaacgccgaggtcggactcagatggcgactgaggcgcagccggatatccgcccagccactcaagccttcacgcgacagatggtgatcgctctgcgtcagcgaacagcggacgaatgtgcgtcgcctgcggatcgttatgttgcaggcgctggagggcggtctccagccgttcaaagctacgcgcaaagtgactatcgtggtgccacggctggcgcagcacgatattctctgccagctggcgacaggcctgcgcctgcatgttcagcagccgctgaaagcgaaacagcacctcgttgtagcgccagtcatcgcgcaacaggtgatattgcagatgcgacgagctggcgcgctcgtgaatatcctgcgccacaaaatagtaatgcaggctgcgccgcgtgctgcgcgagccgcggtcgccgcgttgagctgcgccaccagctgactattgaccatcgcggtggcgatcagcgccgcgtcatcctgctcaccgccgtcgggatcaaacagattggccttggcttccagatagcgcgccagctgggaaaagctggcggccagctgctcctgcaccgggcgcaccggaaacatcaggtggccgataaaggtcagcaggttgtaccacagcgcgccaatcagcagcagcgccggctgcatccaccactgcggaaacaggccaatgcccagcatggtgtacaccgcgatcagcagggcaccaaacgcaatggtggccagctcgaccgagaccgaggcaatgcagaagcacaccagcgtgatgagcaggttgcgcacgcggccggtccagcgatcgtcaagatcggccagcgccgccgccacgacgccgagcggaacggcggcacagccggccagcgcgaagaagatgcgcagcaggtagcgcaggctgctgttgaacagataacggcgccagccgggcaaagccgcgatagcggcgattttaaagtgggcaatgccggtcggaataccgatgatgctcagacactgcaggatgccggtcgagatgtgcatcaggcacagccaccagccaaagaaaatcagccagaacaggttgaggaaggtgccgccggcgttcagcacgtggcttttgctctccgggcgcagcacgtctacgtgaaccgcttcattgccaaacggcagcagggacagtttggtgatctcccagcaggagcgggtcagcggcagggtaaagatcagcacgatgctgatcagcgtggccagcagccagccgagagtggtgat

SEQ ID NO: 68018 - DNA, 927 bp, Glycine max
  Peptide Sequence Number=SeqID_159703
tggcgcgactggctggcgcagcgcgacgggctggacagctatcgcctgattgccggcgagtccgatggactgccgggcgtcacgattgatcgcttcggtaacttcctcgttctgcaactgctgtcggccggggcggagtatcagcgcccggctctcgtctcggcgctgcagcagtgctatcccgactgcgccatctacgaccgctctgacgtggcagtgcgcaagaaagagggcctggagctggcgcagggtccggtaagcggtgaactgccgcctgcgctgctgccgattaccgagcacggtatgcagctgctggtagatattcagggcggtcacaaaaccggttattacctcgatcagcgcgacagccgttttgccacccgtcgttacgcagaaaatgcccgggtgcttaactgcttttcctacaccggcggctttgcggtctctgctctgctcggcggctgccgggaagtgatcagcgtggatacctcgcaggacgcccttgacgtagcaaaacagaacgtggcgcttaacgggctggatgtctcacgcgcgcagttcctgcgtgacgatgtgttcaaactgctgcgtcgctatcgcgacagcggcgagaagttcgacatgatcgtcatggatccgccgaaattcgttgagaataaaaaccagctgatgggtgcctgccgcggctataaagacatcaacatgctggcgatgcagttgctgaatccgggcggcattctgctgaccttctcctgttccgggctgatggccaccgagctgttccagaaaattatcgccgatgccgctgttgatgccggtcgtgatgtacaatttatagagcagttccgtcaggcagccgaccatccggtgatcgccagctatcctgaagggctttatctgaaaggctttgcctgtcgcgtactgtga

SEQ ID NO: 68019 - DNA, 924 bp, Glycine max
  Peptide Sequence Number=SeqID_159704
atgaccgttcgattgattctcgctaagggacgtgaaaaatccctgctccgccgccatccgtgggtgttctccggggccgttgcccgtatggaaggtaaagcccagtcgggtgaaaccattgatatctgtgacagcaacggcaaatggctggcccgcgccgcctactctcctcagtcacaaattcgcgcgcgcgtctggagctggcaacaggatgagtcaatcgacatcgccttctttgtgcgcacgctgcaaaaagcccagcagtggcgcgactggctggcacagcgcgacgggctggacagctatcgtttgattgccggcgagtccgatggactgccgggcgtcacgattgatcgcttcggtaacttcctcgtgctgcaactgctgtcggccggggcggagtatcagcgtccggctctcgtctcggcgctgcagcagtgctatcccgactgtgccatctacgaccgctctgacgtggcagtgcgcaagaaagagggactggagctggcgcagggtccggtaagcggtgaactgccgcctgcgctgctgccaataaccgagcacggcatgcagctgctggtggatattcagggcggtcacaagaccggttattacctcgatcagcgtgacagccgttttgccacccgtcgttacgcggaaaatgcccgcgtgcttaactgcttctcctacaccggcggctttgcggtctctgctctgctcggcggctgccgggaagtgatcagcgtggatacctcgcaggatgcgcttgacgtggcaaaacagaacgtggcgcttaacgggctggatgtctcacgcgcgcagttcctgcgtgacgatgtgttcaaactgctgcgtcgctaccgcgacagcggcgagaagttcgacatgatcgttatggatccgccgaaaattcgtcgaaaataa

SEQ ID NO: 68020 - DNA, 929 bp, Glycine max
  Peptide Sequence Number=SeqID_159705
atgagcgataacgggctgattgccccggacgaaaccctgccgcttgggcagacgttcgtgctgggcctgcagcatgcggtagcaatgtttggcgcaacggtgctgatgccgctgctgatggggctggaccccaatctggcgattctggtttccggtatcggcaccctgctgttctttgtcattaccggtggtcgcgtgccgagttatctcggttcgagcgccgcgtttgtcggcgtggtgatcgccattaccggcttcaacggtcaggggctcaatcccaacctggcgctggcgctgggcggcgttattgcctgcggcgcgctctacacgctgattggcctggtggtgatgaaagtgggtaccggctggattgaacgcctgatgccaccggtggtaaccggtgcggtagtgatggccatcggccttaacctggcaccgattgcggtgcacagcgtctccgcctcgatgtttgatagctggatggcggtgatgacggtgctgtgcatcgggctggtggcggtgttcacccgcggcatggtgcagcggctgctgattctggtcggactgattgtcgcctgggcgctgtacgctctgctgaccaatgtgatgggcttcggcaagccggtagatttcagccgcgtggccagcgccgcgtggtttggtctgccgcacaccaccgcgccggtatttgatatgcaggcaatcgtgatgatcgcaccggtggcgattattctggtggcggagaacctcggccatattaaagcggtggcgggcatgaccgggcgcaatctcgatccgtggatgggacgcgcgttcgtcggcgacggcctggcaaccatgctgtccggctccatcggcggcagcggcgtcaccacctatgccgaaaacattggcgtgatggcggtgaccaaagtctactccacgctggc

SEQ ID NO: 68021 - DNA, 313 bp, Glycine max
  Peptide Sequence Number=SeqID_159706
atgactagaggcaatccatctgacttacaaccctttgatcctgagatagataggacatttcatagattagttagacatcatttagtaccttttgagcatcctgagcatgctgttattggtgattttgaacattattgttttgaacattctgagaacattgcacaacctccaccccgtgagaggactctaagggaaatggttgcacctgatttcacctatgaaagcttatgcatccaataccctgatgaggatgtcccatatgttcttaaaactggactaatccatttgcttccaaagtttcatggccttgcag

SEQ ID NO: 68022 - DNA, 430 bp, Glycine max
  Peptide Sequence Number=SeqID_159707
atgggaggaactaaaaggcttttagtgataattcccaaggtggtcatatctctcttgatggtttctagaggtatcatccccttcaaaaaacatattgcggtagtagggactaccagcaacaatatgttatcaaagagaaaaactctagatgagggttcactgttatcaagcaagtcgaagacccaacatgaccacagattcacctccactccttatgttcccatggacccggtggagtcgccaactgtcgcaacctacccttcggcgggagggcgacgcgagggctcacgggtgcgtcttccaagaatggaaaatgcgcggagtcaccaccaacgtttattcgaggaaaacgtcggaaaaaccggaaaaggatgtggtctacaaactttaagtgtgaaaggttcgggagttgtatttacgcacgatgaag
